United States Patent 6,812,339 (POLYMORPHISMS IN KNOWN GENES ASSOCIATED WITH HUMAN DISEASE, METHODS OF DETECTION AND USES THEREOF) - sequence listing, part 99

SEQ ID NO: 126190 - DNA, 601 bp, Human
aatgtatcttcttaaaagttgcttataatatggtttgaaaattgataatgtacataactatacattcacatgtaaaatatatataaacaaatatacgtataagatatataaataaaaatatgtataaaaagagatgcttcaaattcgtaagtaagtatggaatgagtggttgaaacagacaataaatgctgtagaaatcccaaggagagagagattgtcagggcccaagagtgtcaggaagagatgagaaatatggggctctgtctaggccttcagaggtgtggggatacctttcagatasctggttaggtacaaggacccaaattaccagcagaggcacatatcctgatgttagaatttaatttgaaatagccaagtcacatacatatatgtttgtatatttcatttaaattatccagagcagtgcctcttttgtcatgtcttgatgaaattatctggaatttataaagaggaattttatgagctgctactaaggatcaaatgggaagggaaagaagaaaaaaaaaatgccaaaatgatgttcctgaaatggaacagaattaggtttggcagttggaacagagaattaatttaagggtct

SEQ ID NO: 126191 - DNA, 601 bp, Human
atatatggaattgatatttttctctcctctagttattcttagtataagttagttctgagagatccactatgagttatcaatcacaaagggtatattgtaatttccctttctttctttccttttatcttttaaggtatgttattcagtcattttttttttttctttgtggataggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatac

SEQ ID NO: 126192 - DNA, 601 bp, Human
ccaaagtgttgggattacagggttgacccactgtgcctggcccccctcaatactgttatctaaacatagaaataactgaaatatattttagtcattaaaaaaccctttgggcttacactttgagttacattgaacttctttttacattgtggacaggaaagatagtaagcaaaagtttcctcaatttttaaaaggacgacggtagaaagaacacattgcaatctatagatgatccatggcagctatcttcaaatgctgaaagcttgctcatgtagcaggagtctgtgctgttttagaaaacgaaaaagtattaaaacagtgatggtggggatgtaatttttttacatttaactcccaaggaatgtattaatataaataagttgtacagaattatgctaaggaatagcttggttaaagcaactaatattttgaaagatgccctttaagattatttatggtaatttgcttttcaaatctagaagctttagactttttaagaatatagttcaaagtaggtgatgctggaacttgttaacatttctttttcctactagagtcagctgcttcaattcactcagacttacctgcataattataacct

SEQ ID NO: 126193 - DNA, 601 bp, Human
gggtttcaccgtattggccaggctggtctcgaactcctgaccttgtgatccgcctgcctcagcctcccgaagtgctggaattacaggcgtgagccactgtgcctggccaccttttttatttatttatttttttgagacggagtctcactctgttgtccaggctggagtgcagtggcagtggcatgatcttggctcactgcaacctccacctcctgcctcagcctcccgagtagctgggactacaagcatatgccaccatgcctggctaatttttgtattttttttttttcagtagagttagggtttcaccatgttggccaggctggtctccagctcttgaccttgtgatccacccgcctcagcctcccgaagtgctagcattacaggcgtgagccatcacacccagcattttttttttttttttttaagacagtcttactctgtttcccgggctggaatgcagtgacacaatctcgactcagtgtagtctccacctcctgggttcaagtgattctcgtgcctcagcctcctgagtagctgggattacaggttcatgccaccacgcccagctaatttttgtatttttagtagagacgagatt

SEQ ID NO: 126194 - DNA, 601 bp, Human
accttttttatttatttatttttttgagacggagtctcactctgttgtccaggctggagtgcagtggcagtggcatgatcttggctcactgcaacctccacctcctgcctcagcctcccgagtagctgggactacaagcatatgccaccatgcctggctaatttttgtattttttttttttcagtagagttagggtttcaccatgttggccaggctggtctccagctcttgaccttgtgatccacccgcctcagcctcccgaagtgctagcattacaggcgtgagccatcacacccagcattttttttttttttttttaagacagtcttactctgtttcccgggctggaatgcagtgacacaatctcgactcagtgtagtctccacctcctgggttcaagtgattctcgtgcctcagcctcctgagtagctgggattacaggttcatgccaccacgcccagctaatttttgtatttttagtagagacgagattttgtcatgttgaccaagatggtcttgaactcctgacctcaagtgatctgcctgccttggcctcccaaagtgttgggattacaggtgtgagccatggcgtcgggacctg

SEQ ID NO: 126195 - DNA, 601 bp, Human
gtttggatgaattctaaatttgttattgtgtagaaaattggaggttttctactctaggatagcttgtcctactataggatagtataggttcataattaaggattgttattggtgagagtcctaacaatgtactgaagtctgtcaattttagtatcttttctgttgcgtggaattcttattgttttcattaaacaaactatatgttcattgcacagtagttaagtgtataaaacaaagcaaaaggaacacagctctggctataattttaccactcaggtaccattcttacctttttcattgkttatctttttatatttattttcatcgctacacaaacattttttaggagtttgattctacctccattttggttagatatacaaactctaccccatgagggatgtatggtgtatttctagatttagcaacaattttcttgaaaaatgtacaatactatagaaaaatgaagatagtaaataccaggtataagttaataacagtgtttcttttgttcagtaataatgaactgtgtactagcactgaactttaggccctcctatttgcgtattttctgtttgtatatttttaaatagaggaattg

SEQ ID NO: 126196 - DNA, 601 bp, Human
ccttcatcattcttcccaggtctccttccccatttttccctttagtataggtttcatatgtccctattttggttttctgtgtcttggttcatcctagtgaggcttgagaagggggaaaaggtggaaaggaaagcactactatggcttttgagaagactagccttcctctattcccaacctcatgttagatacacgggagagggagaggaataattgagtttggctgatgctttcctttcagcctttccaggaaagaaaaaaaggaatgtgggaaaaatacattcatacttagctttatctrtttttctccaccagcatcatcttattcataaaaacaaattaggcactcttttcagtaagatggaataactttctgagactggcagcggattatttgggacaaaggggcccttgtgggtttttggcatttccttgtgagtcattagtagatactcagagttagaactttgggtcatttgcccatagaggagctagatcgagataagatttttattgttgctgtggttgggtttcttttttaattggcctaggcctttacatttctgtataatttctaaattcattaaatttttacttttta

SEQ ID NO: 126197 - DNA, 601 bp, Human
ggtaaaaccaccattgagtttggccatgttataaaccagagaataaaaggatgaactaatcatttactttatttactaacaggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacaggtacgaaatccagtgtcacctcattggctccttgctttccagcacagttattgacagtgttaggacartttagacttcagagtggtggtgtccaagagtttctgttttagtagtagaccatatgaatttttcatttcagatcatgagttaaattgagtctgtacttgtatatgtgaattatgtgcaatttttggaggctttatagccattttccttttgtcactgaacttacataatatccctgttgcattgtataatttatatggaattaaatttgttacttgaattaccataaagtgtacttttttttttttttttgagatggggtctcactctgtcacccaggctggagcgcagtgccgtgatct

SEQ ID NO: 126198 - DNA, 601 bp, Human
tccttgtgaagataagaaaattatttcttttcttgtcctaaattttaggaggatatgatggttaccgcccttcattctctaacactccaaacagtggttatacacagtctcagttcagtgctccccgggattactctggctatcaacgggtaggtaaagtagttctaaagtgtaaacctgaactaaatataccaatgaaagtgacttagtgttgttgcttaatgaacctaagtaactaatttggcgttaactttgtggtgtccaagacactctgttgaaacaaaagcttttagcactcaasatcagtactcctttagtaaagcctgttaaagacagtgatttccaagagcagagaaatatatttcactgaatgttctttgagaatagtagaagtacaacaattacagaacaaggtgtagctgtgataaactgatactgaagtgtctaaaagattaaggaagaattctgtattgagtgttagactgaaagaatagatgggtaagcattttttaaaaagtaccttttcaatactaactagcttgtcttttaggatggatatcagcagaatttcaagcgaggctctgggcagagtggaccacgg

SEQ ID NO: 126199 - DNA, 601 bp, Human
gttcctcctttgagctctgcctcaagagggaaaagcctggaaacctggctttctggggtccacacccataatgtcctagtcagacagtcacaccctaatacagtactgggtggtaattcctcccatgcaggatccggggatggccccagctgggccctcctgacattggagcaggggcccggctcacctggatttggggtgcggggcggctgaggctcacgcccagagccttctttagcaggaggattccgagcagatcatgactcagctgcagtcgctggtccctcagggaggtgtgggkagctgtccccaatggggatgggctggaaggctccagactcttcttgcccatgaagtgacctggaaaggaggtgtccaggcacaaggaagtcaagcagccaggatcctacctcagaggaaaagttcctcatctctcccacgtttccgttcttgtagcgggaagacacttaaccttcctcctcttggtgcttccacctcaccaaggagccacaaaggtgtctgggtggtggcaaagcctgctccctcagcttttcctgaacaggtagagaggatggcacagctggcaggaaggtgggatggt

SEQ ID NO: 126200 - DNA, 601 bp, Human
gagctccagtccaggtgaacaaggtccagactctgtcttggctgctgacttctctttccctctctgggcctcagggtcccattccggccacaagcatacacaggacacagcaaaggtggacttgactaatgcagcagggaacagcatgggtgggacaagactgtgtagactgggggagaaaggtcctgctccaaaaggctgatgatcccagtctgttactttagactgggtgatgagtcaggggaacttctttccctacttcttgccccatggggtctactgggaaggtcagcttcctttstttggactgttcctcctttgagctctgcctcaagagggaaaagcctggaaacctggctttctggggtccacacccataatgtcctagtcagacagtcacaccctaatacagtactgggtggtaattcctcccatgcaggatccggggatggccccagctgggccctcctgacattggagcaggggcccggctcacctggatttggggtgcggggcggctgaggctcacgcccagagccttctttagcaggaggattccgagcagatcatgactcagctgcagtcgctggtccctcaggga

SEQ ID NO: 126201 - DNA, 601 bp, Human
ccccattattggtgtcatttctgcagtatttgtaccagcagcctcctgtactgaagagaaacatacagaagaattgagccagggaggggctcctgataaagataggggcatcctgccattcctaagtgccagatgtctgcagaggtgggcaccagcaggctgtcagctgaggcaggccccagagcaccctgaattgccttggaggggtcggggcagtagttttctcagaacacagccccaaccacccagggtggtcatgacagtcaaagaagatcgtggaagaaaatccaaatacagtgcytggtgctgggctagtgtcagcgtcctcactcccccaccccagctctgccccagacctcactctgaagccccagacgtaggcactgctgcttctgagattctctagttggtctgcatgtgtcagagcttcaaaaccaagggcattagaggtgacattgtttcccttcagactcagccagcccaagctcctaggccttacatctgaggtcctcaggggctgctggttctgtgcctcaggaagtcagggatgttggttgaggctgggttggaccttttctagggaatgcctctcccttcaaaa

SEQ ID NO: 126202 - DNA, 601 bp, Human
tctctctgagcttatcttctgctaccctccccccttgctcattccactccagactccactgtgttctgcaaccaaaggaagtgggctccagcctcagggcctttgcactgctgttccttctccctgggatgtgctccctccagatgaacgcctggttctttcatctcatcagtggggacgtctctggttacgtctatacaatggtaacctcaccttgccctggcactctctccctcttgctctactttatttttctgcaaagcccgactcagcacatatttttttatggcccatctccccygctgggatgttagcttcaaaaacgcagggattttgttctgttttgtgcactgttgccattttttgtacccagaacaaagcttagcccatagtaagtgctcagtaaacatatgctgaatgaatacatgagttatatactaacaaacattcatgttttcgtcaggaagaggataaacggttaaagaacagctccaagacagacaaacacacattttaacaaagaagccagacacatactaaactattagtgtacagcatctggaagagacatctgtgaccttcatggagcttgtgtaatcac

SEQ ID NO: 126203 - DNA, 601 bp, Human
gatcccccaccccttacccctgttatctctctgagcttatcttctgctaccctccccccttgctcattccactccagactccactgtgttctgcaaccaaaggaagtgggctccagcctcagggcctttgcactgctgttccttctccctgggatgtgctccctccagatgaacgcctggttctttcatctcatcagtggggacgtctctggttacgtctatacaatggtaacctcaccttgccctggcactctctccctcttgctctactttatttttctgcaaagcccgactcagcacrtatttttttatggcccatctcccctgctgggatgttagcttcaaaaacgcagggattttgttctgttttgtgcactgttgccattttttgtacccagaacaaagcttagcccatagtaagtgctcagtaaacatatgctgaatgaatacatgagttatatactaacaaacattcatgttttcgtcaggaagaggataaacggttaaagaacagctccaagacagacaaacacacattttaacaaagaagccagacacatactaaactattagtgtacagcatctggaagagacatctgtg

SEQ ID NO: 126204 - DNA, 601 bp, Human
ccccacacagccaccatgtccaatggtcatcatctccgccctggactgccacaccagtctttcagccccttccctcctattgtcaactgtggacagagccccagtgctttccacctcatgtaggaaaaaaagccagtgccctcagaatgatctacaaggctccatgcgatcccccaccccttacccctgttatctctctgagcttatcttctgctaccctccccccttgctcattccactccagactccactgtgttctgcaaccaaaggaagtgggctccagcctcagggcctttgcacygctgttccttctccctgggatgtgctccctccagatgaacgcctggttctttcatctcatcagtggggacgtctctggttacgtctatacaatggtaacctcaccttgccctggcactctctccctcttgctctactttatttttctgcaaagcccgactcagcacatatttttttatggcccatctcccctgctgggatgttagcttcaaaaacgcagggattttgttctgttttgtgcactgttgccattttttgtacccagaacaaagcttagcccatagtaagtgctcagtaaaca

SEQ ID NO: 126205 - DNA, 601 bp, Human
ttgtaaggcttgatatgatgctcactcggggtaggtgcttgctttctccccttttcacagagctgatcactcttcctcctgctgggattctcagacattcgctcttggcctcctcccgcctccctggctggtccttctcagactcctttagtgcctgctcctcacctctcctacccttaagcaccgttcgcagcttccatccacttgcttctcaggggatctcctccagtttcaagcttgaaatcccatctctatcctggtgacatccacatctgtatccccagcctggacccatcccctwacctcctgactcttctatctcgtaccattcctatactgctacacagatgaataacaggcctctcccccacaatatgcccacagcagaactgattacttctaccctgagacctgttcttcccacagtcttccccatctcaataaactgcaactctattttgctgcattgctcaggccaaaaatctgggattcaccttgaggcctcctgttctttcgcattccaaatcccatctatcagcaaaccctattgactccaccttcaaagtacttctgggctcagtttcctcttagccagccccac

SEQ ID NO: 126206 - DNA, 601 bp, Human
aatctttgcagcaactttgcaaagtgtagtagtcatcaccatctcccttgccaacgagcagaggcaccgagaggctccgtgccttgcaccatcagcagaaggacagtctgactgcctgactcaggtctgtttgttcctactacatctcctcctctgaagtgcataattcacatatacaggtatctattctgcataattcacccagttctcaagagaaattaaaatgtaataacaaaaaacacatttataataagaaaaggcctcctggcctggcccctgccctcaagaggtcatcttcackgcaccaggtcaccaccagggctcgctccctgggctgagagaagaacgactgatatccaagtcagcttccctgacatctgctcctggtcacaaggtgggctgggctaaagagtctgaatgagactgtgcaaacaattcctacacatagaaagacacaaagtgagggatactccaagttgcaaccaggccctccaacttctcaagttccatgggactcagctttgaaccaggctgctggaagcttggggtggcagccacgtgataagaacaatgacgttcataactaagaatttctgggtgc

SEQ ID NO: 126207 - DNA, 601 bp, Human
tgattttatattacatttaatatatattattaactacaatttactgaacatctacaaggagccagacattatgccaatgtgctttttatatatgatctctaatctttgcagcaactttgcaaagtgtagtagtcatcaccatctcccttgccaacgagcagaggcaccgagaggctccgtgccttgcaccatcagcagaaggacagtctgactgcctgactcaggtctgtttgttcctactacatctcctcctctgaagtgcataattcacatatacaggtatctattctgcataattcayccagttctcaagagaaattaaaatgtaataacaaaaaacacatttataataagaaaaggcctcctggcctggcccctgccctcaagaggtcatcttcacggcaccaggtcaccaccagggctcgctccctgggctgagagaagaacgactgatatccaagtcagcttccctgacatctgctcctggtcacaaggtgggctgggctaaagagtctgaatgagactgtgcaaacaattcctacacatagaaagacacaaagtgagggatactccaagttgcaaccaggccctccaacttctc

SEQ ID NO: 126208 - DNA, 601 bp, Human
agaaaagaatcacaataggtggggaaagaatgacccagaccacacattgcacattaccagatgtcaaaaagctagctgctccccttgtcggaattatttatgtatgattttatattacatttaatatatattattaactacaatttactgaacatctacaaggagccagacattatgccaatgtgctttttatatatgatctctaatctttgcagcaactttgcaaagtgtagtagtcatcaccatctcccttgccaacgagcagaggcaccgagaggctccgtgccttgcaccatcagcwgaaggacagtctgactgcctgactcaggtctgtttgttcctactacatctcctcctctgaagtgcataattcacatatacaggtatctattctgcataattcacccagttctcaagagaaattaaaatgtaataacaaaaaacacatttataataagaaaaggcctcctggcctggcccctgccctcaagaggtcatcttcacggcaccaggtcaccaccagggctcgctccctgggctgagagaagaacgactgatatccaagtcagcttccctgacatctgctcctggtcacaaggtg

SEQ ID NO: 126209 - DNA, 601 bp, Human
tcagattattcggtctgaagtgtgggaacatgaaacacgcccatttcctgaacatgccccctttcctgcccaacagcgcttgtacctcctgctccttctacccagggcaccatccatcagaaaagaatcacaataggtggggaaagaatgacccagaccacacattgcacattaccagatgtcaaaaagctagctgctccccttgtcggaattatttatgtatgattttatattacatttaatatatattattaactacaatttactgaacatctacaaggagccagacattatgccaatrtgctttttatatatgatctctaatctttgcagcaactttgcaaagtgtagtagtcatcaccatctcccttgccaacgagcagaggcaccgagaggctccgtgccttgcaccatcagcagaaggacagtctgactgcctgactcaggtctgtttgttcctactacatctcctcctctgaagtgcataattcacatatacaggtatctattctgcataattcacccagttctcaagagaaattaaaatgtaataacaaaaaacacatttataataagaaaaggcctcctggcctggcccctg

SEQ ID NO: 126210 - DNA, 601 bp, Human
caaataatgtacttgaaaataggtcacagtgaccagcattgggagaattagataactgtcaggccccacctgcagagacttctttggggcagcctcagattattcggtctgaagtgtgggaacatgaaacacgcccatttcctgaacatgccccctttcctgcccaacagcgcttgtacctcctgctccttctacccagggcaccatccatcagaaaagaatcacaataggtggggaaagaatgacccagaccacacattgcacattaccagatgtcaaaaagctagctgctccccttgtyggaattatttatgtatgattttatattacatttaatatatattattaactacaatttactgaacatctacaaggagccagacattatgccaatgtgctttttatatatgatctctaatctttgcagcaactttgcaaagtgtagtagtcatcaccatctcccttgccaacgagcagaggcaccgagaggctccgtgccttgcaccatcagcagaaggacagtctgactgcctgactcaggtctgtttgttcctactacatctcctcctctgaagtgcataattcacatatacaggtatct

SEQ ID NO: 126211 - DNA, 601 bp, Human
tagaacaggcaaaggtagctcctttttttgagtgcctgagagcaaataatgtacttgaaaataggtcacagtgaccagcattgggagaattagataactgtcaggccccacctgcagagacttctttggggcagcctcagattattcggtctgaagtgtgggaacatgaaacacgcccatttcctgaacatgccccctttcctgcccaacagcgcttgtacctcctgctccttctacccagggcaccatccatcagaaaagaatcacaataggtggggaaagaatgacccagaccacacaytgcacattaccagatgtcaaaaagctagctgctccccttgtcggaattatttatgtatgattttatattacatttaatatatattattaactacaatttactgaacatctacaaggagccagacattatgccaatgtgctttttatatatgatctctaatctttgcagcaactttgcaaagtgtagtagtcatcaccatctcccttgccaacgagcagaggcaccgagaggctccgtgccttgcaccatcagcagaaggacagtctgactgcctgactcaggtctgtttgttcctactac

SEQ ID NO: 126212 - DNA, 601 bp, Human
tggaacatcaggccgagagcagatcagggcagagggtggactatggtgtggcctgactggccaccgaactgggagttagctgcagcactgggattcactcctgagagataagcggtagtttggaagacttaatcttttatattggtgacattacctacttatggttcggttttccgtgaacgcgactatgctgttggaaagtatgaggtgtttgtgtttgtctatctccctgtctctcttgtccaccctggctctcacatcgggctaagtaaggccatcctccttccttttccttccttgwatacagaaatgtgggttccctcgctctgagctgcctactctcacccttccccttctttcccacagctggggcggatcctagagggctgatctggaagcatctctgctgactcagaagtcagacagggagaagtcggctcactcatgactcctggacacccggaactacaggtaccagatgtcacaggcactgacgattggaggggagaaacaggctgtgatacactaacacctaatgttcgactgaaatgaaaagatcacaccaaccttttaactgcttcctgatggctttgcttgcttc

SEQ ID NO: 126213 - DNA, 601 bp, Human
ttggggatgcagagagaaatataacaagggtcctaacctcaaggaacttgcagttctgagagggaactaaaggcaactaacacagatgaggacaagagcattcagaaccccaacacgggtgatggtaaatctaagagaatgtcgagggagccacccacagtttctaggagaggaaatgagatctgagcagccttgaaaaaaggcaggatttcgacagagggaagtgggagggaaaagcattcccagcagatggaacagactgaggggaggcactgggaggccctgcagatcagccaggttkgtctggggcatgagtggcataaaggggaacaatgctggcaatgttggaacatcaggccgagagcagatcagggcagagggtggactatggtgtggcctgactggccaccgaactgggagttagctgcagcactgggattcactcctgagagataagcggtagtttggaagacttaatcttttatattggtgacattacctacttatggttcggttttccgtgaacgcgactatgctgttggaaagtatgaggtgtttgtgtttgtctatctccctgtctctcttgtccaccctggctctc

SEQ ID NO: 126214 - DNA, 601 bp, Human
cctcctctacctgagatcatcctgagctctaccctccctgctctttagtgctttctttcttcatctgcagcgtgtgttcaaagaatccctaacgggggtgtgcccctgagtacacctgtccacatgtctaggtaccagcggatggcgctatgacaatctgcacatcaggggagaacaatgtcctcctgctgccttgggatgcttgttcacctcccctccccctcttctaaaacttttcatctctgcgctgcaggcatagcctctttttctttctggctgtcccctatcgtgtgcttactaytatcatagaatgtcgaaccctctgggctgtctgcacacttggctgtgggctccttgaggggagagtccaaatttgatctggactggattcccagggcttagcccagcaccttgccacagtctgagctcaggatacgttcaccgaaagcaggagttaatgagagaatgaatgacaacacctattcatgccttgtgtggactcattcctggggacttggatgaggcaggtatttgtctgcaagtggccctgaggctcccacaggtacttctgaacgcagaggatgcagctcatgggagggaa

SEQ ID NO: 126215 - DNA, 601 bp, Human
tccaagccctgaggggtaaacaactcctatcacagccctctttcccttatctggttcacatatttcctgtacttgctgattcactgagaagacaagctgaatccagcctgctctcctttctaactcttgcaaactggggatctgatagaaaattcttataacaaagctggcctggtgactcatgcctataatcccagcaccttgggaggctgaggcaggcagatcacttgaggtcaggagtttgagaccagcctggacgacatggaaaccccatctccgttaaaaaaaaaaaaaaaaaaaattagccaggcatggtggtacctgcctgtaatcctagctactcgggaggctgaggtgggaggatcgcttgaacctgggaggcggaggttgcagtgagccaagctcgcacctctgcgctccagccagggtgaagagagagactccgtctcaaaacaaaaaaaaagaaagaaaattcttataacaagagatgtcttgttatcttcaagagccttgattttagctcttcagagacatcatgctatttgacctgtggatgactattttacaaatttgtcttctacatcctgcctacattggtaga

SEQ ID NO: 126216 - DNA, 601 bp, Human
tcaatccttagcctctctcagccaagactgaggtataataaaaacagatgtccaaagcctaatgctgtacaggatgctttgcacatccactctgtttagatttgatattgttaccagaaataaacactcattagattaaaaccaggaattttgctagtctaacaggaaaagaaaaatgtaaaattctcattaccttccttcgcaaatatccatcttcagttgtaagaaatacaagtgcctatgaaacaattgttttcattaattcatactcaaactgaaataagcaaaaaaaaaaaaaaaagaaagtttgatgagtcaaagacaagagctgtacatgtgaaagatacataaaaatacggttttggtccaaggtatcaggtgctaccttacgctctgcaaagctgccctgtcattactgatggctcatgttgatgccctacgtcttgactggtgggggcaattttctgccagcacaggctgtcctatgaagagctgagcagggatgaatggggtggaaacagcccaccaaagatgggctggtactatgggttccgctgtcagtgagcgcccctgcccttgaggaccagaacccacaggggct

SEQ ID NO: 126217 - DNA, 601 bp, Human
tccacacactgatcagaacaacctgtccatccgtgaaatgctccctttgtgacttacattgtacggcataggacgctagaaccactgctgagttaagagggcaggttaacctgtcaggagaaaaacatattagcaaagtcacaagaaccaacaacagccttaaacattgacagatcatgcgtagtaacacatgtctttctttgctttgatcaaccattacaaaacaacatgaattgtaacaaaagcaactttatgctgcacataaacagtaaaggcaaatgtaatacactaaaattttttwaaaataaaaccttttcatgtttaaaataatatccatcacaaataccatgaaactaaaggactaatgctggccagtgttttggctgctcaagaagggtcaggctcttatctctaagaggggaaaaaaaagtaaaaaaattgtactctgagatcaatgggcagcctttaaatctttctagtaaagacctgagactcatcatagggctctctaactaaattcctgagttctaatgaccctttggttctagattaccctctttctaaaatagtaacatcctcttaggagggacaagtagaaagg

SEQ ID NO: 126218 - DNA, 601 bp, Human
caccacaaagctagctactataaagtgacattttgctctcatctggctatacgttcttttcattgtgcctacccagcatctacccacaggacttggaagggaatataccctcgataaagttttgctgattgaatgagcggattcctactccagtttaaaccagccttcaagaaaattccatctggactttctatccaatatggtagccactagcgacgtgcggttagtccaaattgagatgtaccgtcagtgtaaaatccagactgattttcaaagacttagtataaaaaaaatgtaaaayatcttgctaataactttgtacattaagttaaaatgctaatattttcaatatattgcattaaataaaacataaaaaacctcctgtttcgttttaccttttttaatgagtgtactagaaaacttaagttacatatatgattcacattatatttctattgaatagcactggtatagatcaatatacaatccattagctatactgcaactctgaaaagaaattcctaagatcccagtagtgttttagagtagcaccaaccaagcagcaggggtgactcctagcaaatttcttaacctagctggg

SEQ ID NO: 126219 - DNA, 601 bp, Human
atgcaggtatcgatggagagactaactctggtactcgtcttactcgtgaatagggtcatctttgatgtcccctgccctccacctcctggttccatgcaggtgggtgggtaagctgcaggcccagccaccttgctcttcacctccttcatttctgttctttcctggtagggaaataggcagacctagggccacctcaggagtccgtcagccttctcttgctattttgcctgttctgagaccagagcagggtgtgtagttcagccagtgcctgctctcagacctgatcatcttgctgccttawctatctatcacacagtaggtcaacagggtaataggccaagatggtttgggcttctggtagaggagatttcttaggtctggagctgcaaatggctctacctgagtactatgctgatgaactgtactgccaccacaaagctagctactataaagtgacattttgctctcatctggctatacgttcttttcattgtgcctacccagcatctacccacaggacttggaagggaatataccctcgataaagttttgctgattgaatgagcggattcctactccagtttaaaccagccttcaagaa

SEQ ID NO: 126220 - DNA, 601 bp, Human
tatggatgtgaaatggccgggcctgtcccaggtatattgtagggagaagggaaggttcaaatccacccaggcccattcgcctgttttgagtttcccactaaggaggaggcgatgcaggtatcgatggagagactaactctggtactcgtcttactcgtgaatagggtcatctttgatgtcccctgccctccacctcctggttccatgcaggtgggtgggtaagctgcaggcccagccaccttgctcttcacctccttcatttctgttctttcctggtagggaaataggcagacctagggcyacctcaggagtccgtcagccttctcttgctattttgcctgttctgagaccagagcagggtgtgtagttcagccagtgcctgctctcagacctgatcatcttgctgccttatctatctatcacacagtaggtcaacagggtaataggccaagatggtttgggcttctggtagaggagatttcttaggtctggagctgcaaatggctctacctgagtactatgctgatgaactgtactgccaccacaaagctagctactataaagtgacattttgctctcatctggctatacgttcttttca

SEQ ID NO: 126221 - DNA, 601 bp, Human
gggtcctactataatacccaggctggtctcagactctggggttcaagggatcctcccgtctcagcctcccaaaatactgggattacatgcgtgagccaccacacctggccagggatgccaggatttaaattgaatatgcctatattctagttagtgttcctgcctcataaacctgaagctcaggctgtgaacaccaaacttgctctgagacatggggaggctcagtctcctcagctgattggcctggcagacacagagttcacaaggtctacagatcataagaatacaaactggtgaccaygccacttcccatatggatgtgaaatggccgggcctgtcccaggtatattgtagggagaagggaaggttcaaatccacccaggcccattcgcctgttttgagtttcccactaaggaggaggcgatgcaggtatcgatggagagactaactctggtactcgtcttactcgtgaatagggtcatctttgatgtcccctgccctccacctcctggttccatgcaggtgggtgggtaagctgcaggcccagccaccttgctcttcacctccttcatttctgttctttcctggtagggaaataggc

SEQ ID NO: 126222 - DNA, 601 bp, Human
ctctccctaagcaggatgaagtgcacccctggtggccatctccactgctagtatcatccacatctgcctccctacaggctgtagactccttggggagagcagtgtgttttatccatctgtgcaccctgaggctggtacagacctctatgtggcacaggtgcagggaacattctggaataaacatatattccaaaaaatatactttattctttgagcctcataaagccttggcaggccattaacaattttccatcattgtatatttttgggtactttacctgaagatcacttttttttttttaagagatggggttgctctgttgctcaggctggtgtgcagtggcatgatcatggctcactgcagtctctaattcctggggtcaagcaatccttccacctcagcatctcaagtagctgggattacaggtgcaaaccactatgccggactttattttttatgtaataagaaaatgtgcttttggttagctggtcacagtgaggacttatatcagatgcccctcttggaagaatttagcaaaatatatcataaaatgtaggtgtaccttttgatccagtaatttcatatacaataattaatttt

SEQ ID NO: 126223 - DNA, 601 bp, Human
gtgatataggcaatgctttttatccccactaaacacataaggaaacagacccaaaggggtctgccactgttgctcagctgctaatttggaggctagactctgaccatagtccctgctcttacctacttactatactatatgctccaaactcctaagtaatccattttcctatctgtgagaaagcaacacatgcaaaagctaattatagcaaacaaaaaaggaagtgcttatgtgggaaataccttgtcattttaagttccatgctttcttctggttgataatattttatgttttgcagcawagagagggtatatcccaggttccaaagtacagcatttcaagctgcccggctgttgtacttggaaagacttttacctgctattcattcaactccaacctgatcttagaggcggttctcaggggtcattcctaggacgttttcccagatgctctcccctctccctaagcaggatgaagtgcacccctggtggccatctccactgctagtatcatccacatctgcctccctacaggctgtagactccttggggagagcagtgtgttttatccatctgtgcaccctgaggctggtacagacctc

SEQ ID NO: 126224 - DNA, 601 bp, Human
aacacaaccaatgagcctccctgtggggtggttttccctttaaatcctaagcggccactctgtgcaaagctctgtgctaaccactagggggaaacaaagttaaacagtgataaacatttgcaaaacactgggcggtttcacatcgatttcaatgatgtcatcccacttgttactcatggtaaccctgtgatataggcaatgctttttatccccactaaacacataaggaaacagacccaaaggggtctgccactgttgctcagctgctaatttggaggctagactctgaccatagtccctrctcttacctacttactatactatatgctccaaactcctaagtaatccattttcctatctgtgagaaagcaacacatgcaaaagctaattatagcaaacaaaaaaggaagtgcttatgtgggaaataccttgtcattttaagttccatgctttcttctggttgataatattttatgttttgcagcaaagagagggtatatcccaggttccaaagtacagcatttcaagctgcccggctgttgtacttggaaagacttttacctgctattcattcaactccaacctgatcttagaggcggtt

SEQ ID NO: 126225 - DNA, 601 bp, Human
ataacaagaatacataccctaccactgtgcagttctactccatagaagtcgagggtccgcgctatgttgatatagcaggattctgcttctgattgttttagcccactacggaagaaaagacaaaaagcagagttcatccaataaagagagggcattaactccaattttaaaaaatctagaacatttgataccatttctgtaaggttattaaatgccttatgttatcaatcttcagcaatctaatgctaaattctactaaagcaagtttttattcttatccattgaatgtgactccctctagaccctcttgtttttaaattaaataatacttcccctttagtgggctcacaatattcagacggagaagactgttacctttcagaatccctgccctaattattccaagttgctaattagtagggaatctttaggtctctctgcctttatctcttcttttggcagtggcctcaaactttcaaacgccactggccccgtactattttaggagattgacttctgccctgggagtaattctgggagagaggtttggcaatgccttcttagaaaggacacttggttgcctggcctttgtttttatggc

SEQ ID NO: 126226 - DNA, 601 bp, Human
tcacctgaaaaatgaatttatacctattttttgccttttaaaaccataatataaaatggtcttacaaaaattactagtttctagtcccctaacccttcaaaagggaaaagtcttcaagtacaaaagcaaacattaaaaaaaagcaattggacaaatgaccaacaaaaaattcagcattacttaataaaccttccaaatatcttttaaaaagtcctgttataatgaaaaagaaatagtttcatcaaagaatttttcaaactctcagagattaaaataaaaacataatgtttgagccaagacrtaacaagaatacataccctaccactgtgcagttctactccatagaagtcgagggtccgcgctatgttgatatagcaggattctgcttctgattgttttagcccactacggaagaaaagacaaaaagcagagttcatccaataaagagagggcattaactccaattttaaaaaatctagaacatttgataccatttctgtaaggttattaaatgccttatgttatcaatcttcagcaatctaatgctaaattctactaaagcaagtttttattcttatccattgaatgtgactccctctag

SEQ ID NO: 126227 - DNA, 601 bp, Human
cacttgagattaagtagtagaaatcttggccccttaaaccgtcacctgaaaaatgaatttatacctattttttgccttttaaaaccataatataaaatggtcttacaaaaattactagtttctagtcccctaacccttcaaaagggaaaagtcttcaagtacaaaagcaaacattaaaaaaaagcaattggacaaatgaccaacaaaaaattcagcattacttaataaaccttccaaatatcttttaaaaagtcctgttataatgaaaaagaaatagtttcatcaaagaatttttcaaackctcagagattaaaataaaaacataatgtttgagccaagacataacaagaatacataccctaccactgtgcagttctactccatagaagtcgagggtccgcgctatgttgatatagcaggattctgcttctgattgttttagcccactacggaagaaaagacaaaaagcagagttcatccaataaagagagggcattaactccaattttaaaaaatctagaacatttgataccatttctgtaaggttattaaatgccttatgttatcaatcttcagcaatctaatgctaaattctactaaa

SEQ ID NO: 126228 - DNA, 601 bp, Human
aacttgtgtgctgtgtgacctcggttatgtccctgagtatcagtttctccatctgtaaaatggggttaatgataacatatggaactcatggtattaccgcaggaaataatccactggtgcatagaaattgcttgacagatgacagatgttagtaaatcctactaaagtagccacaactaatttcaaatatttattgattttaacaattatatcaccataatctttttaaaaaaactatcatatatgagtaactatctccaatttgagcaacacttgagattaagtagtagaaatcttggcyccttaaaccgtcacctgaaaaatgaatttatacctattttttgccttttaaaaccataatataaaatggtcttacaaaaattactagtttctagtcccctaacccttcaaaagggaaaagtcttcaagtacaaaagcaaacattaaaaaaaagcaattggacaaatgaccaacaaaaaattcagcattacttaataaaccttccaaatatcttttaaaaagtcctgttataatgaaaaagaaatagtttcatcaaagaatttttcaaactctcagagattaaaataaaaacataatgttt

SEQ ID NO: 126229 - DNA, 601 bp, Human
gcgtttttatctggctgaaatgagagatgaaaacctagaagggggcttggcatatggagcttctagaagagagtttggcacgtggaagacataagaaacgtccattcccctttgccgtgggacaaaccctttgtgaaccacaatgtgaacatggagttagagaaacgggacaaacaaaacagtgctgatactgtggaaagtccaggcagtattcactatcagtacccaacagaaatcacatgcttataacaaaaccaaatttgcttgatgaagggtagaattgcatttaaatatgatacttgagatcacaacagagggagtatgaagcaggtgtgacagagcaaattagcaaaggaaatcaaaattgagtgaacaaggaaacaaatgaatggtttgggtgggccaaagaccaggtctcaaatctcctaatcctgtggtctttcagtatgcacctcaacccctgcagcataggaagttactgtctattcaattcccaggcccaaccccacatttcccagctccccttgcagagggcagaactcggtgactagttctggccactgtgctctgagcaggaggaatgtatgtctcttttgggctg

SEQ ID NO: 126230 - DNA, 601 bp, Human
ctccctgagctgtcaaatctgattatgcacagacatgaactcttgtcgtttccaggcttggggcctcagcggggctccctactgcccttcactcatttataagaaaaaaaaaatgcactgagagcctaggatgtacaaagttctatgccaggccctggggacagagggaagaggacatggagccactgccatccagaggcttataatccagtgagggagacaggaaccacataaagaatgatgcatggaagtaaatcactgtaactgtgagcactgcatgcaggaatgcctagagtctcayaagagcactaagaactgagcctataggctcctatggcccgtgaagccctccatgacctggcccctctcctgctgctcctcatgcccatggccagctccagcctggcctgtcccactcctcctgactcactagctgggttctctcttgtctctggacctatacaccctgccacttctctagaattttccttgggccaaagctcagctggtgttcagatcctggtgagtgccttaccctgcatgcttagggcccttcttatgtcctgcccctcctgggcacttgcccatgcacctcccttgt

SEQ ID NO: 126231 - DNA, 601 bp, Human
aatcaactccccttttgagttcttaccttgccttgtttggcccatgggtatctgtggacctcttactccccccacccctggcttcatatacaggggtaggagggcctggcaggcctcctgtggttcctagggctccagctcagcatcgccttcccaggctgaccccaatttccccacctgacagctctctccctgagctgtcaaatctgattatgcacagacatgaactcttgtcgtttccaggcttggggcctcagcggggctccctactgcccttcactcatttataagaaaaaaaaaatgcactgagagcctaggatgtacaaagttctatgccaggccctggggacagagggaagaggacatggagccactgccatccagaggcttataatccagtgagggagacaggaaccacataaagaatgatgcatggaagtaaatcactgtaactgtgagcactgcatgcaggaatgcctagagtctcacaagagcactaagaactgagcctataggctcctatggcccgtgaagccctccatgacctggcccctctcctgctgctcctcatgcccatggccagctccagcctggcctgtcc

SEQ ID NO: 126232 - DNA, 601 bp, Human
ttggtagatgtaactgtgaagtaaattttttggggtgactacaggttaatagtctaaggatgagaagagtgtctgggctcaccccttctggagatactcttcctagtgtgtgttactgctctgccatctccctgaagtcgggggagtctcctcacgattctcctgtgccaactggcagatgcaaaaattcctgttctgcagaacgagtcaggagaatcaactccccttttgagttcttaccttgccttgtttggcccatgggtatctgtggacctcttactccccccacccctggcttcawatacaggggtaggagggcctggcaggcctcctgtggttcctagggctccagctcagcatcgccttcccaggctgaccccaatttccccacctgacagctctctccctgagctgtcaaatctgattatgcacagacatgaactcttgtcgtttccaggcttggggcctcagcggggctccctactgcccttcactcatttataagaaaaaaaaaatgcactgagagcctaggatgtacaaagttctatgccaggccctggggacagagggaagaggacatggagccactgccatccagagg

SEQ ID NO: 126233 - DNA, 601 bp, Human
acttgaactattcatgggacatcccccagatggatcagcaatatacctctattacatattagatattacctaatacacatctattttcaacgatctgttggtagatgtaactgtgaagtaaattttttggggtgactacaggttaatagtctaaggatgagaagagtgtctgggctcaccccttctggagatactcttcctagtgtgtgttactgctctgccatctccctgaagtcgggggagtctcctcacgattctcctgtgccaactggcagatgcaaaaattcctgttctgcagaasgagtcaggagaatcaactccccttttgagttcttaccttgccttgtttggcccatgggtatctgtggacctcttactccccccacccctggcttcatatacaggggtaggagggcctggcaggcctcctgtggttcctagggctccagctcagcatcgccttcccaggctgaccccaatttccccacctgacagctctctccctgagctgtcaaatctgattatgcacagacatgaactcttgtcgtttccaggcttggggcctcagcggggctccctactgcccttcactcatttataa

SEQ ID NO: 126234 - DNA, 601 bp, Human
aagggctgactatcattcatttatgcaaaacttctgtaatccatacaaagggtgcatatttctctgctggaatctttacttctgaaatactttggggaaatgaaggaattttactattctctaggatcatacaaagaccttggtagaacattctagaatggagaggctgtgtaggtaaaacgaaacttgaactattcatgggacatcccccagatggatcagcaatatacctctattacatattagatattacctaatacacatctattttcaacgatctgttggtagatgtaactgtgamgtaaattttttggggtgactacaggttaatagtctaaggatgagaagagtgtctgggctcaccccttctggagatactcttcctagtgtgtgttactgctctgccatctccctgaagtcgggggagtctcctcacgattctcctgtgccaactggcagatgcaaaaattcctgttctgcagaacgagtcaggagaatcaactccccttttgagttcttaccttgccttgtttggcccatgggtatctgtggacctcttactccccccacccctggcttcatatacaggggtaggagggcc

SEQ ID NO: 126235 - DNA, 601 bp, Human
ttgaacctgggaggcggaggttgcagtgagccaagatggcaccactacactccaggctgggtgacagagtaagactccatctcaaaaaaaaaaaaaaaagaaaagaaagaaagaaaaaagaaattataagaataaattgacaatttatgctacctcttatacttagagggtagtcttagaacaaagaaaacaaaaatacaaactgcatggttatttcatttagagaataaatttatcttaattagaattttaaaatgtatatatgaattatatatatcaatgtacatccatttcttttacygtacatcattttatttagagaataaattttaatctaaattagaatttaaaaatttatatattatatatatttatacataaatatatataaatttacatccatttcttttcctgtactagtcattaaatattttgaatatcattcctgtggctaatagtacctatctcataggagagttgtaagagtcaaatataattatgtgcccagcacaaagtaaatgctcagtaattatcaactgtgattactactgttattttgtaattattataggcaatatatcccaaagtcacttgactctgg

SEQ ID NO: 126236 - DNA, 601 bp, Human
atcctagctactcgggaggctgaggcaagagaatcgattgaacctgggaggcggaggttgcagtgagccaagatggcaccactacactccaggctgggtgacagagtaagactccatctcaaaaaaaaaaaaaaaagaaaagaaagaaagaaaaaagaaattataagaataaattgacaatttatgctacctcttatacttagagggtagtcttagaacaaagaaaacaaaaatacaaactgcatggttatttcatttagagaataaatttatcttaattagaattttaaaatgtatataygaattatatatatcaatgtacatccatttcttttactgtacatcattttatttagagaataaattttaatctaaattagaatttaaaaatttatatattatatatatttatacataaatatatataaatttacatccatttcttttcctgtactagtcattaaatattttgaatatcattcctgtggctaatagtacctatctcataggagagttgtaagagtcaaatataattatgtgcccagcacaaagtaaatgctcagtaattatcaactgtgattactactgttattttgtaatt

SEQ ID NO: 126237 - DNA, 601 bp, Human
agctttgcagatgaagaaatagaagcaacaaattaaagctcaagtgacagaggcaggatttgaacccaggcagctcagcaacagagggcatggtttcagttgcctccccattccttctctcatctggcctgaggatcaggcccaacctaagtcaatgatataatccagtaagttattttcatggcttgctcaacagtagatctactgaatgtatacaaatactaaacagtattataagagctaaaaacttaatatattcactcttggttcatcagaagctgagagatagcatttagcaccrcaaatagtatcactgatactaacagaaattagctacttattcagtttacaagttccctaatgattatcaatgtattaggaaagtaactggaacagtctgatgcagttccacctatcagaaagataatggctcagacacgggtctcatttagttagtaatagccacatcaacaacaaatcacgaaaacaattttgaaaaaccaacaaatgatttagaaaatatggcctggcacggtggctcatgcctgtaaccccaacactttgggaggccgaggcaggcagatcacctgaggtcaggagt

SEQ ID NO: 126238 - DNA, 601 bp, Human
gcatgaagcctgtcaccctgttaaagggtgacaactttggttctggcatctctaaattttaaactaggatttaatgtcttatgaaaacattctacacatttccttgtgacatgacatcaaccaaccaacaaaaacaaaacagaacaaagaacaaacaaaagaacataaacaatatgaatcgccctgtagcacatcatgtactaattcacattaagaaatgctgttgtcaccctgatcaaaatgctcacaacagcatcactgggagactctttcctctgaggcaggcctacatcagaaaccwcactgccagtgatgaagagcacaggatcaaaacaaggggagcaaactgcccaactccaaggtttaatgtgtcatgggttattaatagggactctctgaaaaaaaagtgttccattgtcccataagcttggaaaataacccaacaaatttctttttatgtggaacctttcagaaggcccaataagcagatgtgtatctgtatctctaggggctgggcaagtcatgtgacccttctaagcctcagtgtcctcatctgtaaaatggaggtaatgagacttgaaattcaccagtatgctgaagc

SEQ ID NO: 126239 - DNA, 601 bp, Human
cctgagaatgaatccaatgaggccgtgttctcagggcatccagtgtggcacctgggcgtcagctcctgcagcgggggatcccaagctgccaagctttctaagttctattttccctcacagtttttccatcttccctttctttgttagccatttctcctcaggactgtcagggcctccatgatttgcaatccccctgggcctggataatcaataatgctgtgtccaaagcagaagtaaaaaggctcttgtgactcctcaggagaggacctataaatagccacaggagctccgggccacgagygtggcaacatccaaccccgctgttcccctggatccagtcctgggctctctgggcccctggcattgctgccgatgagattttcagataaattaagctgctgtgttatagcataaatttacctctttagaatgaggtatctaaatgttggaaaccaagaagcaaatctattcagttacgtcatgatttctaacactaaatactatcactgtcccttcccagagcattaggcccccagtgaaggggtccttccctagcaggcccagcacagcatctcctctgtctgcctgtctcccagtttct

SEQ ID NO: 126240 - DNA, 601 bp, Human
cctggtaaccaaggcaaaaagggaaacaaatgggttaaatatatcctattgaataacaaaagcactcaaccatctttcaggacagacattttttctgtccttgagctatgagggaactctgtcacgttaaaaaagcggggtgggggaggtaggacataaaaatttaacaaaaaatttctcaaagaaaattagagatgttctaacgtttgtttctttatactaactattaattgaaaacaaaacccctcagaaccctgttgttcggagaaggcttttagaagcaagcatatttccaatgatytgaaatcatgtgatggtaaaactttaataatctagagaaatcagagttagcatggccctagagtctgtacctccagaacagggaatgattaaactgggctttgcttgtgagctggagaggagactaattcaagagactaacaagtacttagtgactaggaagtctttgtcgtggacaaaaagaagtacaagctctagaccccaggcacatagaccgtcttccgggtgaaaaggtagagtctgatttatgttcttatcctggcagaaggcacctgtgggagctggctgcaggcaccagctc

SEQ ID NO: 126241 - DNA, 601 bp, Human
gactcatccgctaagatggcactcaggcagcctgagctgcgccactctgggtttacagccaaatctaaccgctctttttctttctctctttcttcttttttaaacgagtacagaacatcgcacttaattcttcttcttaaaaggaaccctcctcactgtctgtgatattattcatccgatttctctgacagaatgcttctttttgcctcttaacacaaatctgctgtataaaacatgtcaaatattttgtaaacattttgcaaatactcacagaaactaaccaacaggtttttttttttttctttttttctctcaccaggtacagaccagtctgtacttcttacctggagcaatgggggttcccagaccctcaggagggccagcctcctctgaagacccagcacaaagtggcttcccaccggcaggaagaggtctcccacctaacagaggtggtgggggctgcttttctggctgttcatcccacttgcagagcacagtcactaacttgaccccctgacatgtctattgtcagtgcacctggtaaaaccccacaaggaagcctgcctttgaaccactgttatttgctattcttaacatttag

SEQ ID NO: 126242 - DNA, 601 bp, Human
gagtttgaacaggtagtcaagtgggaaaaaaggcattctggcaaaacactgataataacaaacacacaaacaaaagcagtagcacaggtaaaggcaggaaatgctgaaaaagcagagaaaaggtatttaagcaggaagtgacattcttggatgtgtatttcagaatgataaatttgctattcttgtgaagcatggtgtggaaggaggtgacaccaaagacaggggaacgatttggatatgactgagctagactgtgcaagagacgatggtggctgcatgggggcagtgcagtggggatggyggaggagtcaaatgtaagagatgtctgggaggtagaatcaacacgatgagaaatggcatagggacagtgaaagaaaaggaggagtgagggacgactgatgtttcaaataggtgcaaactgggaagtactgaaacaatggccccccttaccaagacacaggaacagccatgggctggacaccaacatgaggagctgagattggatcatattgggtttcaggtatctgagagacatctacacgcaagtggactcaaacaagaaggcaaggttcaaggaaaagggacacaaacactctgaaca

SEQ ID NO: 126243 - DNA, 601 bp, Human
gatatggacacatgatgtggaagtggcagagggggcatcccattgtgaaaacttaggagtttgtatctcggggccccatctagtttcatctaaccatttgtccgtctgtccgtccgtccgtccgtccatccgtccatccgtccgtccatccaaccatccatccatccatccatccatccatccatccatccatccatccatccaaatagtcactgaatgtctattaaatgccaaataaccatgtcaggttttaaggaaggagaggtgaatagggcactatccctgccctcaaagaattcaytgtccaaaggagaagaaatacaattaaccaagtaataatattatcatgttacagtggagatgctcagatgtctagggtactgtgtaaggccaggagaggcttcctggagcaggtgcacttgagcttgagtttgaaagatgaattaataggagtttgaacaggtagtcaagtgggaaaaaaggcattctggcaaaacactgataataacaaacacacaaacaaaagcagtagcacaggtaaaggcaggaaatgctgaaaaagcagagaaaaggtatttaagcaggaagtgacattcttgga

SEQ ID NO: 126244 - DNA, 601 bp, Human
acaagtggagtgaagaaaggggcaggatgagggatgcaagaagatggtgaggatgggatggagccaatgacaagggggaggaaggagcagaagaggtttgtccctgaggcaggacggggaagacaccatggaagagccagtgtgggactgaccacatcctggttcttagggagaaaggggcagagacagagaaatgtgagacacagactgaccatcaggcagacaaacaagtattcaccctccagaaaacacatgcttctgaactgtaaaggcagcaggcatcagaaagaaacactcccawgaaagagacactcccgcacgaagctctccctaaaccctagaaaattaaagacctccccgccccgccgcctgtgaaaggaggcaaagtcctgctctcaaattgtggtgtgatggaacaggggccctgttttgggagcttctcaaggtcaggagaccctagtgctctttctgttcctctcctagtactcggaacacaggaccaggcacacagggagtactcaactgaaatgctgagtgaatgaagaataaagcctcttggcaaggtaccaagaggatcacccgaggtgattgggtgagttac

SEQ ID NO: 126245 - DNA, 601 bp, Human
acaaaagacagctgctactgcctctttcttgaccttcatttcaagcccttatccatggattttttatgaaattggtgcttctctttctcctagtgagtttaaatgagcctaatttaaatataaaatctgtatcatagtcacacagaatgattcataatcacaatctatttgaataaaatattcagtgacagaccaatggagaaacacagcgatacagtaggacaagagtctggccttatggtgtccaagtggctggttgggggtagggtgttatggatgggaaggcatttcagagacagartattttggaattgaagttgtatacaagttttcagattgaaaaagcatgactttcacttacgtaaaaggaagctttacaaaattccccccaaatacggcatctttgctgggtttcactgtttacaagagcatcacccagtggcagaaagggcaactgcttggcagttacaaaacaagttaaaatggtatttccagttctcgttctgtctgtctctgtctctgtctctacctctgtctccctctctctccctccctgcacccccccaatccatttttttttcttttgaggtagggtaaagct

SEQ ID NO: 126246 - DNA, 601 bp, Human
ttcacagatgaagaagctgaggtcaggagaggctgagtaacttgcccagggtcacatggctttcccccggcttagcagacagaaacctgaccgatgtgcgtcctaagcctttcttccctctccagaccatgcagagcccacttccaagacccctatttctaacccctcagagtcacagggattaaccatccctgctgtcactgtacaggacaggacccttgagtctctgcatcacccacaccagccccttccggagccacaggcccagcacagacaccttacagagctgatgactatgggrctctcctacattctaagactctgccccaccctaacctcatccaaagtgaagtgaggggagaagcgcagagaccaagtcattcagtgaaacccagacaaaagacagctgctactgcctctttcttgaccttcatttcaagcccttatccatggattttttatgaaattggtgcttctctttctcctagtgagtttaaatgagcctaatttaaatataaaatctgtatcatagtcacacagaatgattcataatcacaatctatttgaataaaatattcagtgacagaccaatggagaaaca

SEQ ID NO: 126247 - DNA, 601 bp, Human
gatgaaaacggaacagaactttgtggtcatttgttctaactcccagttcacagatgaagaagctgaggtcaggagaggctgagtaacttgcccagggtcacatggctttcccccggcttagcagacagaaacctgaccgatgtgcgtcctaagcctttcttccctctccagaccatgcagagcccacttccaagacccctatttctaacccctcagagtcacagggattaaccatccctgctgtcactgtacaggacaggacccttgagtctctgcatcacccacaccagccccttccggwgccacaggcccagcacagacaccttacagagctgatgactatggggctctcctacattctaagactctgccccaccctaacctcatccaaagtgaagtgaggggagaagcgcagagaccaagtcattcagtgaaacccagacaaaagacagctgctactgcctctttcttgaccttcatttcaagcccttatccatggattttttatgaaattggtgcttctctttctcctagtgagtttaaatgagcctaatttaaatataaaatctgtatcatagtcacacagaatgattcataatca

SEQ ID NO: 126248 - DNA, 601 bp, Human
caaaggaaacaggactgttgttgttgtgcgttcaggagaatttatattattcctagttggcatgatttgcctgtgacatccatgaactgccacgctgagatcttgttacattttcctctatcgaatatagtttcttctgtatcgtggagctgcactgtctagtatggtagccactagttatatgtggctacttaaatttaaataaattaagacaagaaaccagccatacttcacatgctcactagccatatgcggccagtggctcccgtatgagacagtgcagtcagagaacatttcaccacggcaggaagtcctgctggacagcgctgtcttagagagttacagatgatgaaaacggaacagaactttgtggtcatttgttctaactcccagttcacagatgaagaagctgaggtcaggagaggctgagtaacttgcccagggtcacatggctttcccccggcttagcagacagaaacctgaccgatgtgcgtcctaagcctttcttccctctccagaccatgcagagcccacttccaagacccctatttctaacccctcagagtcacagggattaaccatccctgctgtcactgtacag

SEQ ID NO: 126249 - DNA, 601 bp, Human
gagagttgcagtgggagcagagccgaggcaggagcacagcagtatggagtgtcagccaaacgtgtgaggcaggcagagacgcagggctttgcagacacaaccttcatttactttcagtattttacagctgtgcacggtgttcaaggaacttgacgtattattttataacaacaactataaagacaacagtgtgatgctcagtagaggctgtccttcaaacctctgctcccatcaggcagcaatgcaggtactttccagtctaagtgccattgattgattgaatgattgagatggagtctcrctctgtcacccaggctggagtgtagtggcacagtcttagctcactgcaacatccacttcctgggttcaagcgattctcctgcctcagcctcctgagtagctgggactatacccacatggcaccatgcctggctattgtatttttagcagagatgaggttttaccatgttggtcaagctggtcttgaactcctgacctcaagtgatacacccaccttggccttccaaagtgctgggattacaggtgtgagccactgtgcctggccccaagtgccatttaatcttcacagcaaccctgtgaa

SEQ ID NO: 126250 - DNA, 601 bp, Human
tgttccctcatgcctacaactgggataatgacagcatctatatagggctcttgtgagaattacctaaggtgatatcctttaaagcctgtggcacatagtaagtgctcatgaaagctttcctttcctactagtttctcattttatctggtttccttttctatgcctctcctctggctgctctgtaaaacaccattctcgcacctgtaacagtggttttcacatgatggtctgtttagcctagggctccctgggggccagtgaaggaagactgaagaggctgggctttgaggaccctactggytccatcacaggtcacagagcagacctgctttcatctgttctgtattttggaattctgcaaatgattttattaaaaagaagggtttcctacttaaatatcctacttgaggaactgtatagacaaaaatgaaggaaacgtgtacatgctaaaacgcaaccctaaaatgtatacgttctccttttcttatgctatcatcccaccataccctccaaagacaaagcctcggatgcacagcagtggttccggttgggtcttcacctcctctcctctggaacagcgtgtgcatcaaaacaggtgctg

SEQ ID NO: 126251 - DNA, 601 bp, Human
gtgttccctcatgcctacaactgggataatgacagcatctatatagggctcttgtgagaattacctaaggtgatatcctttaaagcctgtggcacatagtaagtgctcatgaaagctttcctttcctactagtttctcattttatctggtttccttttctatgcctctcctctggctgctctgtaaaacaccattctcgcacctgtaacagtggttttcacatgatggtctgtttagcctagggctccctgggggccagtgaaggaagactgaagaggctgggctttgaggaccctactgrttccatcacaggtcacagagcagacctgctttcatctgttctgtattttggaattctgcaaatgattttattaaaaagaagggtttcctacttaaatatcctacttgaggaactgtatagacaaaaatgaaggaaacgtgtacatgctaaaacgcaaccctaaaatgtatacgttctccttttcttatgctatcatcccaccataccctccaaagacaaagcctcggatgcacagcagtggttccggttgggtcttcacctcctctcctctggaacagcgtgtgcatcaaaacaggtgct

SEQ ID NO: 126252 - DNA, 601 bp, Human
catatgtgcaccacacttgctaggttccaaagtgctctagaaatgctaattattaagtgtgattttatgacagctgggaccaaatgctttctggaacacacttgtgattgtttactgaaagccacaggagggacttttttttcataaagggaattccctttatgaaaaaaaaaaaaatgctccaaagcaagcactgatagaaaccagctctcgcagaagggaattaaggctaccccagggcaggtctttcgtgccatggagtgggtggtgtggacacctgcagtgggccctgctggggaayagccccttcctcttcctactcctgtccagtgtacacccccatcagccaggacgcccacctgccaaccacactggagaaggtagagaactggaacaccaggactagacgacccagagctccaaacccagcacaacacagttacctttttttttttttttttttagctgttatcctggctggaatgcattggagccaacacggctcactgcagcctcaacttcccaggctcaagtgatcctctcacctcaatctcccgagtagctgggaccacaggtgtgtgccaccatggctggctaattt

SEQ ID NO: 126253 - DNA, 601 bp, Human
gatgcagattctactgctggcaaacctaacaagtattcttgcaggggccctttcagacagacacacaacaataagttatggcagcacttcctttaggtgggtcgctggcacttgaaatgtaaaggctgcacacacggtcattccaaagcccccagtttgctccgtgtatcccagatacacattatactgatgatgttttctttccttaaaaaacaaacaaacaaacaaaaacaacaaactatttggaaaaccgtttttaaaaatgcaatcttttgggccgggcatggtggctgatgcctgwaatcccagcactttgtggggccaaggtgggcagatcccttgaggccaggacttctagactaacttggccaacatggtgaaaccccatctctacttaaaatacaaaaattagctgggcatggtggcgcatgcctgtaatcctagctactgaggaagccaaggcacgagaatcacttgaatcacttgaacgtgggaggcagaggctgcagtgagccaagatcacacactgctgcactcctgcctgggccacagaatgagactcggtctaaagggttctaatcttgaagatacaattgctctc

SEQ ID NO: 126254 - DNA, 601 bp, Human
gctaacctggtgggaaaaagagattttttttcaaacaatgaaagtgtaaataaaatcaacttgaggtggtctagcagaaaagcacagctacagaaaaaggctttaattaccataagactttaaatgtatctcagcagtaatgatctgttgataaatttgtaaagtactaagattaatcctactaagataaatcatatattaaaaagtgttatggcagtgtttacatttttttttttttttttgagacacgttgcccaggctgggctgcagtggtgcgatctcagctcactgcaacctctgyctccaaggctcaagtggttctcatgcctcagcctcctgagtagttgggactacaggcatgtgccaccacatccggctaatttttgtatttttatttatacaattttatacaaatttataacttgtaaatttatacaaattatacaatgaataatttatacaatgatgatcatatagtagcaacacacacagtgtatataatgtgtaaagacacaatcttgtgtgtgtatacatgtgtatatgatatatctgcaatgagcactggaacaagtatggaaggatacataaaaaattgttgttt

SEQ ID NO: 126255 - DNA, 601 bp, Human
cacccttcctttaagaacgagagcatttcattcatcatttcaggagtctatttccacaggaaaaacatttatcccaatatatagtacatttcatttacagaggtacttccctacacatgtaatcactacgaaaaatctcaaacaacacaatctttgcatatctaaagtcatgtattagacatatttgtatggtatctgatgtgattttcacaacagccctgtaagagatattaattgtattcttattttgcaagttcaatgctttgttcgagatcacaaacaagaactcagatctgactcsaaggcttatgttttcttttctatatgactgctttttccctttaatcctttctcaccagtggtttttattaactctatgggaatttaaaaacacagttttttcagtgttggaagtgattttttttttttgcggaaaatttgggaaattcagactaatataaagaaaaaaattatcagcaatttcacaactctgagatgtgctttttgtatattttctccagcttattttttctgtgcctacatgaacacaaatgaacagaagcacatatatgtaaacgcataatacatttatatactatgt

SEQ ID NO: 126256 - DNA, 601 bp, Human
ctaaaagcaactagatgtgggggggggggggaagaattctggctcaaaattaaatggaaatcatctaaattagtctagaatcatttcccttcagttcaatgtagtgaaccacacccttcctttaagaacgagagcatttcattcatcatttcaggagtctatttccacaggaaaaacatttatcccaatatatagtacatttcatttacagaggtacttccctacacatgtaatcactacgaaaaatctcaaacaacacaatctttgcatatctaaagtcatgtattagacatatttgtayggtatctgatgtgattttcacaacagccctgtaagagatattaattgtattcttattttgcaagttcaatgctttgttcgagatcacaaacaagaactcagatctgactccaaggcttatgttttcttttctatatgactgctttttccctttaatcctttctcaccagtggtttttattaactctatgggaatttaaaaacacagttttttcagtgttggaagtgattttttttttttgcggaaaatttgggaaattcagactaatataaagaaaaaaattatcagcaatttcacaact

SEQ ID NO: 126257 - DNA, 601 bp, Human
cggatactcacaaggcagcacatctttatatcggtttttgtccaaattttgaggcagctttgcaaacgtgatggccaaacctggcttttttctgtagagttgctatgtgagaaatagagaaaaaagcaagcattgcaaaaatcagatgaagaaagtgtgaaaacatactttatcattcacagtaccaaaatcttaacattttaaagtgattatgtgttatatactaaaagaaaatcttcccaataagaaattctacagttccatgagaaactgactaaactctttaataatttttttttttaatttgaaaaaatgccataggaagggtctgggtctcaggtaatggagcatggtaagtgaaaccttgtctttatgacaactatttgacaagagctaaaagcaactagatgtgggggggggggggaagaattctggctcaaaattaaatggaaatcatctaaattagtctagaatcatttcccttcagttcaatgtagtgaaccacacccttcctttaagaacgagagcatttcattcatcatttcaggagtctatttccacaggaaaaacatttatcccaatatatagtacatttcattta

SEQ ID NO: 126258 - DNA, 601 bp, Human
tgtaccctaaaacttaaagtataataataataaaataaaataaaaaagaaggaatggaagtctagagaggccaagtaagttgcccaagatgcgtttttagagagaaaataagtgcttttcccataacatgtgaaacattccactttttctttttggcttatatgtacagaggaggttttatttttctcattttttttttaaggcaggatgacactcattacatggagagaaatagacagtttcatcactggcaaaaacaaacacctgaatggaagccactcagtacaggggcatgtggacrattgaattagaaacacagaacaagtctggtcccatcttctgttagctttgtgacttttcaaattattttaactctccgaaccttagttttctcctctgtaaaatgagactattctgcctgccctcccatggctgttgtggtgctgaaatgcggtggtgaacgggaaagcactgtgtcaactgcaaagccccacacaggccctcatcatcgttgcgacagtggtgaatgtgctcttaagcatcatccagattcctaacttacgttcacgtaacttgcattaatataatcttcatttccctg

SEQ ID NO: 126259 - DNA, 601 bp, Human
ttaatctttttaagtggttacatttcaaatgcaaagatcacatattactatctggttggctacagaaagtctgaccccaggttcagatagcattaggagatatacctaatgctaaatgacgagttaatgggtgcagcataccagcatggcacatgtatacatatgtaactaacctgcacattgtgcacatgtaccctaaaacttaaagtataataataataaaataaaataaaaaagaaggaatggaagtctagagaggccaagtaagttgcccaagatgcgtttttagagagaaaataartgcttttcccataacatgtgaaacattccactttttctttttggcttatatgtacagaggaggttttatttttctcattttttttttaaggcaggatgacactcattacatggagagaaatagacagtttcatcactggcaaaaacaaacacctgaatggaagccactcagtacaggggcatgtggacgattgaattagaaacacagaacaagtctggtcccatcttctgttagctttgtgacttttcaaattattttaactctccgaaccttagttttctcctctgtaaaatgagacta

SEQ ID NO: 126260 - DNA, 601 bp, Human
ctgctgaaaaggcagagtcaactttacagggaagagaagggcagacagacaagacagggacagcgctgagctgcccaaatggattctatggaaaatggcacagtgatgtaatttctcctttttacaaaggccactgttaacctggcacacacactgctctttcaggaccagcacttgtcctgaatgggcaaggccacgtcactgcaggggtgttggggcacatgaagtaaggctaggggaagtgccttctggcttgttgtaatggatccaagctgggactggggaggaggagggctgagcytcccgtcactaggggtgtctattggttgctctgtagaggagacttagggtcacatacgggctggaccaggagacgctgaagacccttctcagcgctgagattcatgttacacagagtagggtgtgacactgcacacatctgaattagaaatcaagctacttacccgccctcgttctgtgagagtcgtcaacatgacaatgagtgacaacttctgatcccagacaacctgccaaaactgtgcacaggtatgcggcaggggcccctgagtggcgatgtacttgttcacaaggttagcagcag

SEQ ID NO: 126261 - DNA, 601 bp, Human
aagagaccattgctgggcggtgggggctcccttttctctgaggagaagaatgaccttcctgctgaaaaggcagagtcaactttacagggaagagaagggcagacagacaagacagggacagcgctgagctgcccaaatggattctatggaaaatggcacagtgatgtaatttctcctttttacaaaggccactgttaacctggcacacacactgctctttcaggaccagcacttgtcctgaatgggcaaggccacgtcactgcaggggtgttggggcacatgaagtaaggctaggggaagygccttctggcttgttgtaatggatccaagctgggactggggaggaggagggctgagcctcccgtcactaggggtgtctattggttgctctgtagaggagacttagggtcacatacgggctggaccaggagacgctgaagacccttctcagcgctgagattcatgttacacagagtagggtgtgacactgcacacatctgaattagaaatcaagctacttacccgccctcgttctgtgagagtcgtcaacatgacaatgagtgacaacttctgatcccagacaacctgccaaaactgtgca

SEQ ID NO: 126262 - DNA, 601 bp, Human
aggcagagggaatgggacacacatggtcaagaggtaaagaggcacatgatgtacccagggaacgacagacagtacaatacacctgcacagaaggtaccagtctcaaggtgagactttacgtggtgcacctgagaagccaccagagggtttgagcagggaaatgacaggaccaggcaaccctctggaaaggtatcgctgaaagctgtgccaagggatggacaagacgggggctgggggagcctctaggccaggaagccactaaggaggctgctgctgctgctcctggaagagaaatgcaaargctctgagagaaggtgagggtttgggggacagagaggggagactggcagcggcagaccgtggtgagtggatgtgggaagtgaagagaagggaggggtaagaccgattccaggttcctggctcgggtgactgggcagatgggtgccactggccagactggtgagctcagggcgtgtaccacctgggtgcaggtgcatggctgacagcttcagcttcaggcaccttgtatgtgaggacactcaggtagatgtgtcctatcaacaaatgagcagatgggtctgggttcaggaggtggaaggaa

SEQ ID NO: 126263 - DNA, 601 bp, Human
cactctcagagacctcacatagtttacaaattccagaaagtcggaggagtcatcgggcacaccgtggtcaggccatgcgacgtactggagatgtgtcactgtgtgttcttccccggtctgtgggagatgcagtggccttggtgagcccatccaggtggtgagcatgaggacccagccccaacccagacacagggtggccctgtctcctgatgctttctccctctgcgcacagccctgctgtggcccctagcaattcctcccctccttccccaaagatccccatcccctctcaggctcagcygtgggcctgtcctgcagggctgccttccttgatcacttctgcccagtgatctcctctgcccagtgatctcctccatttgctgctatggtacttgccattagaggccacacatgctgactgtttttttttttttttttcaactgtggcaaaatatactaacatgaggcttaccactgtaaccacatttaaatgtacagttcagcggcattgagaatactcgcaatgttgtagagccatcagcactacctatttccagaactttaaaatatcccgcaaacataaaccctgcacccattatgc

SEQ ID NO: 126264 - DNA, 601 bp, Human
ggtttggggagaggagggtgggggcgcggctgctgtggggtgtccccgggcggggttcacgggaagcccccagctggcccgcgtcgggaagcggactcgcccaccctgcccccctgcctggcgtgtccaagcgcagtgtcgccggggtcgagggagggcgccggggagtgtctcgggcgggcggaggggccgagagtggagggaggcaggagtttctttgtctccagcacggccgctttctcgccttggcaaagtgggcagggggcgcgcagggatctctgagctgggggaggggttcctsgggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccggcgaccctgggttcctgtgcgctcgcagcgcggagacggagacatttcgggaaagtctgtaccgccgcccggtgggcttctgggccctcaggcgggcg

SEQ ID NO: 126265 - DNA, 601 bp, Human
cggctgctgtggggtgtccccgggcggggttcacgggaagcccccagctggcccgcgtcgggaagcggactcgcccaccctgcccccctgcctggcgtgtccaagcgcagtgtcgccggggtcgagggagggcgccggggagtgtctcgggcgggcggaggggccgagagtggagggaggcaggagtttctttgtctccagcacggccgctttctcgccttggcaaagtgggcagggggcgcgcagggatctctgagctgggggaggggttcctcgggccggagcggagggcggggttctscatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccggcgaccctgggttcctgtgcgctcgcagcgcggagacggagacatttcgggaaagtctgtaccgccgcccggtgggcttctgggccctcaggcgggcgatctggcgctttttttctcccgacct

SEQ ID NO: 126266 - DNA, 601 bp, Human
ccaagccacggcaaccccggcgaccctgggttcctgtgcgctcgcagcgcggagacggagacatttcgggaaagtctgtaccgccgcccggtgggcttctgggccctcaggcgggcgatctggcgctttttttctcccgacctcgccagaggtagggtgggaccgcgagcccggatcctcccggctccggacttcctggagtgcgcacttgaggcgcgggacgcaccggctgtgtgtcccaggggctgagactcgcgccccgccccgcagccttcggctcgccgggccgggcccctctccrgaacctccaaagggcggtagacgacaggtggggaggcagccggggttctgaggaggcccgaggagagcttcctggccctgggcaaggggaaggtgaggtctcaaagagggcagaaggtctcttcttctgtgggatttgtgctctgccaggcgctcttctcgagtcccgcgccgcgtgcgcccctcctttgtcccatttgttacttcatttgttatctgtgctagttgagggtccgccacactgtcagtccctcaaatgggagatgccagtcctgggcccaggcgggatgccgaggcccca

SEQ ID NO: 126267 - DNA, 601 bp, Human
aagagctctgaaaactttcacaaatgctgcgcagttaatacacaacgtgccaccaattcccacgcagagataaacatgctacttttcatagctgctcgcctcagaaacgtggattggaaaggaaatcgggcaagtcacgtcttggggtaatggaagatgcggtgaggagggccttcctctaggctctccggcttctgattccggatgtgggcactgcccggctcagatcacttgctgacctttgcccatgtgagagggaaggcccggcgctgcccattgtcctgttataaaaacataagtkctgtgcttatccaggcacccctaggtcagccattcactgaattcttaccaaataccttccacatgctgggaacttttaatttttaaaatgcaatcaggagatcactttgcacataatgttgcactttcttgccaaatgcacggtgaagcctacgctccccacatcaggttgttcccatatatgtacgcaccccggggacttgtctcacttgagtgctccctgcttctttttatcctgtctctgctgggccaatcctaggaaaaaacggtcaaacaagtacgatgtgtcacctcctgtggc

SEQ ID NO: 126268 - DNA, 601 bp, Human
ttgtttttttttttgtcttttctttttttctttttcttttttttgagacggagtctcattctgtcgcccaggatggagtgcagtggcacaatctcggctcactgcaacctccgcctcccgggttcaagcaattctcctgtttcagcctcccgagtagctgggattacaggcacctgccaccacaccaggctaatttttgtatttttattagagacggggtttcaccatgttggccaggctggtctcaatcacctcaggggatctgcccacctcagcctcccaaagtgctgggattacaggygtgagccacccctcccggcacaagtgaggttttaacactaaattcattcttggaattaccccaactttgggcagctgggctcagtgcccaataagagccttggcacagtggccagtgaggggcgtcaagagggctccgccttcctcaccatatgccttcctggagacctcgaatcatactcaggcacaagaggcttttgcaccagccctgcccctccatccccaactcactccggacctgtgctagggaggattacagatgatctgcgcgtgtcggcccctgggagaaagcgatggctct

SEQ ID NO: 126269 - DNA, 601 bp, Human
gaggggagttttctgagacacacatctcttttccttagtgattattttccaaagttccatttctgactctcttgctctcattgagctggagctgactaagaaaacaaaatgtagaaagataagttctctgcaaagcacctagagagtcctgcctggtagccaaggagtgaattcaaattctaagtcagaaattgggtggggctttggtaaaataggccctgatcaattcatgcacactcccaagttttagatccaattcgaccaagttgtaagctaaaatcttctgattgtttcttggccyttaatcttgagtgtaacttccactaggggattgtgaggcgtagctgtcttgcccatcatggtgtccatggaactgggcacacaaggcattcaataaacatctgttggataaatattttcctgagtctggcacagtgatgggcacacacagcatccttgggcaaagttgaaactcagagctggccgggaacggtggctcacgcctgtaatcccaacactttgggaggccgaggcaggtagatcacctgaggtcaggagttcgagaccagactggccaacatggtgaaactccatctctact

SEQ ID NO: 126270 - DNA, 601 bp, Human
acacacagcatccttgggcaaagttgaaactcagagctggccgggaacggtggctcacgcctgtaatcccaacactttgggaggccgaggcaggtagatcacctgaggtcaggagttcgagaccagactggccaacatggtgaaactccatctctactaaaagtacaaaaattagccaggcatggtggcgggtgcctgtaataccagctactcgggaggctgaggcaggagaatggcttgaaacctgggaggaagaggttgcagtgagccaagatcacgccattgcactccagcctgggcracagagcgagactccatctcaaaaaaagaaaaaagaaaagaaaaagaaagaaagaaactcactgagccttgggacaagaagagagcatagggctctccctgtagaaacctttcctttttatcagctagggtgaatttgacactgagaaataacatcactaatctgagatcacagcctggctggttaagggcagagcaggcttgcacaggtctcctcttttgtaacccaatgtcctaatcctcatattagttcctctacccataaaggaattacagaaatcttgttaaagagaagttgagt

SEQ ID NO: 126271 - DNA, 601 bp, Human
tctgacccatcagaactgatgccatccagtacaccacggccaggggtcctagtgcacctcagccaaacaccaggccctgtctgggaaaacactagacaaggagaggctagctctgatcatcagccatgacgagatctgtgagcaggcagcaactactgccaacagccaagagtgaggtgaggtgaatcgtttagtggacgagtgcacgtggatgggaaagaaaatgaccttgagcagttgcagtccaggcactctgtaagaagtacacgtttgctcaacacgatgcatttttttttaaaaagcccattcttctccctagtactggtgtacttcactgaagtataagcatgattggaagataaaataggagagaaagatctggttttaactcacttgctccaagtccttattgccaactgttccaaacatcacatttaaattgtaaatagataccatcttagaaaccaattcaccactcagagcctctttccccctgtaaggcagggttgctaggttttaaacatgttttaggttttacaaattggaaatgttgtagattgcaaattataaatacttcttcgagaggggattctagaaaggc

SEQ ID NO: 126272 - DNA, 601 bp, Human
gcctctttccccctgtaaggcagggttgctaggttttaaacatgttttaggttttacaaattggaaatgttgtagattgcaaattataaatacttcttcgagaggggattctagaaaggctcccattgcttttagcagggcatacaaagcaacacatcatctggtcttttgcctctgtctgtagccggcctgggctccagccatttttgtattgcttacaggttccccaaaatgtcctaggatttcatacctctgtgcctttgcacatcccgctcctgctctgtggaatgccctccttgcrcacacaccatccttcctgctgttgccctgctcctcccaggcccttcctttctctcactgctctgtcttcttccaggctaagatctggtatctcctagaccccgtccccttccgagacatctgcattggttgcccctcctgtgtgcaccctagcaccccatcatgcagcaccccatggacatgcatttcacaattatattttatttatcctttatctccagcccctggtgatacgtatatggtttagtaaatgaagcctattaaatattttttgaaggaacaaactctgaccgaggatatg

SEQ ID NO: 126273 - DNA, 601 bp, Human
ctattctaacaacaattaaacaccctctgcttgatctggaagccccctgcttttcctgtgtatctagcgtggagggtgcatcccagtgaagagcacagtctggctatgacgttattcaccattgcggaatgtttggggccaatggaaataaaagctgctttctaatttgtaaaagcagaggacccagtggtgtttgccccctgccagtttaggtaaaaaccaaagatctagagcccagatgccaagcctctgccggctgttggttctccagagagccctttccagccctccactgcccacrgtgctgctgaggctgccccctcctgcctggaaggacagccggccccgtctaccttaatccccttcagggcttccatagtggcgttgagagcagaccaggaacgcagggccagctgtttccgtgcaagggctggtccccaggtaggatgctggaaactgagtgttagagacgttgacagtaagaaatgtgaggtcaggtcgggatgtgtcatctcaaagattttcctcatgaagcaccttctagtggtgtttttatttgaaaacactggtcaaaccagtgaatcctcatgacgggtcaaga

SEQ ID NO: 126274 - DNA, 601 bp, Human
agtggaaacggccgggggagggacaggaacatgaaagccaccagctgggtgagtcaggtggctatctcctgccagggcgtggggacaagctcatcttccggagaggcactgtggggtgagacaccgtcgcctgtggccggccggctgaccgcccctgggcttgcttaccatctctccagagccaaggctggtccttaagcgttgagattagtcactctcttgggtggcatctgggctggttttaaattctctttagtctcctgcaatttatcacccagctaggaagctgcccggtgtcctracgggacctgtgtgtcccatgttttctcagctttggctgtcactgacttcgcgacgatggcaaggaggaaacggctccaactggggagagcagcggccccgacacgacatgtgtctgtattacacgttggcagtcgaggttcctcctgacactttcaagcacttgggatcccgattcactcccctgggaaatccagcatccagcctcgctgtgtgggtgtgcctttgacttcccaaactgctctgcaagcatgaagctctcagctctgtccaagggtttcccagtgccttttttttttat

SEQ ID NO: 126275 - DNA, 601 bp, Human
ctccagagccaaggctggtccttaagcgttgagattagtcactctcttgggtggcatctgggctggttttaaattctctttagtctcctgcaatttatcacccagctaggaagctgcccggtgtcctgacgggacctgtgtgtcccatgttttctcagctttggctgtcactgacttcgcgacgatggcaaggaggaaacggctccaactggggagagcagcggccccgacacgacatgtgtctgtattacacgttggcagtcgaggttcctcctgacactttcaagcacttgggatcccrattcactcccctgggaaatccagcatccagcctcgctgtgtgggtgtgcctttgacttcccaaactgctctgcaagcatgaagctctcagctctgtccaagggtttcccagtgccttttttttttattattgaaggaatgcggagggactcagctttgcttcctggaccttttttaaggttcagggaaacaattcctcctcctcctcctccagcttcttagttgatggccaaaggatgaaagaacccctaggtcagtggttcccaaatagtgagccacagaggagtggtgatctgaaagg

SEQ ID NO: 126276 - DNA, 601 bp, Human
tgagattagtcactctcttgggtggcatctgggctggttttaaattctctttagtctcctgcaatttatcacccagctaggaagctgcccggtgtcctgacgggacctgtgtgtcccatgttttctcagctttggctgtcactgacttcgcgacgatggcaaggaggaaacggctccaactggggagagcagcggccccgacacgacatgtgtctgtattacacgttggcagtcgaggttcctcctgacactttcaagcacttgggatcccgattcactcccctgggaaatccagcatccmgcctcgctgtgtgggtgtgcctttgacttcccaaactgctctgcaagcatgaagctctcagctctgtccaagggtttcccagtgccttttttttttattattgaaggaatgcggagggactcagctttgcttcctggaccttttttaaggttcagggaaacaattcctcctcctcctcctccagcttcttagttgatggccaaaggatgaaagaacccctaggtcagtggttcccaaatagtgagccacagaggagtggtgatctgaaaggagccagaaaaaaaaaaaaaagtgcaatgt

SEQ ID NO: 126277 - DNA, 601 bp, Human
tcccatgttttctcagctttggctgtcactgacttcgcgacgatggcaaggaggaaacggctccaactggggagagcagcggccccgacacgacatgtgtctgtattacacgttggcagtcgaggttcctcctgacactttcaagcacttgggatcccgattcactcccctgggaaatccagcatccagcctcgctgtgtgggtgtgcctttgacttcccaaactgctctgcaagcatgaagctctcagctctgtccaagggtttcccagtgccttttttttttattattgaaggaatgcrgagggactcagctttgcttcctggaccttttttaaggttcagggaaacaattcctcctcctcctcctccagcttcttagttgatggccaaaggatgaaagaacccctaggtcagtggttcccaaatagtgagccacagaggagtggtgatctgaaaggagccagaaaaaaaaaaaaaagtgcaatgtagccatgattattaatagtttcaagttgccagctgccattgcctgaaaagaactcttctatattctgagataatgttcctttttcctttgggatactaagatgtcctttcttt

SEQ ID NO: 126278 - DNA, 601 bp, Human
cgacgatggcaaggaggaaacggctccaactggggagagcagcggccccgacacgacatgtgtctgtattacacgttggcagtcgaggttcctcctgacactttcaagcacttgggatcccgattcactcccctgggaaatccagcatccagcctcgctgtgtgggtgtgcctttgacttcccaaactgctctgcaagcatgaagctctcagctctgtccaagggtttcccagtgccttttttttttattattgaaggaatgcggagggactcagctttgcttcctggaccttttttaagrttcagggaaacaattcctcctcctcctcctccagcttcttagttgatggccaaaggatgaaagaacccctaggtcagtggttcccaaatagtgagccacagaggagtggtgatctgaaaggagccagaaaaaaaaaaaaaagtgcaatgtagccatgattattaatagtttcaagttgccagctgccattgcctgaaaagaactcttctatattctgagataatgttcctttttcctttgggatactaagatgtcctttcttttatgaaagggagtgatggtagctatgaaattctccct

SEQ ID NO: 126279 - DNA, 601 bp, Human
tcaagcacttgggatcccgattcactcccctgggaaatccagcatccagcctcgctgtgtgggtgtgcctttgacttcccaaactgctctgcaagcatgaagctctcagctctgtccaagggtttcccagtgccttttttttttattattgaaggaatgcggagggactcagctttgcttcctggaccttttttaaggttcagggaaacaattcctcctcctcctcctccagcttcttagttgatggccaaaggatgaaagaacccctaggtcagtggttcccaaatagtgagccacagakgagtggtgatctgaaaggagccagaaaaaaaaaaaaaagtgcaatgtagccatgattattaatagtttcaagttgccagctgccattgcctgaaaagaactcttctatattctgagataatgttcctttttcctttgggatactaagatgtcctttcttttatgaaagggagtgatggtagctatgaaattctcccttggctgaagagggtggtaacctcatgagtccccacccccagtgttttggaaatactatgggtccttgaaatctgattgtctggggtctggatccacaaggtat

SEQ ID NO: 126280 - DNA, 601 bp, Human
tgtcttaaatgacatccagtggggaagagatgcgtgcttgtattttcaaggaataagccttggaaacacaaaggtctgtgggagagagaaccctgggatgtagcgatgctgaaggaaacttaggggatagcatgttggagcccaggccataatgggacatggcagccaaaagatcagtacaatttagggttgccagttccaaaacaccttaatgcggaatgacggccaggggcacaccgctccgcctctgcctccccacatttcctctcctctcacaccagcttccccgcacggagtctcrtcagaatggctccggagcatggcatttgtttgaccatctcattaccagagagagagagagagagagagacacactgagagagaagagaaaaacaacacaaatgatcaaggcctggaggaattttcttctaggggaagacagaagagttggtgctgtcagcttccccaggtcagtggagcctgacaaggaagggaaggagggagggagtgagtgacggagggagggagcccttcggggaggggccaggcttaatgcaaggagatagcacatcccaaggagccccctttcctacggtaacca

SEQ ID NO: 126281 - DNA, 601 bp, Human
tctcctctcacaccagcttccccgcacggagtctcatcagaatggctccggagcatggcatttgtttgaccatctcattaccagagagagagagagagagagagacacactgagagagaagagaaaaacaacacaaatgatcaaggcctggaggaattttcttctaggggaagacagaagagttggtgctgtcagcttccccaggtcagtggagcctgacaaggaagggaaggagggagggagtgagtgacggagggagggagcccttcggggaggggccaggcttaatgcaaggagatascacatcccaaggagccccctttcctacggtaaccacattctgctgagagctcacatgtatcacctcactcaaccttcccaagcaccctgttagtccatttgcagatgaggaaatggagactcagagaggtctcgggacttgctaaggtcacacagctagtaaacatggagctgggattccacccaggtttgcctgactccatggtccatctggtcttagccacttttttatactgaggttacctggctgctcacccccattcctcatgcctcctgccctgggcctcctacactttatccc

SEQ ID NO: 126282 - DNA, 601 bp, Human
gagtctcatcagaatggctccggagcatggcatttgtttgaccatctcattaccagagagagagagagagagagagacacactgagagagaagagaaaaacaacacaaatgatcaaggcctggaggaattttcttctaggggaagacagaagagttggtgctgtcagcttccccaggtcagtggagcctgacaaggaagggaaggagggagggagtgagtgacggagggagggagcccttcggggaggggccaggcttaatgcaaggagatagcacatcccaaggagccccctttcctackgtaaccacattctgctgagagctcacatgtatcacctcactcaaccttcccaagcaccctgttagtccatttgcagatgaggaaatggagactcagagaggtctcgggacttgctaaggtcacacagctagtaaacatggagctgggattccacccaggtttgcctgactccatggtccatctggtcttagccacttttttatactgaggttacctggctgctcacccccattcctcatgcctcctgccctgggcctcctacactttatcccgttttctgtaccatgcagagagtttgca

SEQ ID NO: 126283 - DNA, 601 bp, Human
caggacattgggccagacctttggagcaactgagagctactcttggaagattaaggctccagtcttcagtggaacacttattacctgtgtgagttcaggcaaatgacctcacctttctgagtctcagtttcctaatctgtataatggggttaatgatacccaacttacagtgttctgaggattaaataaaacacaaatggtgggaatgtaaaatggtacagctactatggaaaacagtatgacggttcctcaaaaaatttaacgtagaattaccatatggtccagcaattccacttctgggtgtatattcaaaagaattgaaagcaggggccaggtgtggtggctcacacctgtaatctcaacactttgggaggccgaggtgggtggattacctgaggtcaggagtttgagaccagcctggccaacatggtgaaaccctgtctttactaaaaatacaaaaaaaaaaaaaaaaaaattagctgggtgtagtgctgcatgcctgtagtcccagctactcggaggctgagacaggagaataggttgaacccgggaggcggaggttgcagtgagcctagatcatgccactgcactccagcctggg

SEQ ID NO: 126284 - DNA, 601 bp, Human
tgagttcaggcaaatgacctcacctttctgagtctcagtttcctaatctgtataatggggttaatgatacccaacttacagtgttctgaggattaaataaaacacaaatggtgggaatgtaaaatggtacagctactatggaaaacagtatgacggttcctcaaaaaatttaacgtagaattaccatatggtccagcaattccacttctgggtgtatattcaaaagaattgaaagcaggggccaggtgtggtggctcacacctgtaatctcaacactttgggaggccgaggtgggtggatyacctgaggtcaggagtttgagaccagcctggccaacatggtgaaaccctgtctttactaaaaatacaaaaaaaaaaaaaaaaaaattagctgggtgtagtgctgcatgcctgtagtcccagctactcggaggctgagacaggagaataggttgaacccgggaggcggaggttgcagtgagcctagatcatgccactgcactccagcctgggtgacagagcaagactccatctcaaaaaaaaaaaaaaaaattggaaacagggactcaaacagatatttgtacacccatgttcatagtaac

SEQ ID NO: 126285 - DNA, 601 bp, Human
gtttcctaatctgtataatggggttaatgatacccaacttacagtgttctgaggattaaataaaacacaaatggtgggaatgtaaaatggtacagctactatggaaaacagtatgacggttcctcaaaaaatttaacgtagaattaccatatggtccagcaattccacttctgggtgtatattcaaaagaattgaaagcaggggccaggtgtggtggctcacacctgtaatctcaacactttgggaggccgaggtgggtggattacctgaggtcaggagtttgagaccagcctggccaacrtggtgaaaccctgtctttactaaaaatacaaaaaaaaaaaaaaaaaaattagctgggtgtagtgctgcatgcctgtagtcccagctactcggaggctgagacaggagaataggttgaacccgggaggcggaggttgcagtgagcctagatcatgccactgcactccagcctgggtgacagagcaagactccatctcaaaaaaaaaaaaaaaaattggaaacagggactcaaacagatatttgtacacccatgttcatagtaaccttattcacggtagctaaaaggtggaagcaacccagg

SEQ ID NO: 126286 - DNA, 601 bp, Human
ctgaggattaaataaaacacaaatggtgggaatgtaaaatggtacagctactatggaaaacagtatgacggttcctcaaaaaatttaacgtagaattaccatatggtccagcaattccacttctgggtgtatattcaaaagaattgaaagcaggggccaggtgtggtggctcacacctgtaatctcaacactttgggaggccgaggtgggtggattacctgaggtcaggagtttgagaccagcctggccaacatggtgaaaccctgtctttactaaaaatacaaaaaaaaaaaaaaaaaaattagctgggtgtagtgctgcatgcctgtagtcccagctactcggaggctgagacaggagaataggttgaacccgggaggcggaggttgcagtgagcctagatcatgccactgcactccagcctgggtgacagagcaagactccatctcaaaaaaaaaaaaaaaaattggaaacagggactcaaacagatatttgtacacccatgttcatagtaaccttattcacggtagctaaaaggtggaagcaacccaggtatccgtcaatgagtgaatggataaacaaaatatggtagatgctgggc

SEQ ID NO: 126287 - DNA, 601 bp, Human
agtttggacatgcctgggcaatatagcaagaccctgttcttaaaaattttttttaaaaaggtatatccatacaatggaatattattcaatcttaaaaaggaaggaaattctgacacaagctataagatgggtgaactttgagaacattatgctgagtggaataagccagtggccaaagcacaaatactgtatggttctacgtacatgaggcatctggaatggtcaaattgatggagacagaaagtagaatggcggttgccagggtctggggaaggagaaggggaatttgtttaatgggtawaaagtttcagttttgcaagatgaaaagagttcagcagacggatggtaatgatagctgcagaataatatgaatgtcttaatgctactgaaccgaacacttaaaaatagctaagatggtaaattgcatgttatgtgtattttcccacaattgaaacacacacgcgcgcaagcagccagaagagtgcctggcaggtgctcgggacacactgacttattttaagagcacagttgtgattttcaacaaagcaacatcaatgtgggtattacttaattttaaaaataatacaggaccaaaaagcag

SEQ ID NO: 126288 - DNA, 601 bp, Human
tatagcaagaccctgttcttaaaaattttttttaaaaaggtatatccatacaatggaatattattcaatcttaaaaaggaaggaaattctgacacaagctataagatgggtgaactttgagaacattatgctgagtggaataagccagtggccaaagcacaaatactgtatggttctacgtacatgaggcatctggaatggtcaaattgatggagacagaaagtagaatggcggttgccagggtctggggaaggagaaggggaatttgtttaatgggtataaagtttcagttttgcaagakgaaaagagttcagcagacggatggtaatgatagctgcagaataatatgaatgtcttaatgctactgaaccgaacacttaaaaatagctaagatggtaaattgcatgttatgtgtattttcccacaattgaaacacacacgcgcgcaagcagccagaagagtgcctggcaggtgctcgggacacactgacttattttaagagcacagttgtgattttcaacaaagcaacatcaatgtgggtattacttaattttaaaaataatacaggaccaaaaagcagatacaggggaaatggagggag

SEQ ID NO: 126289 - DNA, 601 bp, Human
tctggaatggtcaaattgatggagacagaaagtagaatggcggttgccagggtctggggaaggagaaggggaatttgtttaatgggtataaagtttcagttttgcaagatgaaaagagttcagcagacggatggtaatgatagctgcagaataatatgaatgtcttaatgctactgaaccgaacacttaaaaatagctaagatggtaaattgcatgttatgtgtattttcccacaattgaaacacacacgcgcgcaagcagccagaagagtgcctggcaggtgctcgggacacactgacttattttaagagcacagttgtgattttcaacaaagcaacatcaatgtgggtattacttaattttaaaaataatacaggaccaaaaagcagatacaggggaaatggagggagaaaaggggggaggtgtggctatagacacagaattagaaaaatacaaatcatcactttgttgtatgtttggatacacaagctggaggtggcccaaatacccaacatctgggatttaggattgtggaaagtgcaagcatacttttgtgtggccactctgaattcttgttggctgccctgcccatctaagttta

SEQ ID NO: 126290 - DNA, 601 bp, Human
ctgtttccacaggcctggggcagggcctgagaatttgcatctctaacaggttccaggtgatgctgacactgctggcccatttcaggaccacactttgagaaccagtgagctagagccttgtcactcggtgtggtcctcagaccagcaacatggacatcatctggatgtttggtagaaatgtagtgtctcaggccctcctccaaaccctagacctgccgaatctgaatccgctcagtaacaagcccccaggtgaagtgtatgcacactttgctgggggaatgattggtttccctgccttctrcagagcgcctgccctaagcagtgaccttggcccatcacaccaggggtagcctgtcagtgtagctccactgcccatcacagagtcagcctagagggacctccaaatggatatcagaaaaatgaataatgattcttggccaggcacagtggctcatgcctgtaatcccagcactttgggaggcagaggtgagtagatcacttgagcccaggagttcgagaccagtctgggcaacatggcgaaacccatctctacaaaaatacaaaaattagctgggcgtggtggtgtgcgcctgtaatctca

SEQ ID NO: 126291 - DNA, 601 bp, Human
gtgatttattacataagtccaaggaggatacagtgtgtccagaaacaggcttgacccggtgctggagcacttgaaggaaatttctagagaaactggacagcaaagcgctcatcagctgtgtcattaagccctccaatgagcttggctgggatgcgatctttcacacagcacagggccccacttcacagttggcgtatgcagtcacagttccctagagttctgggggttcctgagtggatctggtggcctgcccagcctgcggtccagttccaaactgcactctcagttataaaaagcaggrgaatggagagggaaggcctctaggggtgatggaaggcaagtctaggggagccttttaaaaccaatctgctcttccagataaagaaagtctccaagcaggctggaagccaagaatttaattgtatttatttttgctattaccttctatttagggcaagggatattggtattctatctatggtagtggtataaagattccttttgtgataaattcatttaagtttttaagtgagtcaatttaaaggaaagtattaagtcaataaagtctagttagcaaaacgcatgaaggtagacccggaaa

SEQ ID NO: 126292 - DNA, 601 bp, Human
cggtccagttccaaactgcactctcagttataaaaagcaggggaatggagagggaaggcctctaggggtgatggaaggcaagtctaggggagccttttaaaaccaatctgctcttccagataaagaaagtctccaagcaggctggaagccaagaatttaattgtatttatttttgctattaccttctatttagggcaagggatattggtattctatctatggtagtggtataaagattccttttgtgataaattcatttaagtttttaagtgagtcaatttaaaggaaagtattaagtcartaaagtctagttagcaaaacgcatgaaggtagacccggaaaatgtttgaagtttatgcaatgacatcccagcctttcttctccccgatagtcattatctgccctggatggcagcaaactcatgactactccttgcaaaacttctctccagagtgactgagttaatccttcagaaagtacctacttacagaaaccatttataactgtgtctggaaacggcccagcacacaacaaaagaatccttgaataaaacaaccttatgaatgattcaaacagtgtccaacaaccctcctccaagaga

SEQ ID NO: 126293 - DNA, 601 bp, Human
gatggcagcaaactcatgactactccttgcaaaacttctctccagagtgactgagttaatccttcagaaagtacctacttacagaaaccatttataactgtgtctggaaacggcccagcacacaacaaaagaatccttgaataaaacaaccttatgaatgattcaaacagtgtccaacaaccctcctccaagagagggtggtcccaccgagaggggaggatgccttaggcccaagaagacctttcacccctgcaacaccactagattagaccctcatctcaccatcctctgaagctccctrcctctctctggcacatctccccacaccatgtttgttgcatggtttcttgcctgcttgttagcttgtagctccttgaaggctaggaccgtttcagatgtgtgccccgttgtacttccagctcctgctacagtgcctggtggaaagtaggtgctcttttggagaaagaagggaaggaaggagggaagggatgaaggggagggagtaagttccttgagggaggctgagataggccccagttactgatattctaggatcacttacatatttctctctatggccaaaggagaaaaaaatgtggta

SEQ ID NO: 126294 - DNA, 601 bp, Human
caatggcgtgatctcagctcactgcaacctccacctcctgggttcaagcaattctcctgcctcagcctcctgaatagctgggattacaggtgtgcgccaccatgcccggctaatttttgtattttgggtagaggcggggtttcaccatgttggtcaggctggtcttgagttcctgacctcatgatccgcccgccttggcctcccaaaatgctgggattacaggcatgagctaccatgcccagctgagtaccgtcttatttagagaagacacccactttcatttttgcccctcatttcatgrggaaagaccagcccacagtttaagtaagtattcctaacaggcgaatccgcagttctatatgggctctgaggtctcgtgcacagaagccaaaggactggagggatgtgaccagatttgggaatcaggcaagctggctccaggcaggctgagatcaagctgataacaaggagattaatgagggcctgcaacctcctcagtcttgtattagggaggagggttttcaaatcaatgctggtctggctggcttaatggtacctaatcttaccttttgaagctcacgcatttgggagttgagatcaa

SEQ ID NO: 126295 - DNA, 601 bp, Human
gaatccgcagttctatatgggctctgaggtctcgtgcacagaagccaaaggactggagggatgtgaccagatttgggaatcaggcaagctggctccaggcaggctgagatcaagctgataacaaggagattaatgagggcctgcaacctcctcagtcttgtattagggaggagggttttcaaatcaatgctggtctggctggcttaatggtacctaatcttaccttttgaagctcacgcatttgggagttgagatcaattgagataaaataaagtaaaatgtgttgactttgggatttgtrgtcttcatcagagtcccattgtgtagtgttgtttttattttctgtcttggaaataggcagagattagctgccggagagggttgttctgtctggactaggtggtctatttacttttgttctgcttttttcattttccgctcgatgattcttcatgagggaagggcccatttctttcctgttcatttctgtatagcgagtgcatgacacctggtacatgctcagtaactatttctcaaatgcagcattgcagcatcaccagcacagactgtgtgccacgagccaccctgctggaaaagccaa

SEQ ID NO: 126296 - DNA, 601 bp, Human
attaatgagggcctgcaacctcctcagtcttgtattagggaggagggttttcaaatcaatgctggtctggctggcttaatggtacctaatcttaccttttgaagctcacgcatttgggagttgagatcaattgagataaaataaagtaaaatgtgttgactttgggatttgtggtcttcatcagagtcccattgtgtagtgttgtttttattttctgtcttggaaataggcagagattagctgccggagagggttgttctgtctggactaggtggtctatttacttttgttctgcttttttcattttccgctcgatgattcttcatgagggaagggcccatttctttcctgttcatttctgtatagcgagtgcatgacacctggtacatgctcagtaactatttctcaaatgcagcattgcagcatcaccagcacagactgtgtgccacgagccaccctgctggaaaagccaatctgctcctgattaggtgcaaaaacagcagccttataaggcactcacagtgcccctggaaaaaggcgtcaggacggtttcctggtacctggtttctgtgatggttaccatgagctttgtgcagtcatt

SEQ ID NO: 126297 - DNA, 601 bp, Human
tcttaccttttgaagctcacgcatttgggagttgagatcaattgagataaaataaagtaaaatgtgttgactttgggatttgtggtcttcatcagagtcccattgtgtagtgttgtttttattttctgtcttggaaataggcagagattagctgccggagagggttgttctgtctggactaggtggtctatttacttttgttctgcttttttcattttccgctcgatgattcttcatgagggaagggcccatttctttcctgttcatttctgtatagcgagtgcatgacacctggtacatrctcagtaactatttctcaaatgcagcattgcagcatcaccagcacagactgtgtgccacgagccaccctgctggaaaagccaatctgctcctgattaggtgcaaaaacagcagccttataaggcactcacagtgcccctggaaaaaggcgtcaggacggtttcctggtacctggtttctgtgatggttaccatgagctttgtgcagtcattgcaaagctgtgtgtgagcaaagtgcatccgatccattttacaggtgcttacaagccctgtgctgagtgctggcgactgaaaagatgagt

SEQ ID NO: 126298 - DNA, 601 bp, Human
gacggtttcctggtacctggtttctgtgatggttaccatgagctttgtgcagtcattgcaaagctgtgtgtgagcaaagtgcatccgatccattttacaggtgcttacaagccctgtgctgagtgctggcgactgaaaagatgagtacagcatagggaaggtgctcatggagtttgtgatctggtgggggagcgagttgtgtaatgacgaggaatgtgtctggaggtgagagtttcggggtctgggctttggttgtggatttgccaccaccaggccattgccctaagggcaggccctaacrtctttgggcctcagttttcgcatttataaaaagtggactcaatggacctacaggtcttcacttgctctagagcaacaaaactggagagctgtctcaaggagttttcctgtgcagtggagttcagcctcactggaaatagcaaatccatttgctgctacacccctaaattccttgccctgaaattttagagcagggcaataaataggtgttggtctattttcacctaccacctgctctacattaaaaagaaaagaaagctgctatatggcaagaggaagacaagctaatatactgggtatc

SEQ ID NO: 126299 - DNA, 601 bp, Human
tcagcctcactggaaatagcaaatccatttgctgctacacccctaaattccttgccctgaaattttagagcagggcaataaataggtgttggtctattttcacctaccacctgctctacattaaaaagaaaagaaagctgctatatggcaagaggaagacaagctaatatactgggtatctgctctttgccaggcactgcatttgacattttcacatctcaatggaacgtcctgataaacttgcaggacggggagcaacagcatcgtcactgctgcacccttcagtccacttagaggaccrttgtgtcacagcaggattggtgttcccgtcaaatgacatcctgtataccgagttttagaaaagcacatgagtgcacgtaacgggatgtagaaaagctattttcaagcatagttaaatgtggtgattttggaagccttcttcacttaactatgaggaaaattcattatcaccaacaaacatcttatgagagtagtatatcagcctaattgccatccctgacctcccatggtgagctgacgtgtaataaaaacaaaaataacaatagcgtgctcatagtactgctgattcctaccgtaggag

SEQ ID NO: 126300 - DNA, 601 bp, Human
cctcactggaaatagcaaatccatttgctgctacacccctaaattccttgccctgaaattttagagcagggcaataaataggtgttggtctattttcacctaccacctgctctacattaaaaagaaaagaaagctgctatatggcaagaggaagacaagctaatatactgggtatctgctctttgccaggcactgcatttgacattttcacatctcaatggaacgtcctgataaacttgcaggacggggagcaacagcatcgtcactgctgcacccttcagtccacttagaggaccgttgygtcacagcaggattggtgttcccgtcaaatgacatcctgtataccgagttttagaaaagcacatgagtgcacgtaacgggatgtagaaaagctattttcaagcatagttaaatgtggtgattttggaagccttcttcacttaactatgaggaaaattcattatcaccaacaaacatcttatgagagtagtatatcagcctaattgccatccctgacctcccatggtgagctgacgtgtaataaaaacaaaaataacaatagcgtgctcatagtactgctgattcctaccgtaggagctcc

SEQ ID NO: 126301 - DNA, 601 bp, Human
acctctgcctctcggatctgactgggtgaagctctggcgtctgtctggagtcaggtgtagtgacccaggtacattggctgcttggccctgtcctctggcttcccttgtcagtttgttcctgtgagactacattccagttttgactcatctcaggttctgacaagcccctaccccaacctcacctttgcacctactccccaatttggagacaatctgtcagacagaggtgtattcaaatcccgcctagagctccctcctcactgtcaatcttggcatgcgatgcttaacatctctaagtcarttggaggaagaaaaatgccgaactcatagggttgggacagggatgaaaagagtaaatccacagcagggactgccatgtggcaagggcccaggcagcattaactctggtaatgattactcttctcaacatccatccatccgagcaaggttcttctcatgcttgcatccagtcacctgattctagcatcaagctggtcacatccctggggccaccatcctctctatgacccgtcaccaccccacccgtacccaccacaagctatcgtggcattagttggacgcagccatttcccatgcccta

SEQ ID NO: 126302 - DNA, 601 bp, Human
tggaggaagaaaaatgccgaactcatagggttgggacagggatgaaaagagtaaatccacagcagggactgccatgtggcaagggcccaggcagcattaactctggtaatgattactcttctcaacatccatccatccgagcaaggttcttctcatgcttgcatccagtcacctgattctagcatcaagctggtcacatccctggggccaccatcctctctatgacccgtcaccaccccacccgtacccaccacaagctatcgtggcattagttggacgcagccatttcccatgccctaartcaacatggctggagttaatttcttccaccctgaacacatatttgggctttcccctagccaatcaggaagtggctcacagggaggacccaagaggcagaacctctcctccgccccctttcctccccagagccctgggctcctaaaagagcatggctgggaaaagtggggacggaggtcatggctgatgcctgaagacacctggggctgttacccttccagaggccagggctggcttcctcttcctattctatctgttggtcctcagcaagcccaggaagcagcctcatcaagtgtcttag

SEQ ID NO: 126303 - DNA, 601 bp, Human
ctaatggactgcactcttcaaaaccaacttacccaaggacagcttttccaaggggacttgtcaaactccacaggcagcaactggtttgttcctttccaaagggcagtagccatcaccttcaacaatactgcaactaacatccacctctgtccagtccttcttattttaatcctacagcaggaaccccaattgacagaggaggacatcaaaactgagagaggtctagggctgcaaaactagaacccatcaggaaccagaactccagtcccctctgccggtggtcccatccatcctccttccrtctgacaccaaggcttcctgagtggtaaccaccatggctgctggagcagaggaagtggccgttgccttagaaccaggcaggtggggaaggggacacatcaaatacccagaagaaaagtgacttcaaagtcctccccaaattgagtgccctccagaaattctctcacgaagaggctgcagctgacattcacagggatgttgtgtctgaatgcgggtacatcaggaagggaacaaaagagagggaagaaagcctggttgaaggcaggggtctttcaagtcccctcgaggcagactcaagagc

SEQ ID NO: 126304 - DNA, 601 bp, Human
ggaagggaacaaaagagagggaagaaagcctggttgaaggcaggggtctttcaagtcccctcgaggcagactcaagagcaaagcatggcacactggatgggcgttctgcttctctttaaagagcatggatttatccataccatgtgacatgaatgaaatgaggagttttcagggctgccaacctcttggttaaggttctgtgtagtatatttctcctacaatagaaaaggaaaaatgacatctgaggttaacaatgtatctgcagtgcaaggcccagtgactgtcaataatggacgctgartaactaagcaatggcggattgcatgaattttcatataaaactgctcctatacatcgctttgagtgtctgggtcacgccttatccttatagtgtaatgtgagcggagagtctagcttgaatattttcccacttagctaacttgccatctcacaactatttgctgagtaacccttgcttcctcttaattctctggggcctcctcgacatatatttaggcaggaggtgaagggcaggacgcagggggccactttctgcaggcataggaggttgggcttcatgcagaccacaatcaaatccttg

SEQ ID NO: 126305 - DNA, 601 bp, Human
agagggaagaaagcctggttgaaggcaggggtctttcaagtcccctcgaggcagactcaagagcaaagcatggcacactggatgggcgttctgcttctctttaaagagcatggatttatccataccatgtgacatgaatgaaatgaggagttttcagggctgccaacctcttggttaaggttctgtgtagtatatttctcctacaatagaaaaggaaaaatgacatctgaggttaacaatgtatctgcagtgcaaggcccagtgactgtcaataatggacgctgagtaactaagcaatggyggattgcatgaattttcatataaaactgctcctatacatcgctttgagtgtctgggtcacgccttatccttatagtgtaatgtgagcggagagtctagcttgaatattttcccacttagctaacttgccatctcacaactatttgctgagtaacccttgcttcctcttaattctctggggcctcctcgacatatatttaggcaggaggtgaagggcaggacgcagggggccactttctgcaggcataggaggttgggcttcatgcagaccacaatcaaatccttgctctgctgctttgct

SEQ ID NO: 126306 - DNA, 601 bp, Human
acatctgaggttaacaatgtatctgcagtgcaaggcccagtgactgtcaataatggacgctgagtaactaagcaatggcggattgcatgaattttcatataaaactgctcctatacatcgctttgagtgtctgggtcacgccttatccttatagtgtaatgtgagcggagagtctagcttgaatattttcccacttagctaacttgccatctcacaactatttgctgagtaacccttgcttcctcttaattctctggggcctcctcgacatatatttaggcaggaggtgaagggcaggackcagggggccactttctgcaggcataggaggttgggcttcatgcagaccacaatcaaatccttgctctgctgctttgcttgctgggtggccctgggcaaatcacttaacctttttgagcctgggtgtcctatttccaaaaccaagtcagaaataagaaagttactatgggcctggcatggtggctcacgcctataatcccagcagtttgggaggctgagcccagaagatcacttgagcccaggagatcaacaccaacctgagcaacatggcaaaacccaaactctactaaaaataacaaac

SEQ ID NO: 126307 - DNA, 601 bp, Human
gggtggccctgggcaaatcacttaacctttttgagcctgggtgtcctatttccaaaaccaagtcagaaataagaaagttactatgggcctggcatggtggctcacgcctataatcccagcagtttgggaggctgagcccagaagatcacttgagcccaggagatcaacaccaacctgagcaacatggcaaaacccaaactctactaaaaataacaaacaaaaaaaaaatatggggcatggtggcacacgcctgtagtctcagctacttgggaggctgaggtgggagaatcagctgagcccrggaagtcgaggctatggtgagccatgatcacgccactgcactctagtctgggcgacaggagtgagaccctacctcaaaaaaaaaaaaaaaaaaaaaggcttcggtagagtgcctggcacatggaggggctcaagggaatgaagttcttaatatttttaattgatgtcttggaatctgcatccatgtctaaggaagagacaggcaagagaatttttgtcctgtctgggacaagaatgatcatttgggatggtggaggcatcactcttacagagtgaactttgattgagggggagagaagct

SEQ ID NO: 126308 - DNA, 601 bp, Human
aaaaccaagtcagaaataagaaagttactatgggcctggcatggtggctcacgcctataatcccagcagtttgggaggctgagcccagaagatcacttgagcccaggagatcaacaccaacctgagcaacatggcaaaacccaaactctactaaaaataacaaacaaaaaaaaaatatggggcatggtggcacacgcctgtagtctcagctacttgggaggctgaggtgggagaatcagctgagcccgggaagtcgaggctatggtgagccatgatcacgccactgcactctagtctgggygacaggagtgagaccctacctcaaaaaaaaaaaaaaaaaaaaaggcttcggtagagtgcctggcacatggaggggctcaagggaatgaagttcttaatatttttaattgatgtcttggaatctgcatccatgtctaaggaagagacaggcaagagaatttttgtcctgtctgggacaagaatgatcatttgggatggtggaggcatcactcttacagagtgaactttgattgagggggagagaagctgtttagtttgaaaatatatatgtatatattcaaacggtatagaaaaactgtag

SEQ ID NO: 126309 - DNA, 601 bp, Human
ggcacccttctgcaggtatgtccaggacgccgaggcagggtgagaggcccaggctcgttgtatagtagggagctccaaaattgggatgggggaaccagcaaaggctctatagccatgagcaccatagagaagtagtcctctctgcccacaacttttcactaggtccagttcaaccaacagcatacatatatgtattgccctgggttttaattgctttggtttctgggattttgagtgttaaggatttcagaatgcagcattatcttagaagtctgttttttgttgttgctttgtttgtttstttgagatagagtctcgctctgtcgccaggctggagtgcagtggcgcgatctcggctcactgcaacctccgcctcctgagttcaagcgattctcctgcctcagcctccggagtagctaggattacaggcgtgcaccaccacgcccagctaattttttgtattttgattagagacggggtttcaccatgttggccaggatggtctcgatctattgacttcgtgatctgcctgccttggcctcccaaagtgctgggattacaagtatgagccactgcacccagccagaagtctgtattttaa

SEQ ID NO: 126310 - DNA, 601 bp, Human
caacagcatacatatatgtattgccctgggttttaattgctttggtttctgggattttgagtgttaaggatttcagaatgcagcattatcttagaagtctgttttttgttgttgctttgtttgtttctttgagatagagtctcgctctgtcgccaggctggagtgcagtggcgcgatctcggctcactgcaacctccgcctcctgagttcaagcgattctcctgcctcagcctccggagtagctaggattacaggcgtgcaccaccacgcccagctaattttttgtattttgattagagayggggtttcaccatgttggccaggatggtctcgatctattgacttcgtgatctgcctgccttggcctcccaaagtgctgggattacaagtatgagccactgcacccagccagaagtctgtattttaaaggctgtctcctttataagatgggtgcagatcagaggacgagtcctgcttcagttggtagtccctgtttatgaatcctttctggttggcgtttctgttcacttggatgataagttatattgtccccccgccggttataggtgacccacagtttcattatgagaaagaggaagga

SEQ ID NO: 126311 - DNA, 601 bp, Human
cacagtttcattatgagaaagaggaaggatcaggaacgattgcagtgagaaatgcttggcatccaggtgacttgtttacttgcattttgatgtgcagatgcctctaagtacctttatgtaaagactagggaaattggctggaacataatgaaagcccaaagttctcagggatgttttctgaagttgagcaaaggagagagccaagggtgagctggtacctttttgtacaccaataaaagctgattaacaagcaaaagtttgctggaatcgaagcaaaaagataaatccaatcaagctaatrtttaaattgaaggcagaagggatggcaagaaaagaactgagcagtcaataaggagagctcaggagtcatcataaaaagagagacacccaaaattctccccattggcccctgcaacaccctcagacgcccaataccagagatggcaactgtcatggaaacaacactatcaaggctgaaaccagcataggtctccagagctgctgtgcccagcggtgtctcagtatctatgaggttcaagagcttcagtacaaggctaagacttgctgtataggaaaagtatctcaaaggctgttgagcacc

SEQ ID NO: 126312 - DNA, 601 bp, Human
gcaaaatcatgtgccctcccccacaaaattacattattctcattaccaggcctagtgaagttttttatgacaaaaacgtggtctcaattatgactatagcttaaattttgtcaataaattattggtagaaacttattttctctcttgttacttaagtacctgcatagtaccatctgtttttcctcttgtcccatacagcctaaaatatttacatttggcctctttggaaaaagtttgctgactcatatcctagagaatacagaacactggagctgctatggaatgtgattagaaagcctgrctgtattataagtagtgaatggcatggacaatagcctctagttcttacagttcaggaaatatgaccttgatgttcaagcctccagatgtccttagcagttacatcacttctgaccagctggtaggcaggtacaagtccttcatcaaggactactcggtggtgtctactgaagatgccttggaccaggatgaccgagaaacttggcagaagctctctgctagtgcaggttatatccatgtgacagggaatcatctccctgtgcccagccggaaaggaactaccaagactacagacaaggac

SEQ ID NO: 126313 - DNA, 601 bp, Human
tacctgcatagtaccatctgtttttcctcttgtcccatacagcctaaaatatttacatttggcctctttggaaaaagtttgctgactcatatcctagagaatacagaacactggagctgctatggaatgtgattagaaagcctggctgtattataagtagtgaatggcatggacaatagcctctagttcttacagttcaggaaatatgaccttgatgttcaagcctccagatgtccttagcagttacatcacttctgaccagctggtaggcaggtacaagtccttcatcaaggactactcrgtggtgtctactgaagatgccttggaccaggatgaccgagaaacttggcagaagctctctgctagtgcaggttatatccatgtgacagggaatcatctccctgtgcccagccggaaaggaactaccaagactacagacaaggactcgggcaactgcctcctactcaaggtgaatcagacagaccccatgatggaatctcttcaggagtgcaaagtggcccaggccgaaggatagggcgctatttcccactgtgttggggtgactgaagattcttgcattgccaaactcatggtgaggatc

SEQ ID NO: 126314 - DNA, 601 bp, Human
atgtaatcccaggtactcaggaggctgagacaggagaatcacttaaacctgggaagtggagggtgcagtgagctgagatcacgcccctatactccagcctgggctatggagcaagactccatcttaaaaacaaatggttaagatgttgtcttagtccattttgttttgctatgacagagtatcacaggctaggcaacttagacagaacaaatttatttctcatagttccggaggctgagaagtccaagagcaaggcaccagcagggcagggcccagtctctttgcttgcaagatggcacgktgagcactgcctcctccaaaggggaggaccactgtgtcctcacgtgacagaatggcagaaaaaagtgaacccactcccaaaagtcctctttatagtggcattaacccattcatatgggcagagcccttagacctaaacacctgccattaggccccacctcctaacactgttgcattggaggttaattttcctattcgaccataaattttgaagggaacgaaacattcaagcatagcagatggtaaatttcatgttatacgtattttaccacgattttaaaaattgggattcaggggaaga

SEQ ID NO: 126315 - DNA, 601 bp, Human
aggcataaacctcagtggctttaatgtgcaaattgaaaaaaagcattcattagtctcccaaaaatgtgaaggaagaaccatctgcaaattcatgaattgtgctttagtttcatcttctattctcaagactaatcacctgtttaagttggctctagactcttaattaaaattgtcagctcctgaaagttcattctgagcctgactctcccatgagaaactgtaaacgtgggaaattctaacacagctaggagattccaacatactggaccttaccttacctataaataactgggcttggtgyatatatcaaaatatcatgatgtaccccataaatatacacagttacgaattttcaattaaaaaattattaaaaatgaaataaaataaacaattgggcttggatgaagaggctaagcaaaaatgcagttttcaggttttgctacttgcttttcactagaatagatccagctgtgtgtggtgtgattttgttttacatttttttaacataccatttttatttactatcatcgtttactgtgtacattctactaggagagaatataatgtccatagtgtgaaaaaaagtttgacattctttttt

SEQ ID NO: 126316 - DNA, 601 bp, Human
agcatctctgtttctacaatttcagcactctataaattatctttagcaaatgtttcttacccgatcatcttctatcaatcaaccaggcaggtatcagcagttccccatcgcaaggaatataagcttattttaataacatttgaggcaaaacctaattagaaaaaacaaatccctcatcaattcctgtgatttattctagagccaaacatctgcagcccagtttctttgaatgatggtcttccctgttctatgaacaactgagaggtgaagcagtgtcttgtacaagtgtaaataatgtgcrggaacacagcacataaactgcagggacgacttcagaagaaaacccccacttaactcttgaagcctgatttgcttcactgagtcccaatggggcaaagcactgtgcaaggctaagaaagtgaacaagacaggcttctattctgttttactgtaggttctgttattatttaggtatgtcaaggccaacagatgaagcaatgactgccacgaagaagatagtttgttatactcacatcacggggctctacacaaggagatactggggttggtctggaggcaggaggagggggaaactggtaag

SEQ ID NO: 126317 - DNA, 601 bp, Human
gatagggatctgaaaattactaaagtttgggaaacatttgttaaatccgtgatgttttttctgtctagagtaaggtgacactcaactgtttttctcccaactcaaccaccagatcattaaccaactattccaaactatttatagaattaactctgcttgacttaatgtctggccaagcaggtctcccctctccccaaggagggctgattttgagggttagggtccagctggtggcatgtgagcagacagtgacccacgggccatagcacatccagcaatgcccttgggacccaacccaggkgaatgtgggttacaggacaggagctgacccgacattcccggaccccaacatggaagtacaagaacactgttatcccaaggagatatttccaaggggaaatggggagggacaaaaataaatattaggcatcaaattaaaatgagaagacccaacgttactctttgtaattgagaactagatttgtagtgatgaaatctggaaccttaagggagaactaaagtgagacactgggtaggtcataataccctttctgttgtctaattatctgcctatgaaatgggtaaatatagcctgttgcca

SEQ ID NO: 126318 - DNA, 601 bp, Human
gaaatctggaaccttaagggagaactaaagtgagacactgggtaggtcataataccctttctgttgtctaattatctgcctatgaaatgggtaaatatagcctgttgccaaataatgttgaaaagacaatttatctggaaaagacatgtacatataagcatgcacacacatgtgtgtgcacatacaatgtgatatatacaagtatgtgaatcctaaggaaatcagatacaaaatccagacttaaaaccagtgtgtggataggcaataactccccccgcagtgttctcatttaatgacaagrttcctttcaatacacagcttccccagtgattttcattatttatttggagtctgccaacaccttgactgaaaggctaaatggaactttaaaaactgagaaaagcacccagtacctccccacaccgcataccccatcattttttaattaataaaaataatgaatctcacatacaacttttctaaaacatgcagggcaaaaagtcgggggtactcgaggcacatgtatttatccatccaccaacctaacgtgtcagtgaagcgggatgaaaccgtgtggccagacagaatgggatttggcaga

SEQ ID NO: 126319 - DNA, 601 bp, Human
cccactttgtaatgcctgggacaccaatgagcttactcaaacttgcatgtttgctgagcaatggagaccctgaagggaaccagcattttcactcaatttcattgtggtaaatggctcgtccaggaggttaagatggaaaataaagcattcgggaactttgctgagacctcttaaaatatttagggagtcaacacagtaatgttaaccctgattattgaacgtacgctccaaattctgaaagagtgtttctacttcatgtaatggtgcagaacagtcattgccaggggacagcttgatgcargacagcgtgcaaacccaggcttgcccctggctgtggctacaccatgcttctgagtccccattctccatcaatgacaagtgccccatagctatggcctgtagtcttataagcttgagcttaaggagcggtggaaggaagtgccaagttatatgatgtaaacaaaggctactactcaaaatcagggccttgtttttctttctaaatatcctattttggtcattgtgggaataagaggtccatatgatgcagaggattgtctattatttgcccttccatatttttttagatctcttttctgta

SEQ ID NO: 126320 - DNA, 601 bp, Human
agggaaccagcattttcactcaatttcattgtggtaaatggctcgtccaggaggttaagatggaaaataaagcattcgggaactttgctgagacctcttaaaatatttagggagtcaacacagtaatgttaaccctgattattgaacgtacgctccaaattctgaaagagtgtttctacttcatgtaatggtgcagaacagtcattgccaggggacagcttgatgcaggacagcgtgcaaacccaggcttgcccctggctgtggctacaccatgcttctgagtccccattctccatcaatracaagtgccccatagctatggcctgtagtcttataagcttgagcttaaggagcggtggaaggaagtgccaagttatatgatgtaaacaaaggctactactcaaaatcagggccttgtttttctttctaaatatcctattttggtcattgtgggaataagaggtccatatgatgcagaggattgtctattatttgcccttccatatttttttagatctcttttctgtatgagacctgtgaagtacatctgtccctgaccctgcatgactgactcgagaaactgttccctctgtccctgaca

SEQ ID NO: 126321 - DNA, 601 bp, Human
tctatctaacccaacacctgatatgttaaaggtacttatttgatgcttgttactactactgtggatatatctgtggcatgaaaagaaggtcactgggagtgaagttcaggagtcgggaggtgaagcaacttaagcctgaaatgtacctctagtgtcattttggaaatgggggaggggactggaaacaggagaacacattcattgaaaaggaatatctcaactcaccaatccaacgtgtttgtgcagcacacagcatgtaaaacctgtgaaccgaggtggaccctggagttttctaatccaycccctttattttacagataagaaggcagagtctagaaatctgaagtgacttttccaagtcccccaggtagactgcaactgagccagggttaaaatcccttaagaccatgatgggctatgcaggatgccatccaaattcaccctggaaagtggagagagaaatggaattttaccattacccacaccagcatttatctctctccctttccagcctttgccatcttgtgtccaggagaagtctggaaacctttcctggaggtttccaagcaggtctcctctccaggcatccacgggagaattc

SEQ ID NO: 126322 - DNA, 601 bp, Human
ttctaatccaccccctttattttacagataagaaggcagagtctagaaatctgaagtgacttttccaagtcccccaggtagactgcaactgagccagggttaaaatcccttaagaccatgatgggctatgcaggatgccatccaaattcaccctggaaagtggagagagaaatggaattttaccattacccacaccagcatttatctctctccctttccagcctttgccatcttgtgtccaggagaagtctggaaacctttcctggaggtttccaagcaggtctcctctccaggcatccaygggagaattcctctgcagctccttctttcctgagcctagtgccatccagtgtgccccagtctctgagaagcatcaccctagactgaacccaccttaagccatgagacaccagagcccagtcactgatttctgatgagtacatcagctagcctcttagtgcgataactcctcatcaccaacattaaagcatttctgttgtgcgtgcctactgaggtaggcttcaacaaagctggggtgaagccgctaattctgtgtcgctgaggtcagtgcccctgcctgtgttctgcatagaagttggtg

SEQ ID NO: 126323 - DNA, 601 bp, Human
acttttccaagtcccccaggtagactgcaactgagccagggttaaaatcccttaagaccatgatgggctatgcaggatgccatccaaattcaccctggaaagtggagagagaaatggaattttaccattacccacaccagcatttatctctctccctttccagcctttgccatcttgtgtccaggagaagtctggaaacctttcctggaggtttccaagcaggtctcctctccaggcatccacgggagaattcctctgcagctccttctttcctgagcctagtgccatccagtgtgccccmgtctctgagaagcatcaccctagactgaacccaccttaagccatgagacaccagagcccagtcactgatttctgatgagtacatcagctagcctcttagtgcgataactcctcatcaccaacattaaagcatttctgttgtgcgtgcctactgaggtaggcttcaacaaagctggggtgaagccgctaattctgtgtcgctgaggtcagtgcccctgcctgtgttctgcatagaagttggtggtatcaaaaggatgcagcaatgccagctcctgctagagcctcatgaggtggcagccag

SEQ ID NO: 126324 - DNA, 601 bp, Human
gagagaaatggaattttaccattacccacaccagcatttatctctctccctttccagcctttgccatcttgtgtccaggagaagtctggaaacctttcctggaggtttccaagcaggtctcctctccaggcatccacgggagaattcctctgcagctccttctttcctgagcctagtgccatccagtgtgccccagtctctgagaagcatcaccctagactgaacccaccttaagccatgagacaccagagcccagtcactgatttctgatgagtacatcagctagcctcttagtgcgatractcctcatcaccaacattaaagcatttctgttgtgcgtgcctactgaggtaggcttcaacaaagctggggtgaagccgctaattctgtgtcgctgaggtcagtgcccctgcctgtgttctgcatagaagttggtggtatcaaaaggatgcagcaatgccagctcctgctagagcctcatgaggtggcagccagtggggcatgccagaaacatcggtgctcctttgaaaattccagaacctcacgagatggatatctgtctcttctacaccttgtttctataaatgggcaatctgtggct

SEQ ID NO: 126325 - DNA, 601 bp, Human
aaagctatcgacccacagtcacacagcttatgaaatctttccactgtacccaatgcgtcttgcatgaaaacagtaaaaattccaaagggttaggtcttgtgtaccctctcggaagctcccttaagcctgcatgctaggaagagttcctctgccttactcaaaactcgtcaattctctatcctctgcgaagttacagatatttgaattcaagagaagtgatatcagccagaaggagtcagaaatattgaggaatggaggtgggtgcatgaagggaatgtgtgagacaacatgcacccctaarcgaagtccttctctacctgcaaaagtcaaactagggccaagcatggtggctcatgcctgtaatctcagcactttgggagaccgaggcaggcaaatctcctgaggtcaggagttcaagaccagcctggacaacgggcgaaaccccatctttactaaaatacaaaaattagccgggtgtggtggcattcgcctgtaatcccagctactcaggaggctgaggcaggagaattgcttgagcctgggtggtggaggttgcagtgagctgagatcatgccactgcaccccagcctgggtgacagag

SEQ ID NO: 126326 - DNA, 601 bp, Human
tgccttactcaaaactcgtcaattctctatcctctgcgaagttacagatatttgaattcaagagaagtgatatcagccagaaggagtcagaaatattgaggaatggaggtgggtgcatgaagggaatgtgtgagacaacatgcacccctaagcgaagtccttctctacctgcaaaagtcaaactagggccaagcatggtggctcatgcctgtaatctcagcactttgggagaccgaggcaggcaaatctcctgaggtcaggagttcaagaccagcctggacaacgggcgaaaccccatctytactaaaatacaaaaattagccgggtgtggtggcattcgcctgtaatcccagctactcaggaggctgaggcaggagaattgcttgagcctgggtggtggaggttgcagtgagctgagatcatgccactgcaccccagcctgggtgacagagcccgcctctgtctccaaaaaaaaaaaaagaaaaaagtcaaagtggagcgtcaggtttagaactcactaacaggatttcatcttttttaacttggctgtttcaagataaatggagaggacacagatgtttggtttgaactctttaaagct

SEQ ID NO: 126327 - DNA, 601 bp, Human
gcagtgagctgagatcatgccactgcaccccagcctgggtgacagagcccgcctctgtctccaaaaaaaaaaaaagaaaaaagtcaaagtggagcgtcaggtttagaactcactaacaggatttcatcttttttaacttggctgtttcaagataaatggagaggacacagatgtttggtttgaactctttaaagcttcagaatgtgtcatcacaaatccacttattctaactgggagaatctgctgtcagcacagacaaaaagaactttggatgtgacccacatatatctgtgtgcatccrgcagcaaggcggctaactcttacactgcctttaaagatagaattgtaacctagtttatagaaacctactagcatagatttcaagcctctgaattcaagccagtcctataatacctggtgttcctgagtcagatggaaagggggtgtttacccagaatcgtgatccacccagggagtataaagccagccagttctttcattcactccaggctcccccgggatcgatttcaacctaaattcaacaatacttatttattgagcacccgctatgttagaccattagggaatataaaatgaatgt

SEQ ID NO: 126328 - DNA, 601 bp, Human
ttcactccaggctcccccgggatcgatttcaacctaaattcaacaatacttatttattgagcacccgctatgttagaccattagggaatataaaatgaatgtgggagatcccttgcgtacagtctcctatgagggacagacacagcacagatgactgtgtaacaaggtccatgtttcaaggagcatatctcagaattaccctcaagagagtgatggggctgccagggaggagggtgaagccacaggctacaatgacattgtcctggtatgagttcttgttttctcttttaagtttgtaagmccatcatttgatactttgttgctcatatacctgctccttgtagagtttcttatcaatagcttgaataagaaatattactcttctgacagtgactgccaggttttaccaggaaaaaaaaaatcactaggggcaggggaagaagaataagtttatcaccctccttcctgtctccaacaatgtatgtaggttataccttagggacagagtttctgcattactggaagataaatagacttccttctcttctcaggtaataactgcaattttgctcttctggagaagtttacattcaagcccgtg

SEQ ID NO: 126329 - DNA, 601 bp, Human
ttctggagaagtttacattcaagcccgtgcaaaaacaaaactattagacttgtcgtcggcttgctaacacatcatgtctaccctctttctttttttttcccttccagagctgaagttgtaataaacggctcctcatcaccagctgttgttgacagaagtaatgaaagcatcaagcacaacatccagccagcctcgtccaaatggagacataaccagacgctctctctgaggatcaggtactggtaattacctacaggacaagaggtagacttggtcttgagcatacacgggcaaattgctkctcttcgtcatctaaagaagtcaggatagaaataaaatgtttacctcccactgaggcaggtttcatctgtaagtgatcaatcggaaataaaaacccgagacaagcctagcggcccagcctgtgtatgtggcgactggggccaggcggtggcaggaacacccgctgaggttctgggcttagaagcagcaaaccttgagtctcgggtcagcagcagagggaatctgggcagtggaggccacaggtggctgcttcttcccaggcataaagagtccttacttgttggggtctgcctgggagtca

SEQ ID NO: 126330 - DNA, 601 bp, Human
gaggcaggtttcatctgtaagtgatcaatcggaaataaaaacccgagacaagcctagcggcccagcctgtgtatgtggcgactggggccaggcggtggcaggaacacccgctgaggttctgggcttagaagcagcaaaccttgagtctcgggtcagcagcagagggaatctgggcagtggaggccacaggtggctgcttcttcccaggcataaagagtccttacttgttggggtctgcctgggagtcacatcccctttcagtgacagtcctccagtttgttcctggagagctgctccctcyctcagcccttgggcttgtataggctgctcctccctaacaacgtgaaaatgaaaacctagagccataggggcatccggagaacccaggaactgacatgacacccgaccagaaagcagaggtctgtttagccagagagcagctctcgtcctgatctgtgcagagtgatgttttcagagcactgcagccatcatcgggtagtggcaatggggaaccgtagagaaggaattacaacttcggcattttggacacttagcttagatatagccatgattgacccagcaaatatttgtaagtataatc

SEQ ID NO: 126331 - DNA, 601 bp, Human
agaagcagcaaaccttgagtctcgggtcagcagcagagggaatctgggcagtggaggccacaggtggctgcttcttcccaggcataaagagtccttacttgttggggtctgcctgggagtcacatcccctttcagtgacagtcctccagtttgttcctggagagctgctccctctctcagcccttgggcttgtataggctgctcctccctaacaacgtgaaaatgaaaacctagagccataggggcatccggagaacccaggaactgacatgacacccgaccagaaagcagaggtctgtttagccagagagcagctctcgtcctgatctgtgcagagtgatgttttcagagcactgcagccatcatcgggtagtggcaatggggaaccgtagagaaggaattacaacttcggcattttggacacttagcttagatatagccatgattgacccagcaaatatttgtaagtataatccaactattcagttccaggcatcgtgctggggccccaggagtgctagcatgaatcagacatgctagctggggacatgaatataagcaaagacaagacagcgtggtatgacatacacatgaggtggtg

SEQ ID NO: 126332 - DNA, 601 bp, Human
aagcagcaaaccttgagtctcgggtcagcagcagagggaatctgggcagtggaggccacaggtggctgcttcttcccaggcataaagagtccttacttgttggggtctgcctgggagtcacatcccctttcagtgacagtcctccagtttgttcctggagagctgctccctctctcagcccttgggcttgtataggctgctcctccctaacaacgtgaaaatgaaaacctagagccataggggcatccggagaacccaggaactgacatgacacccgaccagaaagcagaggtctgtttarccagagagcagctctcgtcctgatctgtgcagagtgatgttttcagagcactgcagccatcatcgggtagtggcaatggggaaccgtagagaaggaattacaacttcggcattttggacacttagcttagatatagccatgattgacccagcaaatatttgtaagtataatccaactattcagttccaggcatcgtgctggggccccaggagtgctagcatgaatcagacatgctagctggggacatgaatataagcaaagacaagacagcgtggtatgacatacacatgaggtggtgct

SEQ ID NO: 126333 - DNA, 601 bp, Human
gaggcaaggaataggggggtaaggttgggacgataggcaggaccagacggggaatgattgatgaccatcccaggccataccatggggagagaggagagcagccatcagcaatgtcaccacgcagagcagggagttgccccctccacaaggctcactgtcaaaatggaaatgcctctgcaccctagttcttgaagcttagttttgggacctgtgcagggctggggaattgaaaggcatgagctctggggacctagcagctgagaaaccatctgaagtagctgactccctgccaccctgcactccttacttaccgcctcttcagaggcctcctggtggccctccatccccctcacgaagccctaacaaccgccccctttgatcagggacaccgtggagtcagcaaccccaactgcattagctccctagggctgctgtaacaaattaccaacaacgcggcggcggcctaaaacaacagaaatgtattcttgcaccgctctggatgccacaattctgagcacccccttgcaggctccaagggagaacccatcctctcaccgcttccagcctctggtggccgcagaactccaacccctgcctccat

SEQ ID NO: 126334 - DNA, 601 bp, Human
gcagctgagaaaccatctgaagtagctgactccctgccaccctgcactccttacttaccgcctcttcagaggcctcctggtggccctccatccccctcacgaagccctaacaaccgccccctttgatcagggacaccgtggagtcagcaaccccaactgcattagctccctagggctgctgtaacaaattaccaacaacgcggcggcggcctaaaacaacagaaatgtattcttgcaccgctctggatgccacaattctgagcacccccttgcaggctccaagggagaacccatcctctcrccgcttccagcctctggtggccgcagaactccaacccctgcctccatcttcacgtggccctctcctctgtgcttctatcttcttctcttctgtctcctataaggacacctgtcattgtatttaaggcccacccgggtaatccaggatctaatctccagatccttaagttaattacatccgcaaagatgttcttttgacatgtggtcacattcacaggttccaggggttaggaggtgggcatatattttagagggggtcaccattctccccactacaccaccgtgaatgaaatcctcctgc

SEQ ID NO: 126335 - DNA, 601 bp, Human
gatcagggacaccgtggagtcagcaaccccaactgcattagctccctagggctgctgtaacaaattaccaacaacgcggcggcggcctaaaacaacagaaatgtattcttgcaccgctctggatgccacaattctgagcacccccttgcaggctccaagggagaacccatcctctcaccgcttccagcctctggtggccgcagaactccaacccctgcctccatcttcacgtggccctctcctctgtgcttctatcttcttctcttctgtctcctataaggacacctgtcattgtatttarggcccacccgggtaatccaggatctaatctccagatccttaagttaattacatccgcaaagatgttcttttgacatgtggtcacattcacaggttccaggggttaggaggtgggcatatattttagagggggtcaccattctccccactacaccaccgtgaatgaaatcctcctgccagtatgagctacccatggtccccaatgtccctttctccaaccattggatagagaaatagctcccccaccccttgtgaagacgagactgtgtccttcataaagaccctgcaaacacagtccctt

SEQ ID NO: 126336 - DNA, 601 bp, Human
cgctctggatgccacaattctgagcacccccttgcaggctccaagggagaacccatcctctcaccgcttccagcctctggtggccgcagaactccaacccctgcctccatcttcacgtggccctctcctctgtgcttctatcttcttctcttctgtctcctataaggacacctgtcattgtatttaaggcccacccgggtaatccaggatctaatctccagatccttaagttaattacatccgcaaagatgttcttttgacatgtggtcacattcacaggttccaggggttaggaggtggrcatatattttagagggggtcaccattctccccactacaccaccgtgaatgaaatcctcctgccagtatgagctacccatggtccccaatgtccctttctccaaccattggatagagaaatagctcccccaccccttgtgaagacgagactgtgtccttcataaagaccctgcaaacacagtcccttcagcagcaacaatgtacctttacccagagggaaaaagaatttcctccagcttcaattaatcaccaagattattcataataaaagattctgcaagtgatttggaatgatgtttaa

SEQ ID NO: 126337 - DNA, 601 bp, Human
aataattgatggtaatttctcctaattagttagaaattaattcactcacagaggtgtttatttatgggctttctaggggctctctttgtttttaaatgctttggggtaagtaattgcaaaggtttcagcaatttcccaactatattagtttgtcaagtcatataatccttggtaaagcacagtaaataaaaacagtgcctctgttttccatcaacagatacgaattattctacaagggtggtttcccctacatgatagcaagagaggcaggtcatcaataaggaaagacaatggatgagamgcgccgagcttaccaagtgttctagctgccccctggctgccccggaggctcttgaacctggacacacattaaagtcacccggggagcttttgagagcaatgctgagaactgggccactctcagaatcaagatttctcacatgtcagcctggaaatttgaaatacttaaaggttccccaagtgactgaatgtgcagcctactggaacgtaccataggttgtgaacatctcaaatccagcaggctttcaggcctcagtgttactatctgcgagatgggacagccatcctgcagcgtctaaca

SEQ ID NO: 126338 - DNA, 601 bp, Human
aactcgggggtcttgctgaacagcggctgtgggcaggagattgacgcccacagcttcgtcatcaggtaacatgccccagcaggcactctggggccagagcggcgggcaggctgtgtttcagtggagcattgccagctgtcccaagagattgaaacaagaggccctggtggagttagcccctgctctcaaccatgactgctcatcagaatcacttggggagcttcgcctccaatgtccagaatgtacctcaaaccaattaaatcaatggaggagaggggaagagaggcgtggcaggggtgcrggcaacccagggagcccaggtcattctgatttacagccaaggttgagaatcactgatccacagcaaagatgggcagatgctggcctgcagcctaaagtttggttggaacacagccatgccacccgttttcatatcattgatggctgttgtctcactacaaggagagtggagtcactgggcacggttaaatcattgggtgaaattgcagagtcagaacagagagatcatatcacctgcaaagccaaaaatgtcattatctggcgctttatagaaaaagtttgctgatcccctgaggtagag

SEQ ID NO: 126339 - DNA, 601 bp, Human
cagcggctgtgggcaggagattgacgcccacagcttcgtcatcaggtaacatgccccagcaggcactctggggccagagcggcgggcaggctgtgtttcagtggagcattgccagctgtcccaagagattgaaacaagaggccctggtggagttagcccctgctctcaaccatgactgctcatcagaatcacttggggagcttcgcctccaatgtccagaatgtacctcaaaccaattaaatcaatggaggagaggggaagagaggcgtggcaggggtgcgggcaacccagggagcccagktcattctgatttacagccaaggttgagaatcactgatccacagcaaagatgggcagatgctggcctgcagcctaaagtttggttggaacacagccatgccacccgttttcatatcattgatggctgttgtctcactacaaggagagtggagtcactgggcacggttaaatcattgggtgaaattgcagagtcagaacagagagatcatatcacctgcaaagccaaaaatgtcattatctggcgctttatagaaaaagtttgctgatcccctgaggtagagcctggtacaaaaggttggta

SEQ ID NO: 126340 - DNA, 601 bp, Human
ccatgactgctcatcagaatcacttggggagcttcgcctccaatgtccagaatgtacctcaaaccaattaaatcaatggaggagaggggaagagaggcgtggcaggggtgcgggcaacccagggagcccaggtcattctgatttacagccaaggttgagaatcactgatccacagcaaagatgggcagatgctggcctgcagcctaaagtttggttggaacacagccatgccacccgttttcatatcattgatggctgttgtctcactacaaggagagtggagtcactgggcacggttaartcattgggtgaaattgcagagtcagaacagagagatcatatcacctgcaaagccaaaaatgtcattatctggcgctttatagaaaaagtttgctgatcccctgaggtagagcctggtacaaaaggttggtaagaaaatctcctgggctggccagttgttggttcaagtttgcaaaactctttgtaagtgtcttgggagggggtgccctactagtgactttattaccctgttctcaaaatctgggaagtgcgggagtaacagagaaacttgaattttgtacctgactataattttctctaa

SEQ ID NO: 126341 - DNA, 601 bp, Human
tgcctttctgggcctcagttttatcatctgtaaaacgggctgggtggactggctggccttgaggttctttcattatgaatacagtctgtactccagcccagtgcttctcagactttaccatggacaggagtcacctgggcctattgacatgcagagttttggggtctagggtacagccggcaactcagcatttctaacaagcaccccaggggacgccactgctggtgtgtgactgcacgtggacaggtgcagccggggtgtgctctgcctcactcctgggagtcacgtccacacccatccrcacatacttggaaaatatgggtcaaaaatgccaaggagcaagttacttcaaaaagtgcagttgttctttgtcccttaggcctatgtccatggctctgaaactcccacgtgtctctggggtggacctgtggggtgttttaggacaagattatgcagccccactgggtacagacttacgtttgacatcagggatacgatacccagcagtggcactagctcctccaccccactgggactattcctctgggttcttcccatctaggagtttattccgtgccctgcacttggtaatatcctacag

SEQ ID NO: 126342 - DNA, 601 bp, Human
tggctgtgtccatctctgggcctcccgtacaaggctgtgccaggccagaggagggcctccatgtggctttactagaatggcagacgctgtgaagctcctgatggaggtttctgtctctgccaatccaagtcttcaatccattcaccctacctcctctgtgggagaaacacaaagacacgcaagacctcaccccctctcagaaaactctgtgtggggaacacaagcttgtaagtcctggtgggacacatggcacgcaaaatgcaactatcttgcaaaacctagtgcctcctagggagtccarggcaggcttccggcagaagcggcattggagtgtggcttgcctttgaccagtaaaagtggtgaggaggaggaaacagcatgaagaggggtgtggaagcaagaaggcagatgcatggatccggcagggcactgctcgagcaagcgtcagctgcacaaagtgctgctgggaatgtctgaggggctgggcccaggagagccccacgatcctgcagtgccaggctgaggacactgtgtctatctgggatcgtgtgtgcagagtataagttcccagatgtttggggaacagaacttcactgtgcat

SEQ ID NO: 126343 - DNA, 601 bp, Human
acgatcctgcagtgccaggctgaggacactgtgtctatctgggatcgtgtgtgcagagtataagttcccagatgtttggggaacagaacttcactgtgcatgcacacacacacacacacacacacacacacacacacacacacacgcacttcttccatagggagaatctgatgaacaaatgcccttccatggataaaccacatcatcatcactgttatcccttaccattttttggccactttgaacgtaccaggtgctattctatgtacttcatgtttattaacttatttaattatcacarctattctgtatggagcactctgtttttatcctggctttgcagtgaggaaattgaggcagagagaggcaaatgccacacagctagtgagggctggagccaggcagtggaccaggtagttggcctccagagcctgcccaagctgcctctctcaccctgcagagtactcttcaatgtgtacctgtaggtgtggtggtttctggaagggagtgactcctctcctgcccggagccaagcccattcagaagtcactttgggaggcctggcctactgttggacaaaagagagcctagatcagattga

SEQ ID NO: 126344 - DNA, 601 bp, Human
gggcagagctcccccaacccagcatcctcactgaggcacagtcattggaaaagcttggacttcacagcccatccctgcctgcctcttcttgtgtctctgcaggtaaggtatggagcccttactgtgagccgagtcctatactgaatgagggctggggcctgcctgcaaggagctcacagcccctgttcccattacccacagcatcttccaggaggtggcatcccagactggccaacattgcagttgggagtatatttcctgcttcacccctcgtgagccgccagggtcaggtgccacatcsccttcattctccttgcctctttcacagcccctcctgccccatggttgatcccaatccatctgaactgcatggagtccacttggccctgctctcaggacccagagcttggcctagaattggccccaggaccctcaggaaggccttggaagcctggctcagccgggtttcaaggcaataaaagtaactgagacctgagcagccccacactggctgatgtgctgcagtgacacctcagtctctgaggcctgtggcaagggctcctgaaggtgaattgacccagggcaatcctatctgcttaca

SEQ ID NO: 126345 - DNA, 601 bp, Human
ggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcgggtgagyggcctccctacaggccagtaggaccgtcactaagtgtgggagattcttggtaggcagtatccctttcccaggtgcatttccatcccagctccaccactcatttgctggatggcctcagcaagtcacctggcctttctgagcctccattccttgagagatgagggggtttggcaagtgggtttcatctggcatgccaattttgaccaatgggtagtgcctgcctagggaactgagttgagaatgatcttgggggtggggctgtcttgaggctcaatgggaacagacgccatgaacatggga

SEQ ID NO: 126346 - DNA, 601 bp, Human
taagttttcttatagggaaagataaattacaggtaaacaaataaataagatacttttaaatggtgctatcaggaaactcttctctagaaagaagttggtttgagctaagtctcaagggacaaaacagcaccagccatgtgcagatctggggtaggaaccttccaggtggagggaaccttaagtgcaaaggccttgaggtaggagggtgtgttcaaggttcaaccaagagacaaatgtggttgaaacagagtgagcaaggagaaaggggaaggagatgatgttggtgagagaggcaggtgcyagaatgcacatatgtttgtgggccatggtaaagagtttgggtttgattctaagtttgaggggcagtgaaggaggtgagggagaagacctgagttgtgtctttaaaagatccctccagcaagaatgaaagctggaatatttgttgggaagctgctgcaatagctctggcaggaaataatgatggcttaggctaggattatggcatgggatatctaagagttggtcagatttgctataaaattttgaggtaaaggcagcaggatttgccggtggattctatttaaggaccataatgggggag

SEQ ID NO: 126347 - DNA, 601 bp, Human
gccttgaggtaggagggtgtgttcaaggttcaaccaagagacaaatgtggttgaaacagagtgagcaaggagaaaggggaaggagatgatgttggtgagagaggcaggtgccagaatgcacatatgtttgtgggccatggtaaagagtttgggtttgattctaagtttgaggggcagtgaaggaggtgagggagaagacctgagttgtgtctttaaaagatccctccagcaagaatgaaagctggaatatttgttgggaagctgctgcaatagctctggcaggaaataatgatggcttagrctaggattatggcatgggatatctaagagttggtcagatttgctataaaattttgaggtaaaggcagcaggatttgccggtggattctatttaaggaccataatgggggagagaaagagaaaaatccaggatgactcttagaattagagtttgagcaaacaagcccaagcaaacaagcacaatgtggcagtgccatagtctgtgatagcagagcttagagaagcccatgcatgtttgggggcattgtggaagggagttctttcttgagcatacgaagtgtgagatgcctgttacaaatgt

SEQ ID NO: 126348 - DNA, 601 bp, Human
tttctgaaacccaagcagaaggcctgcccttctgtaaattgcagatgaggagaggaaggaagctgggattcaaatccacgtatataggcatcagtgatctctactatctccactgtgacctccttgtatccttgacagatagtttaaccactatgtgctgaccattgacacccaaaggatgctaattagattaatgtggaccacagagagacctctctgaaccagccacggggcttggtgtctgtccccatttttaccaataacttaaatgacagcatcagtggtctgcttagcacattcmctggtgatgtgacttttgggggattctccatatttggggtctcagaattagaaccaactcaaccaaagaggaaaaagtttgacatggacaaatgcaagattctgtacttaggttcaaatcatgtatacaagtgcagagagatgaacagcaccaaccatcagtgggtgtgtggttgctcaaaaggataacatggtcttgggtcacagcaatgaatggatagcatctctgagagtcagggaggttggcgatggccttgcttttctctgcctggccagatcccacttagagaatcacattttt

SEQ ID NO: 126349 - DNA, 601 bp, Human
atggagtggaaggacactgaggcaattgagtatggcctcaggcagctggtggtgaatggctctaatttaattacaacatcgaaggaggctgcgacccacagagacggtggcccctcaggcaggaaagcagccctgggtgcagacaaggcctgtgaattggtgcttaattaggcaccaggagcctaattaaggctttaggatggcactgattcagcttgcctctggccagggccagaggggccaggtcagcaaagccagccctgctgcagagacttgagggcccaaggtgagagaagagtawgcaaggtgcaaaaagatagggagagaccagcacaggttgctggtggctcctcccagacaggaccatggcaatccagagagtgtgtccctagggctggtcccttccctgtgctggtcccagtctcctccggttgacagagggtgaggtgaactatcacctttttggaagcgtgctccatgaaagagaaaaggagggacgtctgtgatattaaggcataggtggctcccggcatttgtgtgtaatggattctctctctctccaattttttttttaaatagcaatgcagatagtgaaaagaca

SEQ ID NO: 126350 - DNA, 601 bp, Human
ttgttaatttttatagttactgccaattaccctccctagaggtaggtatcgattcatatcctcacctacaattatggaaaatacctgttttctcttaacctcaccaatgggtgtattatcaacattagttatatttaccaatccaatgaaaagtggtatctgattgttgtttgaaattggattcctttgattatgaatgagattgaatataattttgtttctttggagtggcatcgattgaaactccagaatccagccagaaggcttaagcccccaagaaatggtcttgctggacctcctsctgggccacaggggacagagatgatacctgggcatgagcagtagtctcaccactcctggcggggcccgccatgtagcaggaaaaacccccagtgccatacctttctcctttcttttggtaacttgctgtctaggatggtgtgagcctgcctttcccatgtgcagtcctggcagctgcctaaaagggcttgcagtgaagctggggtcatttatctctcctgataatgtccccagaatgaacctctagcctctgcttgctgcttttcattcactgctctattaaagatttgtgaggtgccca

SEQ ID NO: 126351 - DNA, 601 bp, Human
gactcagcatccccatgccttgatcagcctttcccaacagccccaaattctaagacgaagtcctcagctctccaatactgcagagatggtgtctcattctgagatatcctgcagcacaccagaggcctcaacagtgttcccaaagaaaggacagccgtgggctgtagggcccctggatcacggctgaggctgccaatgcagaggacaggagagcaggagcccgaaagttctgttcccagctttgctgctgatcgttcacaaagcatcactgagtctcccttgatgaccacctgtgaggcawtcctgctccttagggacatcatcagctttatcccacagtgcttttagcttcttggaggaagcccttttggtccccttttccaacagtgacagccactattctttccacatacccagcccaggaacccagggaaaaagacaaatgtgctttggagatgattttggcaatcctcattgattgctgtccgtgctcataaaatacggtgcttaattgtcatggcatttggggtagccaatttgaaaaataattactgccttctttgagattactttggcttctaattaaaatctcaagactggg

SEQ ID NO: 126352 - DNA, 601 bp, Human
ctgctggcttcctcctttcttcttacctacatcttcccatttttcaattccatttgagtcaaatgtttgctgagtgcaacggaagtcaggataatcaatcctaggctatgctacagtaacacaccctgagactccagcactttagcacaacagaagtttatttctcactcactcgcaaactgtgatgtgagctggcaggggctctcttccaatcagggattcggggatctaggattcttccatcttaggctgacatcttctgaccaggagactttgaagttctccaaggcaggggaagaaraagtgggagagcctgctcttgaacaccaaccaagaaagtacacattgtctttgtcgcaggctatcgggccagaactagtcacttgaccccagcccagttaccagagatgccaggagatgtttgttgagtgctgccgtctctgcaacagtgctttggacccagcatgcactgagcaagatgcctttgaatcctactacaaaggggtgtaaggtgtggtccctgcgcttggggagaccacagtacagtttcatgttccccttctggaaagcatcccttccgtctctaaaatgaccattcact

SEQ ID NO: 126353 - DNA, 601 bp, Human
tctggaaagcatcccttccgtctctaaaatgaccattcacttcttccgcagtcatagttcttgaggccctcagcacagaggcagcaggaccaacgaccttcccaggagcccacagatcagcgggaaaggcaggtgtgcacaatgcataagactggagccagggaaggacactggtgcacgggtgaccacagctgcccagagacagggcaaaagtgcaaaggagtgttgatctgagccttgataggaggaggtgccatgaaacagcatagtaatgaattttcagcctgggctgctaagcacrataagagaagtagaaacaaagctgatggtaatcatctggaggtggttaacagtctgactggggagatgacagtagaacaaaggcaatatttccaggaagataggatgcacgtgcttagtttctggaggtgggaaagagagttcaccacagggatcagtggggaaaggcatctaggcgagcacccagcacgtgtggaggcccagcacacgcctgagtaacctcagaagcacctatgggccacttggacgtttcatcgctgattcgattcctctctccccctttctggtcataacattgatg

SEQ ID NO: 126354 - DNA, 601 bp, Human
ccaggagcccacagatcagcgggaaaggcaggtgtgcacaatgcataagactggagccagggaaggacactggtgcacgggtgaccacagctgcccagagacagggcaaaagtgcaaaggagtgttgatctgagccttgataggaggaggtgccatgaaacagcatagtaatgaattttcagcctgggctgctaagcacgataagagaagtagaaacaaagctgatggtaatcatctggaggtggttaacagtctgactggggagatgacagtagaacaaaggcaatatttccaggaagayaggatgcacgtgcttagtttctggaggtgggaaagagagttcaccacagggatcagtggggaaaggcatctaggcgagcacccagcacgtgtggaggcccagcacacgcctgagtaacctcagaagcacctatgggccacttggacgtttcatcgctgattcgattcctctctccccctttctggtcataacattgatggcctgaaaagaaattcatttctgaaagccttcccctactaagaccttgctatcagaaaataagcaaaccattgtttatctggcctgtgttagggcttgagt

SEQ ID NO: 126355 - DNA, 601 bp, Human
gagatgacagtagaacaaaggcaatatttccaggaagataggatgcacgtgcttagtttctggaggtgggaaagagagttcaccacagggatcagtggggaaaggcatctaggcgagcacccagcacgtgtggaggcccagcacacgcctgagtaacctcagaagcacctatgggccacttggacgtttcatcgctgattcgattcctctctccccctttctggtcataacattgatggcctgaaaagaaattcatttctgaaagccttcccctactaagaccttgctatcagaaaataarcaaaccattgtttatctggcctgtgttagggcttgagttcacttaggaagtaaacatcggggtgatgtttcatgcagggacaccgtggtggctcgacgatccctgggtaacgtcagcccacagctgcagccagctcattcccagcctggggagttgccatggggtgaaaaatgctcaagaaccaggagcctcagatgcctgtgttttatccaaactctgtctaaccagctgtttgagaagcttgtctcttctcaagcaagtcacactggactcccgcgttttcctttctaaaatgacaga

SEQ ID NO: 126356 - DNA, 601 bp, Human
taaatgttttctctgacatgtctttacttctggcctgaatttaatgggtgtgtttgattatacagtcacatgcatctctgtggagatgtcaacagaaaccatgctggccttcactttagttagggagggcaaaccatggagtttgcttgaggacagaaagatgtgaattgtgtctggtctagagacacaatggtaagaaatttgtggtaaggaaaatgtcttcccaccaagccataagcattgccttttaagggattcagcctagggtaagtggaagcttttactagaaataaagacattrgaccacacatcagcatgcgttctgagtcccagagggagaataactgtgatggaacgtaagaggatgacaaatagaatggatgttttcccactttgggagaaagttctagattttcttggaatgttgagacctggaggatatcttggagatcacctagactgtgactcatcattgcataaatgtgaaacattaggttcagcagagagatgtgacttgctcaaaggcacacagatagttggtgaccaaactgtcactaaaactcaggtcttgagttacttcccccctctgagcatgtttctt

SEQ ID NO: 126357 - DNA, 601 bp, Human
tcacccttggtcagagatgggtatcagagagggggtcctgcagcagggacagcaaggaaatctgaagacgctcaggaggcaaggatggaatcaggaatgcagatccgcaaggggacgccctgtgggactcttggaaaggcagcaggcaccacacaagagccagtggtttctcagaggtcagcaaactgctgctcaagggccaagtctggccacacccatgtgtgttgtctgtggccctttcatgctacagctacacaacggtcaagtagtattgggattgttgtggcccaaaagccaaaamtattgatcatctagccccttacagaaaaaggttgccagctcctgcttgagctgtccacgggcctgagttcaagtcaagtgctgcccctttctacccaggtaaccttgggcaagccacttttcacctcagagccccatttctgcatctgtacccacaacaggtttgttttgagaatttcataaactcgtgtctgtgaccgcatccaggctaaggagcagttcagttgcttcatgtgcttgtcactcctctgtggagggaaccagggatgtgtagcttgatcggtccctggagtggcagaag

SEQ ID NO: 126358 - DNA, 601 bp, Human
cgagaatgggaaacgtttgcgctttgaaggggactgggctcgggcgggggtggagaaagctgatcgtcaggctgttccccccgttccctcgcccctcggaccggcggtggcggtggtctttgcgagggaaaagtgttgggcgtgggaagggtttgctgggttgcaggcgactgcccagccaggctaaaggagactgctcttacgtgtcaggctgaaggtggtggcttggtttgattgtgctggggattcgtgtaatttttcatctgggccgagatgtatggtgtattgtttttttctcccracctgggccacgtttctgttagggtggtgattgtgtccacttttctgggagctgctcacagctatctggacacctctctgtggattttcttcttcctggaagggctctatgcgcttagataggtgtgaagcacctgtccaccctgaaaaatgtccaccaaacctccgagctggcatgatagctttgagtcctgtcagcttgtacatctcagcgtggttttctttccttttttcagttcctcgttttattgttttatgtagatttgtactctccccgtgccggccacatcttttcattttt

SEQ ID NO: 126359 - DNA, 601 bp, Human
agctgatcgtcaggctgttccccccgttccctcgcccctcggaccggcggtggcggtggtctttgcgagggaaaagtgttgggcgtgggaagggtttgctgggttgcaggcgactgcccagccaggctaaaggagactgctcttacgtgtcaggctgaaggtggtggcttggtttgattgtgctggggattcgtgtaatttttcatctgggccgagatgtatggtgtattgtttttttctcccgacctgggccacgtttctgttagggtggtgattgtgtccacttttctgggagctgctsacagctatctggacacctctctgtggattttcttcttcctggaagggctctatgcgcttagataggtgtgaagcacctgtccaccctgaaaaatgtccaccaaacctccgagctggcatgatagctttgagtcctgtcagcttgtacatctcagcgtggttttctttccttttttcagttcctcgttttattgttttatgtagatttgtactctccccgtgccggccacatcttttcatttttgtttaacaaatacttcttgaggcctactagataccattcactgttattggccagggg

SEQ ID NO: 126360 - DNA, 601 bp, Human
tacatctcagcgtggttttctttccttttttcagttcctcgttttattgttttatgtagatttgtactctccccgtgccggccacatcttttcatttttgtttaacaaatacttcttgaggcctactagataccattcactgttattggccaggggacatggtggtgagcaggacagaattcctgtcctcatgagtcttacattctagaaggaaggagcagataaaatctaaataaggttatgagattgtgacgaagcgtgtaagtaaaatagaactgggtgatggcgtgaatagagacakgggttatgtggctagtttggtatatccactgtttaaggtgaaatctgcctctgtaaagaaatgaaaaaattatatagagcacattactgatatcgattcacttggatttttagtctggggggagaaaagagcaattgtatatagtaatcgttaccatgaactagaatagagtgtatgttagtggaagagactttaagaaattagttacttttagttttttggttttttttttttcctttttactgcggaaaaagtgtgcctttgcttttggaaacactgtattttattagtatagtgtgg

SEQ ID NO: 126361 - DNA, 601 bp, Human
atctgtatgatctctacatcatttgtaatagatgcatgatattttagtttaccaggtaccaagatttatttattattactgatggatgtttaggttgtttccaatttatctagattacaaagaacactgtgatgaatttatatgcatacatctttgagaaatgatctcatttatatttccgaaagaggaattattgggccagaagtggtgcacattttaaactttgatacatattggccccatggaaatgttatgtatattcacagtcctggtaacattgtatgatggccccattttgccktacaaacactaagtagcaggcatttcactgttttctgtttctattttcattcctttaaagttacattgagcacttttaaaatatgtttatatgctagttacatttagatgtaaattacatactcataatcctttgcctgtgctgcaatctgttgctgaattcatctttctgatataaaggttgttttctgtcacatgtagcattcttttccccagtctgttttttgtcttttaactttgtacatatatttgacatggagaaaagtgtgtgtgcatgtgtgttttaggtagataggtcttt

SEQ ID NO: 126362 - DNA, 601 bp, Human
tgttttctgtcacatgtagcattcttttccccagtctgttttttgtcttttaactttgtacatatatttgacatggagaaaagtgtgtgtgcatgtgtgttttaggtagataggtctttccgtttcttttacattttctaactctgttataatttttatatcttccttattcctccaaattattatatatgttagtctctgcttcctcttagtatttttttcttaattttttcacatattaccctgaattcacccagtattttacttcgttatatgagagctagagccctaattatagttycttctaaatatttagagacttgtccagaattacttatcagatgattatttgattattccactgttttgaaatatttttattataaactaaattctgctttatacttgggtatgtttcaaagcttctattgccctttcttaacctattttagatggcagatgtttgtaggatttctgccaacaatgtcaaaggtaacattcagattagagacatttcaaattcaagagtcttattgttgagattgaagatttcctaaaaataactaaagagtatagccttggcaagttaaatagcctttat

SEQ ID NO: 126363 - DNA, 601 bp, Human
tccagaattacttatcagatgattatttgattattccactgttttgaaatatttttattataaactaaattctgctttatacttgggtatgtttcaaagcttctattgccctttcttaacctattttagatggcagatgtttgtaggatttctgccaacaatgtcaaaggtaacattcagattagagacatttcaaattcaagagtcttattgttgagattgaagatttcctaaaaataactaaagagtatagccttggcaagttaaatagcctttatgggttaattttttttttttttttaatggtaagtgctagtgtggcttgataggttggggcctaaggtgaaattgtataaaagcctagacctgatggtagtgtttctcttctagcccttgggagccacgttgctgcgtgatgaagtgatctaagcagaaaccttgcttcatgctctcttccctatcccatccacctcatattattattatttccctgtgtacataaggtcctaatgtttatcatcaggctttatctttcgactggaggtgctaggctagtgtggaaataatttatgtgtccttaaatattagctaccctcaagta

SEQ ID NO: 126364 - DNA, 601 bp, Human
acctgatggtagtgtttctcttctagcccttgggagccacgttgctgcgtgatgaagtgatctaagcagaaaccttgcttcatgctctcttccctatcccatccacctcatattattattatttccctgtgtacataaggtcctaatgtttatcatcaggctttatctttcgactggaggtgctaggctagtgtggaaataatttatgtgtccttaaatattagctaccctcaagtaaaacagaggtccttttttacctggaggtgtatatgtatatgtgtgtgtgtgtgtgtgtgtattytttctttgatacagggtcttgctctgttgcttaggctggagtgcaatggcacgatcttggctgactgcaaccaccgcatcccaggctgaaatgattctcctgcttcagcttcctaagtagctcccaagtagctgggactacaggcatgcctggctaatttttgtgctttttgtagagacagggttctgccatgtttcccaggctggtcttgaactcctggacttaagtgatctacctgtcttggctcccaaagtgctgggattacaggtgtgagccatcatgcctggccccctggagatt

SEQ ID NO: 126365 - DNA, 601 bp, Human
agtgtttctcttctagcccttgggagccacgttgctgcgtgatgaagtgatctaagcagaaaccttgcttcatgctctcttccctatcccatccacctcatattattattatttccctgtgtacataaggtcctaatgtttatcatcaggctttatctttcgactggaggtgctaggctagtgtggaaataatttatgtgtccttaaatattagctaccctcaagtaaaacagaggtccttttttacctggaggtgtatatgtatatgtgtgtgtgtgtgtgtgtgtattctttctttgakacagggtcttgctctgttgcttaggctggagtgcaatggcacgatcttggctgactgcaaccaccgcatcccaggctgaaatgattctcctgcttcagcttcctaagtagctcccaagtagctgggactacaggcatgcctggctaatttttgtgctttttgtagagacagggttctgccatgtttcccaggctggtcttgaactcctggacttaagtgatctacctgtcttggctcccaaagtgctgggattacaggtgtgagccatcatgcctggccccctggagattttttaagttt

SEQ ID NO: 126366 - DNA, 601 bp, Human
ggttgtcaagtttgactgcactatggagtcacatcaagggcttaaaaaaaagaaacaactgctgcctgggtctcacccctacagacatggttaaattggttcaggcatcagtattttcaaaactccataggtgacatggatgtgcagcctaggctgagaatgattgcccccaggctgtctgcccacagttgtgtccagcacctgccacctcttggcttcatttaattctccatttagcctagagcccacagttcatcacttcattatcttgcctcttgcctcacctcgtatcagtctgccmtgttatcttgaatccatccaataattatagctgctcaactttgaaaatcctacagagggtaatcacacagccatgtggactaatactactacacattggtagtctcagggctcagctaaacctgcattgcggtgctgcctggcagtgcttttttttctgtgtttagctctgacatccatcacttaaaaaaacctcttctaaatcttcattctaccgcattcttggtagatgaccttagctcctacttcatactgtggatcccatcatgccttaaattagttttttctttttctctctttg

SEQ ID NO: 126367 - DNA, 601 bp, Human
ttcaaaaccagcctgagcaatatagcaagaccccatcgccacagaaaaattttaaaaaattagccagaggcagtggtatgcagtgagctatgattgccactgcactccaacctgggtgacagagcaagattgtatctcaaaaaaaactagaaaaattaaactagaagccgtctgttccaccctttggccctttcactcactgtcaggtttcagtagaaactagtgtttgtttactgttatcacatttcaactcccattcatttactttttaaccgatttttagctgtctacccttatcctycatgaactgccccaattcttgccaaaagtgctcagagatagcagcaagtacatatgtaatctactggacattaccattcttaccttggtctctccagcagcattcagtgttattctttcttgaaccctttgagaaagaaaacagcctggccagataaacccttctgtcactttacttgcatcctggctgtctttctgcttctttgatccccacttttagtctccttcatgcattactctttttttttttttgagagggagtttcgatcttgtcatccaggctggagtgcagtggcacaat

SEQ ID NO: 126368 - DNA, 601 bp, Human
ctcccattcatttactttttaaccgatttttagctgtctacccttatcctccatgaactgccccaattcttgccaaaagtgctcagagatagcagcaagtacatatgtaatctactggacattaccattcttaccttggtctctccagcagcattcagtgttattctttcttgaaccctttgagaaagaaaacagcctggccagataaacccttctgtcactttacttgcatcctggctgtctttctgcttctttgatccccacttttagtctccttcatgcattactctttttttttttktgagagggagtttcgatcttgtcatccaggctggagtgcagtggcacaatcttggctcactgcaacctctgcttcccaggttcaagcagttcttctgcctcagcctcccaagttgctgggattacaggcgcaccaccgtgcccggctaatttttgtatttttagtagagacggggtttcaccatattggttgggctggtctcgaactcctgacctcaggtgatccacccgcctcagcctcccaaagtgctgggattacaggcatgagccactgagcccggcctctccttcatgcattact

SEQ ID NO: 126369 - DNA, 601 bp, Human
tcccattcatttactttttaaccgatttttagctgtctacccttatcctccatgaactgccccaattcttgccaaaagtgctcagagatagcagcaagtacatatgtaatctactggacattaccattcttaccttggtctctccagcagcattcagtgttattctttcttgaaccctttgagaaagaaaacagcctggccagataaacccttctgtcactttacttgcatcctggctgtctttctgcttctttgatccccacttttagtctccttcatgcattactctttttttttttttgagagggagtttcgatcttgtcatccaggctggagtgcagtggcacaatcttggctcactgcaacctctgcttcccaggttcaagcagttcttctgcctcagcctcccaagttgctgggattacaggcgcaccaccgtgcccggctaatttttgtatttttagtagagacggggtttcaccatattggttgggctggtctcgaactcctgacctcaggtgatccacccgcctcagcctcccaaagtgctgggattacaggcatgagccactgagcccggcctctccttcatgcattactg

SEQ ID NO: 126370 - DNA, 601 bp, Human
ccggctaatttttgtatttttagtagagacggggtttcaccatattggttgggctggtctcgaactcctgacctcaggtgatccacccgcctcagcctcccaaagtgctgggattacaggcatgagccactgagcccggcctctccttcatgcattactgattcaataataatatattccttcttggccatcttctaagaatgctgtgcctcagagagcttgtgtatttaccttacggtggatggcttctgtatttttatctctaggctaaccttacctgctgagctctctgtatctgttyatttatttactcttcatttattcaaaattatttttaaaaattgagaacatactgtgtattattgctttgctgggctctggagaatttatattctactgtagtgtttctccagttgtagtttactgccagcctgcatcatttggtatgcttgtgaaaaatgcagattcctagtctcttcatctggtttattcacttgtgatctctacctgtgggcattatttatactacaagttgcaaacctctggtctcctagatgagatgtcaccacttgatgtcttgagagtaaattaaagttcgtat

SEQ ID NO: 126371 - DNA, 601 bp, Human
ttggtatgcttgtgaaaaatgcagattcctagtctcttcatctggtttattcacttgtgatctctacctgtgggcattatttatactacaagttgcaaacctctggtctcctagatgagatgtcaccacttgatgtcttgagagtaaattaaagttcgtatgttcaaaagttcattactctttcccatctctcattgtgcccagattttatgaatggcaccactagttaccatagcctgacccaggtatacccctcattatccctcattccccctccagcaataccatcatcagttattgrctaaactccttgattctgagttctcaccttctcttgactttgcttccttcgcttgtttcttttgtgtgtgtgttttgttttgttttgttttgttttgagacagtctcgctgtgtcgcccaagctggagttcagtggtacggactcggctcaccacaacctctgcctcctgggttcaagtgattctcctgcctcagcctcccgactagctgggattacaggtgtgcgccaccatgcctggctaatttttgtatttttagtagagacggggtttcaccatgttggccaggctggtcttgaac

SEQ ID NO: 126372 - DNA, 601 bp, Human
tgcttgtgaaaaatgcagattcctagtctcttcatctggtttattcacttgtgatctctacctgtgggcattatttatactacaagttgcaaacctctggtctcctagatgagatgtcaccacttgatgtcttgagagtaaattaaagttcgtatgttcaaaagttcattactctttcccatctctcattgtgcccagattttatgaatggcaccactagttaccatagcctgacccaggtatacccctcattatccctcattccccctccagcaataccatcatcagttattggctaaamtccttgattctgagttctcaccttctcttgactttgcttccttcgcttgtttcttttgtgtgtgtgttttgttttgttttgttttgttttgagacagtctcgctgtgtcgcccaagctggagttcagtggtacggactcggctcaccacaacctctgcctcctgggttcaagtgattctcctgcctcagcctcccgactagctgggattacaggtgtgcgccaccatgcctggctaatttttgtatttttagtagagacggggtttcaccatgttggccaggctggtcttgaactcccaa

SEQ ID NO: 126373 - DNA, 601 bp, Human
tttgttttgttttgttttgttttgagacagtctcgctgtgtcgcccaagctggagttcagtggtacggactcggctcaccacaacctctgcctcctgggttcaagtgattctcctgcctcagcctcccgactagctgggattacaggtgtgcgccaccatgcctggctaatttttgtatttttagtagagacggggtttcaccatgttggccaggctggtcttgaactcccaacctcaggtgatccacctgcctcagcctcccaaattggctgggattacaggcatgagccactgcacccrgcctttcacttgtttcttatgcctttctggtttgtgtgcttgtctctttcttttggacctttgcaatatttttcccttgccttccatctcccctgcctgtactttattctcttaacttctataaatacaaaaatgatcctggttgcttccttttagtctttcatggttatttcttgcctagaggatgagctccaggccttttcagccttgtctgtgaagtcacgaagaatttatagcagagatgagtcttaaagcagtgctgctcaagcttgagtgtgcctgtgaatcacctagagatct

SEQ ID NO: 126374 - DNA, 601 bp, Human
acgattagacacttacacacccagagcctgaaaatgtgaaaagaaaatctgcatattccagaaaccaagagggaatgcaaagcagtgggttggtctggtctgctaatttgaatcccggtggggttttaatttattgatatttcttctcattggtatattttcctgattctttgcatgcttggaaattttttaatagataccagacattttgaatttcaccgtgttgggtgctggatgtttttgtttttctggactgttgactccagctcttcaattcattttctttcttttttttttttttgagatggaatcttgctctgttgcccaggctggagtgcagtggtgcgatcttggctcactgcaacctccgcctcccggattcaagtgattctcctgcctcagcctcccgagtagctgggattacaggcacgtgaggccacacctggctaattattttttgtatttttagaagagatagggtttcaccatgttggccaggctggtctcgaactcctgacctcaaattatcctcccgccttggcctcccaaagtgctgggattacaggcatgagccaccgcacccagcctaccttattttctg

SEQ ID NO: 126375 - DNA, 601 bp, Human
ttgaatcccggtggggttttaatttattgatatttcttctcattggtatattttcctgattctttgcatgcttggaaattttttaatagataccagacattttgaatttcaccgtgttgggtgctggatgtttttgtttttctggactgttgactccagctcttcaattcattttctttcttttttttttttttgagatggaatcttgctctgttgcccaggctggagtgcagtggtgcgatcttggctcactgcaacctccgcctcccggattcaagtgattctcctgcctcagcctccygagtagctgggattacaggcacgtgaggccacacctggctaattattttttgtatttttagaagagatagggtttcaccatgttggccaggctggtctcgaactcctgacctcaaattatcctcccgccttggcctcccaaagtgctgggattacaggcatgagccaccgcacccagcctaccttattttctgtgtcataggaatcactgtcttcctttgcttgatgtccagtatcttcaaaactgttgtctcctgtatttttttctgattttttggttgtttcaggtgggagagagtaa

SEQ ID NO: 126376 - DNA, 601 bp, Human
ttttttgtatttttagaagagatagggtttcaccatgttggccaggctggtctcgaactcctgacctcaaattatcctcccgccttggcctcccaaagtgctgggattacaggcatgagccaccgcacccagcctaccttattttctgtgtcataggaatcactgtcttcctttgcttgatgtccagtatcttcaaaactgttgtctcctgtatttttttctgattttttggttgtttcaggtgggagagagtaaatccagttagcgtttcttcatcttgtccaaaagttgaaggcttggkgggtgggtggtgggaagagtagggcttttagtactagtgcgaggacagagtcagtgctgcacactagttataataacctcaaactgtaaacaacccaaacatccatcaacagaaagtaaataaagtgtggtatattagtaaaactatcctgtaacaagagtgaatacatgatagctaaatgtaacaacgcggatgattctcacaaacataacgcaacccaaagaggccagacaggaaagatacatcctatgggattccatttatataaaaatttaaagccagcaaaactagtctgaagtc

SEQ ID NO: 126377 - DNA, 601 bp, Human
tcttctattgttttgacaaacatttcaagtaatttgtaccacatggctttgttggttgcgttatgtaagtcaaaacagtattctgcaaggtaggatctcgtaccctagggggtacacaacaaactgacctgttgggttttggaaagaaaatattagagagagacagggacagaggggaggcacaaatacattttttaaaggccctgtgatatagtctggcttattttgagtagaaatttcagatatagtacttaacaattctctttatccataaacctagagagggctttgtggctgttgrgagagtcagaatgaatctatgataaaatactgcattctcaacatgaaaagttcttcaaaggaggaggtgtatctaatgatatttaaagtaaaacatcttgggagaagggagaagtaggatctactctaaactttaccaaaatgtaatcgcctctagactattcagtacagcttagatgatcttcgttgctactgtttttgatctaaagccttgccacaggcactgagattattagtgggccagttctctctgctacttagccagcacttgacctgcatgttttggtagtttaatagcact

SEQ ID NO: 126378 - DNA, 601 bp, Human
tctgaaagatctctgcgctgtattcatcttacaagtctacttttatactgatactcattccttgggaagacataaaagaatgaaaaggtgatgcagttcattttccacagcattgaacactcatttgtcaccagcgtagaagggatttggggagagattaagcagtagcagtaatagtcaataatctgcgtctaaagtggcttgctggctttacttcagtaaattctggccatgtgaagaatacctaaatcaactatcagagttcttaacagtgaacctgtcataactatgatttttttttcttttttgcaattatagaattgattttttttttccttttgaggcagagtcttgctctgtcacctgtgctggagtacaatgccacaatctcggctcactgccacttccgcctcccgggttcaagcaattctcccgtgtcagcctcccgagaagttgggattacaggcgcatgccactaccgctggctaatttttatatttttagtagagagaggatttcatcatgttggccaggctggtcttgaactcctgacctcagttgattcccctgcctccgcctcttaaagtgctgggattgcagg

SEQ ID NO: 126379 - DNA, 601 bp, Human
tggggagagattaagcagtagcagtaatagtcaataatctgcgtctaaagtggcttgctggctttacttcagtaaattctggccatgtgaagaatacctaaatcaactatcagagttcttaacagtgaacctgtcataactatgatttttttttcttttttgcaattatagaattgattttttttttccttttgaggcagagtcttgctctgtcacctgtgctggagtacaatgccacaatctcggctcactgccacttccgcctcccgggttcaagcaattctcccgtgtcagcctcccragaagttgggattacaggcgcatgccactaccgctggctaatttttatatttttagtagagagaggatttcatcatgttggccaggctggtcttgaactcctgacctcagttgattcccctgcctccgcctcttaaagtgctgggattgcaggtgtgagccaccgtgcctggcctgatttaacaattttaatacagggattcttagcaaataaaatatctcatcaaattgtgaagacacagagctgatagctgaaaaatgattcctggttaaaatctgatactttagaaaatacttggaa

SEQ ID NO: 126380 - DNA, 601 bp, Human
tcagatttttatctggtctctggagaccaggtaactgtcaagttggtttcagtacctcttgagtggcaattttcgtcagtcatcattagaggtagatattggatagaatatataataacagcagtatgtaggtagaaagtatgaggaaaatatacattgttttcctcatcgacttaattattaagaaaacatgtttttcatttgacaaaaaatcttattagctaaccttcttcattaaccttagtcttggttcttttgtgatcaactgcaaatttcttttatttttattttccccgagacrgagtttcactcttgttgcccaggctggagtacagtggcgcaatctcggctcactgcgacctccctctgcctcccaggttcaggcgattctcctgcctcagcttcccaagtagctgtgattacaggtgtgtgccaccatgcctgctaattattgcatttttagtagagacggggtttcaccatgttggtcaggctggcctcgaactcctgacctcaggtgatccacctgccctggcctccaaagtgctgggattacaggcttgagccaccacgcctggcccacaaatttttttattggcag

SEQ ID NO: 126381 - DNA, 601 bp, Human
agctaaccttcttcattaaccttagtcttggttcttttgtgatcaactgcaaatttcttttatttttattttccccgagacggagtttcactcttgttgcccaggctggagtacagtggcgcaatctcggctcactgcgacctccctctgcctcccaggttcaggcgattctcctgcctcagcttcccaagtagctgtgattacaggtgtgtgccaccatgcctgctaattattgcatttttagtagagacggggtttcaccatgttggtcaggctggcctcgaactcctgacctcaggtratccacctgccctggcctccaaagtgctgggattacaggcttgagccaccacgcctggcccacaaatttttttattggcagtttttgctgagattataggtagtgggcaaacaattgttattatgctcacaggcactataaacattttatttctactttttacttgtgtatgcttatcattggaagtaaatataacagactttgtcgttctcttgagttagttagctttgttatgttttcatggacataattaacctcccttctgtgcttaaaaatgttcgaccagttttatgttgtcgt

SEQ ID NO: 126382 - DNA, 601 bp, Human
acagctgggcaagtgttaagaaatgcctttcttaatttactgttaaaaatctaaacatagcactgggcaaaataaagttgtaggtattttcatagttacaaggctaagcatgcatttcaagatcgtaaatgtccattcaaatcaaattctgttttgtttcaaaaagttatgaaacaaaaaagggtaatcttactttgtccttttcatgtgatgaatttggaagggccctttaaatttattataatgggattttatatgaaatttgttgcaccttcatgaaataatattaagtatagagacraagcttctagagagaggttgtgtttattttgcttccttttgatgtcactttttactctgctaggcaccctgtgagcagttagtaaatcttcagtagtgatggccatggacaagcttgagatccagttaatggagattaactaggagattcctatctgggaatggcaagactgcagttgtgggcactgccagtctcttccttatttattctgcttgcagataggctcctaattagaagcttcactccattaaagcaacacttgttatcataagtgtttgcatccattgtgaatgctctctt

SEQ ID NO: 126383 - DNA, 601 bp, Human
tgcctcggcctcccaaagtgctgggattatagcctccccagtagctgggattacagtcaggcaccaccacgctcagctaatttttttgtatttttaatagagatggggtttcgccatgtcatactggtctcgaagtcctgacctcaggtgatccacccccctcgacctcccaaagtgctgggattacaggcgtgagcccatggtgcctggccatgtgtgtttacatttaataaacctttattaaatataatctcactgtatttatgaatttatactgttttaattatagcttcaaaataaygcctgtagctttttcccttaggattattttttaaattgacaaataaaatttgtatatatttttggtgtacagcacgatgttttgaaatatatatatatgtacacattgtggaatagctaaattaagttaattaacatatgcattaccacacatatttattcatggtgggaaatctctcttagcagttttcaagtaaacaacatgttgttatatactttctcatgtacttatactttatttgtggtgagaaatctactcttagtcattttcaagtataccatacattgttgttacctatag

SEQ ID NO: 126384 - DNA, 601 bp, Human
gcaccaccacgctcagctaatttttttgtatttttaatagagatggggtttcgccatgtcatactggtctcgaagtcctgacctcaggtgatccacccccctcgacctcccaaagtgctgggattacaggcgtgagcccatggtgcctggccatgtgtgtttacatttaataaacctttattaaatataatctcactgtatttatgaatttatactgttttaattatagcttcaaaataacgcctgtagctttttcccttaggattattttttaaattgacaaataaaatttgtatatatwtttggtgtacagcacgatgttttgaaatatatatatatgtacacattgtggaatagctaaattaagttaattaacatatgcattaccacacatatttattcatggtgggaaatctctcttagcagttttcaagtaaacaacatgttgttatatactttctcatgtacttatactttatttgtggtgagaaatctactcttagtcattttcaagtataccatacattgttgttacctatagttgccatgttgtacaattgccattaaatattgactcatacttaactactaaggcaaggac

SEQ ID NO: 126385 - DNA, 601 bp, Human
aacctagaaccctaacaattacaggaagtttatggggtttttttgttttttttgttttgttttttttttagatggagtctcgctctgtcgcccaggctggagtgcagtggcgcgatctcggctcactgcaagctccgcctcccgggttcacgccattctcctgcctcagcctcctgagtagctgggactacaggtgcccgccaccatgcctggctaattttttgtatttttgatagagacaggttttcaccgtgttagccaggatggtctcgatctcctgacctcgtgatccaccctcctyggcctcccaaagtgctgggattacaggcgtgagccaccacgcccggcaggaagtttctggttttaaaaataaacattgtatcatttggacactttggagtctttatttcccccaccacccccttctgggccctttagaaaacattgttgagatagtattctaaaaataatctgtatcttatttttgtgactttgtaagcttttcccatatcattaatagcttttcataaaagtaatttttattggctgtatcataggccatcgtatgtgtgtcctatgcttgagttaatcattcctgtac

SEQ ID NO: 126386 - DNA, 601 bp, Human
aaatgttctgattcctctacatttttcaaattaatgtgttttaaagcgattaaaagtaagtttctctgtgtttagaatttttactatatagatacaaatttctgtgttttagaagaattaaaactatcagtgcagtcataaactagtaggtgaaaatttaaagactatcatttcaaaatttgaaatttgtcagtgaattatatgatactttgctaagaagccactgaaagattcatatgactgacttagcatttctctatcacaaaatacttgttttgttttggtttttttttttttttttgagacagtctcgccctgacatccaggctggagtgcagtggcgcaatctcggctcactgcagtctccgcctcctgggttcaaacgattctcctgcctcagcctcccaagtagctgggattataggcacccgccgccacactcagctacttttttttgtatgttagtagaggcggggtttcaccatgttggccaggctagtcttgaactcctgacctcgtgatccgcccgcctcagcctcccaaagtgctgggattacaggcatgagccactgcatccagcctaaaatacttgtttttaaag

SEQ ID NO: 126387 - DNA, 601 bp, Human
aaaaaaaatttttaggttgtgtgtggtggctcacacctgtaatcccagcgctttgggaggccaaggcgagaggactgcttgagcccaggagtttgagaccagcctgggcaaaatggtgaaaccctgtctctacaaaaaatgcaaaaattagccaggtgtggtggcgtgtacacctgtggtcccagctacttggtgggatgaggtgggaagatcgcttgagcctgggagattgaagctacagtgagtgccactgcactccagcctgggtgacagagcagaaccccgtctcaagtaaaaaaamaaaaacaaaacaaaaaaagtttaaagagaatggtctttctatcacagggtaaaaaaattgattatttgagggaaaaaaaaaaggatttgtcttgtagccaggatattgttttaaagaaaatcctttttgtttttccaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatt

SEQ ID NO: 126388 - DNA, 601 bp, Human
aaatttttaggttgtgtgtggtggctcacacctgtaatcccagcgctttgggaggccaaggcgagaggactgcttgagcccaggagtttgagaccagcctgggcaaaatggtgaaaccctgtctctacaaaaaatgcaaaaattagccaggtgtggtggcgtgtacacctgtggtcccagctacttggtgggatgaggtgggaagatcgcttgagcctgggagattgaagctacagtgagtgccactgcactccagcctgggtgacagagcagaaccccgtctcaagtaaaaaaaaaaaaacaaaacaaaaaaagtttaaagagaatggtctttctatcacagggtaaaaaaattgattatttgagggaaaaaaaaaaggatttgtcttgtagccaggatattgttttaaagaaaatcctttttgtttttccaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgact

SEQ ID NO: 126389 - DNA, 601 bp, Human
gtggtcccagctacttggtgggatgaggtgggaagatcgcttgagcctgggagattgaagctacagtgagtgccactgcactccagcctgggtgacagagcagaaccccgtctcaagtaaaaaaaaaaaaacaaaacaaaaaaagtttaaagagaatggtctttctatcacagggtaaaaaaattgattatttgagggaaaaaaaaaaggatttgtcttgtagccaggatattgttttaaagaaaatcctttttgtttttccaggtggaccaaactacgaattaacatgcttcctgctacrataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccaggtatgtggataggcatgaaaaggttggcagtcccttggtggaactagaactatttcaatttagaaaaagttgaaggaaatgtatctgagccattcttcagcttcccattgtaggttagtctcgggtttgaacatgactttctctagt

SEQ ID NO: 126390 - DNA, 601 bp, Human
tccggctcggcagcgtcgcagctgccccaggatctgcgccgcggtcaagttgcggacttggagccggcaaacgcggagggctggtcccgcgcgtctgcgctgggaatgcacgtgtcctggctggcgcggtcggagccgggagctggggaccttcctggcccggcggtggcggggctgagaggtgcctggtgcctgggagcgggtcctccgagacgccgaagccatcagccaggctgagcgccttcccggccgccgcggcgcgcacggtgcggtgggcgcatctctgagccccgcgctcacscggggctgcgcgcgtcgcgggtggtcctggtcgggccaaggacgactggcccaggagccaaggcgaggtggggcttccgggggttgttcccgcgccttggcagagggatgccgctgtagcttcctgggtgagagcgtgcgcgcgcgcgggtttgccagtttccccacatttccaatttctcctgttacgctttctccagaaggttttttcttttccttttttctttctttctttcttttttttaccttcaacttggcttcctgcggggttgttttggagcaggatgagggctttgcctcc

SEQ ID NO: 126391 - DNA, 601 bp, Human
tctttctttctttcttttttttaccttcaacttggcttcctgcggggttgttttggagcaggatgagggctttgcctcctccagtgtccccaggtggcagcggtgcctctgctcccagggcagaccctgcacccgaaaaatctctagtgtattcggggagccatgaaaaggctcccttgggccggtgggatccttggctttgtctctggctgctgcgcacaccgtcagccgtcagggcaattggcattcggcctctttggtactggggacacaggtggagggatggagcgggcacagcccrgggttgctgcccgtggtcctctctgagtccttggtgattttgcctgggctggagagaaaccctggctcctggtctgctggggccgcctctgcctcagaggatgacacaagagtgcatgtaagtatttttaataaaaactgtagtactcgtaaaacaatctacaccctgcagaagggatttgttattttattttattatttatttatttatttatttatttttgagacggagtcttgctctgtcgcccaggctggagtgcagtggtgggttctcggctcactgcaacttctgcctcctggg

SEQ ID NO: 126392 - DNA, 601 bp, Human
attaaaaaattttcacattcacagtcttctaaattcactttggagtgtattggattccactgcattgacatacgtaagtttgcattaaaagatcctttaagatatctggtcaggcacggtggctcacgcctgtaatcccagcactttgggaagtggaggtagaaggattgcttgagcccaggagttcgagaccagcttgggcaacatagtgagacctaatctctactaaaaattaaaaaaaaatccttaggcgatctgttcacagattaatcttgtgattggggcgattccagaagtggtratgggttgtgctgagctagccccacactctctctgagaagcagtgtacagtagtgtttaagggcaggggctctaaagtcagacttccagagtaataccccccccccccaacctcacaaatcagtttctactatatttatatctgccatcccagtgttggtggtagggtcttcagatccctggggaagcagatggtgggatgagagtaggagagttgtgttgggactccaagtgttgaaggggcacagaaagagctgagtggcacagagaggttgtcccagagtagcggagtctgctttgg

SEQ ID NO: 126393 - DNA, 601 bp, Human
agcagtgtacagtagtgtttaagggcaggggctctaaagtcagacttccagagtaataccccccccccccaacctcacaaatcagtttctactatatttatatctgccatcccagtgttggtggtagggtcttcagatccctggggaagcagatggtgggatgagagtaggagagttgtgttgggactccaagtgttgaaggggcacagaaagagctgagtggcacagagaggttgtcccagagtagcggagtctgctttggggagaagagagattgactgaggatagcatcaagtttttyattttatgtacaaagatgatctttttagcttcacccaggaagtatgggttttgtgtcttcctcgtgtttaggtttttattctgacctaattaggtctaagctgaggtgcttatttctcttctggagtttatatcctagaagctctccaatcgaagccctctgcaggtatcctcaggtcctggagaaacacagcaggaaggcttgttggcttcggaaagggagggctatggtttaaagccagtaagatgtgggtttgattcttgactttgtctcctgtaggctgtgtggccttaaataagt

SEQ ID NO: 126394 - DNA, 601 bp, Human
gattcttgactttgtctcctgtaggctgtgtggccttaaataagttacctaatctcttgagtcctcagtttcctcatttgtaaggcagaggaaacaatgcctatgattatgctgattaaatgaaacagaggcacaaaataagtgtttaatgaatgacaactactattgtcattattcttcctatccatgctatctgccatgtattggaggcaaaagctgttactacttcatgcatatgcgctatgcaggcttccagaatgaaactgatggggtccctttcccccacatatgtgagaggggrtccctcttatttcaactcgttcctcattgctggtttggcatatctcagctactctaacccggcaagaatccacagaagaagccaagaaggaaaaaggcttatacatttgctttacccataagaaaacctcaagccctgtatctgaaaaaagaggaagataaaaggatctataagacttcaagttccatgagaagagggacatgtctattttgttcaatactctatgcccactgcctggcacataggcagcaaaacaaatatctgtggaatgctatgtaaaggcatctatagatgatgtgc

SEQ ID NO: 126395 - DNA, 601 bp, Human
aggtctcctgggaagaccataagatggggcaagcacaccacagtgaggagggggagtctggctatgactttagaatttcctgatcgaaatttctcctctaaagctccccaccctacttgggatctgaggttatcatcccctcccagtcccaagaacccttcttcccttgttggcagaaatctccaggaagcatgcccacaggaaccacaactcatgaatcagaagacagataattaaccgagggagtgactgagcagcttcagggatgaaccgcttcgttttacccagccctctctgctgmccacagagtgggctgctccaccccatcgcctctgctccctcttcctgaaccttggcccttcctgagtgggaccttcattgtgcctgatggagctcaggccactagtggaaatgaaggtgggagcagggaaatgactctgtttaggggaactgcctattccccgtgtgggaactgctggcatttattgaaacgtgagactctccagcaaaaaagtgatagcatctgcctttctgtccacacacacagtctcaccaaaaacactctttttttttttttgttagataattcaggtataattta

SEQ ID NO: 126396 - DNA, 601 bp, Human
gggcggatcacctgaggtcaggagttcaagaccagcctgaccaacatggagaaaccctgtctctactaaaaatacaaaatcagctgggcatggtggcatgcgtctgtaatcccagctactcgggaggctgaggcaggagaatcgcttgaacccaggaggcagaggttgcagtgagccgagattgtgccattgcactccagcctgagcaacaagagcaaaactctgtctcaaaaaacagaacaaaacaaaacaaatattgttatttctcaaataggttcatccacataggatcattgtcagkcgttaaaattgctggttcccttctaattctattcccctataatgttcatattaatcaggtggtgtgttctgtttagacatttcccctcgcatttatgtttatttgtgtgtgtgtgtgtattcctttacttaaacccatgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttg

SEQ ID NO: 126397 - DNA, 601 bp, Human
cagctgggcatggtggcatgcgtctgtaatcccagctactcgggaggctgaggcaggagaatcgcttgaacccaggaggcagaggttgcagtgagccgagattgtgccattgcactccagcctgagcaacaagagcaaaactctgtctcaaaaaacagaacaaaacaaaacaaatattgttatttctcaaataggttcatccacataggatcattgtcagtcgttaaaattgctggttcccttctaattctattcccctataatgttcatattaatcaggtggtgtgttctgtttagacayttcccctcgcatttatgtttatttgtgtgtgtgtgtgtattcctttacttaaacccatgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttggtgtcccaggggctgcaaagtgggacagagaagatgaagggaaatacttcaatttgctcctgccccttcccaccaccttc

SEQ ID NO: 126398 - DNA, 601 bp, Human
tgcgtctgtaatcccagctactcgggaggctgaggcaggagaatcgcttgaacccaggaggcagaggttgcagtgagccgagattgtgccattgcactccagcctgagcaacaagagcaaaactctgtctcaaaaaacagaacaaaacaaaacaaatattgttatttctcaaataggttcatccacataggatcattgtcagtcgttaaaattgctggttcccttctaattctattcccctataatgttcatattaatcaggtggtgtgttctgtttagacatttcccctcgcatttatgwttatttgtgtgtgtgtgtgtattcctttacttaaacccatgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttggtgtcccaggggctgcaaagtgggacagagaagatgaagggaaatacttcaatttgctcctgccccttcccaccaccttcaactggaactcctttaac

SEQ ID NO: 126399 - DNA, 601 bp, Human
ctcgggaggctgaggcaggagaatcgcttgaacccaggaggcagaggttgcagtgagccgagattgtgccattgcactccagcctgagcaacaagagcaaaactctgtctcaaaaaacagaacaaaacaaaacaaatattgttatttctcaaataggttcatccacataggatcattgtcagtcgttaaaattgctggttcccttctaattctattcccctataatgttcatattaatcaggtggtgtgttctgtttagacatttcccctcgcatttatgtttatttgtgtgtgtgtgtggattcctttacttaaacccatgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttggtgtcccaggggctgcaaagtgggacagagaagatgaagggaaatacttcaatttgctcctgccccttcccaccaccttcaactggaactcctttaactaattaacaatttggagttc

SEQ ID NO: 126400 - DNA, 601 bp, Human
ggctgcaaagtgggacagagaagatgaagggaaatacttcaatttgctcctgccccttcccaccaccttcaactggaactcctttaactaattaacaatttggagttcatgtaaggatttctttgggaaaaaaagaagatcctgctgttaaaatcaagcttgaaaaactttgcactagaagagagctccagaagtttggcaaaagacatattcagtagccacttaaaaagtccctgtagtcaaccctacatctctttgctaatggaaattttggatagagaaacctgggtctgtgagatcyactgatggctccagaccccaactttagccatcgcacgtgttgaactccaggttgagcctttgctggagccgcctgcaaggagcatgtttgaccaatccccagtggaggggagggtggtgtttcctttctgggacttccacaagttgagaacagaccatgctgccctgggcagttcttgaaggctgtgagagtgggcctgacaaagtttattccttttttttttccattctcttttattattattattgtttgaaattgacaaataaaaattatgtatatttatgatgtacaacatgatgt

SEQ ID NO: 126401 - DNA, 601 bp, Human
taaaaagtccctgtagtcaaccctacatctctttgctaatggaaattttggatagagaaacctgggtctgtgagatccactgatggctccagaccccaactttagccatcgcacgtgttgaactccaggttgagcctttgctggagccgcctgcaaggagcatgtttgaccaatccccagtggaggggagggtggtgtttcctttctgggacttccacaagttgagaacagaccatgctgccctgggcagttcttgaaggctgtgagagtgggcctgacaaagtttattccttttttttttccattctcttttattattattattgtttgaaattgacaaataaaaattatgtatatttatgatgtacaacatgatgtcttgaaatatgtgcgcattgtggaatggttaaatgaagttaaataacatatgcattacctcacatacatacttctgatttatttgtggtgagaacacttaaaaatctcctcccagcaattttcaggtagatgacatacggttattaactatagtcaccatgttgtacagtggatctcttgaacttattcctcttgtctaactgaaaatttatatcccttgacc

SEQ ID NO: 126402 - DNA, 601 bp, Human
accccaactttagccatcgcacgtgttgaactccaggttgagcctttgctggagccgcctgcaaggagcatgtttgaccaatccccagtggaggggagggtggtgtttcctttctgggacttccacaagttgagaacagaccatgctgccctgggcagttcttgaaggctgtgagagtgggcctgacaaagtttattccttttttttttccattctcttttattattattattgtttgaaattgacaaataaaaattatgtatatttatgatgtacaacatgatgtcttgaaatatgtgcrcattgtggaatggttaaatgaagttaaataacatatgcattacctcacatacatacttctgatttatttgtggtgagaacacttaaaaatctcctcccagcaattttcaggtagatgacatacggttattaactatagtcaccatgttgtacagtggatctcttgaacttattcctcttgtctaactgaaaatttatatcccttgaccagcatctcctcatgcaaaccataccccaaagctcatttctgtgttcctgctgagtttgccattccaagaggttttgatgctgaaggtgcagt

SEQ ID NO: 126403 - DNA, 601 bp, Human
ccccaaagctcatttctgtgttcctgctgagtttgccattccaagaggttttgatgctgaaggtgcagtttgtggaaagcccagcagactctggggagcctacatttaaataaatgcaaatgtcgacagggaggcagaacagaggacatttcaaattagctttaattttcttttagcttataaaagtaattaagcttattatttaaaaaaaggcagctcagaaatataatgcagaaagtaccagtaccagttccttgtagtcttgtccttaaagataaccactgttgatagttactgcagrgtttttttctatgtatttgtcaacatatataattatttatcattattgttatttctcaaataggataatcaataataggatcattgtcttttttttttttttttttgagatggagtctcactctgtcgcccaggctggagtgcagttgtgtgatcccagctcactgcaacctccgcctcctgggttcaagcaattctcctgcctcagattcccgagtagctgggatcacaggcatttgccaccacgcccagctaatttttgtgtttttgatagagacagggtttggccatgttggccagg

SEQ ID NO: 126404 - DNA, 601 bp, Human
caaattagctttaattttcttttagcttataaaagtaattaagcttattatttaaaaaaaggcagctcagaaatataatgcagaaagtaccagtaccagttccttgtagtcttgtccttaaagataaccactgttgatagttactgcagagtttttttctatgtatttgtcaacatatataattatttatcattattgttatttctcaaataggataatcaataataggatcattgtcttttttttttttttttttgagatggagtctcactctgtcgcccaggctggagtgcagttgtgygatcccagctcactgcaacctccgcctcctgggttcaagcaattctcctgcctcagattcccgagtagctgggatcacaggcatttgccaccacgcccagctaatttttgtgtttttgatagagacagggtttggccatgttggccaggctggttttgaactcctaaccacaggtgatccacccgcctcggcctcccaaagtgctgggattacacgcataagccaccgcacctggcccattgtctcttaataatatactctaggcatctttttatgtcagtttatggctttccattattt

SEQ ID NO: 126405 - DNA, 601 bp, Human
cgcacctggcccattgtctcttaataatatactctaggcatctttttatgtcagtttatggctttccattatttatcccaagagctataattctagccataaggcatactctttgttatatggatatatcagaatttacttaaccaattccctgttggcagacattgggatcattcccaattatttgctactacaaataaagctgcaggggatatccttattcatttattatgcacctttgttcaagtgtttctacagacttaatttcttgaatgaaagttggtgggtcgaagggcatgcrtattttaaatttaaattttagtaggtgttgtcaatttgtcctcccaaacggttgaaccagtttgctttcctaccaagacaggctggcagtaaggactggtgttagcaccgcggcctgctgtccacacccataacacatgagctgggggaggaaggctgcagaactggacagcaggatgccaaggaggtcaccaatagggcacccctgggctgagcctcggacagcttggtacagacctgcttcttctgtatactgaatgaggtggggtcgatgctaataaaaatttccagaactcttgag

SEQ ID NO: 126406 - DNA, 601 bp, Human
tgaataataagtctctttcctttttgcttcccttctttctgtcttgcactcagcagccaggatgatctttttttgctcacctctgctcagattcctccagtggcttcccactatgtggagaaaaaagccacactctctaccatggcctatagcttcctagtgttctggtccctaactgctcctctaacctcctctgtgcttttctcttcctcctttctctccacctgctatttctttaacaggctgatgtccatccagatcttgccttgggttctttctggaatgtctgtgccttggatcktcccaggattcactctttaacatcattttgaaatgtcagctccacagagagaccttttctgatcacatgctctaaagagagtccttccccttattgcttgttattcctttatcctgctttattttcttacagcatttgccactgtttgaaattgtgcatttttgttgtgtattttttgttaccatcttcctcactaaaatgtaagcttcacaagagcaggggctttgtttagtttatcagtgtgtctccagtgcctaggagagtgcctggcacaggtagatgctcaatgaatatttgtcg

SEQ ID NO: 126407 - DNA, 601 bp, Human
ataaaccacttgtgcctatgtaggacagtaagcatgagatttttttttttcatgagtcacatggccaggtgactacaatgaggcatcatgtgagtcacccactgtccccatggacctaattgggaagtgagcagtcaaaggtcagtggcagggctggggacccagattagaactcctttctggcagagtgatagatgtccatagtgttagtggaacatcctcccttctcgataaacacctcttactgtgacttagccctctcctgtagtcccctgtcctcattagggtggcctgttcctayagtccagcatcctgtctcactggacaacatgtcctcaaaatagcccccattgacgcattatgacttccactggatccaattccctcccttgtttcctttgttcttccatttttcccaccctttgtctctcttctgcttctgtgattcaagctgatgtgccaaaccacagccttctacttctactttccaggcaaacttcttggctggtcttgattggattaaaatttttattttcaaaaaacttttttgaggcagggtctcactttgttgcccaggctggagtgcagtggcacaatcaca

SEQ ID NO: 126408 - DNA, 601 bp, Human
ataaaaccatcagatctcatgagagctcacttactatcatgagaacagcagcatggaggtaactgcccccatgattcaattacctcccatcaggtccctcccacaacacatggggattgtgggaactacaattcaagaggagatttggggggtggggcacactgccaaaccatatcatttcaccccaacccctcccaaatctcatgtcctcacatttcaaaacacaatcatgacttcccaacagttccttcaaatcttaactcattcaaggattaacctgaaagtccaagtccaaagtctyatctgagacaaggcaagtcccttctgcctatgagactgtaaaattgaaagcaaattagttacttcctagatacaacgggagtggaggcattgggtaaatacagccattccaaatgggagaaattggccaaaacaaacaggctactggccccacgcaagtctgaaatccagcaggacagtcaaatcttaaagctccaaaatgatctcctttgactccatgtctcacacctaggtcatattgatgcaagaggtggtctcccatggctttgggcagctccacccttgtggctttgcagggtac

SEQ ID NO: 126409 - DNA, 601 bp, Human
acctgaaagtccaagtccaaagtcttatctgagacaaggcaagtcccttctgcctatgagactgtaaaattgaaagcaaattagttacttcctagatacaacgggagtggaggcattgggtaaatacagccattccaaatgggagaaattggccaaaacaaacaggctactggccccacgcaagtctgaaatccagcaggacagtcaaatcttaaagctccaaaatgatctcctttgactccatgtctcacacctaggtcatattgatgcaagaggtggtctcccatggctttgggcagckccacccttgtggctttgcagggtacagcctctctcccagccactttcatgggctggcattgaatgtctgtggcttttccaggcacatggtgcaggctgtcaatggatctaccattctggggtctggaggatggtggccctctgctcacagctccactaggcagtgcccgagtggggggctctatgtgggggcctcaacccatatttcccttgtgcactcccctagcagaggctctccatgagggccctgccttgtagcaaacttctgcctggacatccaggtgtttccatacatcctctg

SEQ ID NO: 126410 - DNA, 601 bp, Human
gacatacccaataccaggtaatttataaaagaaagaggtttagttgactcacagtttagcatggctgagaaggcctcaggaaacttacaatcatggtggaaggggaagcaaacacatccttcttcacatggtggcaggatggagaagtgctgagcaaagggggaaaagccttttattaaaccatcagatcttgtgagaacttactattaggagaacagcaacatgaggataatcatccctgtgattctattacctcccactgagtccctctcatgacctgtggggattatgggtactacarttcaagatgagttttgggtggagacacagccaaaccatagcagtgctcatatctcccatggtcctcttccctcttctaacccttcttgatgtcttcttgtgcttctctctcttgtgaatatcaatggcatttatgtccagaattaccccttggcatgccaattcccatggaaactccagaaagggagggagatacttaaaatagttcaggctgtgctcctctcagaagtcttctgataggggaaaaaagagaggctctgtccacatctgcctgggaagagagcaattataaggctaagag

SEQ ID NO: 126411 - DNA, 601 bp, Human
tggtcctcttccctcttctaacccttcttgatgtcttcttgtgcttctctctcttgtgaatatcaatggcatttatgtccagaattaccccttggcatgccaattcccatggaaactccagaaagggagggagatacttaaaatagttcaggctgtgctcctctcagaagtcttctgataggggaaaaaagagaggctctgtccacatctgcctgggaagagagcaattataaggctaagagatggccaggcagctcatgcagggagaagtcttgggttgcattgttcgttgtgaacattsaggaattctgaaactagcagccacttttctttcattatagacattgcatggctcagggctgccccatctcagaggtgaccttgatgctttaaggccaggcttggaaccaatgtcatcattcccactcatgggcctcacgcttacattctgaagttgtagtcaagtcggagagtggagccccagaggttattcatgggctcataaaggcatcccacttgtagaattttaaagttgggcaaggcctttgaagttagatggactcaaggctctgaggaaacctggggcttccaggaggtgctt

SEQ ID NO: 126412 - DNA, 601 bp, Human
ggagatacttaaaatagttcaggctgtgctcctctcagaagtcttctgataggggaaaaaagagaggctctgtccacatctgcctgggaagagagcaattataaggctaagagatggccaggcagctcatgcagggagaagtcttgggttgcattgttcgttgtgaacattcaggaattctgaaactagcagccacttttctttcattatagacattgcatggctcagggctgccccatctcagaggtgaccttgatgctttaaggccaggcttggaaccaatgtcatcattcccactcaygggcctcacgcttacattctgaagttgtagtcaagtcggagagtggagccccagaggttattcatgggctcataaaggcatcccacttgtagaattttaaagttgggcaaggcctttgaagttagatggactcaaggctctgaggaaacctggggcttccaggaggtgcttcaaggattccgcatataatctagggtttttgggagaacaatgaaagtttaaattgcctgaggaattgttgtagcccatttacatgttttatattggaattctatgcataattttgagaaatgagctcag

SEQ ID NO: 126413 - DNA, 601 bp, Human
aaactagcagccacttttctttcattatagacattgcatggctcagggctgccccatctcagaggtgaccttgatgctttaaggccaggcttggaaccaatgtcatcattcccactcatgggcctcacgcttacattctgaagttgtagtcaagtcggagagtggagccccagaggttattcatgggctcataaaggcatcccacttgtagaattttaaagttgggcaaggcctttgaagttagatggactcaaggctctgaggaaacctggggcttccaggaggtgcttcaaggattccrcatataatctagggtttttgggagaacaatgaaagtttaaattgcctgaggaattgttgtagcccatttacatgttttatattggaattctatgcataattttgagaaatgagctcagttgcttaaaaaagcaaagcaaaacttcatctattcccctacctttcattttgccccagtgcatatttactgagcatctccactgagtaagaactggagctgagctgggcagggcagagcaggtctcaagggacttaaaatctgttgggtggcagtgttgttaaggcagacacataaattatt

SEQ ID NO: 126414 - DNA, 601 bp, Human
tttcccttttttttgagacagagtctcgcactattgcccagggttggagtgtaatggtgatcatttccgtttttatggttttcaataggtcaacatctactcttacagtattgtaaaatatcctgattaatagaagccaaataataggtacatactcttagaaaatcagataatccctaagcatggtgggtcagctagtcaacattctgcattacattgaaaggacatttgtattttctttgcctgtttccaaattttatgtaatctttctttctttctttttttttctttctttctttcyttctttctttctttctttctttctttcgttctttcttttctttctttctctctccttccttcctttctttctttccttttttttcttttctgagatggagtctcactgtgtcacccaggctggagtgcagtggcatgatctcagctaactgcaacctctgcctccttggttcaagtgattctcctgcctcagcctcctgagtagctgggattacaggagtgcaccaccacgcccggctaatttttgtattttttagcagagatggagtttcaccatgttggccaggctggtctcaaactc

SEQ ID NO: 126415 - DNA, 601 bp, Human
ccttttttttgagacagagtctcgcactattgcccagggttggagtgtaatggtgatcatttccgtttttatggttttcaataggtcaacatctactcttacagtattgtaaaatatcctgattaatagaagccaaataataggtacatactcttagaaaatcagataatccctaagcatggtgggtcagctagtcaacattctgcattacattgaaaggacatttgtattttctttgcctgtttccaaattttatgtaatctttctttctttctttttttttctttctttctttccttcyttctttctttctttctttctttcgttctttcttttctttctttctctctccttccttcctttctttctttccttttttttcttttctgagatggagtctcactgtgtcacccaggctggagtgcagtggcatgatctcagctaactgcaacctctgcctccttggttcaagtgattctcctgcctcagcctcctgagtagctgggattacaggagtgcaccaccacgcccggctaatttttgtattttttagcagagatggagtttcaccatgttggccaggctggtctcaaactcctga

SEQ ID NO: 126416 - DNA, 601 bp, Human
gcactattgcccagggttggagtgtaatggtgatcatttccgtttttatggttttcaataggtcaacatctactcttacagtattgtaaaatatcctgattaatagaagccaaataataggtacatactcttagaaaatcagataatccctaagcatggtgggtcagctagtcaacattctgcattacattgaaaggacatttgtattttctttgcctgtttccaaattttatgtaatctttctttctttctttttttttctttctttctttccttctttctttctttctttctttcttttgttctttcttttctttctttctctctccttccttcctttctttctttccttttttttcttttctgagatggagtctcactgtgtcacccaggctggagtgcagtggcatgatctcagctaactgcaacctctgcctccttggttcaagtgattctcctgcctcagcctcctgagtagctgggattacaggagtgcaccaccacgcccggctaatttttgtattttttagcagagatggagtttcaccatgttggccaggctggtctcaaactcctgaactcaagtgatccgcctgcctcg

SEQ ID NO: 126417 - DNA, 601 bp, Human
ggttttcaataggtcaacatctactcttacagtattgtaaaatatcctgattaatagaagccaaataataggtacatactcttagaaaatcagataatccctaagcatggtgggtcagctagtcaacattctgcattacattgaaaggacatttgtattttctttgcctgtttccaaattttatgtaatctttctttctttctttttttttctttctttctttccttctttctttctttctttctttctttcgttctttcttttctttctttctctctccttccttcctttctttctttccttttttttcttttctgagatggagtctcactgtgtcacccaggctggagtgcagtggcatgatctcagctaactgcaacctctgcctccttggttcaagtgattctcctgcctcagcctcctgagtagctgggattacaggagtgcaccaccacgcccggctaatttttgtattttttagcagagatggagtttcaccatgttggccaggctggtctcaaactcctgaactcaagtgatccgcctgcctcgtcctcccaaagtggggagattacaggcatgagccaccacgcctggccat

SEQ ID NO: 126418 - DNA, 601 bp, Human
gagaggacagtggcttctgtctaagcagatgcctgggtttggcttcctggctgagcttctcaaggtgattttggttctcctggttgtttctgctcctcctcgtagcctttgctctgtcctttgacagtatgaggactgttcacatttgaatagcaccttatagtgtaccaagtgcttccccttacctcactgaattcttgtacaaatcctgagagacagatattgtcatcccatagaggctagttgagttgcccaaggtcatgaagtagttagcaggaagaacattcagaattcaagcacraaccttccaactctaaaattccatgttcttttagtgtatatcagtcagccttttctaacatttctgcacttcctcctagagcattttgtggttggattccaagatatatgcattgagaagcttgagaagatttcagatttgcttttcttttgccagtcagtgggacactgccaccaaagtcacctcaccctccacgcccccactgtatttaggctatgtgttaatgttagtgcatctgggccttggatcccctgtgtagtggctgtgaatatcactagaatgactgaagaggggatacat

SEQ ID NO: 126419 - DNA, 601 bp, Human; identical to SEQ ID NO: 18191

SEQ ID NO: 126420 - DNA, 601 bp, Human; identical to SEQ ID NO: 18192

SEQ ID NO: 126421 - DNA, 601 bp, Human; identical to SEQ ID NO: 18193

SEQ ID NO: 126422 - DNA, 601 bp, Human; identical to SEQ ID NO: 18194

SEQ ID NO: 126423 - DNA, 601 bp, Human; identical to SEQ ID NO: 18195

SEQ ID NO: 126424 - DNA, 601 bp, Human; identical to SEQ ID NO: 18196

SEQ ID NO: 126425 - DNA, 601 bp, Human; identical to SEQ ID NO: 18197

SEQ ID NO: 126426 - DNA, 601 bp, Human; identical to SEQ ID NO: 18198

SEQ ID NO: 126427 - DNA, 601 bp, Human; identical to SEQ ID NO: 18199

SEQ ID NO: 126428 - DNA, 601 bp, Human; identical to SEQ ID NO: 18200

SEQ ID NO: 126429 - DNA, 601 bp, Human; identical to SEQ ID NO: 18201

SEQ ID NO: 126430 - DNA, 601 bp, Human; identical to SEQ ID NO: 18202

SEQ ID NO: 126431 - DNA, 601 bp, Human; identical to SEQ ID NO: 18203

SEQ ID NO: 126432 - DNA, 601 bp, Human; identical to SEQ ID NO: 18204

SEQ ID NO: 126433 - DNA, 601 bp, Human; identical to SEQ ID NO: 18205

SEQ ID NO: 126434 - DNA, 601 bp, Human; identical to SEQ ID NO: 18206

SEQ ID NO: 126435 - DNA, 601 bp, Human; identical to SEQ ID NO: 18207

SEQ ID NO: 126436 - DNA, 601 bp, Human; identical to SEQ ID NO: 18208

SEQ ID NO: 126437 - DNA, 601 bp, Human; identical to SEQ ID NO: 18209

SEQ ID NO: 126438 - DNA, 601 bp, Human; identical to SEQ ID NO: 18210

SEQ ID NO: 126439 - DNA, 601 bp, Human; identical to SEQ ID NO: 18211

SEQ ID NO: 126440 - DNA, 601 bp, Human; identical to SEQ ID NO: 18212

SEQ ID NO: 126441 - DNA, 601 bp, Human; identical to SEQ ID NO: 18213

SEQ ID NO: 126442 - DNA, 601 bp, Human; identical to SEQ ID NO: 18214

SEQ ID NO: 126443 - DNA, 601 bp, Human; identical to SEQ ID NO: 18215

SEQ ID NO: 126444 - DNA, 601 bp, Human; identical to SEQ ID NO: 18216

SEQ ID NO: 126445 - DNA, 601 bp, Human; identical to SEQ ID NO: 18217

SEQ ID NO: 126446 - DNA, 601 bp, Human; identical to SEQ ID NO: 18218

SEQ ID NO: 126447 - DNA, 601 bp, Human; identical to SEQ ID NO: 18219

SEQ ID NO: 126448 - DNA, 601 bp, Human; identical to SEQ ID NO: 18220

SEQ ID NO: 126449 - DNA, 601 bp, Human; identical to SEQ ID NO: 18221

SEQ ID NO: 126450 - DNA, 601 bp, Human; identical to SEQ ID NO: 18222

SEQ ID NO: 126451 - DNA, 601 bp, Human; identical to SEQ ID NO: 18223

SEQ ID NO: 126452 - DNA, 601 bp, Human; identical to SEQ ID NO: 18224

SEQ ID NO: 126453 - DNA, 601 bp, Human; identical to SEQ ID NO: 18225

SEQ ID NO: 126454 - DNA, 601 bp, Human; identical to SEQ ID NO: 18226

SEQ ID NO: 126455 - DNA, 601 bp, Human; identical to SEQ ID NO: 18227

SEQ ID NO: 126456 - DNA, 601 bp, Human; identical to SEQ ID NO: 18228

SEQ ID NO: 126457 - DNA, 601 bp, Human; identical to SEQ ID NO: 18229

SEQ ID NO: 126458 - DNA, 601 bp, Human; identical to SEQ ID NO: 18230

SEQ ID NO: 126459 - DNA, 601 bp, Human; identical to SEQ ID NO: 18231

SEQ ID NO: 126460 - DNA, 601 bp, Human
tccatctcctgggctcaagtgatcctcccacctcaccctcccaagtagccaggactacaggcacacatcaccgagccagctaatttttgtatttttttcccttgtagagacagggtctcactctgttacccaggctggtctagaactcctgggctcaagtgatcttcctaccttggcccctaaaagtgctgggattataggcataaaccaccatgcctggccatggttagtgcttggccagattagatgaaaacaaattaataattatttgagcaaaagctttcctctgtgttctgaattscacctgatacatttctgtcccttgtccacatctcctatcactgtcacagggaatggaaaataggagaagggcaaaagagacggggacacaggggtgaaataggagaggttctatccccgaatgctgtggaatcactgaagagtgataggctgaatatagctccttagaaatagtggcagggaacaggtgtggtggctcatgcctgtaattccagcactttgggaggctgaggcaggtggatcgcttgagctcaggagtttgagaccagcctgggcaacatgaagaaaccccatctctaca

SEQ ID NO: 126461 - DNA, 601 bp, Human
acaggtgtggtggctcatgcctgtaattccagcactttgggaggctgaggcaggtggatcgcttgagctcaggagtttgagaccagcctgggcaacatgaagaaaccccatctctacaaaaaaatgcaaaaattagccagacatggtggtgtgtgcctgtagtcccagctacttgggaggctgaggtgggaggatgtcttgagtcaggggaggtggaggtttcagtaagccgagattgtgccactgcactccagcctgggcaacaaaatgagaccctgtctgaaaaaaaaaaaaaaaaaaagaaacggtggcaggatggcattctacctcatctcctcctgttatttcctatcaattcccatgccaagaactaaagtgtgagcaaaatgaacattattctgtttcattgatgatgtattccagagaacggtgccttgggaaaacttctgagatgaattttaaacattcagggtagggaaggacttaaggaagtcactgtaagatgctattctgtttcctccacaggccaacaacccactgtataaagaggccacgtctaccttcaccaatatcacgtaccggggcacttaatgataagcag

SEQ ID NO: 126462 - DNA, 601 bp, Human; identical to SEQ ID NO: 18232

SEQ ID NO: 126463 - DNA, 601 bp, Human
gcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatagcgtgaacccgggaagcggagcttgcagtgagccgagattgcgccactgcagtccgcagtccggcctgggcgacagagcgagactccgtctcaaaaaaaaaaaaaaaaaaaaagaaaaaaattctatgtgaattgttgctgctttgggctattarataaattcatgcattatcccctctttaattcgtagacagtttttgctcatgttcttcctagtattgtgaatttaatatttactaaaatttgtataaacttgtcctcactgtttatatatacacaatttgtttttttgaaatattttaaaaagaatgtgaagcaagccattttaagcattatacttatatttacagttgaaaatacaaatgaaaacagcagtgcagtggctcgcacctgtaatcccaacactttgaaaggccaaggcgggaggttttcttgaacctaggagtttaggacca

SEQ ID NO: 126464 - DNA, 601 bp, Human
tcgagaccatcctggctaacaaggtgaaaccccgtctctactaaaaatacaaaaaaattagccgggcgcggtggcgggcgcctgtagtcccagctactcgggaggctgaggcaggagaatagcgtgaacccgggaagcggagcttgcagtgagccgagattgcgccactgcagtccgcagtccggcctgggcgacagagcgagactccgtctcaaaaaaaaaaaaaaaaaaaaagaaaaaaattctatgtgaattgttgctgctttgggctattagataaattcatgcattatcccctctytaattcgtagacagtttttgctcatgttcttcctagtattgtgaatttaatatttactaaaatttgtataaacttgtcctcactgtttatatatacacaatttgtttttttgaaatattttaaaaagaatgtgaagcaagccattttaagcattatacttatatttacagttgaaaatacaaatgaaaacagcagtgcagtggctcgcacctgtaatcccaacactttgaaaggccaaggcgggaggttttcttgaacctaggagtttaggaccagcctaggcaatatagcaaaacccca

SEQ ID NO: 126465 - DNA, 601 bp, Human
aaaataacctgcttataacatcctaactgcataaaattaccttcacagtttttttttcttctgtatctttgttgttttcctgcattgactttcttattcatattctgaatcacattccttgatccttatatttttacactagcttttggtatatctttcatctcattgtggtcctatgttatattttatactggatggtagggtttctggtatacaggcctccagccctaggatcatgtttgttattcagagttctacattaaaaaaggaattcatttttataaatgaattcataaaaatkaaaggcaggtgccaagtggtattctgtaagaggcatggcttcatggacttgtaaagggcaagaaagcaaatgagacactaagcttttaagtggtggttgctgaaattaggtccaggagtttctcctgagctttaggtttgaaagcccaaaacacacaaaacccacagtgtttaactggttgcttgtcagtctcccccaccaaactatgagctctttgagggcaagtggtagggaaaggcatcctgagtcatttccctttgtatgtctagtgcacagtgacgtagtaggcatttgggaaag

SEQ ID NO: 126466 - DNA, 601 bp, Human
acttcagtgtttatatctctatcagcattttggtcagaaccgtttaaccagtctttaagaagtttccagactttccctcatttccctgtcttcttctaagccctccaaactcttccagcctctgcctgttacccagctacaaagccgcttccactttttaaggtatctttatagcagtgccccacacctcagtaccaattttctgtgtgtgttcatttttgtgttgttataaagaaatacttgagactgggtaatttataaagaaaagagatttaatgggctcacaattctgcgggctatrcaggtagcatggcactggcatctgcctggcttctagggatgtctcagagtgcttttactcatggcagaaggtgaagcaggagcaggcacgttacatgatgagagtgagagtgagagaaggaggagttcccagactcttaaccagatctggcatgaactactgagcaagaactctcttattaccaaggggatgatgctgaaccattcatgaaggattcgcccccatgatccaattaccccactagaccccacctccaacatttgtaatcacatttcaacgtgagatttggaagggataaac

SEQ ID NO: 126467 - DNA, 601 bp, Human
gctccaacgctgtagcctcagcctagctcccttcttgtctactttaactttctgagagctctcattgggcttgtggctccagaatcatctgtatattgatgactctggctcagacttctccttgagttctcaatatggatagccagctgtctactagacacctatacttgttttgtttaaatctatgaaacagaaccattaactcctccctcccctttcctcctaattcttcaattctcaaaattgcctgtcttggaatatgactaccatccacccacttaagtgcttgaagacccctccycctcgcaaaaaaaaacaaaaacaaaaacattctttccctttcatcctacatccagtccttaagtacgttgtctgatctccttccaaaatacctggcaaatccacttatccccttctgcctccacttctaaaacccaaatacaagcaccatcatctatactttataagcagcaacctcccaactggtctttttccttcaatcttgctctcttcaatttccttcagatagcaatttatgtgatttttctaaaatgcaggttagttaccactactctgctttaattgttttcattgcacttta

SEQ ID NO: 126468 - DNA, 601 bp, Human
tagcctcagcctagctcccttcttgtctactttaactttctgagagctctcattgggcttgtggctccagaatcatctgtatattgatgactctggctcagacttctccttgagttctcaatatggatagccagctgtctactagacacctatacttgttttgtttaaatctatgaaacagaaccattaactcctccctcccctttcctcctaattcttcaattctcaaaattgcctgtcttggaatatgactaccatccacccacttaagtgcttgaagacccctccccctcgcaaaaaraaacaaaaacaaaaacattctttccctttcatcctacatccagtccttaagtacgttgtctgatctccttccaaaatacctggcaaatccacttatccccttctgcctccacttctaaaacccaaatacaagcaccatcatctatactttataagcagcaacctcccaactggtctttttccttcaatcttgctctcttcaatttccttcagatagcaatttatgtgatttttctaaaatgcaggttagttaccactactctgctttaattgttttcattgcactttaaggtgagaatgc

SEQ ID NO: 126469 - DNA, 601 bp, Human
ttagttaccactactctgctttaattgttttcattgcactttaaggtgagaatgccattctcctctccctagcccccatgttcttacctttggccactttttccattttgaccctctcttctttcctccagggtcactgggttttactacagtggctttgcttctggctagtaaatcttctaatcttgttttgatctctgggcctttgtatttgcttttgctgctgggaatgttctgctcgaaagtcttctcacccttgacccctggaagttcagacagaagccaaatgttagctccttaraaaggctaatgtagcccactaagagagttctattggcccttttttattgtcttcattgtacttgtctgtagttattttaattgtctactgtctacctccaggatagtataaacttattgaatgttcttgttcacactgactcctcagcatgtagaacagtccctagaagtagtaaatattcagtaaatatgtattgggaaacagactattgttacaaaactgttcgttttattatatttagattgtgtaagtttattaatagaaattaattgtccccaaaattgaattaataactatagt

SEQ ID NO: 126470 - DNA, 601 bp, Human
gagttaggctcatataaccactatctccatttttttttctttttgctggtaagagcattcaaacacaagacaagacaaacctacgcatagactaatctcatccttattactgcagtccattgctgccttgctttctattgactctgtcttaaagattagagctctttggaagctttcaactgataagtcttttttttttctttttttttttcaactgagaaatctaaaatactttccgtattgcccagtatggaccctgttatagttgcaagtgagatcattttctgaaatctttgaatcktgttgaatccttcaatgaagtaaataattactttaaagctatatgttcatttctcattatttattctaatgtatttatattccctcttctactctttgcctgcctgagcagtgagattaatagttaaagcacttaaagctgagagccttaacagtaatctactgttttcctgtcttcctcctttgatgttctcttggaataggctcttgccaaaaaaacaaattgaagttaggtttaatatgagaagtcaaaaatgatgttatcctggttatctctgccttcttctctagcattcttttt

SEQ ID NO: 126471 - DNA, 601 bp, Human
cattttgatgaaaaatgttccctcaataatgaatttttaaatgaaataatgtaaagagtggtgtcatatctctttaatgcccagctttattgaagatagctcggttctcctgtctgcttctgtatttattatgtcacattatcacatgcagtgtaatctttggaaaattatgttacacattaatgaaatatgagaccaataattatgtcttcaaattatgaaaataggaatccctctcaggtttcacgacagcactttgagaactacttctctgtactgttaatgtacaaacttggtacawcacccaatgaatagctcaactaggaggttttaaaatggaatatttgccttgtggtagagagtattgactgaatttagattgtgcatgtctctcagttgaatatatttacaagagaatacctttgataatacaggtttttattattatatttgagcttggactttactgaaaacattgttaaaattctttatatatttatacatatatataactgtaagctgtagtcattttgtaactttgatcctttttcccctataacttctctaaaaatttgtaatcattgtcagtaggtaggaaagg

SEQ ID NO: 126472 - DNA, 601 bp, Human
tccatgtcagattcagagctgaaaattgtataattgtccgtaattctttcccctccttaacctctgttgtgttggtctttaaacttttttggttatttactctatcaggaaaaaaatgagcacatacctccaaatgatgcatttattaattatatttataactatataatttgtatattttcagcatatagaaaaaatagaaattgaaagtaaaagataaagctgggcacagtggctcatgcctgtaatcccagcactttgggaggctgaggtgggaggattgcttgaggccaggagttcraggccaatctgggcaatgtggcgagatcccatctctacagaaaattttaaaatgagctgggcgtggtggcatgcgccttgtggtctaagctacttgggaggctgaggtaggaagattgcttgagcatgcagtgagccacattggcaccactgcactccagcctgagcaacaaagtgagactctgtctcaaaaaaaaaaaaaaattaaaatttaatgtttgctttcttcttgtagccataaaacattattgttaacctgatttaggtctaagtttaatttcagaagttggctttaatgtct

SEQ ID NO: 126473 - DNA, 601 bp, Human
ctatagagttttggctcattctctcccccctccccacctcccaccccacatccttttctgatctctattctgccatttgtactgattttaatctctccctggattttttttttcttagatggctggttctctaccaatatttggtagctcaaatgtcatgcatacctcaatggggccttctctgctcactgaacctcagttatccctcttttttcatttaatagcacatcactatgtttttcttcatggcacttgtcgatatgtgaaattaattatttgtgtattattatctgaattcttyatataccgtccccagtctgagtatggattccatgaggagagagagcttgtgtgtcttactcactactgtatttctagcccctaaaatagtgtctggcacctagcctgtgctcaaatggttggaataacaagtagcagtttgcttaacttttcatgttataaaagccaagttttaatcacatttcagtaaaaatgacatagtaaataagcatgattcatgggtttcacgtaatactaacttctcatgtatatcttgtctatcatatgtaataattaatatggttagctcttggttgagtgc

SEQ ID NO: 126474 - DNA, 601 bp, Human
tgttgatagattgccaacattttatacattgtcagatgattgctgctgaaaccagagtcaaacctgtgatatccacaagggtcagttaagttagaatcacaactttagagcaaaacctaagtttaaccataactttttaagatttataaatgcatgccaaaagaagcttattgcaaagaaccagacacatttatattggccagaaaatcctattgcaaaaaaatcagagtaattacatttataaacaccattataaataggataaaagttccaattctaatatagacttaacgtttcatcaaaaaaaaaaaaaatcttgagatgtgtataccttcagtatcctgtgccacttagaacattaggagatatacgtaatgctaaatgacgagttaatgggtgcagcacaccaacatggcacatgtatacatatgtaacaaacctacacattgtgcacatgtaccctaaaacttaaaatataataataataaaatttaaaaaaaagaaaaaagaacattcacaccctgtttggatttttctttgtattggtgtggttgtcatttataccaaatagccagaaagagcttggatatataaatataat

SEQ ID NO: 126475 - DNA, 601 bp, Human
gttgtttctttataagcagtgtttttctcagagaagtgtccctcataccttaggttacaattaatgagcattcattgaacccctacaaattctaggcagtatgctaagcactttacatttataggtttatatgagaaatgtaaatctcatatttctatgaagtgtacagacagggaactgagttgttaaaatttacctaatattacatggtaagtgagtagtagattgagctttgaacttggatatgactgattagagttaaaaccttaagcacaagaaataagttttatttaatgtcttrctaaatgtattttattgatcaagacatggtggctcacatctgtaatcccagcactttgggtggccaagacaggaggattgcttgagcccaggagtttgagaccagcctgagcaatatagtgagaccctgtctctacaaaatttttttaaaaaaattagcagagtgtagtggcgtgtatctgtggtcccagctactcgggagggttacttcagcccaggagatccaggctgtagtaagccatgttcacaccattgcactccagcctgggtgacagaccaagaccctgacttaaaaatatat

SEQ ID NO: 126476 - DNA, 601 bp, Human
tgtttttctcagagaagtgtccctcataccttaggttacaattaatgagcattcattgaacccctacaaattctaggcagtatgctaagcactttacatttataggtttatatgagaaatgtaaatctcatatttctatgaagtgtacagacagggaactgagttgttaaaatttacctaatattacatggtaagtgagtagtagattgagctttgaacttggatatgactgattagagttaaaaccttaagcacaagaaataagttttatttaatgtcttgctaaatgtattttattgaycaagacatggtggctcacatctgtaatcccagcactttgggtggccaagacaggaggattgcttgagcccaggagtttgagaccagcctgagcaatatagtgagaccctgtctctacaaaatttttttaaaaaaattagcagagtgtagtggcgtgtatctgtggtcccagctactcgggagggttacttcagcccaggagatccaggctgtagtaagccatgttcacaccattgcactccagcctgggtgacagaccaagaccctgacttaaaaatatatatatatatttatatatata

SEQ ID NO: 126477 - DNA, 601 bp, Human
tttgagttactataggtacttataatttgctaataagtggtcgggttaggattagtgcctaagtctgtccagttacaagcctgtgcactcatctctgaatttctgcattaagtggagaaaaggcaacctgtgaggttatttagtaaagatgaactaattatattttaataaaatttcatcacacattttgctcatctttttactggttatgggaatttttagttatgtctctaatgttaaagttctgcactgaatggagtcgttgtagtgcggctgaagtttctatattactgccatcacwagaaaatacctgttaatacagccattctttaagggaaaaagcagagctctgaggttagaaacagcatgacctccagcggtagcatctttttggaagaacactgtgtggataaataagcatatattattaaaattgcttaaattgcatcattttactgctctctaggagtatgatggaaaaagtgacgtttttgcttctgtcctcagtacacttattatctaatagcaaatatttgctctttgtaatatgtagccaagtggtaatgctgactcatgtagtgttgggggaaaaggtggattt

SEQ ID NO: 126478 - DNA, 601 bp, Human
gcatcagggagcttgcctcttgaacatataaagcaccagtttattctaagctttggatacttccttatcattgcgtattattttgtcttagtttcagtacaaggccaaagatataattaagtctaagaaagaatcctaagtgtttttctcccagttctcctggggacaagactgtacttggaagcaaaaaattaaatctgacaatgtcaagttataaggtgcaagaaagaagtaatttctcagagaaattcaatactatcaagcaagttataactctttacagtgtttaatttatatctgkcaagggttagtgtctggaaatttaataatcacatttttctttcatttctattctgaaaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaagtaagtagaaaatagttcagtagacg

SEQ ID NO: 126479 - DNA, 601 bp, Human
gagttacagttttagtggtcgcagtgccagaaggtcttccacttgcagtcacgatctcactggcttattcagtcaaagtaagtagaaaatagttcagtagacgttgttatgtttaaagccttagctggtatagaaaatgcccatctagttactccttttctgcttctgaaagtgaggactttcatataaatgtacactattttctctagaaatgttgtcattgatgccctgtacctcccaccagttgaatatctctgaaggagacctgtgcattccacatagggcagccttgacacaatamtaagcacgactctgctgggcaaagttctagcataattttctctacgtgatagttatattgtcaagtcatgtcacctcctctttcccgtctgtaaaattaaggtgagcgtgttaggctaatgtttctaaaaattaaaaaaaaagttaaaaattatgatttccatgtgtaaaacctttcagtcagttctcatgacaattagagtaaaatgcaaactccttaccatggcctgcagggccctgccagtctggcctttgcttacctctcagtgctcaattcccttctcctttggcccagtctcac

SEQ ID NO: 126480 - DNA, 601 bp, Human
tttcaaaatgatcttgcaggtaaaaaattataaccaaacaaagaatgctgcttttgtaaattttcaaatgttaattactagttctctttaagaaacactgctgacagtgagcaatattaattaattagtcatcgtttctacctttgcactcttcattattagacctgtcttgataagaattttttttgcttactgtttgagtttattttcttttcaggcatttaacaactttcatttcaaaaataaagtggtaaatgtatcaaagtgataagatacagtataatcatctatctgtcctttkttgatattttaaagtaatttgaaatatttggggtaaatacaagttttggacacatagaacagtcattttaccgaactgccattagttcattttgagtagtcattaatgatactaatttttcaattgattagaaagatactggtaggattgacttatgctttttgaatagaaaattaataagaacaagttaactacttttttaagcctttattagatgtttatctagctctgttaccaattactgttcttttcacagaggtatagtctttatggattctctgttagtgtttcacaaaactg

SEQ ID NO: 126481 - DNA, 601 bp, Human
gacattttgcaaaaaccgttggagacatatattcagtattatttgtgtacggatgtaggtacctgaattgattcactaggttatgttatgcagcaataaaatgattgaaaccccagaaagctctggtactgtgtttagcttattttaataggtcaaatatgctaaaaaaaaaaaaatttcagtattacattggtactttatacattgtatttatagaaagctgggagttttctaattttaaaacaatttataatcattttaatgtaatgaggtgattggttttatatgcagcttaactagtttttttttttttggtcactgtagaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattggtaaggtttttgaaataatttatgaaaattaatt

SEQ ID NO: 126482 - DNA, 601 bp, Human
agttttctagtaaaattcttggtgtttgtgattttttttttttctgtgtgaacccaagataaatgaaataatagtacctacagtgcatatgctagcttttatggtttttaaagacagtgtctctttgggatcctatgtgttcatagcaccataacctagcacagtgccttgaagtgggtagaattttcagttattatttatcttaaattaaataataggtgccattatttgttttcacagtctctagactagcattgtctagtagagctttctgtgataataggaatgttctgtatattgkttagtacagtagccactagccatgtgtgaatactgacttctagttttcagtggctagtgcaactaaaagacaggatttttaaattttatttaattcaaattaaaatatcttgctagtagttgtcatattggatggcatgcagctctagactgatttccctctttaatttttttttgctatttggtttttcaccttttttaagtttgttgaacaactactgtgtgccaggcactatcctaaggtactagagacttaagagttttgagatctgatcaccggcctcaaagaagttactgtctt

SEQ ID NO: 126483 - DNA, 601 bp, Human
tttagcaggattcttattgctatttacattctgacagctgaccagaaaggcagttatgtaaaatgaattttaaaataaaaaaagctttcttcccaaaacttgaatgtaagacagatacaatgggctttaaataaatacaggtaaatataatcaaacaaatacacaatacaatggcttgttggttagtgttttttaagctcttcatggttttaggcccagttataccactttttttttttttaaatgataacatcaaaagtctaaatttagttcaaaaacaggctggccatgatggctcacrcctgtaatcccagcactttgggaggctgaggcgggcggatcacataaggtcaggtgttcaagaacagcctggccaacatggcaaaaccccatctctactttaaaaaaaaacatacaaaaattagctggatgtggtggtcgcgcctgtaatcccaactacttggaaggctgaggcatgagaatcacttgaacccaggaggcgcaggctgcagtgagccaagatggcaccactgcactccagcctaggtgacagagcgagactctgtctgaaataaataaattaatttagtttaaaaacata

SEQ ID NO: 126484 - DNA, 601 bp, Human
acaatggcttgttggttagtgttttttaagctcttcatggttttaggcccagttataccactttttttttttttaaatgataacatcaaaagtctaaatttagttcaaaaacaggctggccatgatggctcacacctgtaatcccagcactttgggaggctgaggcgggcggatcacataaggtcaggtgttcaagaacagcctggccaacatggcaaaaccccatctctactttaaaaaaaaacatacaaaaattagctggatgtggtggtcgcgcctgtaatcccaactacttggaagkctgaggcatgagaatcacttgaacccaggaggcgcaggctgcagtgagccaagatggcaccactgcactccagcctaggtgacagagcgagactctgtctgaaataaataaattaatttagtttaaaaacatagagaaactgtaagtacttggtagcttggacttgaaactactcttgttaaagcttgaatttactttggttttgcatttgtacagttaaaacttagacaaacgtattgtcttagagttttttttttagttacaagaaatcgctgttgataatttctttctaaatgtatc

SEQ ID NO: 126485 - DNA, 601 bp, Human
actttgggaggctgaggcgggcggatcacataaggtcaggtgttcaagaacagcctggccaacatggcaaaaccccatctctactttaaaaaaaaacatacaaaaattagctggatgtggtggtcgcgcctgtaatcccaactacttggaaggctgaggcatgagaatcacttgaacccaggaggcgcaggctgcagtgagccaagatggcaccactgcactccagcctaggtgacagagcgagactctgtctgaaataaataaattaatttagtttaaaaacatagagaaactgtaagtrcttggtagcttggacttgaaactactcttgttaaagcttgaatttactttggttttgcatttgtacagttaaaacttagacaaacgtattgtcttagagttttttttttagttacaagaaatcgctgttgataatttctttctaaatgtatctcctattttcaggcagatatagcattttagagcatactttcttgatttgttgatctatagataaagtgtgtgttctgcttgtacatttggccctttgtatccatggattctgcatccgcagaatcaaccaactgtggatcgcaaatat

SEQ ID NO: 126486 - DNA, 601 bp, Human
gggacaaaaaatatggatggttgcatctgtagtgaacatgtgcagactttttcttgtcatgattccctaaataatatagtgtaacaattatctacatagcaagttttggtcgaaggagagaatccttgtcacatgaaattattcttgccaaaaattagttaaccatgtatagagatactgctgtcatcaaagactgaatctcatggtgtaatccaataatcaaatacatctatggtagtaaaacctaaggtaattaaaatacttttatttaaattttatttggattaatgcgggactccaratattgagactgtgttcagtattccagtcccggaacattagaagtgaagagttgctgtctcctaaaaattcacagcacatggaaataattacaggacagtgacaagtgtctcaggcagaagtccttgactctgcctgtagagactgggaagggttttctggaagaggtgccagtttagctgagggaaggagaggaaccaagaggccctcattcatcagcgaattatgtacaagtttttcaatctaactagaagaggttgcggtgctgtaatgagatacgaagctagaagaattcacaggg

SEQ ID NO: 126487 - DNA, 601 bp, Human
cttgctatgttgcctaggctggtcttgaactcctgggctcaagcagtcctctcacctcagcctccaaaagtgctagaattacaggtatgagtcaccacacccaaccccagttaattcttaatatttccatgcacactattttaggccttttagaataacaagcaaaacataagcactgtattatgaatttatattcatcatcagacctcactcttttcataaaggagagcaaatctgagatcacctcacctgagttagcccatatttcatagaactttccaagttgcctttcttctcatayagtctgtgtttatcttagtatgtctaaatgttaactagaaataaacagctatgtggaatttttttaatattgtgcatttttccagtaacatacagtcttttctacaaaagagtactatattttgagaaaggcacagattatttgaagagttgtactaaatacaggggaatgtagttgcttggggttatattggaaacagtataaaattattattcttggtcataagaattttactttttagtaagcgtaatttaaacatgaaatacgcatgcatcaaaaatattgggcagagattttact

SEQ ID NO: 126488 - DNA, 601 bp, Human
gtgttccaagctttatattaaatatcaaagcaatcataaacttttaagacaggcaggcagacacatatatgcacacacctctgcacccaggcatctttttttccatcccaggctcttttttctgatgcacagttacatatgaaacctctgagtttctgggcccatgtggctaggggagcagatacttcagggaagtaaaggtgcacttaagagagtggcaaaggaaagtttgtagttgttgctttatcaaggtttgagatgtttacttctttattctgtgtcctatgttcttggagttatycagggagtaaatcatatctcgttaatacagttgtcattatacaccaagagttgcagtaattatgttgctgttaccataaatgtctttcaaccttgttggtggagcattgtcttaggtggtacagaacatcagccaaaatatagaactatgttaatatatttaatgaaagatttcattttatcactgtgtttctgccctaatatggaatagttttagaactacctatgggtgtcaaaattatttaacccttattgggtgaccttgcttagctaaaatagaagaaataatccatttagactt

SEQ ID NO: 126489 - DNA, 601 bp, Human
aagttaggatggtatttagaaaaattggttttgtaggtacatgatcttgtttggatttgttatatttcatatattgtttaccttgataatcattttcagtttcttaaaattcatgattatgataatcacttcagtttttttgtttaccatatgtgcttcatgcagtatttttgttttttttttttctctgttgaacagtttacttttacagaatatttttgacacaggaattactgaatttttcttaattctgataatttcgaggggtataagtatgctccacagagtaggtttaaatagwtaataaataggaattgaattttaaaactggataaaataaataggcttggattttcaaaagcctgtaattaagtttacttatatttctacttaaattgaattattattaatatagtttccttcctacctaaagtattgtgcacaaaattattattttcctcacagttactgtactgtgagaattttacatacagaaagtaataaagatcagagcaggtgtgagccagctcagtgtcatgccttagatcaagagtgctttcttatgttctttataagtagaaagtaaaacaactctggttcg

SEQ ID NO: 126490 - DNA, 601 bp, Human
ctggcctagtaacgtgctgaaactaaccagtcatatggcttaaatagatgtgtcagacaaaggaagcattaaccttaatcttatggaatgttttattcaagtgaagttagggataaagtaaatgatcgtatgtttttgtcttctcttgacttccaaggaacctggaattgggagcccagaaacctaggttttaagactctttagcactaattaggagttccttaacaagtcagccacccatcctctctgttgctcagttttattatttatgaagtggttagaaaaaaaaaatctctaataytgttcaacaaattcagataggaaaaatcttctcagaattgaagttttgctaagaagggatttaatctttctttgcctgccaccggtgtatgtgtgtgattgtgtgtgcacatatacttgttgccctcacctttacactctgcccctcttagagcttcactaactctcaaatctctaacttaagtttacacttttcttctgagctctagatattttccaaatttaacatgtttaaaaagtacatttatttccccccgattcttcactgctcacttttataccgactgattacaaagaaaaa

SEQ ID NO: 126491 - DNA, 601 bp, Human
tacatttttttaaacacattcacatgttcatttgaagaaatgtattattcattattgctgtctaaagagatgaatttggtgaccgcatcttttttctagaatgtcaaagtgttatttatttctcttaacaatgagtaaatgatgtctttattactaaacaggatttattagaatcaaagcaaaagcaaacactgtatttgaattgatacatagtaaatgctcaactagttggattttgtccttttttttctaaatctgaatgacgcttgagttaatagcacttaatgtcagtgtgtgcactgatgtttttaagtttgattgcccactaatctttttcatttatacagcagactgagaggaagatgaattgttgagctatctgcttaggggtgaaaatactagaaaacttttaacactttgtgtcttcttgggaaatttttcacagaagaatcccagaggatttgtttttgtttttgatctattctttccagataactgtagtaattgatttaagttttaatctgttacagagaaaaacactaaaactttatagacaaatgatagacaaatggcatatactcaaatatttatagctgtttaa

SEQ ID NO: 126492 - DNA, 601 bp, Human
taatggggccatacttaccctatttttgggggcggggggcagaattatgatttttaccctgttttggagggacggaattttatgatttttattttttattgtaaaatatacacaacataagatttactgttttaacaatttttaagtgtacaattcagtgacattgagtacattcacaacttacatcactacgatccatttccagaactttttcatcatcccagtgtgcctgttaatcagtagcacttcatttcttccttccagaacacctagtaacctctgttttacttctctctatgartttacctattctagatacttaatataagtggagtcatacagaatttgtccttttgtatctggcttatttcacttaatgttttcagggttcatctatattgtagcctgttaccagaatttcattctgttttatgacggaataatattccgttttatgtgtctaccacattttgttatccattcatctgttgatggacacttgagttgtttccaccattgggctgttgagaataatactgctatgaactctggtgtagaagtatctgttttagtttctcttctcaattttttgaggtatata

SEQ ID NO: 126493 - DNA, 601 bp, Human
cctcgaggagtttaccttcttttatgctgcagtatcttgtctatctttcctctccagtgctgaaccaggagtgggagttctggttctagacctccttactttatttttcctcatctgtagaatgatattataatttgggctggttaaactgtaaggctcctttcagttccatgataacagaactgatgactgaatgactttcacaagaaacacgtggagtccagtgagcaccagcaatgaactttcgcaactgcagaaattagtgattgtagctgagttgacacaacagtagctgaacttrttaattttactggaactttgaacccagtttgtgattatctcttgccgtgtcactgaatacattgagtacattggaattagattgacatattaaagttacttgaaaactcctgaacctacctgaacaatgaatgaatgaaaataatgaatgaatgaaaacaataaacattttacacttaaatgtttaatttagatgaactttatagaggagctaatagccaggcttctatttttgagatcccaatggttgtaaaggtgaccacatttgtcccctatgtagtccaagatcagtctcctgtcc

SEQ ID NO: 126494 - DNA, 601 bp, Human
atctcaagaccatgtttttcctttatagattttgccctttaatgagcgaaatgtaaaggcaaagtgagtgaaatgaaaatgaccagattgttgccactacttttaagtaaagttaacaacaaacttacatgatgctgtgtaggttacacagcgttttcatgttcatcatggtcagaggcagcctggatgcaaagtggatgttatggggtggtggggggcggtgagtagtttcatgaacttttaaaaagcacttccattaaaaaattcttcctagatcttctgtaaaccttttttaaagacrgctacaatgaccctggcttatttgctactatttctctgctttgttatattatcacccaagcccaccatggaccccatgctagagagggctaagacttctttttcctcatgtccacgctcccaagtcatgcttgtgtatcacctgtttcttatggacttccagtgtgttatgttgtgttagaattcccagttcagtttgagacagattttgcacttggcatattagtagttcccaccttgccattcatacttgctttgttgtttcatatttatgttttcttagcatgaaatgtagccgctg

SEQ ID NO: 126495 - DNA, 601 bp, Human
gcttttcatttgtgttttcctagttgagtgtcattttgtatattgattgaccatttgggttttcttttctgtcatttgcccttttttcatttaaaaaaaatgccttgtttgactttttgtattgatttgtaacaattctttatatattttctgcacgtcaatcctttgttatctgctgcagataccctccagtctgtgccattcatttgtttattttgtggctttggtgtacagaagttttttgttttcatgttgtcagatgtatccatctttttctttgtggtttgtgggttttgtgggrgtgggtagtttttggattttgtcttatttaagaaatcttctgtaacccgaggtcatttatgcacacctgtattttcttcagaaagtttgaaagctgctctgctttttccatttgggttttaagtgagcttgagtttatttttatgtgttacctgaggtggcctttttctgtacgggtaacaaaccggagctgttggcatttattgtagtcccttctttcaaaagctcccaaataacgtggggctgtgtctaggctgtttctttcctcttgggccagctgtagggtttgcctttccttgtc

SEQ ID NO: 126496 - DNA, 601 bp, Human
ctacctcaggctgcattcctacatcagcccccatacctccacacccccgcatcatcccacaatatcccagacttactttccggaagcaacggcctggtctcggactctagcagtgatttctagttgcttctcagggccacaggtcttgcctaggagcaccctggggagtcatttgacagctcacccagcttcttttggtgcccgagggcatatctggaggccatagggaagccctggaaaagactgggcacaagctgaagccaaagttgggtgcctggctggcattggtagatttggggtyctggtttgcattgctcacgatgcagaatggttgctgacctttcctccagcgttggggatgatgtgagagtccagcaggcccccttcatgtgggccctaacttggggaaatctccaccgtgagcaccaggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgtt

SEQ ID NO: 126497 - DNA, 601 bp, Human
ttctcagggccacaggtcttgcctaggagcaccctggggagtcatttgacagctcacccagcttcttttggtgcccgagggcatatctggaggccatagggaagccctggaaaagactgggcacaagctgaagccaaagttgggtgcctggctggcattggtagatttggggttctggtttgcattgctcacgatgcagaatggttgctgacctttcctccagcgttggggatgatgtgagagtccagcaggcccccttcatgtgggccctaacttggggaaatctccaccgtgagcaccrggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgttccttgatattgtcggagaaggatgtttaccaaacaggaggtccctgtctcagggtcttcctctgaatggtttcctccagtgagtcacttcagcatcctctcccccaacccgattccctttcaagcag

SEQ ID NO: 126498 - DNA, 601 bp, Human
acctttcctccagcgttggggatgatgtgagagtccagcaggcccccttcatgtgggccctaacttggggaaatctccaccgtgagcaccaggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgttccttgatattgtcggagaaggatgtttaccaaacagraggtccctgtctcagggtcttcctctgaatggtttcctccagtgagtcacttcagcatcctctcccccaacccgattccctttcaagcagcccaccctacttgtaatccacatgtcttgaatgaatttttgcatatcattttcttctatcttccttcaccaaatgatgtctcccttcttcacagcgatgctcagaactctttccatccacataacttacctggtttctctttctcagccccacccctctgtctgcttgcctgtgacaccactgtgcagagctgcccctctttctgtttgt

SEQ ID NO: 126499 - DNA, 601 bp, Human
gaaatctccaccgtgagcaccaggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgttccttgatattgtcggagaaggatgtttaccaaacaggaggtccctgtctcagggtcttcctctgaatggtttcctccagtgagtcacttcagcatcctctcccccracccgattccctttcaagcagcccaccctacttgtaatccacatgtcttgaatgaatttttgcatatcattttcttctatcttccttcaccaaatgatgtctcccttcttcacagcgatgctcagaactctttccatccacataacttacctggtttctctttctcagccccacccctctgtctgcttgcctgtgacaccactgtgcagagctgcccctctttctgtttgtttatacttatgtgtattgcttttctcgtgaatcttcccagggcttgttcatgtctgtttagcctgtcat

SEQ ID NO: 126500 - DNA, 601 bp, Human
atctccaccgtgagcaccaggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgttccttgatattgtcggagaaggatgtttaccaaacaggaggtccctgtctcagggtcttcctctgaatggtttcctccagtgagtcacttcagcatcctctcccccaacscgattccctttcaagcagcccaccctacttgtaatccacatgtcttgaatgaatttttgcatatcattttcttctatcttccttcaccaaatgatgtctcccttcttcacagcgatgctcagaactctttccatccacataacttacctggtttctctttctcagccccacccctctgtctgcttgcctgtgacaccactgtgcagagctgcccctctttctgtttgtttatacttatgtgtattgcttttctcgtgaatcttcccagggcttgttcatgtctgtttagcctgtcattcc

SEQ ID NO: 126501 - DNA, 601 bp, Human
gggacgcctggagacggcagacaagcagtctgtgcacagtgagtaattaactgtggagaccagagtcctttctctgatgacagggtgctaatgggctgggcttcctgactgcactctgccttgggggcttaatgattcagcgtggaatgagttttgttgttagggtggacagaaaaaccctatggcaaagtcactgatttccctgagtgtgccctttggaatcccacaagtcttatcccccattacccctccactcaacctgacatggccctatgggaatggaagcgcttgcctccatctrtcttaatctaattacctagtccttagaggaatgtactccataaaaattcagagatgtttaactggaattggccatttcttctgagctgagaactgtggctttttaggaggattattcagaaacgaacagcaatattaattagtttagttcccacagcatggtttcttttgagaagcatgctggttttttgttttttttcattttttttttttttttctattctgaggaaaggtcctttttctgagttggtcatatggacaccacctgcgggggctgcctacccaccccactgctgggctc

SEQ ID NO: 126502 - DNA, 601 bp, Human
cactgatttccctgagtgtgccctttggaatcccacaagtcttatcccccattacccctccactcaacctgacatggccctatgggaatggaagcgcttgcctccatctatcttaatctaattacctagtccttagaggaatgtactccataaaaattcagagatgtttaactggaattggccatttcttctgagctgagaactgtggctttttaggaggattattcagaaacgaacagcaatattaattagtttagttcccacagcatggtttcttttgagaagcatgctggttttttgttttttttcattttttttttttttttctattctgaggaaaggtcctttttctgagttggtcatatggacaccacctgcgggggctgcctacccaccccactgctgggctccctcaggacccattcctcctgttctctcatgtctcctttcgcagcttcaaaagcagctctgttcttggttctgtgccccaccttgttctaatctcaactgtctttgttcactgtgggcacaaagggctaggaaggggcagtgtcactgctgtcacttctttatggggcaagaagcagtctggatgctttct

SEQ ID NO: 126503 - DNA, 601 bp, Human
gaaacgaacagcaatattaattagtttagttcccacagcatggtttcttttgagaagcatgctggttttttgttttttttcattttttttttttttttctattctgaggaaaggtcctttttctgagttggtcatatggacaccacctgcgggggctgcctacccaccccactgctgggctccctcaggacccattcctcctgttctctcatgtctcctttcgcagcttcaaaagcagctctgttcttggttctgtgccccaccttgttctaatctcaactgtctttgttcactgtgggcrcaaagggctaggaaggggcagtgtcactgctgtcacttctttatggggcaagaagcagtctggatgctttcttttgtgcacagtttagcttctttgttcatcggactttgtttgccttctcagcaatctcattgttacatgattagaaatggaaagaggtcattttgactgtcttatcgaaagggatagggaaaatgaccgtatttatcgtatctctttacctctgtggattctttcctgggcctttcctattgatatttggtttattttggggacgtcaacattgctcagcccacccat

SEQ ID NO: 126504 - DNA, 601 bp, Human
ctgggggaggtgatagaatattctgaaaaccaacgtacatgttgaaaaactatgactatgcaaagaaaaagccccctcaaagggcacaattctatctgagtgatgccgctcaaaataaatagcctgtgaggtttgtgactcagaaaccttgtgaccccttacctctttggtgtcattttgaaattttgcctccagttctgttttttgactagatccatagccacctgaagcctaatgttgccatggagttttgttctgctctttggttcctgctgggttcttcttgggttgaaatgaaaartcacttcaatcagtccacccataatgaaatgctgatctaatgtttgatactccagcatgaaattaaaatgaaaccacccttgccacctccacccccagcgcctgtttccaaaagttttatgaaactttgtggatgctttacctcaaagatgcccttgggcttcttccaggagagccatataatccatagaaggtcaagaagaggtcagtgagcctgcttcctgtcccctgttctctgtcatgcatccagaatcagagcaacagattctgaagtcaagctgctggaatcttgtgtgctacc

SEQ ID NO: 126505 - DNA, 601 bp, Human
agccatactgttttagatgggagggtaagaaagatttgtatgtgaatggcatttcataagtgctagtcaaattactgaagagaagtctctgagtctttcaaacgccagcatcttctgacacactgggcattagctgcatgcagaaaactagttaattcaggcactaggagtaaagcacatgatgaaattaaaagacctgacgcctatctgtgaggagctcccctgttagcaggggcagttgaaaacacgtatgtgcaaaatgattccaaatctgagcagcaaagaaacagtggcataaccttttttttttttttggacaattgaaactggaatttaggtggtaaaaacagcactagtggagcagggcacaatgacacacgcctgtgatcccagcactttgggagaccaaggcagtggattgttcaggagttcaccatcctgggtgacatggtgagacattgtctctacaaaaaaatataaaaattagccgggcgtggtggcgtgagcctgtggtcccaactactctctggagcctgaggtgagaagatcacttaagcctggtaggtcaaggctgctctctatcctgggtgacagagtgaga

SEQ ID NO: 126506 - DNA, 601 bp, Human
ggcactaggagtaaagcacatgatgaaattaaaagacctgacgcctatctgtgaggagctcccctgttagcaggggcagttgaaaacacgtatgtgcaaaatgattccaaatctgagcagcaaagaaacagtggcataaccttttttttttttttggacaattgaaactggaatttaggtggtaaaaacagcactagtggagcagggcacaatgacacacgcctgtgatcccagcactttgggagaccaaggcagtggattgttcaggagttcaccatcctgggtgacatggtgagacatygtctctacaaaaaaatataaaaattagccgggcgtggtggcgtgagcctgtggtcccaactactctctggagcctgaggtgagaagatcacttaagcctggtaggtcaaggctgctctctatcctgggtgacagagtgagagcctgtctcaaaaaaaaaaaaaacacgaaacaaaccccagcactacttggcaggagagcttgtgattggcagaaaagagaagggaacgctctcacagctggcgaggacttggctcctgcctatagtccactttcagagcaaaagtagagccaccaggat

SEQ ID NO: 126507 - DNA, 601 bp, Human
tttggacaattgaaactggaatttaggtggtaaaaacagcactagtggagcagggcacaatgacacacgcctgtgatcccagcactttgggagaccaaggcagtggattgttcaggagttcaccatcctgggtgacatggtgagacattgtctctacaaaaaaatataaaaattagccgggcgtggtggcgtgagcctgtggtcccaactactctctggagcctgaggtgagaagatcacttaagcctggtaggtcaaggctgctctctatcctgggtgacagagtgagagcctgtctcaaaaaaaaaaaaaacacgaaacaaaccccagcactacttggcaggagagcttgtgattggcagaaaagagaagggaacgctctcacagctggcgaggacttggctcctgcctatagtccactttcagagcaaaagtagagccaccaggatgggcgttggtgtttccctctacagtgtgggtaacagggcaggccctgcgctcagtacccacattcccagctccactggacttccagctctgtgatcactggacacacttccagctgtgtgatcttggacaagttattctacctctctgggca

SEQ ID NO: 126508 - DNA, 601 bp, Human
ctgaggtgggagaattgtttgagtccaggaggctaaggttgcagtgagctgagatcgcgccactgcactccaccctgggtgacagagggaaaccctgtctcaaaaaaaaagaaaatgcagaagcacagcctcctctatccttagttaactctcagtctacttggagaggtaaactatagataaaatagctaaaggacacgagcaaacatttaacactgcattaaggggaagccatggaaaggaacatttggaaccagctaggttagtgagtagtcagagaaagcctttaggagacacccartgaggtcttgaaggaatagcttttcctaagaggagatcatgatacagagacaagtatcgttggaatgaacgatacttgtggagtggaactcatttggagagtgacagatctgaggaagttcctcttctgtgtggacagaggccaccccaggcctttgcttggctttttcttatccattagggtccgctgattctttcaccagcccctccggctgttctggcttggccttggccaaaagacagagcagtgagaccccaggaactgactgataagcaaagttaatcaagtgcctgtgtttct

SEQ ID NO: 126509 - DNA, 601 bp, Human
ttttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaatttctctggctgaggcttcttaattgctttctgggcagaatgtagattttggattcctgtccatgatgcctaatgttgatctcactttccttgtttctctcagttgctcattaatgtgtatttattwaaaaaaaaaaaaaaggatatggggcatgaggttagatgccatgcatataagttgcagtgggtgatatgtgctgagtgacttggggtctgccccggcattcacttatacttgtttcttactaagaaattgaatgtgctttaagctgaaaattagaaagcagtagggaaggacaggctggatggtttgggttgttggtttaggaataaaatgcccttttgttttggtggtgggtgatgccatctatagaagggttttaggtcattgtgttggtgtctttccgtctttcccacttgagaccct

SEQ ID NO: 126510 - DNA, 601 bp, Human
caagtggttctgtcaccttagcctcgcaagtagctagaaccacaggtgcacaccaccacacctggctaatttttttttgtagagaaggggtcttcactacgtgcccaggctgatctcgaaatcctggcctcaagtaatcctcccacccacccctcccagagtgctgggattacagggatgagtccctgcgcctggcctgtttgcagtttttagatattctcctgtgtttttttctagaagctttaattgtggctttagcttttatgtttaattctatgaaccatctcaaattaatttttaygtataatgtgaattgaggttcaatttttacacacatatctgtaagagagatacatatatataaaatacatacctgtgatattatatagtcagtcgttccagcaccatttgtggaaaagacttttctttccacttagcgttgctctggtaccttgatcaaaaatcagtcgacgacatgagagtggctctatttctggctgatattgctttctgtgtattctgggcatgaccaagagaatgtctgttggcaaagctccatctcctgatgccattcacccactcttggtaaagcgacttgatg

SEQ ID NO: 126511 - DNA, 601 bp, Human
aaaatcctggaaacaaatgtctatcaagaaagcaaagataatctaaacagcagcatattcataggatgacaaactattcaaccattataaagaaaaccgaatcaaaagcactggcttattagacaagagtttcccaaactatcatgctaaaacagtaacagcgagcttccaaattaatgttgcctttttttttttttttttccaaactgaaaggagggtggggaaaacaaacgcatcatatgtaaagcactgagtccagcctggctcttagtaagcattttaatcaccttcaaaaattaawtgtgacttacggaaacaggtcactgaatattatttcatttcacttattcatttatggcctgttttgctctatataaaattctgaagtggctccataatacagcatcttaaaaaaaagctttcaacttgccctttactcgcaaatgtttacaatgcaaaaaagtccctacaacgtaatatttaacgagtgatgcttttcaatatgccatacaaatctcaatactataattcaggagaagtactcctcctaccttactgtggcaatccattgaaaacgtatttctctccatacttgaaataa

SEQ ID NO: 126512 - DNA, 601 bp, Human
ttaaactgcacatagcctttgcctcggtaattccatttttaagaatctgatatacagtaatatatgtgtacagatataaaaaggctactattccaagaacaaaatcctggaaacaaatgtctatcaagaaagcaaagataatctaaacagcagcatattcataggatgacaaactattcaaccattataaagaaaaccgaatcaaaagcactggcttattagacaagagtttcccaaactatcatgctaaaacagtaacagcgagcttccaaattaatgttgcctttttttttttttttttccaaactgaaaggagggtggggaaaacaaacgcatcatatgtaaagcactgagtccagcctggctcttagtaagcattttaatcaccttcaaaaattaaatgtgacttacggaaacaggtcactgaatattatttcatttcacttattcatttatggcctgttttgctctatataaaattctgaagtggctccataatacagcatcttaaaaaaaagctttcaacttgccctttactcgcaaatgtttacaatgcaaaaaagtccctacaacgtaatatttaacgagtgatgcttttcaa

SEQ ID NO: 126513 - DNA, 601 bp, Human
ggctcaatgcaacctctgactcccgggttcaagcgtttctcctgcctcagccttcccattaggggggattacaggtgctcgccaccaggcccggctattttttttttttttttttgtatttttagtagagacggggtttcaccatgttggtcaggctggtcttgaactcctgacgtcgtgatccgcccctcctggcctcacaaagtgctgggattacaccgcgcccggccacgttttttccttcattactttttgtttttgagacggaagctcactttgtcgcccaggctgtagtgcagtrgccccgatctcagctcaatgcaacctccgccttccaggttcaagcaattctccttccttagcttcccaagtagctgggattataggcacgcgccaccatgcccggctaatttttgtatttttagtagagacggggtttcaccatgttggccaggctggcctcgaactcctgacctcaagtgacccacccgcctttattacttctttagtatcatgcacggaggattcttttcaatctaggtacatacatatttttaagtagtattctacattttcttctattttagaatttttattgctc

SEQ ID NO: 126514 - DNA, 601 bp, Human
gagaaccaccctaattcttgtttttcaactttctaataatcttaaatcaaatacaccagtaaacaaaattctgactgcgaacgcagacgtttatcacacatataaaaaacgtttttttcctttatttatttatttgagacagcgtctcgctctgtcgcccaggatggagtgcagtggtgcgatctcggctcaatgcaacctctgactcccgggttcaagcgtttctcctgcctcagccttcccattaggggggattacaggtgctcgccaccaggcccggctattttttttttttttttttgtatttttagtagagacggggtttcaccatgttggtcaggctggtcttgaactcctgacgtcgtgatccgcccctcctggcctcacaaagtgctgggattacaccgcgcccggccacgttttttccttcattactttttgtttttgagacggaagctcactttgtcgcccaggctgtagtgcagtggccccgatctcagctcaatgcaacctccgccttccaggttcaagcaattctccttccttagcttcccaagtagctgggattataggcacgcgccaccatgcccggctaattttt

SEQ ID NO: 126515 - DNA, 601 bp, Human
cagaaaaggcatgttagggattctagcacttatcattatggacagaattttatttgctgctctctacccgcaccattaaaatgccctatcagtacagagatgtgttcactgctgcatctccagcacctacaacagtgattggtacacacgaggtaaccaacaaatatctgctgaatgtaaaattccgctttaggaatccaaattgttacatatttcacagcttcttgaaccctaaatgtaacagtaacagctagtatagtgttcatttgccttgtcagtatattcaaggagctgttaagcrtataagccaattactttataattcttaatgtctccctcctattgagatattgataccaaacatatgcagaaaacacttacatcaatgtatccagattcaattcaaacatttaaaaacattaacaaggaaaaatacagaaactctgctaaacagcaagcccaggtttagaaaatgactttgtcacctcctccaacgaagaaagcacacaagaatgctctgttattacaggatgaccataagtttgctcgtatttttaagagtaaacaatgcaaatcctttgtttcttcaacaatgagttac

SEQ ID NO: 126516 - DNA, 601 bp, Human
cttgatttttcaagataatcataggaacaccaaaagaagcttactaccttttgctcagctgttggtactccaatgactgcctcataatgcatatctaattcttgcccctcagacagacatatacaatatttttctccaaaaagccacagaagtctaactgaaactattttctcccgaaaccaataaagtcctcatacaatggaataccatgaagtacaagaactgaatgaaaactaatgagctacagttctccacaacataatcttacaaacataatgctgagcaaaagaagccatatacracagaattcacactagaagattctgtatgcgcaaagttcagagagtcaaaactagtgctttcagaatgcataattaggtggtaactataaagaaaaactagaaaatgagaaacctagaagacaagatacatgcaatctttgaagaagggaggatatgacccagaaaaggcatgttagggattctagcacttatcattatggacagaattttatttgctgctctctacccgcaccattaaaatgccctatcagtacagagatgtgttcactgctgcatctccagcacctacaacagtgatt

SEQ ID NO: 126517 - DNA, 601 bp, Human
aaaaccaggtaggaggagtctcacttttcactgggagccctttgtacttttaattacattcatctattacttatcaaattatttttaaaacttaatatccttattgtaaacttgcttgtcattttctcatttcaaacatgcacaagggataactgcataacttgcacaaaaagcttctggtaaattaccagtctcaggttcaagacatttaggcttgtaggagaccaaggggaaaatgtattactcctctaagcatgattctagcactaccattccctagtaactcagacagatgctggtraacaggaaatgaactagaccaggcataaggagaccagagccgaaaggtatcatcaactagaaacgtgatcttaattttcctcacctacacaattagggaaatgggtgaaattatctcaaatgaaaagacttttctagctccaaaattctatcagactataattccaatgaacaggctacaaattcaataattagtgaagcactgcaggcatcaaaagtgactgcaattcatggttgctggattctgagttctgcgcacatttctaagtcagcatcaactgactagaatcacaatttctga

SEQ ID NO: 126518 - DNA, 601 bp, Human
attaaccactattttaatgagcattccataaagaaaaaatgttcactaatgactgagaattttgatgcattagaaaagcaaggggtgtggaggttcctttggaagaatacctaagaaacgcatggcttctggagtggagaaaggaaaaccaggtaggaggagtctcacttttcactgggagccctttgtacttttaattacattcatctattacttatcaaattatttttaaaacttaatatccttattgtaaacttgcttgtcattttctcatttcaaacatgcacaagggataactgcrtaacttgcacaaaaagcttctggtaaattaccagtctcaggttcaagacatttaggcttgtaggagaccaaggggaaaatgtattactcctctaagcatgattctagcactaccattccctagtaactcagacagatgctggtgaacaggaaatgaactagaccaggcataaggagaccagagccgaaaggtatcatcaactagaaacgtgatcttaattttcctcacctacacaattagggaaatgggtgaaattatctcaaatgaaaagacttttctagctccaaaattctatcagac

SEQ ID NO: 126519 - DNA, 601 bp, Human
ttttatatgtttaatcatatgtatctgatttaaatatgctacctatcaatacatttcaaacaaaggaaggccatgttgcaggtttatgaaagttaaggttagtattagataatgatttccttcaccatttaataatgaaacattaaaaagttgactatatcttatcagaaaaaaaaatttttttttttttttgagagggagtctcgcctctgtcacccaggctggagtgcagtggcatgatctcggctcactgcaagctctgcctcctgggttcacgccattctcccgcctcagcctcccragtagctgggactacaggcacccgccaccacgcctggctaatttttttgtatttttagtacagacagggtttcaccatgttatccaggatggtctcaatctcctgacctcgtgatctgcctgcctcagcctcccaaagtgctgggattacaggcgtgagccaccacacccagccaaaaacaactattttttaataattaatttacccattatctactatgtgcagatccaaacattcgtgagataatcaggggcagagtccagcaacatgattctttcccctttccatcttcctaataat

SEQ ID NO: 126520 - DNA, 601 bp, Human
gaaaatccaaaattcagaatgttccaatgagcatttcctttaaacatgacgtcatcactcgaaaagttttgaattttgcattttagatttcagatctgggatgctcaacccatatcaagtgctgatgaggatacgcaacaacgggagctcttatacactgccagtggtggtgttagatggtacagagaatttgaccatttctttaaaacttaaataattaccatgggacccacagcaagtcttttcctaagtatttacccaaaagaaataaaaagttatgttcatacaaaaacctgtacaytagaggtttgttcataatcaatggaaactgcaaaacacaaatataccacaactggagaacgaacacacaattatacattcatacaatgaaatgctactatgcaataagagaaactactgatagagtaacatcatggagaaatcccaaatgcattaggctaagtgtaagaagtcagcctcaaaaggctacatgttgtatgagtccatttacatgacattctagaaaaggcaagaatgtacaaaaagaaaccatatcattggttaagtggacgtgaggggaccgggatgattaaaaataggt

SEQ ID NO: 126521 - DNA, 601 bp, Human
atataaatactttgctgatcctgctctagatagtctaaattttattcggcatcatcttagaacaccaaacaactaagacagttgaaagtaccattctgtagcctcagagaatgaagtcaattaagttatgctttggcataactcagctcccactggcaagactttttcattgtccaaagattttaaaaatgtttttatttttaattattatagtaaacagtagttgtatatatttatgggatccacatcaatacattttgatacaagtataatgtgtaacgattaaatcagggtaactggratattcataacctcaagtatttatcatttctttgctgttacgaacatttcaattccactcttctagttactgtgaaatacacaataaattaacgatagttgccctattgtgctactaaacactgtatcttactccttctaaccatatttttgcacccattaaccaagtcttccatccctacttccctaccacccttcccggtctctggtaaccatcattctactctctgtctccgtgagttcatttttctttttttttttttttttagttcccacgagtgagaaaatgtggtattcgtct

SEQ ID NO: 126522 - DNA, 601 bp, Human
aagtttctaattttgatggggtccaatgtatctgttttcccttttgttgcttatacttttgacatcatatccaataaaccattgcctaacccaggtcacgaataattatccctgtgttttcttcaaagaggtttagagtttaagctcttatacttacacctatggttcatttaaacttaatttttgtaaatcttgtgaggtaggggtccaaattcattattttgcatgtggttaaccagctgtcctgggtctgttaatgactgttcttccctccagtgcattgccttggcaccccatcccwagtttacctcttatgcaatcacctccctagtttaaacactcactggctcacccttaaaattacctgactagtttccttgctttctatactcatcttttaatactttagtatacaaatatttaatcttttacataattctattttagaaaatgaaaaagcagagtaacgacgagcaactcattcctgaggaattcacttcatttcccaaagaattagaaaaatgtatgcattttctaagggcgagtatctgaaaactaaaaaggtgtgggtgtgttacagcagcaggagaggtgaacacat

SEQ ID NO: 126523 - DNA, 601 bp, Human
ctttgtttagtttatgtgaattacatgagttcttaatttcagaaattatgttccataaactttttgttttttagagacagggtctcactctgttgcccagaatggagtgcagtggtgcaatcacagctgactgtaacctcaaactcctgggttcaagtgatcctatcgcctcagcctcctgaagtaactgggactacaggtggacacgaccatgcctggctaaattttttgggggtgtgtagagatagggtctcactatgttgcctccactggtcttgaactcctggcctagagtgatgctcctgccttggcctcccaaagtactggaattacaggtgtgagccactgtgccagccacatttaaaaactgtaaattaaacgtgacatataaatggaaagagcactgtatgctgagtccaaacctgggttcaagttctcgctcttaaggggcattttactagacctttctgagacttaccttacttcacatggttaacacctacttcacagacaaatataatgaagggtctgaaaaacttataatgtactaagtacaaacaatagccttctaccagataaagggagtgtatcttagattaca

SEQ ID NO: 126524 - DNA, 601 bp, Human
tgaggcaataatatgctctctgtattagacttactaagagactatcatggtaccttcccaaggggttttcaaaagaaatggaaaatgtgccatttttttctcatctatcttcaacgtaaaaattgtatagttctgccaagacagttgatttttaaaagtatgtttacatgagaaaatgtacaggataacttttagcttctggggatggaagaaagagcatcaaagacttgccgtatttcaaacttttgaaaccttaagcaaccatgagcagcaataacttctgtgtttatatgtctacgcstggctagacaactgaatttatgttagaacttggaaacagggtcctggaattttttcagttatgtgtcctgttttactggacactagccatgcccattcctttacatataattatgactgcttttgcactgaacagttccaacagggaccttgtggtgcacaaagtcaagctatttacaatctggcctttcacacaaaaggtctgcccacccactggttaaagtatttcttggttccttaaaaaaaaattcctgaaagttgctcctgtttcagaaataactgcttaatttattctccaaag

SEQ ID NO: 126525 - DNA, 601 bp, Human
cccgggttcaagtgattctcctgcctcagcctcccaagtagctgggattacaggtgcccaccaccaagcctggctaatttttttttgtatttttagtagagatggggtttcgccgtgttggccaggcttgtctcgaactcctgacctcaggtgatccatccccggcttccaaagtgttgggattacaggcatgagtcaccgtacccagccgagtcaaggattttatattcaacacaactgaccttcaagtacaaaaaacacaaataaaccagtcaacatgcaagaacacaggaaatattgkctttatgatctcatcctaaggaatctaataatattctgacaatcaaaatgacgagatacatggataggactggtgataagcatcacatatatactgtacttatttataacaccaagattaaacgaggattaaagggttaaatgatgtaacagctatatgatctagatatggtaaaaaccattttaaaacagagaaataaatgatagcatgtgcaaaaaaaaatttttactgtttccagtaatcaaagttgacagaggtagattactctgaggcaataatatgctctctgtattagactta

SEQ ID NO: 126526 - DNA, 601 bp, Human
ttcagctcatctttcaaaacccaggttccatgtcacctcattcataaaactacccttggctttcacagaagtggtccatcctgtacatgtgctggggcacatgtacacacttgtgctacttaacacacagcacaagtatcctcggttagcaaggccctatttgggaggaagtcacatatttaaaatcgaaggctaacctgattaagcccgccaaacttaacctgtctttttcatcgcttacttctagttgatctattttaaactccccactagcaagtcacatagcaaatctcccacgaamttccttacagataacttccgaatgtgggtcactacagtaacggttgcttaaagttatttccaggaaccagttggcagctcttgtccacttcaagctgattaagaccaccgaaccttcaactgggcctgcatgaatgcccaaagagaggtgactgtttgatgtcagagggccaaaacctccttcctcagatcatggtgatactgccatttttcaaacatgcattctatgaagagctgtgtaacttgactacatgtatgcagatcctaactaactcacttttccttacccccaatctttctc

SEQ ID NO: 126527 - DNA, 601 bp, Human
acgagtgtgtgacaatgactattatacggtttggtgcccctgccttgatttgggctacaaagcccacagttttaaccgccattgtttctgaaccttcagtcaaataattacacagcgaagaagataagaaataccttcatattgaataaaaagagttttgcccttgaacctaaaaaggtttcagggacctttaggagtccacagaccatactttgaaaatgtcgatattaagaactacttaaacatgaagggagaaaaataaataaataaataaaacaatgaaacaatttacaaaagatayatgagatgttaaaacccacagataaatgcaaattaaaaccaaagaacaccaagaacagaaacattaaagtataacatatttcagaaaagggaggctatagcaaacagtctactactgatgggcacacaaattgctacaactttcaggagaggaatttggcagtaacctaacaaaactacaaatgtactatcttttgacagagcaaactaacttctagaaagtaccctaaagatacacatacctctctcacaatacaaaagtaacaaacgcacaaggttattcattgcagactgtttgtaa

SEQ ID NO: 126528 - DNA, 601 bp, Human
ttctcctgcctcagcctcccaagtagctgggactgcaggcacaagccaccatgcccagctgatttttaaacttcttttgtagagatggggatctcactgcattgcccaggctggtctcaaactcctggtctcaagtgatccccctgcctcagcctcccaaagtgctaggattacaggagtgagccaccacacctagccagtttccctcttaatatatgttaatttaaggaaaaatatatgaagcatggcacaggtggagtgtgaatatgacaaaatcactaagacagtgtaagacagtacrccagtgcctgaggagaggaacactgcttgttgcacagtgcccacgataagcagcactcttactgtagctgtccttcagctggtcctcctttcagcacatctgaaatcactattgacgtttccccactctgaaaatgaggattatctcgtccaccagatattgcaattccaaatccaaatccaggagcctaaagtaaaaattacagtaaaatattgctattaaggacaaaaataattgttatatcatactctacaatctagagaagccaaaatataaaaattacaatcttaatatatctgt

SEQ ID NO: 126529 - DNA, 601 bp, Human
taggtgtgacaactatgctcgattttaacactatgaaaaatttggaatcaaaatatttaggaaaaaaaatgcctacttcaaaatagtttagcttaactaagtctcaaaggtaaaataaaacaaaatgatgccatgtaagtactagaaaaaaatacaacagagaggcttttgcaattaaaaggcttttggaagcatgacaccaaggcagaaccaataaaatgaaagtctgacagacatgacaaaataaaaatgaaaacatttcaatgttgtaataaaatgatacaaaacaacaaacacaaasaacttacaagcattcacaaaagcaaagaggataacaacacatgaggtatgtatgacaaaaggctaataatctgactacagaaaacactctagtatgaccatcaccaccatataaatgcaaaggacatgaacaggtaaatgaaaaaacaaatgggtagtaaatacaccatgagaggatcaaatccacttgtgatttaaaatgtttcatttgaaacacttgtttagtttatcagtttggcaaagatttaagacctgttgaaaactgaactctcaatagcctattgattttctgaaggacaaa

SEQ ID NO: 126530 - DNA, 601 bp, Human
taggctgggcatggtggctcatgcctgtaattccagcactttgggaggccaaggcgggcggaccacaaggtcaggagttcgagaccagcctggctagcatggtaaaaccgtctctattaaaaatacaaaaaattagctgggcatggtggtgcacacctataatcccagctacttgggaggctgagggaggagaactgcttgaacctgggaggcagaggttgcagtgaactgagattgtgccactgcactccaagcctgagagagagagtgagactccgtctcaaaaaaaaaaaaaaaaaaattacatcagaattacagtttaacttaagacaaatatacaaagagtactcacagccagaaatagaatcagggtgaagaaaacggccttttaggatatctgggcaaggaatgaggcagtcatccatatggtcattacatcacagaaggatagggtattggttaaaagactgttcttcaagattaaacacttataaatgaccattacacagatgaccccaaaatatttcttgtatattagtttgttcgttcattctaaatatttcttggggtatatatgaactaggtaccaggcattagggag

SEQ ID NO: 126531 - DNA, 601 bp, Human
gaaggctctgaccgctggtcaggagatcgtgaccggctgcggcggggaggcctatcgtgtgatcgaccagaatgatctgatgccagtgactgaatttctgaaatgtctgttaataaaagggtgctacttattttcccacaaaaataattacagtcaagtataaggtactccagtaataatgaagataagctagtaagtaaaattatatataaaatggaagatttatgcattaatttcacctgccagcaatcatatcaatagtggtgagttgtctacaggaaaaaatgtatataaaacttayagattttgaaggtgtttggctggtagaaaattatcatttcattcaaagatgttcaatctccctagtattttaagaaaataggtcacttagagggaacgttcaaacagaatcacactcaccgtctctctcagaggcattagcagagtggatgctgtcagaaagatcagggacattcaatagcgtagcccgttcatctctttgaactaccatttttaatttgcctttagacctttctatcaatgtctttgcatctgtcaatgacatattttctgtcacagtaccatttatctgcaacagaaa

SEQ ID NO: 126532 - DNA, 601 bp, Human
ctcacgcctgtaatcccagcactttgggaggctgaggcaggcagatcacgaggtcaggagatcgagaccatcctggctaacacagtgaaaccccgtctctactaaaaaacacaaaaaattagccaggcgtggtggcgggtgcctgtagtcccagctactcaggaggctgaggcaggagaatagcgtgaacctgggaggcggagctcgcagtgagccgagatcgtgccactgcactccagcctgggagacagagcaagactctgtgtcaaaaaaaaaaaaaaaaaaaaaaaaaagattgctcaggatatttatcgccatacactgataacatatatgtgacattagtaagtatttggcaaaggacgaatgagcaggataacatccacattactggtaaaatctttcaaccttcactacagaaggaacattcactgtggtgccgcctgttgatcactcagaactatgcacattggtcacggtgtaaggtacaggagccacgggaaagaagtcactgattcgactcgctgattaaccattgaaatacttaatgaatcatatctttctaactggcaccctttctatctttctcagatgaaaggga

SEQ ID NO: 126533 - DNA, 601 bp, Human; identical to SEQ ID NO: 92695

SEQ ID NO: 126534 - DNA, 601 bp, Human
aaaaatgtttaagaatttaatgttcctgacattccttatgaatgtaaataacaaactacaacttgaattgtactgatataatatataagcagtctgttaattacatctaaaaatcatacacttgttttgtggtaatgaaaaatcatcttctgatgcctacagtaactattctcttgaaagtaatcattataatgcttttcagtaagggcttaattttcttatagtatgtcagtaatagtctcagaaaaactaccttctactttcaaattaaccaaatcccatcccactcaaaaccacaatracataatgaaatgggtcaagttttaataacttacttgatctatgatttgctttattgtatgcaggcgaataatgccagagctacgttggtcagttccagcgtctcgtggttcactctctattcattatgtcaggacaaaaataagacatcaaattttcactggttagacaggagtttctcaactactggccacaactgatatgccggactggatagtactttgtttgtggaaactgtcttatgcatgcagtacttaaagtgagttttaatatgcatacttccctttttttttttcactat

SEQ ID NO: 126535 - DNA, 601 bp, Human
tgaacaagtctcaatggcttctcaactcggtaacagctgttgcagaagaaaagtcttcttgctatctactctaatctttagcttgccagggttctgaatactataatccagtagccagtcaaggaaatattgaaagtctgggcaagaataacttagaactaatcaatccacttaagtttttaaagctggtttgaaatgcagatgtaagcaagaacgatgggttgctttgaactaggaaatatgttaagaaagcctcaggatgacttttcctggtttagcagggaatatgtaagactgtgtcagatcttgtaaaaaggaactctttctagcaattaggtcaaagtagttggttcaggaaagtcaatgtgaaatgaagtagttttagtttaagaatctattctatgaaatatacttgaagagaagaggacaggaagataagctttaagttgtaacaaccttttctggcttacaaaatgcatcagtctagcctgataataaataacctatttttcctcacataaaaagctagaaagttggacctttattttaaaaccaagcaaagaaagcacacaagactatcactaaaatactttatagaaaa

SEQ ID NO: 126536 - DNA, 601 bp, Human
cctccccagaagcagaagcctgtacagcctgcagaactgtgagccaatgaaaccttttctttataaattacccagtctcaggtggttctttatcacagtgtgagaatggactaatacagtaaattggtaccagagaagtagggcattgccaaaaagatacctgaaaatgtggaagcagctttggaactgggtaatgggcagaggttggaacagtttggagggctcaagagaagacagaaaaatgagggaaagtttggaatttcctagagacctgttgaatggttttgaccaaaatgctaayagtgatatggacaataaagtccaggctgtggaggtctcagacagagatgaagaacttactgggaactggagtaaaggtcattcattcttgctatgctttagcaaagacactggtggcactgtgcccctgctctagtgatctgtggaactttgaacttgagagagatgatttagggtatctggtggaagaaatttctgaatagcaaagcattcaagatgcgacctggctgcttctaacagcatgtgttcatatgtgtgcacaaacagattatctgaaactggaacttatatttaaaagtga

SEQ ID NO: 126537 - DNA, 601 bp, Human
cctctcttacaggctcagaggaccgtgtaatggcagactccggtggagtcccaacctcatcattaagagtttcatctagttcttgatcagtgtaggccccgccttctgtgtctgtgtcttcatagtcagaagtgtgtctactgtccgtgctatacattgagtattcactacctggagctgacaggtaggacagacgatcatcatgcaaatcaaggtcatcacttgtagcaccatccgcctgggtcaaataaaagtaaattacaaattttattcagtagttctttaagagatggcctttatygtacaaggcagattgaaaaggatatctttctctggagaagtcacatctacttcttgaaacttctggtaaggaaaagtcaagaagattgtacaagcacacacgcagacacatggagcaccccttgagatctgaagggcatggatgaaggaaacagtggccggtaagccaggacaaagttagactccagggcccagccctggaagacaacgaagaaactctgacactgctcagatttataaaacctactcactagctcttcagcccttttaagcaaggggaagagggagaatgttaccaaac

SEQ ID NO: 126538 - DNA, 601 bp, Human
tctactttttttccccctagaatcactgtttaggagagctgatagtttttatttaaggacaaactcctcctattcacacctctcctctactaacacagtaaaaggttttcttattgactaagagggttaaattcctggtcagttctatgccacaaagagcacaaagtgtactcacctgtacagagttttgtcatgttcactgaattgattctgagaagtgggtttgggaccaatgatgggagcacctgaaggtttagatgctacttctggaggctgtttaaaaaaaaaaaaaaaaaaaagwcaaatatgcctaaggaacagataattaacagaatagatatcatgtaatggcggaggggagagccaagaagccttttaaacggtgtgcccatgcatccaaggcactaaagacatatttaccttaaaactgccagtgtcatttacatccttcttggtctctaaggatgcagatcttttgttttcaaacatcttaactctggtgagtacagactgtggcttcattgctggatcttcctcttcttcggtttgagttgggggtggaggcagtggtttggtgtttgaaggcagagcttctggctta

SEQ ID NO: 126539 - DNA, 601 bp, Human
tgtgggttttgttctattgaggtatgaatctacctgtgtgcccgtgtgggcttagacacaactatcagtaccaaattctcttatcagtcagggttcaaccagagacacagaaccagtaggagacacaaacccacgcaggcacaagaaaggagaacaaaccaacacgaaacccagggatgagtaaacggaggggagcagcaagcacagggaaaagatgactgggagtcaagaaacttggggttcagtcccagctctgccctgtcattttccctcacctgtaaaactggatcagaaatcttayaaaaacaaaaaacaaaaaacctcttcagtatttccctcaaacaggatcctcctcacatctgtatttatatttaaaaaataaaaacagaaaagaaaaagaaccagcatgacatcattaggtgtgtgtacagaagtgaagactgatgattacctatcgatgagggtccttgtggttgacactgtcttccgtcaaaaccctgtgatgttagcatctttgtgaatgcaaaaactatgtacatctaatagcagactttaaaaacaaaacacacatcccagaactaaaaagtatgtacaatgctga

SEQ ID NO: 126540 - DNA, 601 bp, Human
gtagctcaaaatcttcccttcctgaccaactgccctctgaaataggacttgcttagccagcccctgtaactgtgtaaatgaatttcttttgacaaatccacatctgtttttgttcttgtgggttttgttctattgaggtatgaatctacctgtgtgcccgtgtgggcttagacacaactatcagtaccaaattctcttatcagtcagggttcaaccagagacacagaaccagtaggagacacaaacccacgcaggcacaagaaaggagaacaaaccaacacgaaacccagggatgagtaawcggaggggagcagcaagcacagggaaaagatgactgggagtcaagaaacttggggttcagtcccagctctgccctgtcattttccctcacctgtaaaactggatcagaaatcttacaaaaacaaaaaacaaaaaacctcttcagtatttccctcaaacaggatcctcctcacatctgtatttatatttaaaaaataaaaacagaaaagaaaaagaaccagcatgacatcattaggtgtgtgtacagaagtgaagactgatgattacctatcgatgagggtccttgtggttgacactgtct

SEQ ID NO: 126541 - DNA, 601 bp, Human
taaaatctgaaagtgcacataatgccagtgacacagtgagggacaccttatggaacagcctcacattaattgccagtcttaccacttgacgttccttttcaagtagtcatagctagtgtaagagccaagaaatctaggtgatggcaaagcaagcgcaatagaaaaatgaaagaaaatggtcaatctaactaagtaaatttgcagcaaatggaactcaaatgtcatttaaaaatatcaaccaacatccaccatttcaccataatttggtctataaaggaacatatcactaactctcatttgrccaaggaaattgaagataaataaaacacaatcacttagttatgtcccgtctgctggcccatccttcatgtactttaactgttactgcagtgaaaagcaatgtgtttgaactttgctccttctccacctctgttgcagctgctaatagtgagcaaagaaatttatcaaatcaaagagtggtgatcaaggataattagcaggttctgaataagtgggagtgacatgtcccattaaaaaaaaaaaaaaaaaggctgggcaaagaaattctgcaagtgaagacacaggaaaaagtaacacaaca

SEQ ID NO: 126542 - DNA, 601 bp, Human
tcaacatgtaatcaatatatgaaatctttggaacttggtgtgtatttcacatttccagcatctttcaatcccaaattgtcacacttcaagtgctagctagccacgtgcaggcagtggctactgcattcaatcatatgggtctataataaaaaacatattcaaatgtgcttgttgcgaatgtgatatattttccattttcaaaatgttttgtttgctccataggtggttaaagagattcatgcagggccaacacagtcagtcctactggtttttaaaacaggatatccccaaaatcagagtrcagaatcagatgtcagtattccggcaaaatacaaaaaagcgaactaaatttgtttaggaagtaaaagcactgctaaaagatgctaaatcacaacacacttcgttataatatcctggtagatccaggaggattatgaaaataagtttccttaagaagctcagaaacatgctgtcatctcctctgagactccttcatgcactctgctgagcatgtactagtgctaggttctggggtgatgaataagacagtacctgtcaagaggtttaggttctccaatcaggtgaaggcacagcaaagcct

SEQ ID NO: 126543 - DNA, 601 bp, Human
tagagtattacactgaaaaaccatggccaagtatgatcacaatggaagatcttgttaagtttctctggtatacatacgttgtagattaagaaattaaacaggccaggcacggtggctcacacctgtaatcccagcactctgggaggccgaggcgggtggatcactttaagtcaggagttcgaaccagcctggccaacatggtgaaaccccgtctctactaaaagtacaaaaattagccaggcatggtggtgggcacctgtaatcgaggctgaggcaggagaatcgcttgaagctgggaggygaaggttgcagtgagctgagatcgtgccaccgcattccagcctgggcgacagagcgagactccacctcaaaaaaccaaatcaaaacaaacaaacaaaaaataaattaaacaatagtaaccaaaaatagaaatagttatataaaggaacaaagtcattttaataaggtaaaaatgcctatttgtgcaggacaatatctcccactgcatcctgaaaaatttgacagaataaatcatttttctgaacaccaagaaatagtcaatatttggccatattatcaaaaaaaaatttttttgagacgg

SEQ ID NO: 126544 - DNA, 601 bp, Human
tgtgcatcctttttcttaaaaaaaatgaccttgcatgtgtcatagaaacgctgctttattgctgcagaggtcaaagttcaaggctcaagaggtacaggagagaatacaaaggtagcctttagaaacgtggtcttgtttatgtataaaaaaggtaaagtttataaaagttaatttacaaaccaagaacaaaagtggtatgcacgcattatgtacaagcatccttaaaacatcaaaattttcaaatgcatagccagaaagaacagaaaaccaccactgccccttgtcaaaaaaaaaaaaaaaagaaaagaaaagaaaagaaaaaaatatccccaaatcacaccactattttcttctgggtgataacacatttctgaaaccaccaaatgcacaacgtactcagtctttgtcatgatacagtatctagataatgcacaaaagccataaaaacttagtaacacaaggagaatgagctaagaattaagaacatgagggtaaggcatttctgctggttagtatgtctgtggtaatatggtgaagttagagatctgaagaggccatggaaccagtctcacatgcttttgtatccttccctaagaaaaat

SEQ ID NO: 126545 - DNA, 601 bp, Human; identical to SEQ ID NO: 92695

SEQ ID NO: 126546 - DNA, 601 bp, Human
cggcccctcacctcccgtgctctgcaggcccagtaggtagctgtggggtcctccctggccaggccagtgagtggctggcatccacggcagcatctgctgtggtccatggtcatgccgcccctccagggacactggcaccctcgtcaggacacggagcccaggacagcagctgcatgtgtccatctccaggttccaactgctgccctccttcctgctcctgcaacccccatcctcaggcagtgagagggtgctggggcttctcctgagactgcccggggacataccctccccctgcccctgstggaggcctgggtggctgacttttgctttcttttcggcaggaaggagcccacgtgggaatcccctgagctgcgccatggccagagtgagtcacccctttccagccagcaaacaaggcgagtccccaggccaaggtgtcacagcttccaagctggtgggcggggtggggaggccgcttcccaatcagtgtgtgcctctgcctctcagtcaggctggtatcaacttgctatgccttacaggcctgtcatcacaatcaatattattagacagagtcttgctctgtcgtccaggatggagtgca

SEQ ID NO: 126547 - DNA, 601 bp, Human
tttcctgcctcagcctcctgagtagttgggattacaggcacctgccatcatgttcagttaatttttgtattttagtagagacggggtttcaccaccttggccaggctggtcttgaactcctgatctcaggtgatctgcccacctcagcctcccaaagtgccgggattacaggcgtgagccaccatgcccagccagttttttttttacgtgtctgtgccaatcttctggaaacagagcagtataaattaaacaaaggcattttcatgagagcagcactggggcaagtactctgagactgggyggcacggggcagtcatcctggtcactacctgctctcgagggctgtgggcatttgccaagcttgggaaaccttttctggacttggggtggggctgaggtggtctcagactcagcccttcaacactgtcatcatccaggaccagtgaggtgtgtcaccccatgttggaggccactgtctgaaagctgttagaatgactttcccgttaccctgaaggaagtagagtgtcctaaaacaggtgaaccccttcttttttctttgagatggagtcttgctctgtcacccagggtggaatgcagtggc

SEQ ID NO: 126548 - DNA, 601 bp, Human
gcagtcatcctggtcactacctgctctcgagggctgtgggcatttgccaagcttgggaaaccttttctggacttggggtggggctgaggtggtctcagactcagcccttcaacactgtcatcatccaggaccagtgaggtgtgtcaccccatgttggaggccactgtctgaaagctgttagaatgactttcccgttaccctgaaggaagtagagtgtcctaaaacaggtgaaccccttcttttttctttgagatggagtcttgctctgtcacccagggtggaatgcagtggcgtaatctcrgctcactgcaacctctgcctcccaggttcaagtgattttcctgcctcagcctcctgagtaattgggattacaggcatctgccaccatgcccagctgatttttgtatttttagtagagacagggtttcaccacgttggccaggctggtcttgaacccctgacctcaggtgatccacccacctcagcctcccaaagtgctgggattacaaacatgagccactgtgccgggccttttgtgtatttttttttttttttgagatggattcttgctctgtcgccaggctggagtgtagtggcgcaa

SEQ ID NO: 126549 - DNA, 601 bp, Human
agacaccgtctcaaaaaagaaaaaaaagagacagggtctcactctatagcgcagcctggagtgcagtggtgcaaccacagctcactgcaacctccacctcctgagcttcagtcatcttcctgcctcagccttccaagcagttgggactacaggtgtgcagcaccacacccagctaaattttttttcctttttttggtagagatggggttcccccatgctgcccatgctggtttcgaactcatgggctcaagcggtcctcctgcctcagcctcccaaagtgctgggattataggcatgaacygccacgtgaaccctttctcatcccgagctggctgctgcagactcaggacagctttgagcctcccaggtgcagccaggaggagacgccttcttacgtttgagagctcagttagttcctgggcttgagcaacctcactgagcctgcaggtgcggacttgggacatttccatggctgcttgcagcaaactcaggggtgatgacgttgatggaatccgatggcttcctgagttccatctcaaggccttgctgtcccaggaatgtgggtttggggcggaggggaattccaactgcaaaccaagta

SEQ ID NO: 126550 - DNA, 601 bp, Human
ccacacccagctaaattttttttcctttttttggtagagatggggttcccccatgctgcccatgctggtttcgaactcatgggctcaagcggtcctcctgcctcagcctcccaaagtgctgggattataggcatgaactgccacgtgaaccctttctcatcccgagctggctgctgcagactcaggacagctttgagcctcccaggtgcagccaggaggagacgccttcttacgtttgagagctcagttagttcctgggcttgagcaacctcactgagcctgcaggtgcggacttgggacrtttccatggctgcttgcagcaaactcaggggtgatgacgttgatggaatccgatggcttcctgagttccatctcaaggccttgctgtcccaggaatgtgggtttggggcggaggggaattccaactgcaaaccaagtaacatatatgaaatgtggcattggcgcctggggacagcgtggcctgtgtaaattatgcaacttcaaagcctgccctgttttgcagtgtattccatccttgaggagtcccgtggtctcagggtctgaatgcttggaggagacttacctccgtgaacgtttcctt

SEQ ID NO: 126551 - DNA, 601 bp, Human
gatggcttcctgagttccatctcaaggccttgctgtcccaggaatgtgggtttggggcggaggggaattccaactgcaaaccaagtaacatatatgaaatgtggcattggcgcctggggacagcgtggcctgtgtaaattatgcaacttcaaagcctgccctgttttgcagtgtattccatccttgaggagtcccgtggtctcagggtctgaatgcttggaggagacttacctccgtgaacgtttccttctctgcaaagcggggtgaaaggtctccatttcaccaaaggctggatggagarggggtggtgtgtccagtgctagcccgtgcaccgccagagagaacctgctgcagctcccgttctcctgggcagatgacagtgccgcctcccccatgcagcccacaggactcctagggcagcccctgttttggccgccaaggccactgttttcatttgagtgtctggaggccataggttgtgttttcacttgaggtcgggagttcaagaccagcctggccaacatggtgaaacctcgtctctatcaaaaatacaaacattagccgggcgtgatggcgggcgcctgtagtcccagctactcgg

SEQ ID NO: 126552 - DNA, 601 bp, Human
gacagagtgagcctccgtctcaaaaaaaaaaataaataaagtgcacaacccagtagattagcacaccggccatgtcgggcggccgtcaccactgtccggttgcagagcattacctcaccccaaaaggagaccccatagccttaataccttacttaagtgtgcagtattcttttagtcctgtttctcataaatgttacccaaattgaggcgccgctctgcgcccggcaccgggggaggcggagggacccgcaggtgtcgggtaggtgcggccgccccgccagggccccgcgtcccgcgcgcracgcgcgcctcgtgggaaccggtgtcgcccggcttgggctcccggctcacctctcgggtgtgcggcaggggtctccgccccggggccacgggaggggaagcaagggcctcgctgtctcgccgcacctggggaagggacccaattagcgcggaccccacagcgcagcacctcaccagctccccgcaccaacgccccggcgcgctctttgaggaaaaagcagagggcgacttaggtacccacgccgtctcagcgccgaccaatcggcgcacgctgcggctcctgcgggctcgctggttggct

SEQ ID NO: 126553 - DNA, 601 bp, Human
tcgtcaccgcgtgtgtgagagtccccaccgcacgctcgttcagccggtcaccgcgtgtgtgagagtccccaccgcacgctcgttcagccggtcaccgcgtgtgtgagtcccccccgcacgctcgttcagccggtcaccgcgtgtgtgagtccccaccgcacgcttgttcagccggtcaccgcgtgtgagtccccactgcacgctcgttcagccggtcaccgtgtgtgtgagagtccccaccgcacgctcgttcagtcggtcaccgcatgtgtgagagtccccaccacacgctcgttcagcyggtcaccacgggggtggcacttttgtttttagctgacttagctgatagaattgggagttttagagtaaaactgatctggaagcctgaaaaaaccagcagcacattgttcgtttccaggttgaatcgctcctagctgacccctcacgtctcttatgatacgtacagaaagcaagagcagcccatgccgtccggccgcgcaccaggtctcagtctgtgtgtctggttcaggtgaccatggtgttcagttcagttcctcctgcctcgtgtgtaggccactgagagctccctagtctaagccgg

SEQ ID NO: 126554 - DNA, 601 bp, Human
gaaaccctgtctctactaaaaatacaaaaattagccaggcgtggtgacaggcgtctgtaatcccagctactcgggaggctgaggcaggagaatcgcttgaacctgggaggcggaggttgcaccttagatcacaccgttgcactcccgcctgagcgacagagcaagactctgtctcacatgaataaataaataaaccattagtggctcatgaaatcaatgtaatagcttctgaccagaacaaaagaaagaaaatagaacactcagaatgcctcttatgaagactaagtgtagttctgtgaaycttttagtgacgtacatgtatgtagcacgtctccacatgtcatgatgaatgtgcgctgagggtgcagtcctggtgagcaggctcccacctcagtttgccacggctggtatgcatctgtgagctccggaacatccacatagctctgccgcccacaggagcaggtgcacccaccttcgagaaagtgggagaaacaggtgtggcctccccaccgagggaccttgagcactgggcaggcagagccccagcgtcccttctgttgggtggttggaggagtaagtttaggttataagcatgttttct

SEQ ID NO: 126555 - DNA, 601 bp, Human
caggagaatcgcttgaacctgggaggcggaggttgcaccttagatcacaccgttgcactcccgcctgagcgacagagcaagactctgtctcacatgaataaataaataaaccattagtggctcatgaaatcaatgtaatagcttctgaccagaacaaaagaaagaaaatagaacactcagaatgcctcttatgaagactaagtgtagttctgtgaatcttttagtgacgtacatgtatgtagcacgtctccacatgtcatgatgaatgtgcgctgagggtgcagtcctggtgagcaggctmccacctcagtttgccacggctggtatgcatctgtgagctccggaacatccacatagctctgccgcccacaggagcaggtgcacccaccttcgagaaagtgggagaaacaggtgtggcctccccaccgagggaccttgagcactgggcaggcagagccccagcgtcccttctgttgggtggttggaggagtaagtttaggttataagcatgttttctgaactctgaagtgccacacgaatgcaaggtctcactaaattacagattcagaagctgggattgaaagcacaccactgctggctt

SEQ ID NO: 126556 - DNA, 601 bp, Human
ggctcatgaaatcaatgtaatagcttctgaccagaacaaaagaaagaaaatagaacactcagaatgcctcttatgaagactaagtgtagttctgtgaatcttttagtgacgtacatgtatgtagcacgtctccacatgtcatgatgaatgtgcgctgagggtgcagtcctggtgagcaggctcccacctcagtttgccacggctggtatgcatctgtgagctccggaacatccacatagctctgccgcccacaggagcaggtgcacccaccttcgagaaagtgggagaaacaggtgtggcstccccaccgagggaccttgagcactgggcaggcagagccccagcgtcccttctgttgggtggttggaggagtaagtttaggttataagcatgttttctgaactctgaagtgccacacgaatgcaaggtctcactaaattacagattcagaagctgggattgaaagcacaccactgctggctttggggggcagacaggtgactgacagtctcgtcacagtttctcaagagtcagccctattcaggtcagtgagcgcaggtcagggatgaggtcgctgcactctgcgttccccagtcctgta

SEQ ID NO: 126557 - DNA, 601 bp, Human
tcttttttactttttttttcgagacggagtctcactgcaatgcgcaggctggagtgcagtggtgcaatatcggctcactgcaacctctccttcccgggttcaagcgattctcctgcctcagcctcctgagtagctgggattacaggcgtgcaccaccacgcccggctaatttttgtatttttactagagatggggtttcaccatgttggtcgggctggtctcaaactcctgacctcgtgattctcctgccttggcctccgaaagtgctgggattacaggtgtgagccactgcgcctggcctttttttttttttttttgaaatggagtcttgcctcatcgcccaggctggagtgaagtggtatgatctcagctcactgcaacctctgcttgctgggttcaagcaattctcctgcttcagcctccacagtagctgggattacaggcacacaccacaatgtccggctaatttttgtatttttagtagagacagggtttcaccatgttggccaggatggtctcgatctcttgacctcgtgatctgcctgcttcggcctcccaaagtgctgggattacaggcgtgagccaccgcacctggctggta

SEQ ID NO: 126558 - DNA, 601 bp, Human
ggctggtagtggccctttttcaggggtttacaggtaaactttccttccactttttgagatctggggacattacatgggagttggaggcaagtctcggaaggctgctgggccttgtcctgggcgcaggcttcttaggcccacctcagggttgccaaggggcaggtgtgcagatccatagggaccagcaccggggctcttccaagcagggcaaaggtgttaagggaacagaggagagcagggggattgggggcatcatgaggatggtgggggacaaggccagatggggctaaacccagtggcygggtttccttctgagtgcccaggatgttcctagggagccctcagtgaggggtgccctattgtgggtatgaaggaggagcagagagcagggtcggggccagagaaggggctagtgctggcagcatggaggcagagccagtggaattggcctgtgattggacaaggaatgggctcagaaagcatcctggatagctgggcatggaggtgcactcacctgtagtcccagccactggagaaactggcgggaggatcgcttgagcccaggacttccaacctgtagtgtgcatgatcacacttgtga

SEQ ID NO: 126559 - DNA, 601 bp, Human
gctcaagtagaacagcaaggcccccatcttggggctgtcgtccaggcacagagcggtcagcatctactgtccttcctggagaaaaaagggaaaatgcatttgtcatttaaatgttggaatgggccaggcacggtggctcctacctggaatcccagcacattgggagggcaaggttggatcacatgaggccaggagtttaagaccatcctggccaacatggtgaaaccccatctgaaaaatacaaaaaattagccacctgtggtggcgggtacctgtggtcccagttacttgggaggctgargcatgagaattgcttgaacccaggaggtggaggttgcagtgacagattgctccactgcactccagcctaggtgacagagcgtaagactctgtttaaggaaaaaaaaaaaaaaaaaggaatggttctgagaagtcattccttaagtaaataaattgccaccccaggttgccctcttgggaggggactctggaggccgccctccacccttaggccagggcctgtcagtccctgcctccctgggctgcctcctggggatctcagccaacaccatgcccctgtccttcctccacctctttccca

SEQ ID NO: 126560 - DNA, 601 bp, Human
ctggaagtccctctctagctgtccccagttccctgaatcaagactgcttccctgccagagagatgaccccaattcctgcctcctctcactgggctctcaggggccgggactggggacagagcatacttagagctagccctggccctcgggctgcttttggaaggaggagcatggcaggcgagcatcaggtgacacgtgcccccacggggagcgcaagaaggcactggaggctgttgcgaaggagcagtgggtttcgggtcctcatgaccggccctggttccgggtgtgaggctgtggagaygcatgggtctgcctttctcatccgcagcttcctgttgctacttgggaagctccatgtttgctgtccggttgtgtttcgagtctgttctcttgggcgtctgtgccgtggaagttccttgtgcttgatagggccagcacgtgtgaacaatcttcacttcagctagaagctttgaagtctttggactcaagctttacccaaaccgcttataaggttggggggaaccgagtgcctgtctctccccgcttttttttttgagtggagtctcgctctgtcacccaggctggagcacagtggcgcgat

SEQ ID NO: 126561 - DNA, 601 bp, Human
cagagcatacttagagctagccctggccctcgggctgcttttggaaggaggagcatggcaggcgagcatcaggtgacacgtgcccccacggggagcgcaagaaggcactggaggctgttgcgaaggagcagtgggtttcgggtcctcatgaccggccctggttccgggtgtgaggctgtggagatgcatgggtctgcctttctcatccgcagcttcctgttgctacttgggaagctccatgtttgctgtccggttgtgtttcgagtctgttctcttgggcgtctgtgccgtggaagttccwtgtgcttgatagggccagcacgtgtgaacaatcttcacttcagctagaagctttgaagtctttggactcaagctttacccaaaccgcttataaggttggggggaaccgagtgcctgtctctccccgcttttttttttgagtggagtctcgctctgtcacccaggctggagcacagtggcgcgatcttggctcactgcaacctcagcctcctgagtagctgggactacaggcgcccgccgccacgcccggctaattttttgtatttttaatagagacggggtttcaccgtgttagccagga

SEQ ID NO: 126562 - DNA, 601 bp, Human
gctgagattacaggcgtgagagttgtagttcgttgagagggagacagacctcgaggaaatgcttggtgtgcctgccgggtgactgctcgctctccttgtctgctcactctgcccagtgaatgggtctaggcatcctcattgttcccttcctctgtcctcaacatcagcccaaccctgaccaggccccttcctgaggttcccacacaacaggggctccatgttcagaaggggagagagaaacccacctggggatgctctgtaaggagagcagagcccagtggagtctctgcccgggacgctgaggaagagctgcggttaattcaaaaggaagggtgaggtgcaggtattggctggacgatgctcagagaagcaggaagagtgggcatggcactgagtggctgaggccatcactggtggccttggtgcttaggcagaaggagagggcatggtgcagggcgctgaggccgtctgtggctgccttggtggggcttactgagttctagtggacagcaaggtgccagggcagggctggcacatggagggctctgaaggccatgtgtatcgtctgaagtgagggaaacccgtggtagctaaagggaat

SEQ ID NO: 126563 - DNA, 601 bp, Human
cactgagtggctgaggccatcactggtggccttggtgcttaggcagaaggagagggcatggtgcagggcgctgaggccgtctgtggctgccttggtggggcttactgagttctagtggacagcaaggtgccagggcagggctggcacatggagggctctgaaggccatgtgtatcgtctgaagtgagggaaacccgtggtagctaaagggaatgcactagccagccccaggtgcgccacattcctgctctaggggctggagggaaacccgtggtagctaaagggaatgcactagccagccycaggtgtgctacgttccgctctcggggctggaggggaacccgtggtagctaaagggagtgcactaggcagccccaggtgtgctacgttcccgctctcggggctggaggggaacccgtggtagctaaagggaatgcactagccagcctcagatgtgctacgttcccgctctcagggctggaggggaacccgtggtagctaaagggagtgcactagccagctccaggtgtgctacattcccgctctcggggctggaggggaacccgtggtagctaaagggagtgcactagccagccccaggt

SEQ ID NO: 126564 - DNA, 601 bp, Human
gcgctgaggccgtctgtggctgccttggtggggcttactgagttctagtggacagcaaggtgccagggcagggctggcacatggagggctctgaaggccatgtgtatcgtctgaagtgagggaaacccgtggtagctaaagggaatgcactagccagccccaggtgcgccacattcctgctctaggggctggagggaaacccgtggtagctaaagggaatgcactagccagccccaggtgtgctacgttccgctctcggggctggaggggaacccgtggtagctaaagggagtgcactagscagccccaggtgtgctacgttcccgctctcggggctggaggggaacccgtggtagctaaagggaatgcactagccagcctcagatgtgctacgttcccgctctcagggctggaggggaacccgtggtagctaaagggagtgcactagccagctccaggtgtgctacattcccgctctcggggctggaggggaacccgtggtagctaaagggagtgcactagccagccccaggtgtgctacattcccgctctaggggctggtctggcggcatggctctctcctgagtgccttcagagcctg

SEQ ID NO: 126565 - DNA, 601 bp, Human
aggccgtctgtggctgccttggtggggcttactgagttctagtggacagcaaggtgccagggcagggctggcacatggagggctctgaaggccatgtgtatcgtctgaagtgagggaaacccgtggtagctaaagggaatgcactagccagccccaggtgcgccacattcctgctctaggggctggagggaaacccgtggtagctaaagggaatgcactagccagccccaggtgtgctacgttccgctctcggggctggaggggaacccgtggtagctaaagggagtgcactaggcagccycaggtgtgctacgttcccgctctcggggctggaggggaacccgtggtagctaaagggaatgcactagccagcctcagatgtgctacgttcccgctctcagggctggaggggaacccgtggtagctaaagggagtgcactagccagctccaggtgtgctacattcccgctctcggggctggaggggaacccgtggtagctaaagggagtgcactagccagccccaggtgtgctacattcccgctctaggggctggtctggcggcatggctctctcctgagtgccttcagagcctgagtgcc

SEQ ID NO: 126566 - DNA, 601 bp, Human
gtgccagggcagggctggcacatggagggctctgaaggccatgtgtatcgtctgaagtgagggaaacccgtggtagctaaagggaatgcactagccagccccaggtgcgccacattcctgctctaggggctggagggaaacccgtggtagctaaagggaatgcactagccagccccaggtgtgctacgttccgctctcggggctggaggggaacccgtggtagctaaagggagtgcactaggcagccccaggtgtgctacgttcccgctctcggggctggaggggaacccgtggtagctawagggaatgcactagccagcctcagatgtgctacgttcccgctctcagggctggaggggaacccgtggtagctaaagggagtgcactagccagctccaggtgtgctacattcccgctctcggggctggaggggaacccgtggtagctaaagggagtgcactagccagccccaggtgtgctacattcccgctctaggggctggtctggcggcatggctctctcctgagtgccttcagagcctgagtgccagcaggcaggcgtctcctgcccagtgggtttggtaagatatatttcagaaggc

SEQ ID NO: 126567 - DNA, 601 bp, Human
ttcccctagctggggagggggttgtgcgtggcaggaagcccgtgcgtctgtgtctctttggagctgtgggttggttgtgtggatgccagctgtgtggtccccagcctcactgagcctgagtttccatactagcggcgggagatgggactagagggtctccaaggctccctgaagctctgcgattctgcttctctgagtcttgaccgcaggtcagtggggacccggcccctcaccatcgcctgctactgatcaccattggtttggttttgtctcgaggactgttctggaattgaggtgtaaygtgctgtgtgttcttccttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcaggtgcatggggcctgcaggctgggaggaggggcaggcaggctaggctggttttagagccacgct

SEQ ID NO: 126568 - DNA, 601 bp, Human
ttttttccccactagctctgggcctcagaactgtgctgcctgtgttcacgagggcatatatgaagaaggcatttctattttagaaagcagttcggtaagtaaaatgtcttgaagctaaaaatgttgaacagaaaatgtcttaatttcctttacaacatgggtggggctgggcacagtggctcacacctgtaatcccagcactttgggaggcccaggtagggggattgcttgagtccaggagtttgagaccagcctgggcaacatagtgagaccctgtctctacaaaaagcaaaaaacttaycaggggccgggctcagtgtctcacacctgtaatcccagcactttgcagggccaaagtgggtggatcacctgaggtaaggagttcgagaccagcctggcgcacatggtgaaaccccatctctaccagaaatacaaaaaattagccgggtgtggtggcgcacgcctatagtcccagccacttgggaggctgaagtgggaggattgcttgaggctgggaggcggaggttgcagtgagccaagatcgcatgccactgcactccaacctgggttacaaagtgagacccctcctttaaaaaaaaaa

SEQ ID NO: 126569 - DNA, 601 bp, Human
gggccgggctcagtgtctcacacctgtaatcccagcactttgcagggccaaagtgggtggatcacctgaggtaaggagttcgagaccagcctggcgcacatggtgaaaccccatctctaccagaaatacaaaaaattagccgggtgtggtggcgcacgcctatagtcccagccacttgggaggctgaagtgggaggattgcttgaggctgggaggcggaggttgcagtgagccaagatcgcatgccactgcactccaacctgggttacaaagtgagacccctcctttaaaaaaaaaaaaaraataaagggccgccagaagttgtcccttagcagactcctgaagtttagggtttggaaactttggcatcaaggtgagtccaaaaataaaaaggaatcagagagtcatcctctgctcctggagtggcctggaaaggcgatgtgacgcagtattggttggtttggacgtgtggtctgtgttccttggttgctgcagggagtctgggaggaggtttaacccgagggatattcctctccccaggccttcccagataatgctgcccgcagggaggtggagagcctgccggccgtctgtcccagtga

SEQ ID NO: 126570 - DNA, 601 bp, Human
ccgggctcagtgtctcacacctgtaatcccagcactttgcagggccaaagtgggtggatcacctgaggtaaggagttcgagaccagcctggcgcacatggtgaaaccccatctctaccagaaatacaaaaaattagccgggtgtggtggcgcacgcctatagtcccagccacttgggaggctgaagtgggaggattgcttgaggctgggaggcggaggttgcagtgagccaagatcgcatgccactgcactccaacctgggttacaaagtgagacccctcctttaaaaaaaaaaaaagaawaaagggccgccagaagttgtcccttagcagactcctgaagtttagggtttggaaactttggcatcaaggtgagtccaaaaataaaaaggaatcagagagtcatcctctgctcctggagtggcctggaaaggcgatgtgacgcagtattggttggtttggacgtgtggtctgtgttccttggttgctgcagggagtctgggaggaggtttaacccgagggatattcctctccccaggccttcccagataatgctgcccgcagggaggtggagagcctgccggccgtctgtcccagtgatgg

SEQ ID NO: 126571 - DNA, 601 bp, Human
gaggtatttaccctctctgtgcctcaggtttcttgtctgtcgatgggggtgcaggatcccaccatcgtggggtggctgtgagggttggaggtgcctgtgtgagccctgggaatgccatggttatctgagcagtagcatttcctgggaatgaaggggagatcgctgtgcaccaggacctgcagctttcaagtttggtgggggtttttgttgtgtctcttgtatccacaaaggattgcttattttgaattgtgttgacactggaaattgcagaaataatggacacacttgtcctgtggtcacrgcaacataggcagtggcccgcacttcacttggctgtggtttgtccctgtgtgctgggcgagccgtgcacgccttcctgcactggggatttcagtgtgattctcacgtcaccttttaggcatttggaaacttcacctgtagtgtagaggccaggaggtgccgagagagctcgtcgaggccactacagctcgccaagttatgcagtcttccttcttgtaatgaatgccctttaagaggtttctctctgggatccttgtacaggattcctggagtaacactgtccacagagcccaaaggtaga

SEQ ID NO: 126572 - DNA, 601 bp, Human
gtgtggctctgccgcacaaacggctgtggcgcatggcattgtaccccccactccctgctccttgaaagagatgcagcttggtcattgcccagtgctgtctgcaagggagatggctccctggggaggtggcccagggtcagggtctccctgggagggttggggtaccagctggctgcagggagtaggggtgctatgcgccatgccaccctttgagaggactgaggagtgtctgggggacaggtgggataatagtttccagctctgcactggaccctgagtcctctggggtctctgccacctycaggctcatgggatgccacattgacaattatgagggcctccggctgagggccaaggactatagccagcccctggcctggggcgccacgcggtcctgcaggcacgcagggtggaaagtccctggctgcacctttgagagctctggaaagtccctgagaggagccgggtttggtcatgtgggaggggcgggcactgctctggaataacttggctgtggcctttgattttgttgataaaacctctcactggctgtaaatgtcacacatggggacggaaatcaacccgtctatacagttgggag

SEQ ID NO: 126573 - DNA, 601 bp, Human
caaatcgaataattttaaaactttaggtaaatgttgatggagtgcttgctgagtgccaatagcagaactgaattccccagtgggcccctgagctactcgttctggcagctggatgcgggggtgcggggagactttccagagaggacataggctggctgcacgagcagcggaaaggccaggaaaagccaagtatgctcggcctcacggacattctagtgacattcagagggatgacgactgtatttgcgtcaaatgtgtagtttgaattctggctgaataaatattgatttttttttttttwaactgtgtctgctgtgggtggggagaagactgagacagatggtgctggtgtagatgtatctgctgcaggacaaccctggtcccactggagatttcaagtaccgagtgccaagagaaaggttttttttgtttgtttgttttttgttttttgcgatggagtctcactctgtcacccagactggagtgcagtggtgcgatctcggctcactgcaagctccgcctcccgggttcacaccattcttcctgcctcagcctcctgagtagctgggactacaggcgcccccaccactcccggctaatt

SEQ ID NO: 126574 - DNA, 601 bp, Human
gaggacataggctggctgcacgagcagcggaaaggccaggaaaagccaagtatgctcggcctcacggacattctagtgacattcagagggatgacgactgtatttgcgtcaaatgtgtagtttgaattctggctgaataaatattgatttttttttttttaaactgtgtctgctgtgggtggggagaagactgagacagatggtgctggtgtagatgtatctgctgcaggacaaccctggtcccactggagatttcaagtaccgagtgccaagagaaaggttttttttgtttgtttgtttkttgttttttgcgatggagtctcactctgtcacccagactggagtgcagtggtgcgatctcggctcactgcaagctccgcctcccgggttcacaccattcttcctgcctcagcctcctgagtagctgggactacaggcgcccccaccactcccggctaatttttttgtatttttagtagagatggggtttcaccatgttagccaggatggtctcgatctcctgacctcgtgatccgcctgcctcggcctcccaaagtgctgggattacaggcgtgagccaccgcgcccagccaagaaagat

SEQ ID NO: 126575 - DNA, 601 bp, Human
ctgacctcgtgatccgcctgcctcggcctcccaaagtgctgggattacaggcgtgagccaccgcgcccagccaagaaagattttatttttgacatttcgagcatgcagcgcatctgagcagtgaggctgagagtagaggtgtgccgctgccccacaggcctacatgctgccccgcagcacctgccagccttcgccagcctactttcagcccttcaaccccccacacacatttttttcttttctggcttattttaaagcaaatgaagatgtcatatcatttcacctatgagcattttattaytattatttttagaaatagagtcttgctctgttgcctaggctagcgtgtagtggtgggatcatagctcactgcagcctcaaactcctgggctcaagtgatcctcccaccttggtctcctaaagtgctgggattacaggtgggaacccactgtgcctggccattttactatgttttaaagaacagtcttttttatttttatttttttatttatttgagatggagtctcactctgtcgcccaggctggagtgcagtggcacgatcccggctcactgcaagctccacctcccacgttcacgcca

SEQ ID NO: 126576 - DNA, 601 bp, Human
ggcctcccaaagtgctgggattacaggcgtgagccaccgcgcccagccaagaaagattttatttttgacatttcgagcatgcagcgcatctgagcagtgaggctgagagtagaggtgtgccgctgccccacaggcctacatgctgccccgcagcacctgccagccttcgccagcctactttcagcccttcaaccccccacacacatttttttcttttctggcttattttaaagcaaatgaagatgtcatatcatttcacctatgagcattttattattattatttttagaaatagagtctygctctgttgcctaggctagcgtgtagtggtgggatcatagctcactgcagcctcaaactcctgggctcaagtgatcctcccaccttggtctcctaaagtgctgggattacaggtgggaacccactgtgcctggccattttactatgttttaaagaacagtcttttttatttttatttttttatttatttgagatggagtctcactctgtcgcccaggctggagtgcagtggcacgatcccggctcactgcaagctccacctcccacgttcacgccattcttctgcctcagcctcccgagt

SEQ ID NO: 126577 - DNA, 601 bp, Human
aggcctacatgctgccccgcagcacctgccagccttcgccagcctactttcagcccttcaaccccccacacacatttttttcttttctggcttattttaaagcaaatgaagatgtcatatcatttcacctatgagcattttattattattatttttagaaatagagtcttgctctgttgcctaggctagcgtgtagtggtgggatcatagctcactgcagcctcaaactcctgggctcaagtgatcctcccaccttggtctcctaaagtgctgggattacaggtgggaacccactgtgccyggccattttactatgttttaaagaacagtcttttttatttttatttttttatttatttgagatggagtctcactctgtcgcccaggctggagtgcagtggcacgatcccggctcactgcaagctccacctcccacgttcacgccattcttctgcctcagcctcccgagtagctaggactacaggcgctcaccaccactctcggctaattttttttgtatttttagtagagacggggtttcactgtgttagccaggatggtctcaatctcctgagctcgtgatccacccgcctcggcctcc

SEQ ID NO: 126578 - DNA, 601 bp, Human
cattttattattattatttttagaaatagagtcttgctctgttgcctaggctagcgtgtagtggtgggatcatagctcactgcagcctcaaactcctgggctcaagtgatcctcccaccttggtctcctaaagtgctgggattacaggtgggaacccactgtgcctggccattttactatgttttaaagaacagtcttttttatttttatttttttatttatttgagatggagtctcactctgtcgcccaggctggagtgcagtggcacgatcccggctcactgcaagctccacctcccaygttcacgccattcttctgcctcagcctcccgagtagctaggactacaggcgctcaccaccactctcggctaattttttttgtatttttagtagagacggggtttcactgtgttagccaggatggtctcaatctcctgagctcgtgatccacccgcctcggcctcccaaagtgctgggattacaaggcgttagccaccgcgcctggcctaaagaacagtcttttaattaaatctaagaacattgactatttgtgctttcgtttttaggtttcataagccagaatagttgctgaggctcctc

SEQ ID NO: 126579 - DNA, 601 bp, Human
tctcggctaattttttttgtatttttagtagagacggggtttcactgtgttagccaggatggtctcaatctcctgagctcgtgatccacccgcctcggcctcccaaagtgctgggattacaaggcgttagccaccgcgcctggcctaaagaacagtcttttaattaaatctaagaacattgactatttgtgctttcgtttttaggtttcataagccagaatagttgctgaggctcctctttgattcagcttgatggtggcttgttacacactagtgtggccgagggctgggtcctgtcccrtcagtgggtagcagagtgcaaggcgctgttgggttcagggagttggttcctttagcaggcttagcttgggccagtgccgctggaggtcttggagggctgggcccatgttccctggggcgcctctaaggagtagttgctgtgcctgtgtgaaggtttgggaggaacactccctggggaggttgaatggaagccagcccaagtgcctgtgctgtccagagcagggtctcccctcttgggggaagtagcattaacctttcctgagtcacttggggctcctgagctgtagccagctctctatgg

SEQ ID NO: 126580 - DNA, 601 bp, Human
cacgggaaaaacccaccccatgattcaatgacctcccaccaggcccctcccacaacacatggggattatgggagttgcaattcaagatgagatttgggtggggacacagccaaaccatatcagtgacaaagtgagaccctgtctcaaaaaacaaaacaaaacaaaaagccctgtttagttttatttctgtacctcaccagccccttatggaggcaggtgggacctcctgtggcttgggccagaggcctgagagtccttcttgacttctctgtgttcctgtaagcggcacgttcagtctgcyggcaggtccacgtggctccccagacacatcctgaatccggccctctctcccgttacactagcacctttgtagtgcctgccaccccgttcttcctcctgtgactgctgcggcttcccaaccttagagtctgtgagaggtgcagctgccaggcagtcctggaagggttcagccacatcccgtcaccttgctgtcctgacccctcacattcgggcagagccctcaagacggtcggggaagccctgcctggggcagcagtgggctggagaggtggctgggttctgcatcctacattcttgattc

SEQ ID NO: 126581 - DNA, 601 bp, Human
ggacgtccacagtcctctgcctcgcctgacgcttagcctgcggcaccggctcccgcttccctagtctgcagtctgcatcttgtggcaccttccccggccctgcctccactgcctgccttccctggtgttctggcactggtggtcactaccaggttgtcagctccaggagggcagggcctctgcccagctcctgggtggctcagtgtgtgggaacgtgtaggtgcctgagtgaccttcctgtgtgtcactggccctcgcctgtcttcctcgcagcttcggccctttcagatgcgtgtgctgygcagctagacccagctcctggcaccttggcctggtgggcttgtgcctcaggcctttgctggcttcctggtgctggaggcagaggccagctgcccgcatgctatctcccgtgcgtgttccctacctcttcacacctcccacctgcaatgaggatggggctgggactggcaagactcagcctggaccgcgttgggcttggtcatcagatcgagcgtggcctgctttctcggttaggagctggtgtgtgtggcagggacccgctggcgcagagcagggactgtgcacttggctgtttcagggg

SEQ ID NO: 126582 - DNA, 601 bp, Human
gttagccaggagtggccaggtgcggcggttcatgcctgtaatcccagcactttgggaggccgaggcgggcagatcacgaggtcaggagctcgagaccatcctggctaacatggtgaaaccctgtctctactaaaaatacaaaaacaaaattagctgggcatggtggcgggcgcctgcagtcccagctactcaggaggctaaggcgggagaatggcgtgaacccaggaggcggagcttgcagtgagccgagattgcgccactgcactccagcccaggcgacagagcgagattccgtctcggaaaaaaaaaaaaaaaaaaaaagccaggcacggtggcgagtgcctgtaattccagctactcgggaggctgaggcaggagaattgcttgaacccaggaggcagaggttgcagcgagccaagactgcaccactgcacactagcctgggcaacagagcaagactctgtctcaaaaaaaaaaagaaaaaaaatttttaaaaaaagtttgtttttaggacaaaaaagcatttttgtcttagaaaagtctaaatgcatcaggtagagagtgcggtggtgggtgtgcgtccgtcctcgccaggcctggg

SEQ ID NO: 126583 - DNA, 601 bp, Human
gcatttctgcggtgcacagagctagtcgctagcgccatgtctgagatgcagctgtgactgctcacatggcctgcagcctgtgtctgcgtccctgttgtctgtctttgccttggtgtatctgaatcacgatccatacagggttcctgcctttggtggaaatgtctctgggtctctctctgcctctggggcccatggcatcttttttcctgggctcttgtccttcaggagccccacttccctgagacccatctgcacttccctgtaaactgtcagatggacgggcctgaccatagcacatctrgggtgccaagccctccgcagcagcatgtcagggtctgtcttggagacgtcccgcatgccgccagccctgcccatccgccaggccctcccaccggcctcgcctcccagcgggagcagcgtttccccatcttcaccggggccgttgtttcacgtggcttccaaatctcctctggtggcttgggtctccctcgcattgccctgagctggcagaacaaacaaagcgttaagatctccgaggctcctgggtggtgctggcaggatcctgcccgggaggagcactgtccttcgaggctggagggtg

SEQ ID NO: 126584 - DNA, 601 bp, Human
acgaggtctgccccaagttccccttaacttgtgacggctgcggcaagaagaagatcccccgggagaaggtgagtgtccttcacctccttggaggaccgcagggcggggcccatgtgttggacgtgagggtcccgtgggtgggggtggggcaggttatgacccttgtgcccaaaggaacagcagtgcaaagcccctgtaacgttgggtcatggatgcgttcagggtggcggccgctctcctgagtgggccgggggccaggtggctgagtcccgagccctcttcctcatcctccagtgtacayagctgcttacttttcagcaggtcacttcctagttatcctgaaaatgaaacattaaagttctcatcgccctccatgtgctgcttatgagaaatgttgttactgactttgaagctgaatgtttgcagcaagcggttggggtggagactgggcgccctagtctggtctgctgccacagccgtgaaatgtgggtggctcgcctggcagaactttgtccctggtgtccttacttctttcaggaaaatggtttctctcccagttgagagttaactgctgcagatgacacctttaggaaaggaagct

SEQ ID NO: 126585 - DNA, 601 bp, Human
gtggctcgcctggcagaactttgtccctggtgtccttacttctttcaggaaaatggtttctctcccagttgagagttaactgctgcagatgacacctttaggaaaggaagctgggaaataatacgcatggaaacattttcccaaactgcctcccttgttggaggtgtgagggtagctcatccagagaggctgaagctctggaaggggcacctgctctgtgtgtcagaggtccaatgtggaggcctcacaggtggcagcccccatctgggcagctacaggaggggtcaggctggccaggccygcccgcgggctcagcctgacaggtgtgtgcctgtctttctgatttgcttctgtttaaatataggtcacagcccaagtcctgaaatgggtagggctgggggacgggacagggctgtctcctcacctctttccacttgtctgttaaatgtcccgcactgtgagcttggccgagtgctgtctgaaagcatcctttcccttcacctggagactggagcgccatagaggctatggctgctgccatgcccccttcagaggccaggacgcctgcctggggcccgtgtctgtgaggctgtgtcccctg

SEQ ID NO: 126586 - DNA, 551 bp, Human
atctgcaatcccagcactttgggaagccaaggcaggtggatcacctgaggtcaggagatcaaaaccagcctgtccaacatggcaaaaccccttctctactaaaaatacaaaaattagccaggtgtggtggcacaggcactcctgtaatcccagctacttgggaagctgagacaggagaatcgcctgaacccgggaggcacaggttgcagtcgcagtgagccaagatcgcgccagtgcgctccagcctgggccacagagtgaaactccatctcaaaaaaaaacaataaacaaaaaccagcamcatggcttctgatgatgaggccactgatgatgaggccacctgtttcttcgaagctctttttgttcttggaagtacatcttatgaagatgtagggtccacataccatgttcttattataaaggaattttttttttttttttttttttttttgagatggagtctctctgccgcccaggctggagtgcagtggcgcaatctcggttcactgcaacctctgcctacctggattcaagtgattctcctgcctcag

SEQ ID NO: 126587 - DNA, 601 bp, Human
gcctgggacatgtgcagggctgagccgagcatggggcggcgtatgttgggacctggtcctttggaggctgacctgtggggctcgctggataggagaagtgggcctgggcctcatggccaaacagcccagaagccttggcagtgacggacacctcgtgtttgataaggtgtttgccccttcatggtgatgctggcaggaaccacagacgggcagtgtttagtgtttcctgggggcctgggggttgccctcctgccctcacaggaaccctagggcaccctttatcagatgaggaaattgaggyttacagaggccaggcgcccagctggcttccagttccatggacggccctgccgtgggcagcctgggggacttgtctcctcgcttccagcagtgccttctcccacacctaccctacctgggcgatcgcaccccccattcccagcatgctgcgcacatgccaggttcctggcctcttctccttcagcttcctgtggtggaaatttctgagcctggacagatgagagagagcacattagaacttggggccctgctgtggctcaagatggggggtgcccagtgacagttctgtttcattcctgcc

SEQ ID NO: 126588 - DNA, 601 bp, Human
cagcagagcctcgaggcggttctgacgggcgtttcccaagctgtggtgtgaccgagcccatctgtgcttctcttgctgttcatgactcctgcccactgaatagtgtttttggtttttgtttgttttgggggaaattgttcaaggttcttatgtgactgtttctggaaactgattcacagttacggccgtttccctccttccgggtatgaaatcttgtgctgcgtctggcatgtgtgggtttggttttctcacactcagagccgcgacacacctgccatgtcacctgggaaatggaggaggracttggggttcatgtttttcctcgggctgttcctgcatccatagacccatgtcagataccacagtgttagtctctgtttcttccctggttcgatgttcctgttgtatgtgagtgtctgtgtgcacttggcccctttctggattttacgttttgcttcatgttgtgtctgtgtcatcctgtaccaccacgcaccgggtgagcagtgggcgtttgattctaggttttgaacccaggccctgaggcctcagcaccgcatgtcctgtggactgtgatagagggacaggcgtgccatgtgacaca

SEQ ID NO: 126589 - DNA, 601 bp, Human
agagcctcgaggcggttctgacgggcgtttcccaagctgtggtgtgaccgagcccatctgtgcttctcttgctgttcatgactcctgcccactgaatagtgtttttggtttttgtttgttttgggggaaattgttcaaggttcttatgtgactgtttctggaaactgattcacagttacggccgtttccctccttccgggtatgaaatcttgtgctgcgtctggcatgtgtgggtttggttttctcacactcagagccgcgacacacctgccatgtcacctgggaaatggaggagggactyggggttcatgtttttcctcgggctgttcctgcatccatagacccatgtcagataccacagtgttagtctctgtttcttccctggttcgatgttcctgttgtatgtgagtgtctgtgtgcacttggcccctttctggattttacgttttgcttcatgttgtgtctgtgtcatcctgtaccaccacgcaccgggtgagcagtgggcgtttgattctaggttttgaacccaggccctgaggcctcagcaccgcatgtcctgtggactgtgatagagggacaggcgtgccatgtgacacacaag

SEQ ID NO: 126590 - DNA, 601 bp, Human
tggaaactgattcacagttacggccgtttccctccttccgggtatgaaatcttgtgctgcgtctggcatgtgtgggtttggttttctcacactcagagccgcgacacacctgccatgtcacctgggaaatggaggagggacttggggttcatgtttttcctcgggctgttcctgcatccatagacccatgtcagataccacagtgttagtctctgtttcttccctggttcgatgttcctgttgtatgtgagtgtctgtgtgcacttggcccctttctggattttacgttttgcttcatgtygtgtctgtgtcatcctgtaccaccacgcaccgggtgagcagtgggcgtttgattctaggttttgaacccaggccctgaggcctcagcaccgcatgtcctgtggactgtgatagagggacaggcgtgccatgtgacacacaagctggggtctccacaggtgtcccgaaatgcttgcccatctcagttactggcacagtgtgcatgtttgcacgtgtgtgtgcacaggtgtgtgagcgtgtcgctttggaaatgggctgttgggtttcattcagtgtgagagtgaagaggccaacggggcag

SEQ ID NO: 126591 - DNA, 601 bp, Human
tgcgtctggcatgtgtgggtttggttttctcacactcagagccgcgacacacctgccatgtcacctgggaaatggaggagggacttggggttcatgtttttcctcgggctgttcctgcatccatagacccatgtcagataccacagtgttagtctctgtttcttccctggttcgatgttcctgttgtatgtgagtgtctgtgtgcacttggcccctttctggattttacgttttgcttcatgttgtgtctgtgtcatcctgtaccaccacgcaccgggtgagcagtgggcgtttgattctrggttttgaacccaggccctgaggcctcagcaccgcatgtcctgtggactgtgatagagggacaggcgtgccatgtgacacacaagctggggtctccacaggtgtcccgaaatgcttgcccatctcagttactggcacagtgtgcatgtttgcacgtgtgtgtgcacaggtgtgtgagcgtgtcgctttggaaatgggctgttgggtttcattcagtgtgagagtgaagaggccaacggggcaggtcatgtaacctctgtgtcagtcagtgtggtccatgtggaagtgctgaaatgcatca

SEQ ID NO: 126592 - DNA, 601 bp, Human
gtttttcctcgggctgttcctgcatccatagacccatgtcagataccacagtgttagtctctgtttcttccctggttcgatgttcctgttgtatgtgagtgtctgtgtgcacttggcccctttctggattttacgttttgcttcatgttgtgtctgtgtcatcctgtaccaccacgcaccgggtgagcagtgggcgtttgattctaggttttgaacccaggccctgaggcctcagcaccgcatgtcctgtggactgtgatagagggacaggcgtgccatgtgacacacaagctggggtctycacaggtgtcccgaaatgcttgcccatctcagttactggcacagtgtgcatgtttgcacgtgtgtgtgcacaggtgtgtgagcgtgtcgctttggaaatgggctgttgggtttcattcagtgtgagagtgaagaggccaacggggcaggtcatgtaacctctgtgtcagtcagtgtggtccatgtggaagtgctgaaatgcatcagaacagagaaagatggctctgtgacgtcactcccttgtagtttcaggaccacgtcaagacttgtggcaagtgtcgagtcccttgcagattccacg

SEQ ID NO: 126593 - DNA, 601 bp, Human
cactgcctcctcctgccccggctgtccgagtgttcccagcttggtctctgggctggcagccctgtccactccctcctggtggcattgtagtgcctggctttgactgccacctgtctctgaggatgcccagtgtgtgtgcccacctgtcgccttgagcctccctgggtgttgagtgcacgtctcagatgtacccggccggctcgccacgaccactccttggccgctgtctccctgcccccatctcacacagaaaagggcagcactctaacccagcggctgtcgctgagccctccgccaccarcaggcactcgggcccctcctctcgcctcatgcttcacgttcgggctgacagaggtctcgtctaccctcaaatggtccccccagccgtcactgccctgtccacgtcatcctcatctctcactgggacccaggctcaggcgcttatgggacccccgttcttttccgttctggcctgttcacagatggaaatcgatcacagctcttcctcatggcttctcattcagagtggcctgctcctgtgatctttccctcccctcagctatctcctctgccctgctcgctggcctgagcttccttgggc

SEQ ID NO: 126594 - DNA, 601 bp, Human
ctgccacctgtctctgaggatgcccagtgtgtgtgcccacctgtcgccttgagcctccctgggtgttgagtgcacgtctcagatgtacccggccggctcgccacgaccactccttggccgctgtctccctgcccccatctcacacagaaaagggcagcactctaacccagcggctgtcgctgagccctccgccaccaacaggcactcgggcccctcctctcgcctcatgcttcacgttcgggctgacagaggtctcgtctaccctcaaatggtccccccagccgtcactgccctgtccacrtcatcctcatctctcactgggacccaggctcaggcgcttatgggacccccgttcttttccgttctggcctgttcacagatggaaatcgatcacagctcttcctcatggcttctcattcagagtggcctgctcctgtgatctttccctcccctcagctatctcctctgccctgctcgctggcctgagcttccttgggcatgcccacttgtgcccaccccaggcacttgggcactggcacaatggccaggcgcctgggtctctccaggtggacccccctgctccacccctgcagactctgcc

SEQ ID NO: 126595 - DNA, 601 bp, Human
gctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtttgtgcctgccgggtggccagccatgaggaggacagtgtaaagggggatagtgttcgtgccccagcaggttctagcaggtcctrgagctttagagcccggacaatgtagaactccatctgcaaaccccagtccagtgtggtttaggggaggctctggcccccttcatttctgagtcctgtcatctaagggacccaaaccctggaaggtcctagaggccaggccgtgggcaggagcctcttctctctgatgggagggcagagtcagccatggatggggatgtgcatggcctggtgtggcttctgagcacgcttgctggcccggagcttctgtgtggacttggagccaccacctcttggcgagggtggggttgggttcttgtgtgc

SEQ ID NO: 126596 - DNA, 601 bp, Human
ctccccaggtgtggttctaggacccccacctcactgcagctgctgtttacttggcacctgggtcccctcacccctgtgaccacataggatggctcccaagggtggggctgggatacgacccccagtgataccgggagcagctacacctccctgagtggcaagtggggtagctgaatatgggctggccggtgggtgccctcgggcaggggtcggggtaggggggttgggccggctgccctcctgccgtgccagccctcgaggtgtgcccctcgtcacccacagcctggtcctctggcacacrgccctaaagcagacattacatcaacaggctctcctgcctgatcacagctcccaggaagacagggcgggtgggggtggctgtgggggtgggacatggctctcagggccttggagctgagctagtctgatccctcccaggttcattttccacacggagctcagggagggtgtttctcacactcccccacctttttttttttttaaaccccaactatggggtctcttgagagggtgctcgtggggtctcccctggagggcactgctggagagggggtggggtggtggctgcccagctgcaggc

SEQ ID NO: 126597 - DNA, 601 bp, Human
tgggtgccctcgggcaggggtcggggtaggggggttgggccggctgccctcctgccgtgccagccctcgaggtgtgcccctcgtcacccacagcctggtcctctggcacacggccctaaagcagacattacatcaacaggctctcctgcctgatcacagctcccaggaagacagggcgggtgggggtggctgtgggggtgggacatggctctcagggccttggagctgagctagtctgatccctcccaggttcattttccacacggagctcagggagggtgtttctcacactcccccacctttttttttttttaaaccccaactatggggtctcttgagagggtgctcgtggggtctcccctggagggcactgctggagagggggtggggtggtggctgcccagctgcaggctcctgccaggactgtgcttctgggcgctgcagtccagaggcggcccccctgctgtccctcgaggccctggctgaccttgtggcggccccagccatcatctcggccccaactcagtcactcccttcttgggctttgttgccatggctcagaacacgccctcgtgcagactttatttttaggctgagttgg

SEQ ID NO: 126598 - DNA, 601 bp, Human
gccctcgaggcggaaagagacccaagcgtcatctggaggggccgccacattgtgtggtgcctgctgccaaggccttcagcagggaccagaaacaaaactcacactctttcttctctgagttgagactggaaaaatgaaagattgttttaggggaaacttgagggaacagtctgggcagcctgcagggcatggccctgttcctccagggctgggaaagtcagcactgctttctggtggcgaccttccctctgcagctgctggctcagccgattgtatatgctgggagctctgcactaagcgytgggtgaagggtcagcattgtggaggccctgccacggaggtggtcttcttgggagctgcactcaggcaagaggacctgtttgtgtggaacatctgctttaagcaatgctggtgaacacagcttgtgtgcggcacgcgtgcaggctgaggacaggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggac

SEQ ID NO: 126599 - DNA, 601 bp, Human
aaaatgaaagattgttttaggggaaacttgagggaacagtctgggcagcctgcagggcatggccctgttcctccagggctgggaaagtcagcactgctttctggtggcgaccttccctctgcagctgctggctcagccgattgtatatgctgggagctctgcactaagcgttgggtgaagggtcagcattgtggaggccctgccacggaggtggtcttcttgggagctgcactcaggcaagaggacctgtttgtgtggaacatctgctttaagcaatgctggtgaacacagcttgtgtgcrgcacgcgtgcaggctgaggacaggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatgggg

SEQ ID NO: 126600 - DNA, 601 bp, Human
tcagccgattgtatatgctgggagctctgcactaagcgttgggtgaagggtcagcattgtggaggccctgccacggaggtggtcttcttgggagctgcactcaggcaagaggacctgtttgtgtggaacatctgctttaagcaatgctggtgaacacagcttgtgtgcggcacgcgtgcaggctgaggacaggcagaatgggcctgggggcacggtggaggacgaggatggggaggatgggcctgggggcacggtggaggacgaggatggggaggatgggcctgggggcgtgtggaggacrgggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatggggaggatgggcctgggggcacgcggtggagaggactaggacagggaggatgggcttgggggcacgcggtggaggacgaggatggggaggatgggcctgggggcacgcggtggaggacgaggacggaagggtggt

SEQ ID NO: 126601 - DNA, 601 bp, Human
caggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatggggaggatgggcctgggggcacgmggtggagaggactaggacagggaggatgggcttgggggcacgcggtggaggacgaggatggggaggatgggcctgggggcacgcggtggaggacgaggacggaagggtggtcctggtgctgccacagtggggtccctgcgtgcagacctttgcacacagtgttctgtcatgtgacttggaaagcagcctctgccgagttctggctgtcactcacgtctgtgtcttgttgggtgggaaggaactcgactcttcttgttttggggttcactctagccagtgcctcttctgaggcaggcttgg

SEQ ID NO: 126602 - DNA, 601 bp, Human
gggggaggatgggcctgggggcatgtggaggacgaggatggggaggatgggtctgggggcacgtggtggaggacgaggatggggaggatgggcctgggggcacgcggtggagaggactaggacagggaggatgggcttgggggcacgcggtggaggacgaggatggggaggatgggcctgggggcacgcggtggaggacgaggacggaagggtggtcctggtgctgccacagtggggtccctgcgtgcagacctttgcacacagtgttctgtcatgtgacttggaaagcagcctctgccgrgttctggctgtcactcacgtctgtgtcttgttgggtgggaaggaactcgactcttcttgttttggggttcactctagccagtgcctcttctgaggcaggcttggggcccaacctaagccctgggccggtcagggctccctctgtggctctgccgaggtcccaaccactgcatttagtggatctcgccatgtggctctgctcatcttcttaagttttgggggttacatttgggattcttagaaatgctttttctggctgggcacagtggctcacacctgtaatcccagcactttgtgaggc

SEQ ID NO: 126603 - DNA, 601 bp, Human
atgggtctgggggcacgtggtggaggacgaggatggggaggatgggcctgggggcacgcggtggagaggactaggacagggaggatgggcttgggggcacgcggtggaggacgaggatggggaggatgggcctgggggcacgcggtggaggacgaggacggaagggtggtcctggtgctgccacagtggggtccctgcgtgcagacctttgcacacagtgttctgtcatgtgacttggaaagcagcctctgccgagttctggctgtcactcacgtctgtgtcttgttgggtgggaaggaastcgactcttcttgttttggggttcactctagccagtgcctcttctgaggcaggcttggggcccaacctaagccctgggccggtcagggctccctctgtggctctgccgaggtcccaaccactgcatttagtggatctcgccatgtggctctgctcatcttcttaagttttgggggttacatttgggattcttagaaatgctttttctggctgggcacagtggctcacacctgtaatcccagcactttgtgaggccaacacgtgtggatcgcctgagggcaggagtttgagaccatcctgg

SEQ ID NO: 126604 - DNA, 601 bp, Human
gtaaaaccccatctctactaaaaatacaaaaattagccaggtgtggtgtcgagcgtctgtaatctcagctactcaggaggctgaggcaggagaatcgcttgatcccaggaggtggaggttgcagtgagctgagattgcgccactgcactcagcctgggcaacaagagtgagactccatctcaaaaaaaaaaaaaaaaaaaaaaactttttctaagtactacctttttttttgtaatgaaatttgttttcattggaaactaactgcatagtttgagggaaaaaaaacttctttgcaccccaraacctgaatgtttctttgtaggtgtttttgtccctgggggagggcagccaggcaggaagagccctgccccgcccttgctgagtgtcagctcaccaggcacccctcctgcctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaggccgtccctgcaggcttcgctagggccgc

SEQ ID NO: 126605 - DNA, 601 bp, Human
gggattgtaggcgtgagccactgtgcctggcctattttgaaaatcagaatctattattttgtggaattgaagatgcagagactagactggaatgagagaaggtcccttccttttgccacagttggcccagacttgctacttcccccaccccctatagctagtggagtaggcagagcagagttgggtgggggagggggtgtggagggcccacaggcccttgtctgtcctggggcatccaggttcacagtcctgacagaggcagactcaggttctccctgaaaagtgctcttcacgagtgggcagtgggtgcttcatgatctctttggcaagaaaatgtctttgccagatgtgttattttttgcattttcctaataataattcaagttcaggagtggtaagctttagtctaggactccagatgtcagtggacaggaaaggccagaatggacacagattccccagagagaagcggaatgccggtggctggggagggctggggagcccgggcgctgtggcaggagcaaggccgcccaccacgtggtctcggctgggcctcagcctctggcctgggtcctgggatggcctcctgctggtggccctg

SEQ ID NO: 126606 - DNA, 601 bp, Human
gacctgtgtcccctccctggggctctctcctccaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccrgctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatccc

SEQ ID NO: 126607 - DNA, 601 bp, Human
gctctctcctccaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacrctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcagga

SEQ ID NO: 126608 - DNA, 601 bp, Human
aggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctctgtggtcagtggcatccatttgattccaggttgcctgcggcttccagccttggcagtggtgaccctctgcgggtcctcctggcctctcctctcac

SEQ ID NO: 126609 - DNA, 601 bp, Human
agggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctctgtggtcartggcatccatttgattccaggttgcctgcggcttccagccttggcagtggtgaccctctgcgggtcctcctggcctctcctctcacagacccctccccacggggtgcctagcccctgcctgcttctctagctagccaggctgtgttctctgttcctcacctgctgtaagctccctcttctcgagccttgttccctcttctggaatgttcttccctgtccatctcctctcctgggcctccccagggactcctgtgagagcagaatgaggatgagccagccctggtcctgcctttctgtgca

SEQ ID NO: 126610 - DNA, 601 bp, Human
tagccgggtgtggtggcgggcgcctgtaatcccagctactcctgaggctgaggcaggagaatcgcttgaacttgggaggcagaggttgcagtgagccaagatcaggccactgcactccggcctgggcaacaagagcgaaactctgtctcaaaaaaaaaaaaaagttaattttgaacatgttaaatttgaggtgaggtgcaggaaatagagttgaaaatataggcagatagagtgcatggactgtaatttaaatagtgttttctctcacaggtggtagttaaaatcttgagaatggatttgstttcagggagagattgtagagagagtaactataggccatacccacagagaggaggttggagaaattattgaaggaggcatgtggatctcagagctaagagcaaggaaggagttctttttaaaaaagttacatatagttgtagattctcaggggcccagtgttgttattaagctaatttaacagcatttacagcaaataataagcacctacttctgggaattctggcagaaaataaataattcaaatagatataatctccactgcctaattgtctacccagaagtggtatcatttacatat

SEQ ID NO: 126611 - DNA, 601 bp, Human
tagtagctgttgctactgggatatttttggcttttgagaacagctgaaaaatgtcgatttttttttttttttggtctgacctctgaattcattttcagacgcattttctctttatgcctgccaatctgctacatcatctctctaactataccttttcctaattacactactctctttcctctgtagttcagcctcctgttttattttgttcagagcatatttgaatgtcagttctgttttaatgaattgcctgaaggattcttcctgtgcgctgcacaaacgaaaccagttcactgagacygtgctactgcagtaaagaaacagcttacttaacaatgatgctggctgtgcaaaggagttattactcaaatcagtctcgccaaagacttggtggttagtttttcaaggatagtttttagtttggtggcaggggactagggaatgagggctgctggttggctggggatgtgatgataagggtgtgaaaaatggtccttgtgtgctgagtccacctctgggtggggagccacgtgactggttgggtcatgagtcactagttcacctctaggtagtgtcagttggtccagaatgcaaaggtctg

SEQ ID NO: 126612 - DNA, 601 bp, Human
gattattgggctacttaaacttcgtaactcccctcgttacatcttttttttccctgaaaacatttgtcatttctctcccaaccactgcctcattttaatttactatctctgcaatactttttcttttcttttccattagagatgatatgctgtcttctttaggaaactttacctaagtgtaagtaaggaaatgaatgctatcctccctagtgtttttattatgatagctaaaatgtaacatataaaaagaagtgtatatagaaacaatatttttgttttagttctatgccatatctctctrtaggttattttttatatttttaaacgtttattttttgaaggttggaaccagatatgtgagtttaaggggctttaaactcttttaaaaatcttttttttttatatttcaaattctgttttattgtaaaagttcctgcagaacagaaaagttttatttaaatagttttctgttttcttgagcattgtgcagtgtatttttagtatacttagcatacttactattacttgatgttaattcagccaattttaggctggtggggaagatgattcatgtacactaacagttataatgcaaaataga

SEQ ID NO: 126613 - DNA, 601 bp, Human
aaggaagagtgaatgaggaagtgcacagataccccatctttgcaggaagcactctcttgctgaggcaaagtagaggagagatagtgagtggccctttgctgcctgtctctgacatctggaagaagtaatgtttaaatgcttttcccacttgttctcatacacattctctgcctttctcacatatacacatgtacaaaatactctgtcagaaagagttttcttgtataccagagactaccctctagtctagaatacacccttatttctttcttccatagttaaggcgtaaattatattcccrtttagaaaagtagatgaggactgggtgccgtggctcatgcctgtaatcccagcactttgggaggctgaggcaggtgggttgcttgaggtgaggagttcgtgaccagcctgaccaccacagaaaaaccccgtctaaactaaatatacaaaaattagccgagtgtggtggcaggcacctgtaatcccagttactcgggaggctgagataggagaattgcttgaacccaggaggtgaaggttgcagtgaactgagatcgtgccactgcactccatccagcctgagtgacagagggagactctg

SEQ ID NO: 126614 - DNA, 601 bp, Human
gaggaagtgcacagataccccatctttgcaggaagcactctcttgctgaggcaaagtagaggagagatagtgagtggccctttgctgcctgtctctgacatctggaagaagtaatgtttaaatgcttttcccacttgttctcatacacattctctgcctttctcacatatacacatgtacaaaatactctgtcagaaagagttttcttgtataccagagactaccctctagtctagaatacacccttatttctttcttccatagttaaggcgtaaattatattcccgtttagaaaagtagrtgaggactgggtgccgtggctcatgcctgtaatcccagcactttgggaggctgaggcaggtgggttgcttgaggtgaggagttcgtgaccagcctgaccaccacagaaaaaccccgtctaaactaaatatacaaaaattagccgagtgtggtggcaggcacctgtaatcccagttactcgggaggctgagataggagaattgcttgaacccaggaggtgaaggttgcagtgaactgagatcgtgccactgcactccatccagcctgagtgacagagggagactctgtctcaaaaaaaaaa

SEQ ID NO: 126615 - DNA, 601 bp, Human
atggtggcacatacttttactcatggctactcaggaggctgagataggaagatcacttaagtgtgggagtttcgggttacaatgagctatgattgcaccattatacttcagcctggacgacaaagtgagaccctgtctcaaaaaaaaaaaaatctttattctacagattgaaaggaaacacactgaatgaggaaaaactaacatacggtcatcaacatccttgtataacctagtttttaaaaaaattggatttcaaaggtaaggaatgcattctttgctcatcccaataaaaagattaaaytacctatcaggagttggtttgggaaatcagatattgtcaagggaatatttagcactacaggacaatggtacaaagtgtgtaagtcattggggaaagacagtgtaacctcaaagccaaattgacaactatttttgaacaaggcaaaagctcaaggtaagtggtacccctaagttctttttgataaactgcaagaagatgaatatcagtcatacagtagatgaacagagatgatatagcaaatggattggcagggaacattgtaggaataagaccaaaataactatgagatttgtagttata

SEQ ID NO: 126616 - DNA, 601 bp, Human
aatggagtatacttccctgccttttttatgttgggcttgaccagtagaatgttaacagacatgtgcagaagctttgaataggctgttgtgatttgacttagtttttatgctcccctgacctataggagaagagaaaaatgtatggagcagaccaaagcatagctgcccagctgactcacagatttgtgagggaggaaatagatgcttataagccataagactgggggaagtttattatgcagcattgttacatggagttattagacctaattttgacagataagaaaactgaaacttttcttttttttttttttttaattaatttattttttttattatactttaagttttagggtacatttgcacattgtgcaggttagttacatatgtatacatttgccgtgctggtgtgctgcacccactaactcgtcatctagcattaggtatatctcccaatgctatccctccccactcccaccaccccacaacagtccccagagtgtgatattccccttcctgtgtccatgtgatctcattgttcatttcccacctatgagtgagaatatgcggtgtttggttttttgttcttacgatagtttac

SEQ ID NO: 126617 - DNA, 601 bp, Human
caccttgcgcttcccaggtgaggcaatgcctcgccctgcttcggctcgcgcacggtgcgcgcacccactagcctgcgcccactgtctggcactccctagtgagatgaacccggtacctcagatggaaatgcagaaatcacccgtcttctgcgtcgctcatgctgggagctgtagaccggagctgttcctattcggccatcttggctcctacccgaaacttttctttttttaagagaggatctcgcttcgtcacccaggctgaagtacagtggcataatcatagctcactgtaaccttgaacctggggctcaagcagtactcctgcctcaatctcctgagttgttaggaggactacaggcacatgccatcacgcctgactaattaaaaaaaattttttgtagagacggggtctcgctgtgttgcccaggctggtcttgaactcctggcctcaggcagttctgtcacctcaggctcccaaagtgctgggattacaagtatgggctactgcaactggcctggaaaaccaaaattgttaacagagatgtgaaataatttacccatacaaaccacccaatatctaatgtgtatagctgacctctaa

SEQ ID NO: 126618 - DNA, 601 bp, Human
taaaattttttttttttaacatatggaaattatattaaaccgtttgtagcccagtaattgtatcctttaaaatggaatttttaaatttactcatgagttcagaaactgttatttaaaagtcacaatttgtagagtattttgccaaggcaatagaaacaatgaggtggtttcttcctgcccaatatttataatttaatttgggacagatgctgatgagagtatagatgcttcctgtatgttatagtgtgaaaacaggatactgtctgtaaggaatacaagcagtttctctatgccagtaggaaaaaaaaatgctttatttaaaaatagtaaggagaccaggtgcctgcctgtaatcccagcactttgggaggcttaggcgagaggatcgcttgagcccaggaattcaagaccagcctgggcaacatagtaagatctcatctctgctaaaaataagaaaattagctggttgtggtggtgcacgcctgtagtcctagctacttgggacactgaggtgagagaatccctctgagcccaggagtttgagtttacagtgagctaagatctgcactccaggatggacaagagagggagaccctgtctc

SEQ ID NO: 126619 - DNA, 601 bp, Human
ggtactaacaaaatggtataatcttcaggccctataaaactggaccctccaatgtccttaaccttgacccttcaagcttaggtaagtataaggtttacagggaagagagactactgaataacatacttgggaaggctattaatgaatatttcatggatgaaataataatttgagttggtgttgtaggatgaggagttcttcaggtgaagaaggatagaaaggtcattacaaatagaagacacagcctgttcaaagggaatgagtattttgatgtctacagtgaagcatactaggtagaaamcaaagaaaatacaaaagtcctgcggcaggaatatgtctgtcagttttgagaacagcatagagatcaatgtggctgtagacaaatgagtgatggggagaatagtaggtaaggttagagtttcctgttacttagggtcttgtaagccgttgtaaggactttgaccttttatcctgagtgagactgggaaacaggaaggttttgagctatgtggacatgatctgactattgttttaaaacaagtagtctggccactttgatgagaatagattggctgtgttgccacccaaatctcatctttaa

SEQ ID NO: 126620 - DNA, 601 bp, Human
cctgttcaaagggaatgagtattttgatgtctacagtgaagcatactaggtagaaaacaaagaaaatacaaaagtcctgcggcaggaatatgtctgtcagttttgagaacagcatagagatcaatgtggctgtagacaaatgagtgatggggagaatagtaggtaaggttagagtttcctgttacttagggtcttgtaagccgttgtaaggactttgaccttttatcctgagtgagactgggaaacaggaaggttttgagctatgtggacatgatctgactattgttttaaaacaagtagyctggccactttgatgagaatagattggctgtgttgccacccaaatctcatctttaattgtagctcccataattcccatgtgctggggggggacctggtgggagataattgaatcatgggggtggcttcccccatactgttcttgtggtagcaaataagtctcatgagagctgatgattttataaggggagatctgatgatttctccttttgcttgattctgattttctcttgtctgctgccatgtaagatatacctttcaccttctgccatgattgtgaggcctccccagctacttggaa

SEQ ID NO: 126621 - DNA, 601 bp, Human
tatttttgtcctaagtaattgcaatggcaaattgctgtttactgagatggatgagactgggaagagcaagtttgaggaatggtgaaaatcaggagtttttttgtacgtgttaagtttaaggtgctatgttaatctgttctttcattgctgtaaagaaatatctgaggcagggtaatttataaagaaaagaggtttaattggctcatggttctgcaggctgtagaggaagcatgatgctagcatctgctcaacttctggggaggcctcaggaaacttacaatcgtggcagcaggtgaagggrgagcccgcacctcacatggccagagcaggaggaaaagagagagtggggagatgctacacacttttaaacaaccagatcttaggggaactcactcactccctatcacaagaatagcaccaagaggatggtgctaaaccattcatgacaaactgtccccacaatccaattacctcccaccaggccccatttccaacactggggattacaatttgacatgagatttggtggggacacagatctaaaccatattattctgcccctggcccctcacacctcatgatcctttcacattgcgaaata

SEQ ID NO: 126622 - DNA, 601 bp, Human
ttactggtggatctaccactttggggtctggaggactgtggccctcttctcacagctccagtaggcagtgccccagtgggggctctctgtgggagcttcaaccctgcatttcccttccacactattctagtagagttctccatgagggctccattagcagcaagcttctgcctggacatccaggcttttccatacatcctctgaaatctaggcagaggctcttaagcctcaactcttgcactgtgtgcacctgcttacagcttgcaccctctgaagcagcctcagctatacctgtgccccyttgagccatggctggaactagagcagctggaatgcagggagcagtgtcttgaggctactcagggtggcaggcactgggcgtagcccaccaaactattcttccctcctacgtctccaggcctgtgatgggaggggctacctccaaggtctttgaaatgccttcaaagccttttccccattttcttggcgaatgcaaatttctgcagcctgcttgaattcctcccctgaaaatagacttttcttttctatcacatggccaggctgcaaattttccaaacatgtatgccctgcttccctatta

SEQ ID NO: 126623 - DNA, 601 bp, Human
aaaagaaaaaaagaaatttcttcttccaggtaccctaaactatcactctcgagttcagagtttcacagatctctagggccagggcacaatgcagccaggttgtttgctaaggcataacaaaagtgactttttgcttcacctcccaatacattcctgatttccatctgagacttccttagcctgggcttcattgtccatatcactataagcatcttgatcacaaccattcaacaagtctctaggaagtttcaaattttccctcatcttcctgtcttcttctgagccctccaaactttccctytgcctattacccagttccaaagttacttccacattttcagacaccttacagcaacactgctttcctggtaccaattttctgtagttagtctgttctcgaattgctataaagaaacacctaagactgggtaatttataaaggaaagtttaattgtctcattgttctagaggctgtacaggaagcatgatactggcatctgcttggcttctgtggaggcctcaggaaacttagaatcatggcagaaggtgaaggcggaaccagcacttcatatggctggagcaggaagaagagagagaggga

SEQ ID NO: 126624 - DNA, 601 bp, Human
gttgggagtacaaatggagtgttgtaagcatatagatggtgtctaaagccatatgactagatgagatactaaggaagtgaatatagatttttaaagggggagaaagaaagtgccaacatctgaggtttgggaccctccaacacatcagggaagtaggaagaactgacaagttaaagaagcagccagagagaaacagagaaaaaacagaaatatggtgatacagagagctaagtgaatgaagtgtttcagtgaggcagaggttgtcaacaattcttggtatatcaaataagataagtattgmtaattgaccgttggatttagcaatgttcaggtcattggtgatcttgatgatgctcagcagagtgaatttaaaatgaagtgagttcatgggaggagaggaattggaggcaatgagaagagacaacccattaggagttttgctgtaatgggggacagaaagttgttctttgggaaaagaggagttgagaagtttttgtgttttgttttaattattagtgttttaagatggaataaataatagtcatgtttgtatactgatgggaatgatccatcagagaaagaaaaattgctggagcaatgt

SEQ ID NO: 126625 - DNA, 601 bp, Human
tgtctatttatttatcttgtatatatttttatgagttccttcagattttctgaataagaatttattcttaatttcatgaagcacctttttgataggcaaacattcctataagtcttgctttcattgaagtaggcttttaagcaatagtgtatgccagatattctgtttatccttgctgttcttagatattacttattcctaagtgtgatttagtccattttcattctactgttgaatttttgtttttttcagtaggggaccctacttactacccagcagagttatattttgaaatattgcrgtattagaaaagcacattatatatggcagtcatcaagcaggcagtgtattttggtctgagtcttttgcttagaaagattattaagcagcattacagatatgaagaaaaatggtacaaacaactgaattttgtttttgaaagattaacaagactgatttttaaaagctgacggatagttctctcaattttgcttgaaaagatttagctaatactaagagaataattttttaagcaccacattttcatgtcagataccacttcctctgtgaaatttcttatccttttgatgtatggtaaatt

SEQ ID NO: 126626 - DNA, 601 bp, Human
aaactgaagtcttctatattttttgtgtatgaaaagtcggaacttttctgaaccaagccatattttcaaaatgaccaaaaaaaatgagtagagatggagaacaatactttgtttttattattggcttctcttattttaatcaaaaatcttaatactcactgttctcttaccacttttttgcctgtttttttcttattctgtatttcaaatgaccttctttagggagacattatcttttagttttttaaagctttgtgaatttatttcaaaatttaataacttagtaaagttcaaaattgtsagttacttattaaacataaacatgtgacaatagataaaagctatctctacattgtaaaattttatatgagtaggaatggaaaactctcaaataatatttttagagtatgggatccaaaatacataagatagatttgcagattagcattttacccattaatgagattctcaggccattgtaattaacttgtgtgtcttaagtgttaaaaacatttacttctctaaaagtaaactgataattaaaaattatgtcacaaaatttttgtttctgcttaaaatgccaagtgtgtatgaacaagta

SEQ ID NO: 126627 - DNA, 601 bp, Human
tcttaaatgtaatgcttggtgtaaagcaataaattaatctaatagacctcatcaagcagccgcctttctttttttaaaataatttttaaaaagcaattttaaatacataaaagctgcaagtacagtaccgataacttttttttttctgaaccacttgggagtaagatgttgaccacaacttcaaaaaatttagtatttttttaaaaataggaacattctctacatgtcctaatatgaaagttaggaaattagcacatacatttttaccatttaatccctattcaatttttgtcagttgtcycaataataacctttgtaataaaaagattcgattcagaatcacatgttgtcttaattttcctgtctctttagtcttcttcagtctgggacagtttctcagttcttttattactttcatgactaatactttggaagattacaagccagatgttttgtgcagtgtccctcatttggggtttgtccgggggttcctcatgttagatttaggttatacttctttagaaggtatagaagtggtgctgtgttctcattacatctcactgggcactgcataattttgatttatcccattactgttgat

SEQ ID NO: 126628 - DNA, 601 bp, Human
tgtctctttagtcttcttcagtctgggacagtttctcagttcttttattactttcatgactaatactttggaagattacaagccagatgttttgtgcagtgtccctcatttggggtttgtccgggggttcctcatgttagatttaggttatacttctttagaaggtatagaagtggtgctgtgttctcattacatctcactgggcactgcataattttgatttatcccattactgttgatattcacattgttcacctgattaaagtgctgtctgaaacttcgtatctttaccactatgaartttctgtttttccctttataataataagcatctggcaagaagttactttaaaactatgtaaatattgttttcctcattacattttcaatttatttgttcatatcaatataaataaattcatggtttcctattttaccctatgggttatagtcaattattttcattatttattttgatcttcagattgttccatatttggccagtagaaactccttcataatgctttctgtgtccttttgacttgtctccgttgttttttgaacactttagtactttttggcactataaaatattctgggt

SEQ ID NO: 126629 - DNA, 601 bp, Human
atattctgggttcatcttacaattttcatacctccaccctgggatcagccatttctttaagtcctgtttccttttagaagccaagacctggatgccaggtgtacccattgctatttgggttttgctgcagagagtttctctcagtgaacaggggtagggtgtatatgtctgtgtgtatttatttctgtatctatctattgaaacctctgaattcacattgacatctccagtccggttaaaagttccaattaaacaacagagttcatttccatatttgcgactcccttttcaaatcgtgagaaatctgactcccattgaccttaatgtttacttagttgttcagtctccctgtatgtaacctatcttccaacacatgtcctcccctccctaccccctgttcttctcaccctacctgggcactgctatcctctgctgggctgcacacacgtagaggcattcttcttaccctgttcaggctctgacttcccacacctggctgctgttctgcagagaggctttcctcaccctgcttgggctctgactccccacactggacactctcctactctcttcatgtggatgtcctcattacctgcctagg

SEQ ID NO: 126630 - DNA, 601 bp, Human
ctgtacacctggcctaggaatatctagataacaatatttttattttatttctactaatttgctctaagattttgggcaaatttctgagccttggtttcctcatctacaataagagttggtaccttctgtcatcttattctttgatataaggtttgtgcttttggattccacgattcttcttgggctttgtgtccccgttcattggctgaacaggaaaaattaaataaacatgatatttaaagtaggatattaattttgtctttttttagaggtatagtaatcctgagatttgtacttgggwtttatttttatttgtttacttatttattttatttttaacttgtaagttcaggggtacaagtgcaagtttgttacataggtaaacttgtgttgtgggggtttgttgtacagattatttcaccacccaagtattaagcctagtacctattagttatttttcctggtcctctttctcctcccaccctccaaaagaacccattgtgtgttgttcccctctatgcgtccatgtgttctcatcatttagctcccacttataaaaacatgaagtattaggttttctgttcctgtgttagtttgctaa

SEQ ID NO: 126631 - DNA, 601 bp, Human
tggccttcagctccatccatgtccctgcaaagaacatgatcttgttcttttttatggctgcatagtattccatggtgtatatatactacattttatttatccagtctatcattgatgagcatttagattgattccatgcctttgctattgtgaatagtgctgcagggaacacacacatgtatgtgtctttataagagaatgaatgatttatattcctttcagtatatacctgataatggaattgctgggtcaaacagtatttctgtctttaggtcattgaggaatcaccacactgtcttcyacaatggttgaactaatttacactcccaccaaccgtgtataagtgttcctttttctccacaacctcaccaatatctggggtttattttattttattttattttattttattagtttttttttacttgttatagtagccactctgactggtattagatagtatcgtattgttttttattgcattttctaatgatcagtgatgttgaacttttttcatatgattgttggccacatgtatgtcttttgaaaagtgtctgttcgtgtccttcacccactttttaatggggttgtttggtttttt

SEQ ID NO: 126632 - DNA, 601 bp, Human
aggaacattggaagaataaatacatatgtcttcctgggaaaactggggaatgttttgcagaggttggagctgagacttgaaagattttattgatcagggccatatcagacaaaggaaacaagtgcggaggcttgaaaagttgtggtgtatttgaggagttacaagttattgtggtatatttgggggtttacaagttataagatgaagtgtgaggagatgcagatgaggctggaccccagtagtcaggaaccagaacacagtgtttatgtccaccaggacaagaagtttagattttgtcccrcaggtagcgaagcaacactatagaatttatagtgctttcctcagctccagaacactctaaaaacgaagagaatcagaaaaccaagatgactaaatgatatatatgacctgacaatttgcaagacatttttctccttcaatcttcacagcagtcctgtgaagtataataattatctttaaactacaaatgagaaaagtagatacaagagagatttgtttattacattctttcattcattcagcaaatactcaggcactactctacccactggagatataatgataaaatgaatgcactttc

SEQ ID NO: 126633 - DNA, 601 bp, Human
tgaatggtgaaaacattattaaattctttttgtttcagctatgtttgtagctctcataattagctttattttatcctgattgtccagctactaaattgtgatgtaaaggagggagctgataaaaggatgtctcatcctttgggaatcctggttctattctttcccttttaatttatctctccaagaatctgctcttaagtgttcattttaatgtgggacaaacaagtaactgtaaaatgtggtttttataatataaaaagattatatggggttagttttcttttttttctcctttctttctttttttttttttcttttttgagacagtctcattctgtcgcccaggctggagtatagtggtgtgatctttgcttactgcaacctccacctcccgggttcaagtgattctcttgcctcaacctctcgagtagctggaactataggcgcgggccaccactctcagctaatttttatgtttttagtagagatggggttttgccatgtgggccaggccagttttgaactcctgaccccaagtgatccacctgccttggcttcccaaagttctggggttacaggcgtgagccactgtgcccagcct

SEQ ID NO: 126634 - DNA, 601 bp, Human
gagtcccagattttctatcatgttactgtgaccttaaaaggcagagaaaagaacaggagatggctgagtagagtagtttctttggaagattcccccagccatatgccatttttattcttttcggcactatttactttaagaaaatgtagtatttttaacactactattccttggggatgaagaaaaacaaaatgtttaaagctagttcaagggtctttttaatgtattttaaatttttgaatagattatacattacatagttaaaatattcaaagaatataaaggatgtgtatgaaaagtwaacctttctccatcctctgcccctcattttcccgtttctagttgccctttacagagataaccatgattactcatttcttatgtatcctttccgagacaaacatatgctcgtatacatatagtatttacgttcatctctccccctttacacaaatagtattatggcatattacacactgtctgtatgttcttttcctcacatagctatgtatcttggaaaatgttccaaatgagtatgtatagaaatagctgcattttattccattgtatggcaataccataatttattcaaccaattccc

SEQ ID NO: 126635 - DNA, 601 bp, Human
gaggcttttgactgttaatggcaagatcaagatttaatgccagacctgtttgacccctaagcctaaatgctttcttcttagagttaataggttaagtgagttagtacatctaatgcatttagaacagtacctggcacattgtaagtattgtgtaagtagtagctactgtcagtactgtattattattattactgttactgttattataattaccatgctgcactggcataaggtatggtactttcagcacagtggtaaattggattagtaattttctaggcaggcatattttcttcctccrtctcatgatactcattccgtctttagttctcagtctttcacttctttataggaagcccttcttttacctgaaatccaaattccatttaaaaatattgactggattctttattctgtttttctccagcatccaaatctgccagtaataaaagtgatgaatataataactatgcctccagaatgtgaagttcttaattcaacttcacatttcctaaagatgctgcctagatttatttggtttgcttctttccttcccattttgaatcaactggtatgggtagaagccagaagtttgaaaggt

SEQ ID NO: 126636 - DNA, 601 bp, Human
ttaatgccagacctgtttgacccctaagcctaaatgctttcttcttagagttaataggttaagtgagttagtacatctaatgcatttagaacagtacctggcacattgtaagtattgtgtaagtagtagctactgtcagtactgtattattattattactgttactgttattataattaccatgctgcactggcataaggtatggtactttcagcacagtggtaaattggattagtaattttctaggcaggcatattttcttcctccatctcatgatactcattccgtctttagttctcartctttcacttctttataggaagcccttcttttacctgaaatccaaattccatttaaaaatattgactggattctttattctgtttttctccagcatccaaatctgccagtaataaaagtgatgaatataataactatgcctccagaatgtgaagttcttaattcaacttcacatttcctaaagatgctgcctagatttatttggtttgcttctttccttcccattttgaatcaactggtatgggtagaagccagaagtttgaaaggtaataataatagttaactttattgaatacttact

SEQ ID NO: 126637 - DNA, 601 bp, Human
aatctgatagtaaagccttttgtattgagtatgaaaattgaaactataatttaattcttttaaaaattatccattatatacaaggagaaatcctgtaaaagtctgaaggaaagcaagcacaactggagtctaactggttgttgaagtgctattagatctagttctgggaagttatgtggttatgtagagctatagagtttttggaagttatgtagttatgtcccaaggctttgtcctctggcattgaggaaaactttagtacttgttttaaattgatagtttttaatgtagtcattatgtrtatgtatatatacatgctgctctaaagacacatgcacacatatgtttattgtggcactattcacaatagcaaagacttggaaccaacccaaatgtccatcaatgatagaatggattaagaaaatgtggcacatatacaccatggaatactatgcagccataaaaaaggacaagttcatgtcctttgtagggacatggatgaagctggaaaccatcattctcagcaaactatcgcaaggacagaaaaccaaacactgcatgttctcacttataggtgggaattgaacaatgagaacacttg

SEQ ID NO: 126638 - DNA, 601 bp, Human
ttcagctttttgatgagaccacaaaggataatacttagaggagtttcctggcctgtattacaagatagaccatgagttctgcctcaattcaacttcattgtgtcaacttgataggataagacaggtggacattctgctaaccagcatctgattagagagggtggaggctggtgatggattgttaggtgtgatgacaaaataagcaattccgttaacatgagtgtgcagagtaaaattgggaccagcagatggtggggctaagctgtatcttatttctcagctatgagattttccgtggccrccttttcacagtagccagctgggattgtccattaactgggtttgagtaaaagggagttgttgctttctttagaatttgttcagcctctccttttcatgtatggctttatgttcatttggtagtaaaacacgatattcaaaggcagaatatatgagaactgaccttttcttggagaacatcccagttagatcccatttccacaatatgattacactttgaaatctggcttttccctgttctttctttaatcctctgatattttaaattcctgtaatctctgctattgccactttaaacctc

SEQ ID NO: 126639 - DNA, 601 bp, Human
ttttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactrttcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatctt

SEQ ID NO: 126640 - DNA, 601 bp, Human
cattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagytgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgc

SEQ ID NO: 126641 - DNA, 601 bp, Human
ttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcakcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatga

SEQ ID NO: 126642 - DNA, 601 bp, Human
caaccttttgattcctactatcttaagctgtagggtcttcacagtgtctggggccagcaggaaatgttctagaaagtgtcaaacatgaagggtttggaaattcataatcaaatgatgactatgctctgtgaagtttccaaccctgttgcatttcctcatttgagcagtgggtgaaggcgaagggcaaaatactccaagggtttgtttctgtgacaaagaaacttcagtgtcggtaccagtaggtgtgggaagagaatgtagaaaatgacataaggcagtagatatgtaaataaatcactamaataagtagttgttatgaaaagagagttgagagttgaaatgaacaggaatctcaaaaactgattagaacctaacgataggagtgttcaagttgtttttcctagatcagagactcacaagggcctcattcaggtaacacaagtaactggcaatcaatcttgggcattttgccacctctcaaaaagtcaggaaaggtgtgaatgagcatttatacttagagagaggaaaacaagcatttccctccaagcagagccatcatgttttcagccaccatcaagtttttcccgaaaacaaaggcaaa

SEQ ID NO: 126643 - DNA, 601 bp, Human
ttgtaacatggatatttaattcctggagaaatagaaggcagcagaaagttcatttgcttctctatgtacaagacaaatggatttttaaggcaaatatgaggaggcttatttattgatagcccatgatttctaggcactgcatgcagcacttttgtacatgatgcttaaagctgccaatagcttcattatccaccccaatgtcccagtgacaagtgcagtgggatgatctagggcagtcctaggacagcctgatttccagtgccctttaacacacgcggagcagcccagaacgagtcctgartggtgctctttcctctaaacttggaatgaagccaaaggacctcttagatattcaacatttccccattccctgccccagtatctctggctctaacctgggcctgggtgctacccagatgtgccttagctaaagtgatgaatagcagggtagcagagttcaagctctggtgcatccaaattgtctaatggagccctaggtaactatttaaagagaagttattttttaaaaaggcaacatattctcacaatgcctatttttcagatagtagagcaaatgtatcaaaatacacaaccttttgat

SEQ ID NO: 126644 - DNA, 601 bp, Human
tatttgtaacatggatatttaattcctggagaaatagaaggcagcagaaagttcatttgcttctctatgtacaagacaaatggatttttaaggcaaatatgaggaggcttatttattgatagcccatgatttctaggcactgcatgcagcacttttgtacatgatgcttaaagctgccaatagcttcattatccaccccaatgtcccagtgacaagtgcagtgggatgatctagggcagtcctaggacagcctgatttccagtgccctttaacacacgcggagcagcccagaacgagtccwgaatggtgctctttcctctaaacttggaatgaagccaaaggacctcttagatattcaacatttccccattccctgccccagtatctctggctctaacctgggcctgggtgctacccagatgtgccttagctaaagtgatgaatagcagggtagcagagttcaagctctggtgcatccaaattgtctaatggagccctaggtaactatttaaagagaagttattttttaaaaaggcaacatattctcacaatgcctatttttcagatagtagagcaaatgtatcaaaatacacaacctttt

SEQ ID NO: 126645 - DNA, 601 bp, Human
agtctcagtttactatggattaaatggtgataataactgttctggttgtctctttgccaggtaactcaaatgccatctatgagcaccctgctcattgtagttgctcaaaatatatttgttaaattgcatgataaacatgaagattctttacaaagcactataaaatgcaatgtattactaattctctttttttaatgaaaaaaatcacctaagtgacctccatttttctgtttactgcctattactaaactattttcttcaatctgggtatgctgactcaaccagaataacagtgaaaatrataattcaaactaatactgtttacagggagttaaacttctacagtgggattaaaggtctgtaccacgttagcacaaatgtcacctctctgttaatcataaaacagggtcacaggccaatgttcaccacaaggagacaggaggacaacctgggatgggtaatgacaaagaacgatttccgtactcctaagcctctgctctctcagatctcaagccaacttttttcagtgtgatggaagttgttcacattatattattaaatgaaaaacaagtttcagagaagtatgcaatatatactgtcc

SEQ ID NO: 126646 - DNA, 601 bp, Human
cacatttatgtagaggtttgctgctagcagatcagacagacctagttttaagaaccagctctgcctaatctagctggaacctcaggcaagtcaggcagcttcctgagtctcagtttactatggattaaatggtgataataactgttctggttgtctctttgccaggtaactcaaatgccatctatgagcaccctgctcattgtagttgctcaaaatatatttgttaaattgcatgataaacatgaagattctttacaaagcactataaaatgcaatgtattactaattctctttttttaatgaaaaaaatcacctaagtgacctccatttttctgtttactgcctattactaaactattttcttcaatctgggtatgctgactcaaccagaataacagtgaaaatgataattcaaactaatactgtttacagggagttaaacttctacagtgggattaaaggtctgtaccacgttagcacaaatgtcacctctctgttaatcataaaacagggtcacaggccaatgttcaccacaaggagacaggaggacaacctgggatgggtaatgacaaagaacgatttccgtactcctaagcctctg

SEQ ID NO: 126647 - DNA, 601 bp, Human
tccctatccagtcctgtcctcatgacaaatatatttctccacattttctgcatcccttcagggtaggctgtcagtactctgtcccttgatataaaaagtcagtagccactgagctaattcatgagaaggtataactgatgatctcattgttgcctctccatttcaacagaggttcttgtcttaccccaaaagaatgaaactgcaatgctgttactggggtaataggacaagctagtgggcaacaatttctagagaagatgaccttctaaggcccattatgtcccagccaccagcagagcawgtttgccctgtttatatattagctgtaatattggagtcaaagacttttagctttggacctggcctccagatcatcatgctgaaaaaagccaacctgggtgtgatcttcagagcaaggtgcaaactttctctctcagtttaggcatttgtacaaaggagttgacaattaccaagaaagaaagatattttcttaatgaaacaaaagggaaaatcagcccaataataataataacaacaagtgatcatgtattgtcaagcactctgctaatggctttacatgcactatataatttttcttgaa

SEQ ID NO: 126648 - DNA, 601 bp, Human
gcaatgaggtaattatagcaggtattatcttcattaattaatgagcaagctaagacgtagagaagctaactgacttgttcaaggtcccagctaggatgaagcagagtccctatccagtcctgtcctcatgacaaatatatttctccacattttctgcatcccttcagggtaggctgtcagtactctgtcccttgatataaaaagtcagtagccactgagctaattcatgagaaggtataactgatgatctcattgttgcctctccatttcaacagaggttcttgtcttaccccaaaagaaygaaactgcaatgctgttactggggtaataggacaagctagtgggcaacaatttctagagaagatgaccttctaaggcccattatgtcccagccaccagcagagcatgtttgccctgtttatatattagctgtaatattggagtcaaagacttttagctttggacctggcctccagatcatcatgctgaaaaaagccaacctgggtgtgatcttcagagcaaggtgcaaactttctctctcagtttaggcatttgtacaaaggagttgacaattaccaagaaagaaagatattttcttaat

SEQ ID NO: 126649 - DNA, 601 bp, Human
ggctctgaccttgccttgttgtgtgggcaagttatgttactcttcgtagttcagttttctcacttcatctctaaataagggtaataattgagtctactaccagaggttatgagaattaaatgaatgcttggaatggtaaaaactcttattcaatggatactagttttcacttttgagaagtttatgcactattggaagacctagttataagatagaatagtaaatgcttcaataattatgatagttaccattaacaataattacgcaatataaactttttcttttcttttttctttctttytttttttttttagacaggatcttactctttttttttttgagacagggtcatccaggctggagtgcagtggtatgaccatagctcactccagcttcgacctccagggctcaggtgatcaatctttccacgtcagcctcctgagtagctgggactacaggcatgcaccaacacatctggctaatgtttttgatttttagtagagacaaggtcccactgtgttgctcagtctggtctcaaactcctgagctcaagcgatcctcttgcctctgccttccaaagtgctgggattacagcagtaag

SEQ ID NO: 126650 - DNA, 601 bp, Human
caaaagtcatgagcttgagaattagcctaaactggctctgaccttgccttgttgtgtgggcaagttatgttactcttcgtagttcagttttctcacttcatctctaaataagggtaataattgagtctactaccagaggttatgagaattaaatgaatgcttggaatggtaaaaactcttattcaatggatactagttttcacttttgagaagtttatgcactattggaagacctagttataagatagaatagtaaatgcttcaataattatgatagttaccattaacaataattacgcamtataaactttttcttttcttttttctttctttttttttttttttagacaggatcttactctttttttttttgagacagggtcatccaggctggagtgcagtggtatgaccatagctcactccagcttcgacctccagggctcaggtgatcaatctttccacgtcagcctcctgagtagctgggactacaggcatgcaccaacacatctggctaatgtttttgatttttagtagagacaaggtcccactgtgttgctcagtctggtctcaaactcctgagctcaagcgatcctcttgcctc

SEQ ID NO: 126651 - DNA, 601 bp, Human
ggagcacctccttggtctaactgtggatacaaataattaacaggtgtcagatgtcaggaaaacacaagcagaactcttgaactaactaacagtttgcatcttttacagatcaaggagttgaattagtaaagtgtattagtgcgagggacccagttcagtccatagcagaagggaagttacctagaaggtacactgtgagagtgtctaccctaacatttattgagcacctgcatgcaccaggtgttgtgttagtacaggaggtaaagagaattaaggatacaacctctactctctacatagyaaaggcaaaagtcatgagcttgagaattagcctaaactggctctgaccttgccttgttgtgtgggcaagttatgttactcttcgtagttcagttttctcacttcatctctaaataagggtaataattgagtctactaccagaggttatgagaattaaatgaatgcttggaatggtaaaaactcttattcaatggatactagttttcacttttgagaagtttatgcactattggaagacctagttataagatagaatagtaaatgcttcaataattatgatagttaccattaacaataatt

SEQ ID NO: 126652 - DNA, 601 bp, Human
tatttggattggaactcggtcagagctgtcactcttcagctaggaatctaagaggatcatgtcttggatgttacggagtatagacaaccaagttccctgccctcaaaagcccgatcacttataagacagcttatggagctttgacagagggcagcagttgatggcattatcctttgaactcatagcttagttggactcctactggcttgtgggaccaaatctttccctaccacagttggctatagcaaaagttgtgaaaaatgccactaggatatactggtgagggaaaaggaggtccatktgtagttatagtataattgaaaagaaaagctctgaagaaaactctagcctactctttttcagcccaaggggaaggcagagcacctgctgacagatgctggcgtagcgagccagggcgttggcgttttcctggatagcgaggctggatggacactggtcggcaatcctcagcacagcacgccacttcccaaagtcaacaccatctttcttgtactgagcacagcgctctgagaggccatcaagccctgcaagtcacaaaagagagaaaggcttctttgtacctttgtacctgatccatggg

SEQ ID NO: 126653 - DNA, 601 bp, Human
aaattcttctgtctttattcccagaatgcttggttcaccctacaatataatcgctgcttttcttggttgcttctcttcttcatcttcccaaaataaaaagtatcctaggttcagttcttggtcctcttatctccttccctctgaagtgtttctgttgaaattgtccttcagtctcctgtcatcaactatactctagtgtggataattcaaaattctctctagcctcaatcctcatactgacctctactgccacattttcaaatgcctaatagacactatcggtagataccttcttggcccraagaaaacaatgcttctccgtgttggaaagtcaagccccaaatgtgaacatcatcaagtagataagaggtggcagcatcttaccatggcccgcttcataaaagcctcctgggttgcctccttgtttgcagccttgccaccccaggcagccagtgcactggcctgcagggcccgtccataagagaaacttagtttccagggctttggtagagggcaaaggttgatagcattgaggttgagagtggcatcctcttcactcatgccaccagacaaaaagcagatgcctggtaggagagaagcc

SEQ ID NO: 126654 - DNA, 601 bp, Human
acaaataaacatgaaagaaagaaattcttctgtctttattcccagaatgcttggttcaccctacaatataatcgctgcttttcttggttgcttctcttcttcatcttcccaaaataaaaagtatcctaggttcagttcttggtcctcttatctccttccctctgaagtgtttctgttgaaattgtccttcagtctcctgtcatcaactatactctagtgtggataattcaaaattctctctagcctcaatcctcatactgacctctactgccacattttcaaatgcctaatagacactatyggtagataccttcttggcccaaagaaaacaatgcttctccgtgttggaaagtcaagccccaaatgtgaacatcatcaagtagataagaggtggcagcatcttaccatggcccgcttcataaaagcctcctgggttgcctccttgtttgcagccttgccaccccaggcagccagtgcactggcctgcagggcccgtccataagagaaacttagtttccagggctttggtagagggcaaaggttgatagcattgaggttgagagtggcatcctcttcactcatgccaccagacaaaaagcag

SEQ ID NO: 126655 - DNA, 601 bp, Human
taaaaactttgttggtcctcatttctcctggcaacctttctgggtctttttctgaaaaacttcttgagtgggcacctttcctttcctctttattgaaactgtttcagtgagggtcactggtatgctcctaaatgccaatctcagggtcttttcttggcctttcttttgaatctctctatagcatgttattattggccctttgaaattgtttacccggctgggtgtggtggctcatgtctgtaatctcagcactttgggaggttgaggtgggcagatcacctgaggtcaggagtttgagacyagcctggccaacatggtgaaaccccatctttactaaaatatacagaaattagccaggtatggtggcgcatgcctctagtcccagctacttgggaggctgaggcagaagaattgcttgaatccaggaggtggaggttgcagtgagccgagattgtgccactgtactccagcctgggtgacagagtaacactccatctcaaaacaaacaaacaaacaaacaaataaacatgaaagaaagaaattcttctgtctttattcccagaatgcttggttcaccctacaatataatcgctgcttttct

SEQ ID NO: 126656 - DNA, 601 bp, Human
gtgtggatgtccctgatgacctgcgctttcacaatccctccatcatgtaagctaggtctcctcagtccatcagccacacagcagcactgctgcaccctgctttccacagtcaaggtaaagcactactttgaaaatctgatacctctcttatgcctgtgagatgatgatttagcttccctggggccttccttccctttagggcctcatcaccacacttctgactactcttgattccttgcctagcttcctctatggtcagcaagctaacagaggctatcggtaaaatttgtcactcttctaycttcctattaaactttcactcttctaccccgctattttgcgttctgaatcttcctgcatgctttagactgctgttaggaaaactcaggaatgaagctaccacacactcactcttatttcagctgcacattacctgatgcttggctatgtctggccataacgtccgatcaatttcctagcaagttcctttaactgcttttctacgctttccgactgtcagtattgaaatttccatttcttcatcattctcagcagataccctcaactgtaatcagtcatcaactgctacatctcttgactt

SEQ ID NO: 126657 - DNA, 601 bp, Human
tgtaaatataaaagatcatgacaacaaaaccaaaatcaccttcaggtgattcagatccacactggagcttgggaagcaccatccttgatgataaactcagcttcccttcttctgtgtggatgtccctgatgacctgcgctttcacaatccctccatcatgtaagctaggtctcctcagtccatcagccacacagcagcactgctgcaccctgctttccacagtcaaggtaaagcactactttgaaaatctgatacctctcttatgcctgtgagatgatgatttagcttccctggggccttycttccctttagggcctcatcaccacacttctgactactcttgattccttgcctagcttcctctatggtcagcaagctaacagaggctatcggtaaaatttgtcactcttctaccttcctattaaactttcactcttctaccccgctattttgcgttctgaatcttcctgcatgctttagactgctgttaggaaaactcaggaatgaagctaccacacactcactcttatttcagctgcacattacctgatgcttggctatgtctggccataacgtccgatcaatttcctagcaagttcct

SEQ ID NO: 126658 - DNA, 601 bp, Human
ataagttctagtgtttgatacaacagtaagatgactatagttaacaatgatttattacatattttaaaatagctggaagagaagatttggaatgttccaaacccaaagaaataataaatatttggagtgaataccctaattatcctgatttgatcattatacattatatgcatatataaaaaatcacagataccccacagatctatacaattattgtgtgtaaatataaaagatcatgacaacaaaaccaaaatcaccttcaggtgattcagatccacactggagcttgggaagcaccatycttgatgataaactcagcttcccttcttctgtgtggatgtccctgatgacctgcgctttcacaatccctccatcatgtaagctaggtctcctcagtccatcagccacacagcagcactgctgcaccctgctttccacagtcaaggtaaagcactactttgaaaatctgatacctctcttatgcctgtgagatgatgatttagcttccctggggccttccttccctttagggcctcatcaccacacttctgactactcttgattccttgcctagcttcctctatggtcagcaagctaacag

SEQ ID NO: 126659 - DNA, 601 bp, Human
gtgggggtaggggaaatgaaaagaggttggtaatgggtacaaaaatacagttaggcagaaggaataagttctagtgtttgatacaacagtaagatgactatagttaacaatgatttattacatattttaaaatagctggaagagaagatttggaatgttccaaacccaaagaaataataaatatttggagtgaataccctaattatcctgatttgatcattatacattatatgcatatataaaaaatcacagataccccacagatctatacaattattgtgtgtaaatataaaagatcatracaacaaaaccaaaatcaccttcaggtgattcagatccacactggagcttgggaagcaccatccttgatgataaactcagcttcccttcttctgtgtggatgtccctgatgacctgcgctttcacaatccctccatcatgtaagctaggtctcctcagtccatcagccacacagcagcactgctgcaccctgctttccacagtcaaggtaaagcactactttgaaaatctgatacctctcttatgcctgtgagatgatgatttagcttccctggggccttccttccctttagggcctcat

SEQ ID NO: 126660 - DNA, 601 bp, Human
aggaggatgagcagaccaattatttttggtttggtcagcttacataatgattatcgttctttggtttctcagtttctagtgggcttcattgtttgcttcccagaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggtaggtaccatgttttgctggaagcaagggtgytgaaggtctgtattaggccggtttcattagtttctactttatcaatattttatgtattctaagtaacagccatgagtcctttagccaagactgtctgtgttgtgattggggttaatgaccacgatatcacttagatgtttgggcttggatttgatttgggtaaatttaggaaagcctcagatttaatctgatcaatttggtactagtccaactttgcatctacagggaaaaagtatttctatgttacgtttttacacatagagagataaacatggaaacatacatatatttaatcataaa

SEQ ID NO: 126661 - DNA, 601 bp, Human
atttctttaactgacactacatctttgacacaaaatcacaccaaaatatgtctccaagtcacataaaaacatagacagccacttaaaaaaattgtcttcctggccctactaaatacaaatgccaaaaaacagcctgagaacacaatcaattcttgcagactgttagaacaaaaatgaatcagcaaacccactcccttcgttatagcattgagaaaaccaagacatagaggcatcagttgctagtctgtgtttgcagtttccttgcattaatacaagtagagaaatagtttccatggtgctktcttttttctctgcagcacccctaattatctatgcagaatttcattctataaactaaaattgaaaatggcaactttttaaatgaacgatactttatttgacggtaaatgagtttgatcaaactccatttattacacaatttattgcaccttcttgggatatacatttggtaggatgatattaaaataaacagaagccccaatttctctacgcagtataaataatttttccactggaaagtgctactacaaataatttctacctggattaaaaattcttatatgcaaactgcatatccttt

SEQ ID NO: 126662 - DNA, 601 bp, Human
aatagtttccatggtgctttcttttttctctgcagcacccctaattatctatgcagaatttcattctataaactaaaattgaaaatggcaactttttaaatgaacgatactttatttgacggtaaatgagtttgatcaaactccatttattacacaatttattgcaccttcttgggatatacatttggtaggatgatattaaaataaacagaagccccaatttctctacgcagtataaataatttttccactggaaagtgctactacaaataatttctacctggattaaaaattcttataygcaaactgcatatcctttgaaactaggaaccctgcaaagtatacagctttcaagggagaaaaatgtccacaaggagttggaatatttaaaatcttatgttagccttagcaaacatgttaacttaagcattaacatttaaaattatatatttttgaccttttataaatactcagggcagtgtattttaaaatattttttctgagacattggatatctttgtttatggtttgttattaatacagctttcaattaaatatgaaaagtcaacttaaaatcctgtcatgtttttcatcatttttc

SEQ ID NO: 126663 - DNA, 601 bp, Human
gatcaaactccatttattacacaatttattgcaccttcttgggatatacatttggtaggatgatattaaaataaacagaagccccaatttctctacgcagtataaataatttttccactggaaagtgctactacaaataatttctacctggattaaaaattcttatatgcaaactgcatatcctttgaaactaggaaccctgcaaagtatacagctttcaagggagaaaaatgtccacaaggagttggaatatttaaaatcttatgttagccttagcaaacatgttaacttaagcattaamatttaaaattatatatttttgaccttttataaatactcagggcagtgtattttaaaatattttttctgagacattggatatctttgtttatggtttgttattaatacagctttcaattaaatatgaaaagtcaacttaaaatcctgtcatgtttttcatcatttttctatgctaaaattcaaagttcctttatattttgaaaaatagttaatattttgatatagccataggaagtaagaaaagaaattacttgtattttctggaagatttcaagaacaatttagaaatgtaaatagcata

SEQ ID NO: 126664 - DNA, 601 bp, Human
tgtgtgtgtgtgtgtgtgtgtgtgtgtgtgtgtgtgtgtgtgttgagacagagagagaaggggagagagagatttgttataaggctttagcttgcaaggctatagagaccagcaagatctgcagttgctaaggtggagacccaggagagccaatggcacagttccaatacaaatacaaataaccagcaggccgaagacccaggaagagttgggtctgggaaaagatgttttagtttgaatccgaaggcagaaaaaagccaatgtcccagctcaaggcagtcaggcaggaggaaattcccgyttacttggaggagggtcagctttttttccctactcaggtcttcaactgattggatgcccaccccccaccgccatatcgggggaataatctgtgttactcagtctactgattcaaatattggtctcatccagaaacaccctcacagacacacccagaaaaatgtttgaccaaatgtctgagcatcccatggccaagtcaagttgacacccaaaattaaccatcacagtctaccccttgtcaacttggcacacatatacatctctttaaaccatacttaatttccaaataaagacagtaacg

SEQ ID NO: 126665 - DNA, 601 bp, Human
ccctaagggctctcctgtatccagacatactttcttacctcccttgtgcaatagctatccaatttctccttggtagtcagcatctgtcaccccagccagcccagtaactcccttctttgctcattgattcagagtcatgaggagcccaaagtggcctggtggcagttttaacttccattttaatggaattgttgtgtctcctagtggaactttggtcctttgaaactaagacttctaggccagcagaccacagggtcatgggaacaatgaacaaaagttttgctagtgcatcactaggagwaatggtgagtggtgccactcctatttccaatcttgattccctgacccatgaatcctagctatgggagaaatggcatccgcaattgcccactgattcagagcatatacagccttctggagaatgttgccccggcctgtaaggtgtggccacctagctggcactgtaactgagtcttcaaaaggccgttaccccgttatatcgagccagcagcttcaggatggtggagaacatgtgtcatggaatgaatgagctgagaaataaaggaccagaataattcttctcatttaatgtttgatgttt

SEQ ID NO: 126666 - DNA, 601 bp, Human
caataaccagcacagagaaggtagataatcaaagttactgaactgagtaaatgttccatgttatatatttttaattaaaaatggaatgtatcacaccctttttttaaaccagccattgctcaactctggtttaatagtgatccataaagaaaacaacacttcaatctcactcacccagagatggtcactgctaacatcccgggagcacagtttgatgaaaaaatgcaggactagaagttaggtgtttcgcttccaatcccaaccctgtctcttccactccatgtgaccttggaccaagctrccatccttcctagacctcaatgtccccagccatggaatagcagagttggttggtcattttcagggttaagctaacctgacttataatctggtcttatacccaggtgtgattaagtggcttcattccagataactcagaatccttgcctagggctcttgggtcccaggccccatagaattacacatctctccaacagtgtgtcctcctcttcctgatattcacgatcttcccctgcctgccaggagaagatggtttcctgatgaggctgctcaagttgatcaaaagtcggcattggtggaa

SEQ ID NO: 126667 - DNA, 601 bp, Human
ggtttcctgatgaggctgctcaagttgatcaaaagtcggcattggtggaaagagccttgcatttctctttcttcccccgcatcatctctccccattagcctgtgtttcagtaaaaacaagccatgtaggcaagaaaaaaatcaagctgcaaaattattctgttctaattctatcctagatcactgtcacacagaattccaagaacaaacaactttataaagggagaacaaaagaggcatgtagccacttccagttaactcaataaatgtgactcggttacctgccgagcactgtgctgggyaccaacagggcagcctggctgggactctgcctttcaggagcacaggctggtggggacacaggcataatacactgagcttgacacagagcagacaggaagctgtgccaggagattaactcttactggtgcaaggcatcacagagcaggtgatactggaactgagctctggatttttttaattccatgccgagtgagggcctttgagaaaggccgcaaggagagtgttgtgtagggaaggaattggggatgggaatcttagtgtggtttctgtggagggtcagatgcgactagaaagagggg

SEQ ID NO: 126668 - DNA, 601 bp, Human
tattctgttctaattctatcctagatcactgtcacacagaattccaagaacaaacaactttataaagggagaacaaaagaggcatgtagccacttccagttaactcaataaatgtgactcggttacctgccgagcactgtgctgggcaccaacagggcagcctggctgggactctgcctttcaggagcacaggctggtggggacacaggcataatacactgagcttgacacagagcagacaggaagctgtgccaggagattaactcttactggtgcaaggcatcacagagcaggtgatacyggaactgagctctggatttttttaattccatgccgagtgagggcctttgagaaaggccgcaaggagagtgttgtgtagggaaggaattggggatgggaatcttagtgtggtttctgtggagggtcagatgcgactagaaagaggggttgggatagataacgcgggggaagagggggcggcaaggccgactgacgggtttagactttgctcagtgggttcagggagcccttgagggtcagagactcagaggggttttgggagctgatgctggggacacatggactggaggggtgtcaggga

SEQ ID NO: 126669 - DNA, 601 bp, Human
aagctgcttccatatggagtttaaacctttattctgaggtttcaagataaaagggctctggaccctcattttacagatgggggatccaaaaccagagagcaccagtgccccgtctgtggcctcacagccctgggctgagaacccaggttatcaggtagggtgcagcttcgctacaagtaacagagactcagaataatgtgatttgtgcagtgttttatccatccctcaagtaaaagtccacaggtaggcaatctagggctgggatggagctcagctccccagacttctcagagtcctagaytttgtccagctcatctttctgccattcctaaggtgtagccctatagccataatagccacattccaggcatccaaatagagaaaaagggatggggagggggagggataaaagaaaggagaaaagccatgattcaagtcccttttaaggaaagttaccagaaattgccactggacatttctcatatcattgcctggaacttaattatatgactcaacctagctgcaagggagcctgtgaagtgtagcctttaatctgagcagccaagagctcaactaaaaagtggaggctttcttttattgc

SEQ ID NO: 126670 - DNA, 601 bp, Human
atgaattggtcaagaattcgtaggtcagggaagttggtgagcatctccgagtatgctggggagtgatgtggtcaggtacacatgtcagtggagtctaaggagcagaggtagagaggcctgaagcaggaaaccagccaggaggcttctctgctggtcccggcaagactcacaagggctggaacgagggtgatgcccacggaaggagacatttcggaacactgcagcctcagaccctaatgcctcccctagcaggccatgccgccctcatctgctgggcctctgctgcactgtgctttctctytccctgcgatgcccctgcactccctctcttcacctggctggctcttccctggtccctcagactcagttcaggaccacctcctccaggaagcccagggctgagtaaggtgaccacaccactgagatgtgtatctcccctgtggctgtgagcccctctgggctgggatcgtaccgtcattgtctcaggatacccagtccccagcacaacaggaacatggaacattttccctgcacatgaggcaggaaaggaggatttggagaaagccagggagggaaggtttgtccccaccttgaataccag

SEQ ID NO: 126671 - DNA, 601 bp, Human
accatgtgtttagtgaataactatgtgtaattaagatttttctctaggccaggtgcggtggctcatgcctgtaatcccagcactttgggaggccaaggtgggtggatcacgaggtcaggagtttgacaccagcctggccaacacagtgaaaccccatctctactaaaaatacaaaaaaaaaaaaaaattagccgggcatggtggcatgcacctgtaatcccagctactcaggaggctgaggcaggagaatcacttgaacctgggaggtggaggttgcagtgagctgagatagcaccactgyactccagcctggccagcacagccagactccatctcaaaaacaaaacaaaacaaaacaaaacaaacaaacaaacaaaacagatcaacaaagaaaaacttttctctaattttactctactttctccattcacctctcatctccctggttactccaatttttttaatttctctttgtgggatcatagccctacatgttaacacactacctggacacatagcattcatttagcagatgtttattgaatgaataagaaataagagaatgagaggtgcttttctatgcatacatgatcaccaaata

SEQ ID NO: 126672 - DNA, 601 bp, Human
atgcctgtaatcccagcactttgggaggccaaggtgggtggatcacgaggtcaggagtttgacaccagcctggccaacacagtgaaaccccatctctactaaaaatacaaaaaaaaaaaaaaattagccgggcatggtggcatgcacctgtaatcccagctactcaggaggctgaggcaggagaatcacttgaacctgggaggtggaggttgcagtgagctgagatagcaccactgcactccagcctggccagcacagccagactccatctcaaaaacaaaacaaaacaaaacaaaacaaacaaacaaacaaaacagatcaacaaagaaaaacttttctctaattttactctactttctccattcacctctcatctccctggttactccaatttttttaatttctctttgtgggatcatagccctacatgttaacacactacctggacacatagcattcatttagcagatgtttattgaatgaataagaaataagagaatgagaggtgcttttctatgcatacatgatcaccaaatactctcctggccagagccaacaacagaatggttgtgggaactcttttcctcacctattgagtagc

SEQ ID NO: 126673 - DNA, 601 bp, Human
atggtggcatgcacctgtaatcccagctactcaggaggctgaggcaggagaatcacttgaacctgggaggtggaggttgcagtgagctgagatagcaccactgcactccagcctggccagcacagccagactccatctcaaaaacaaaacaaaacaaaacaaaacaaacaaacaaacaaaacagatcaacaaagaaaaacttttctctaattttactctactttctccattcacctctcatctccctggttactccaatttttttaatttctctttgtgggatcatagccctacatgttawcacactacctggacacatagcattcatttagcagatgtttattgaatgaataagaaataagagaatgagaggtgcttttctatgcatacatgatcaccaaatactctcctggccagagccaacaacagaatggttgtgggaactcttttcctcacctattgagtagcccgggtgtgagagtcagtattaggttctaataatcatgagagctctatggcgatattttcaggttcatttaacttctccacaagtaatttacataataaggtaaatcacattgtaaaacaggcaccatttgaa

SEQ ID NO: 126674 - DNA, 601 bp, Human
tggtggctgggcatggaggctaatgcctataattccagcactttgggaggccgaggctggtggatcacctgaggtcaggagttcaagaccagcctgaccaacatggtgaaaccccgcctctactagaaatacaaaaattagccgggcatggtggtgggcatctgtagtcccagctactggggaggctgagacagaattgcttgaacccgggaggcagaagttgcagtgagccgagatcacgccactgcactccagcctgggcaacaaagtgagactccatctcaaaaaaaaaaaaaaaaaaggaagaaaataaaagaaatgtggcaatgtttggagacatttttggttgtcacaactgggggcagtgctactagcatctaggagatagagagcagaaaggctgctaaacaatctccagtgggtagagtggcctccacaacaaggaagtgtccagcccagaatgtcagttgtgctgaggttgagaaactctgctttaactaaatccgtggcctctaccagatagattcgaaaagagatgagagtttgcaaacccttctcccctcagttacaacccctgaatttcttctatcgcaatacttag

SEQ ID NO: 126675 - DNA, 601 bp, Human
gggaggcagaagttgcagtgagccgagatcacgccactgcactccagcctgggcaacaaagtgagactccatctcaaaaaaaaaaaaaaaaaaggaagaaaataaaagaaatgtggcaatgtttggagacatttttggttgtcacaactgggggcagtgctactagcatctaggagatagagagcagaaaggctgctaaacaatctccagtgggtagagtggcctccacaacaaggaagtgtccagcccagaatgtcagttgtgctgaggttgagaaactctgctttaactaaatccgtgrcctctaccagatagattcgaaaagagatgagagtttgcaaacccttctcccctcagttacaacccctgaatttcttctatcgcaatacttagcctttctggggccagaacatgccccagcatcttactgccattaaaaccctttatggtaatgaaaatctgtaggccttccctgtggggatccttaagaagcatgagcacttgctttcactgcttaattcattttataattgtgtgttttagttttttgaatttatatttggataatacattccctgttaaacatacatatttgggtaac

SEQ ID NO: 126676 - DNA, 601 bp, Human
acccttctcccctcagttacaacccctgaatttcttctatcgcaatacttagcctttctggggccagaacatgccccagcatcttactgccattaaaaccctttatggtaatgaaaatctgtaggccttccctgtggggatccttaagaagcatgagcacttgctttcactgcttaattcattttataattgtgtgttttagttttttgaatttatatttggataatacattccctgttaaacatacatatttgggtaaccaatctcctattaacatatattctacctgattatataacartagaagggatcataagtaataatttttgaccgtttactatgttaggcactgtgctgagcacattttctgcattatctagtttaattttctcaaccactctatgagagagcaactctcattattcacattttacagccatggaaactgaggcacaatgagatttaggggacttgcccaagattgtgtagttgtatcattattactccaagtcagggcttaagcctgatgtagggtcaactgtgaagtgcaggcatgtcacaaagactttggattattcattatgggtagtcacacattgat

SEQ ID NO: 126677 - DNA, 601 bp, Human
ggattattcattatgggtagtcacacattgatgtttgcagggcagtgaggtattgtctcactctcttgcatcaccataagctccctgctgtggaagagaaggcgtgggcacacacagctagctacaggaagtcccatcaaacctgggacatgcccacagaagcatggctcacctgggagcatcacctgtcctgcctatcatggtggacaatatctgagaactgctgcttaaggaaaagtgggatgtgtggagcatcacttatgttcctgatgccccccaccccaaagtcagtcaggccttkattttctacctactgtcctctcataaaaagctccaactcccagtgtctcttttgatctgtggcctaaatctctctgcaagtacaccagcaccacctgccaagcccattatctgtctgtccgggctctgtgctgggtgggccctgctcacttacagccctcccagaggcaggatcacaccccggtctcctgatcttacagccactactcttactgaaacagcactgtggtgttatgcatagtacaccttttaaaaaatgatgcattagttaggccagatgtggtggttcatgcctgtaatc

SEQ ID NO: 126678 - DNA, 601 bp, Human
acaccccggtctcctgatcttacagccactactcttactgaaacagcactgtggtgttatgcatagtacaccttttaaaaaatgatgcattagttaggccagatgtggtggttcatgcctgtaatcccagggcttaggaaggccgaggtgggtggatcatgaggtcaggagttcaagaccagcctagccaatatggtgaaaccctgtctttactaaaaatacaaaaattagccaggtgtggtggcatgcgcctgtagtcccagctactcgggaggctgaggcagaagaattgcttgaaccygggaggcggaggttgcattgagccgagatcacaccactgcactccagccttggtgacagagaaagactctgtctcaaaaaaaaaaagtaaaaaaaattaaaaagattccttaaacagtagtattccctcccaagctgtatccctctatgtgccaggcatacagtgatcttcatatccctgataacagtcccctcacagaggcagctttcagaaaaggatatggagtttgtgacagtgactgaagatatgcattttaatggtacaaagattgaaagtggggctgggaacggtaatcccagc

SEQ ID NO: 126679 - DNA, 601 bp, Human
ctgaggcagaagaattgcttgaacccgggaggcggaggttgcattgagccgagatcacaccactgcactccagccttggtgacagagaaagactctgtctcaaaaaaaaaaagtaaaaaaaattaaaaagattccttaaacagtagtattccctcccaagctgtatccctctatgtgccaggcatacagtgatcttcatatccctgataacagtcccctcacagaggcagctttcagaaaaggatatggagtttgtgacagtgactgaagatatgcattttaatggtacaaagattgaaaktggggctgggaacggtaatcccagcactttgggaggccaaggcaggcagatcacttgagtttgggagttcgagatcagcctggccaatatggtgaaacactgtctctattaaaaatacaaaaaattagccgggcgtggtgtcaggcacctgtaatcccagccactcaggaggctgaggcaggagaatcgcttgaacctgggaggcagaggttgcagtgagccgagattgcgccactgcattccagcctgggtgcaacagagcgagagtccatctcaaaaaaaaaaaaaaaaaggttggag

SEQ ID NO: 126680 - DNA, 601 bp, Human
aggcaggagaatcgcttgaacctgggaggcagaggttgcagtgagccgagattgcgccactgcattccagcctgggtgcaacagagcgagagtccatctcaaaaaaaaaaaaaaaaaggttggaggtggaatgactcttcagtttagtcagtttgagggtgcatatcttttgggtgatgttctgcccataccagccacccatgtattcccctagctctgcaaatgcagggaacagggagcacacaacgattagaaatggtcatcctcctctcgtaaatctgaagaagaacgctggtttttrttctagatctgtcctgaaattccttgggcaaatctttccttgctctgtgcctcagttcccctaatgggagagtgtgtgcactgatgatctctaagcatccttgcagctataaacttctttgactccctaaggtactgggggctgagttaaagtgaagcccatgaggataactccaatccccccaataggaatctgctttagcagtaagcccacacctagaagcctgcttatgtttgaagaagagaagggaacaattggttgatgttatgtttcttgagatacccatctccaggggcgacg

SEQ ID NO: 126681 - DNA, 601 bp, Human
ttgcagtgagccgagattgcgccactgcattccagcctgggtgcaacagagcgagagtccatctcaaaaaaaaaaaaaaaaaggttggaggtggaatgactcttcagtttagtcagtttgagggtgcatatcttttgggtgatgttctgcccataccagccacccatgtattcccctagctctgcaaatgcagggaacagggagcacacaacgattagaaatggtcatcctcctctcgtaaatctgaagaagaacgctggtttttgttctagatctgtcctgaaattccttgggcaaatcwttccttgctctgtgcctcagttcccctaatgggagagtgtgtgcactgatgatctctaagcatccttgcagctataaacttctttgactccctaaggtactgggggctgagttaaagtgaagcccatgaggataactccaatccccccaataggaatctgctttagcagtaagcccacacctagaagcctgcttatgtttgaagaagagaagggaacaattggttgatgttatgtttcttgagatacccatctccaggggcgacgttcaaaatatttaaccaccagtgtgttgtgagcac

SEQ ID NO: 126682 - DNA, 601 bp, Human
ttttgttctagatctgtcctgaaattccttgggcaaatctttccttgctctgtgcctcagttcccctaatgggagagtgtgtgcactgatgatctctaagcatccttgcagctataaacttctttgactccctaaggtactgggggctgagttaaagtgaagcccatgaggataactccaatccccccaataggaatctgctttagcagtaagcccacacctagaagcctgcttatgtttgaagaagagaagggaacaattggttgatgttatgtttcttgagatacccatctccaggggygacgttcaaaatatttaaccaccagtgtgttgtgagcacagacccgtcaggaggttagaaggcagcgggtagggccagcagggactgtggccagagagcatgccccgtcctcctcttagctctgcagggcactgctcacctcgctgctttcctgggcctttctccagctttttttttggtctgcctcttcctgcctgattctccatccagggccccagcttaacccccttttggcttcttctctctccggagccacctgatactcaactcaactcctgtgaatatctttatgcatccaaa

SEQ ID NO: 126683 - DNA, 601 bp, Human
cctgcttatgtttgaagaagagaagggaacaattggttgatgttatgtttcttgagatacccatctccaggggcgacgttcaaaatatttaaccaccagtgtgttgtgagcacagacccgtcaggaggttagaaggcagcgggtagggccagcagggactgtggccagagagcatgccccgtcctcctcttagctctgcagggcactgctcacctcgctgctttcctgggcctttctccagctttttttttggtctgcctcttcctgcctgattctccatccagggccccagcttaacccycttttggcttcttctctctccggagccacctgatactcaactcaactcctgtgaatatctttatgcatccaaacaacaactcaatcatattcatcactcagcagatgctctttcagtgccctctgtgctcagactggagtcggctgccttgacccctcacctcctctccttcaaaaatgttagaggcagggatgggctggaggattgagacctgagtcctagcctctctctgccccttgtctgcctttgaccttggacaagtccctccctgtcctggggtttcagattccttacttgtaa

SEQ ID NO: 126684 - DNA, 601 bp, Human
cgctgctttcctgggcctttctccagctttttttttggtctgcctcttcctgcctgattctccatccagggccccagcttaacccccttttggcttcttctctctccggagccacctgatactcaactcaactcctgtgaatatctttatgcatccaaacaacaactcaatcatattcatcactcagcagatgctctttcagtgccctctgtgctcagactggagtcggctgccttgacccctcacctcctctccttcaaaaatgttagaggcagggatgggctggaggattgagacctgrgtcctagcctctctctgccccttgtctgcctttgaccttggacaagtccctccctgtcctggggtttcagattccttacttgtaaaacgaggaacaccatggattccatgagctctgaggtcccttctgttcgatgatgagtttctggagaagtgcaagtcttcagcagctgaccactctctctttctctctctctctttctctctctcctgcccccccacaacctccaatgtagaatgcactgctgcctgcaggcctgaggcagaaggatcagaccaccaaggcgcccacgggcccctt

SEQ ID NO: 126685 - DNA, 601 bp, Human
aaacacccaaacccaacttcaaaagcatctatggatgatgtagatttcatgaagttttgggggtagactgaggaaagactcctatccactcaaatcagcaaaacttttccctaaaccctctttcactaggatgtcctgattatttttttacgcaaacctaaacagttttgagagtaaaagaagaaactgttaataacgacatcaggactttgggagaccgaggcaggcagaccacctgaggtcaggagttcaagaccagcctggccaacatggcaaaaccttgtttctactaaaaatacaraaattagccgagcatggtggcacgagcctgtagtcccagctactcaggaggctgaggcaggaaaatcgcgtgaacccaggaggtggaggttgcagtgagccaagatcgcaccactgcactccagcctgggcaacagagtaagactccgtctccaaaaaaaaaaaaaaaaaaaaaaagacatcaggacatgaagcctaagcagggaccatcctatgcaaaccagggactagagatgcactaaccatctccacccagattctctctgctctttctccaaagttcctctctctggcagctgca

SEQ ID NO: 126686 - DNA, 601 bp, Human
tagactgaggaaagactcctatccactcaaatcagcaaaacttttccctaaaccctctttcactaggatgtcctgattatttttttacgcaaacctaaacagttttgagagtaaaagaagaaactgttaataacgacatcaggactttgggagaccgaggcaggcagaccacctgaggtcaggagttcaagaccagcctggccaacatggcaaaaccttgtttctactaaaaatacaaaaattagccgagcatggtggcacgagcctgtagtcccagctactcaggaggctgaggcaggaraatcgcgtgaacccaggaggtggaggttgcagtgagccaagatcgcaccactgcactccagcctgggcaacagagtaagactccgtctccaaaaaaaaaaaaaaaaaaaaaaagacatcaggacatgaagcctaagcagggaccatcctatgcaaaccagggactagagatgcactaaccatctccacccagattctctctgctctttctccaaagttcctctctctggcagctgcagcttcccttccttcgtctgtcccattatactctctgctccagcctgaggcaagccatcttgaa

SEQ ID NO: 126687 - DNA, 601 bp, Human
ttacgcaaacctaaacagttttgagagtaaaagaagaaactgttaataacgacatcaggactttgggagaccgaggcaggcagaccacctgaggtcaggagttcaagaccagcctggccaacatggcaaaaccttgtttctactaaaaatacaaaaattagccgagcatggtggcacgagcctgtagtcccagctactcaggaggctgaggcaggaaaatcgcgtgaacccaggaggtggaggttgcagtgagccaagatcgcaccactgcactccagcctgggcaacagagtaagactcygtctccaaaaaaaaaaaaaaaaaaaaaaagacatcaggacatgaagcctaagcagggaccatcctatgcaaaccagggactagagatgcactaaccatctccacccagattctctctgctctttctccaaagttcctctctctggcagctgcagcttcccttccttcgtctgtcccattatactctctgctccagcctgaggcaagccatcttgaaggccccaggaaacagagagggcctccctgaccatccattctaagacttcccgttgctctccaaaccctctgcccccctccaata

SEQ ID NO: 126688 - DNA, 601 bp, Human
agagttgttggatgaatggatgagctaaaattaaataaatgtttaatggatttgtgcactacttcattagaataccagctacaggaatgtaaagaccatatctgtcttgttcatcattttgttcctggcacctaataaatccgtagcacatagaaggcacctaataaatatttgttgaatgaaagcactaattctaattaattaattgtgtaattaattgtttcttttcagtctcttccattccctccacccctaagaatgcaagcattgtgagccccaggtccacatctgtggctggctyccctgtatcgcagttgtatttgcacaatgcccggcactaagtagctgcttcataaaatgagtacgcacatgggggtagacattgtgcagaggacttcaaaccattccaaatcctggacttggagctcagtccaggtttcactgaaaactggaagtccagggaggcctaaggggcatctagattatagaacttctgaattttgaaaggatcgcgtggtcagagggatcctggagggggtggcaggagagaaggtgaggacgagggcagggagtggggatgggcagcagacctgggtggaca

SEQ ID NO: 126689 - DNA, 601 bp, Human
aaatatttgttgaatgaaagcactaattctaattaattaattgtgtaattaattgtttcttttcagtctcttccattccctccacccctaagaatgcaagcattgtgagccccaggtccacatctgtggctggctcccctgtatcgcagttgtatttgcacaatgcccggcactaagtagctgcttcataaaatgagtacgcacatgggggtagacattgtgcagaggacttcaaaccattccaaatcctggacttggagctcagtccaggtttcactgaaaactggaagtccagggaggyctaaggggcatctagattatagaacttctgaattttgaaaggatcgcgtggtcagagggatcctggagggggtggcaggagagaaggtgaggacgagggcagggagtggggatgggcagcagacctgggtggacacctagcgaggtgagtcattgctggtgtccacttcctcatgtacccacacccctcccaggggaggacctggaggatggtgtgagggatggggaagggagtctgaacggtacagaaatcagtcctgccactcctccagctctggactgggcagagctggggaaagct

SEQ ID NO: 126690 - DNA, 601 bp, Human
tggaggtctcagagccagtggggcaggagaccctccagctctgactggcaggctcagggccattcactccagcctctaccaagcacttcccccacaccaggcctacagtcagcttgggctgctgggaaacagcaccccacaccgcaagacctgatagtatgtgggaagagccataaactggcacaaagccctgaggaatttggaaagggaggccttctcattcaagtgggagagaccagaatatagctccaggcaggatgttttcattagaattagatttggctgcatgtgctggggggawaaataaaagtaacagagacttaatcgaggaatttaattttcttaggcattccagggctagtaaggcatattccttagcatcgtggatcacaaccctttccagcttttcattctgccacccctacaacctgtctttgtcctcatggtctatctggctgctgaagctccagccatcacattcacatgccactagtaagatgaagggaagaagtctaggtacctcttacagtggctcagagtcaccatcctcactggaggaacctgttatggggtataataaaccacaggtcttaaatattta

SEQ ID NO: 126691 - DNA, 601 bp, Human
aggcctgggcagagctgtgggattgcatctgagatgcagcttcaccaagagcccagctgttcctagtgccggctcagaggccgagcagctgagatggtaccagtctttctagcctgaggcagcagaaaacaggctgggtggctgatgaggagtgctctgccgagagctgacttcagaaactccgcatgagatgaaggctggacttcgaacatggtgttggaggtgctgggcggagcaggcccaccagagagtggtgggtggttggagcctttttcacagagcgggtgactgggaccaagartgtgggtaactcactggaggaagaagagtagggagaggaggacatggggcgtccaggtcacctgtagttggtatggcctgtctcccaagtggaacatttccatcagctcagctctggcttgctcactcacacacacagtcagtgctgtccatttagtctctggactaggctctggcaaaagaatggtaagaaaacagcccagtttccaccctcacagagtctacgttaaacaaacaccaggtaagtatgaaatgacaaatgagagtgagcgtctgaacagaatcagtacagcgtgtgagg

SEQ ID NO: 126692 - DNA, 601 bp, Human
ccaagagcccagctgttcctagtgccggctcagaggccgagcagctgagatggtaccagtctttctagcctgaggcagcagaaaacaggctgggtggctgatgaggagtgctctgccgagagctgacttcagaaactccgcatgagatgaaggctggacttcgaacatggtgttggaggtgctgggcggagcaggcccaccagagagtggtgggtggttggagcctttttcacagagcgggtgactgggaccaagaatgtgggtaactcactggaggaagaagagtagggagaggaggacwtggggcgtccaggtcacctgtagttggtatggcctgtctcccaagtggaacatttccatcagctcagctctggcttgctcactcacacacacagtcagtgctgtccatttagtctctggactaggctctggcaaaagaatggtaagaaaacagcccagtttccaccctcacagagtctacgttaaacaaacaccaggtaagtatgaaatgacaaatgagagtgagcgtctgaacagaatcagtacagcgtgtgagggaggcacttggggtagggctgggggagaccagggaagagctatg

SEQ ID NO: 126693 - DNA, 601 bp, Human
gaccaagaatgtgggtaactcactggaggaagaagagtagggagaggaggacatggggcgtccaggtcacctgtagttggtatggcctgtctcccaagtggaacatttccatcagctcagctctggcttgctcactcacacacacagtcagtgctgtccatttagtctctggactaggctctggcaaaagaatggtaagaaaacagcccagtttccaccctcacagagtctacgttaaacaaacaccaggtaagtatgaaatgacaaatgagagtgagcgtctgaacagaatcagtacagygtgtgagggaggcacttggggtagggctgggggagaccagggaagagctatggagaagagcctaggagcagaagagtagcagtgagaaagtgcggagaaggtccagggcttgggagcggcaggaggagcggttccgggctggggagggcaggcccctctgaacggagtggcctggcaggcttgctatctgctgatgggaggagcctggagggcaagctcaggtgtgccctcctaactcaggtgtgacacgggtgagatgcatcactcatgtattcacctaactgctcactaagccagtgc

SEQ ID NO: 126694 - DNA, 601 bp, Human
gtaagtatgaaatgacaaatgagagtgagcgtctgaacagaatcagtacagcgtgtgagggaggcacttggggtagggctgggggagaccagggaagagctatggagaagagcctaggagcagaagagtagcagtgagaaagtgcggagaaggtccagggcttgggagcggcaggaggagcggttccgggctggggagggcaggcccctctgaacggagtggcctggcaggcttgctatctgctgatgggaggagcctggagggcaagctcaggtgtgccctcctaactcaggtgtgacaygggtgagatgcatcactcatgtattcacctaactgctcactaagccagtgcacattattgaactcctactgtatactaggatgaacaggagccagtccttgcctttgggaggcccaggaggtgatgaggaggacagacgagaaacatgtattttttttttaaccttaaaatcttttatcacttcaacatgtagatttcaacattaaaagcgtccctgctgggcaacaagcagagtgcacaggttcctggcagggctaagttcttggcgcatagcctacagggttgtaggtcagaggctgc

SEQ ID NO: 126695 - DNA, 601 bp, Human
gcaggtctgcttcctcttggtctcccagcagtctcgtgtaacttcaccgcctccatcccttttctagaccatcacaggaagctggcatctgtgtgccaaatgcactttctattttccacctctctccactctaagccacaccagtcagccatatgaggctacatcttttatatgatccccgcaaaacctgtacgaaaccccagcacatcccagaacccccgtgagctgctccgtgggagctggagagcctgccccagaatgggactccttcttggtgatctgattcacctgctgctgactyaggcctcagcttctgttgcccacgtagatgcagcctaaattaaaacccacgagagcttgaaaaaatgcagatgcctctctccccaccagttctcttagtgatgaacaagcaagtctaattttagcagagaagaatcttagaatgtgagaaacagaaaggactttgagatcatctcatcttgtggttttcgactctcactcagcaacagaatcacctgaggaggtttaaaaaaaaaaaaatcggccgggcgtggtggctcaagcctgtatcccagcactttggaagtccaagacaggcggg

SEQ ID NO: 126696 - DNA, 601 bp, Human
agcttgaaaaaatgcagatgcctctctccccaccagttctcttagtgatgaacaagcaagtctaattttagcagagaagaatcttagaatgtgagaaacagaaaggactttgagatcatctcatcttgtggttttcgactctcactcagcaacagaatcacctgaggaggtttaaaaaaaaaaaaatcggccgggcgtggtggctcaagcctgtatcccagcactttggaagtccaagacaggcgggttacttgagggcaggagttcaagaccagcccgggcaacatggtgaaaccccgtytctactaaaaatacaaaaattagctggacgtggtggcacgtgtctgtaatcccagctacttgggaggctgaggcaggagaatcgcttgagcccgggaggtggaggttgcagcgagccaagatcatgccattgcactccagcctgtgccacagagcgagactccgcctcaaaaatttaaaaaaaaaaaaaaaggacaaaatatatatatatatatatatatatatatatgtctatctatctatctatctatctatctacagagattctgattggttggtccaggatggagagaggcactga

SEQ ID NO: 126697 - DNA, 601 bp, Human
tatctacagagattctgattggttggtccaggatggagagaggcactgatatggtcttaaagctccctgggtgatccatgtgtgcagccttgaccgagagccactggtcttgtctcaagccctcattggaaagagaggttgaagcctagacaggggaggagaactgcccaaggtcacactgacatcaggggcatggtcagggctggaacttgggtttcctgactcttcattaagggctcccatattgtctctctaacaggaaaccatatctaatcaagtgacttggatattttttaaaaaatcaccaccaaatatttgctaaataccgtattcagggagaggtggaagagaaaatatccttctctgacctccagaagcctacagtctagtagcagaagcagacgtgtatctagatatgtctaacaccacatagattctgaggcatacaccaggtgctgtgggagaattagaaagggagaggaggaatccaggaagactccctggaggaggaagagttactcctagtcttgaaggatagggccatagagttgttagataaaatacagtatgttcaattgaattcaaatttcagagaacaaca

SEQ ID NO: 126698 - DNA, 601 bp, Human
tacagagattctgattggttggtccaggatggagagaggcactgatatggtcttaaagctccctgggtgatccatgtgtgcagccttgaccgagagccactggtcttgtctcaagccctcattggaaagagaggttgaagcctagacaggggaggagaactgcccaaggtcacactgacatcaggggcatggtcagggctggaacttgggtttcctgactcttcattaagggctcccatattgtctctctaacaggaaaccatatctaatcaagtgacttggatattttttaaaaaatcaycaccaaatatttgctaaataccgtattcagggagaggtggaagagaaaatatccttctctgacctccagaagcctacagtctagtagcagaagcagacgtgtatctagatatgtctaacaccacatagattctgaggcatacaccaggtgctgtgggagaattagaaagggagaggaggaatccaggaagactccctggaggaggaagagttactcctagtcttgaaggatagggccatagagttgttagataaaatacagtatgttcaattgaattcaaatttcagagaacaacaaata

SEQ ID NO: 126699 - DNA, 601 bp, Human
gaacttgggtttcctgactcttcattaagggctcccatattgtctctctaacaggaaaccatatctaatcaagtgacttggatattttttaaaaaatcaccaccaaatatttgctaaataccgtattcagggagaggtggaagagaaaatatccttctctgacctccagaagcctacagtctagtagcagaagcagacgtgtatctagatatgtctaacaccacatagattctgaggcatacaccaggtgctgtgggagaattagaaagggagaggaggaatccaggaagactccctggargaggaagagttactcctagtcttgaaggatagggccatagagttgttagataaaatacagtatgttcaattgaattcaaatttcagagaacaacaaatatgtcccaatattgaatggggcgtacttagctaaaaaaaaatttggtgttggccgggcgaggtggctcatgcctgcaatcccagcactttgggaggtcaaggtggtggatcaagaagtcaggagttcaagaccaacctggccaagttggtgaaaccccgtctttactaaaaatacaaaaattagccggacgacaaaaaatac

SEQ ID NO: 126700 - DNA, 601 bp, Human
taatcaagtgacttggatattttttaaaaaatcaccaccaaatatttgctaaataccgtattcagggagaggtggaagagaaaatatccttctctgacctccagaagcctacagtctagtagcagaagcagacgtgtatctagatatgtctaacaccacatagattctgaggcatacaccaggtgctgtgggagaattagaaagggagaggaggaatccaggaagactccctggaggaggaagagttactcctagtcttgaaggatagggccatagagttgttagataaaatacagtatgwtcaattgaattcaaatttcagagaacaacaaatatgtcccaatattgaatggggcgtacttagctaaaaaaaaatttggtgttggccgggcgaggtggctcatgcctgcaatcccagcactttgggaggtcaaggtggtggatcaagaagtcaggagttcaagaccaacctggccaagttggtgaaaccccgtctttactaaaaatacaaaaattagccggacgacaaaaaatacaatattttttgtattgtatatatatatatatataaagtatttatatattgtatatataaaaaata

SEQ ID NO: 126701 - DNA, 601 bp, Human
gaagcctacagtctagtagcagaagcagacgtgtatctagatatgtctaacaccacatagattctgaggcatacaccaggtgctgtgggagaattagaaagggagaggaggaatccaggaagactccctggaggaggaagagttactcctagtcttgaaggatagggccatagagttgttagataaaatacagtatgttcaattgaattcaaatttcagagaacaacaaatatgtcccaatattgaatggggcgtacttagctaaaaaaaaatttggtgttggccgggcgaggtggctcaygcctgcaatcccagcactttgggaggtcaaggtggtggatcaagaagtcaggagttcaagaccaacctggccaagttggtgaaaccccgtctttactaaaaatacaaaaattagccggacgacaaaaaatacaatattttttgtattgtatatatatatatatataaagtatttatatattgtatatataaaaaatacaaaaattacaggatgacactcctgtaatcccagctactcgggaggctgaggcagagaattccttaaatctgggaggtggagtttactgtgagccgagatctc

SEQ ID NO: 126702 - DNA, 601 bp, Human
cccatgggagctaaagtgacgctctgagagattggtaaaaacacagccatgttttctttcatgtgcccagtaggagacattggcacaattcagaatgctgcccactggcagtgaatgctgcctcagggccacatgagggatggaatctccctgtgaggccccagcctcctctgggcctcagtttctcctctgcactgtgagcctgttggaccagatcagtggttttcacctgagaagattaaaaaatatataccaacgcccaggcctgaccctagagattctgattctattgttctgggcyggcccaagcatcaccattttgtaaaagttccccaggagtctctgatgtgccgctggagcagagaccccctggggtagatgtctcttaaagagtatcatatgcaacccccttacctgttttccagaaacagggccagagagggcaggaggcttccacagagacacctagcaagtcaggaacattgccgatcattgggaccaaggccaggttccagcccctctcacacccctagtcctagctctttgcacaatactacacgccttaatttttgcctcttctctggcccccaagtgcacaaag

SEQ ID NO: 126703 - DNA, 601 bp, Human
ggagctaaagtgacgctctgagagattggtaaaaacacagccatgttttctttcatgtgcccagtaggagacattggcacaattcagaatgctgcccactggcagtgaatgctgcctcagggccacatgagggatggaatctccctgtgaggccccagcctcctctgggcctcagtttctcctctgcactgtgagcctgttggaccagatcagtggttttcacctgagaagattaaaaaatatataccaacgcccaggcctgaccctagagattctgattctattgttctgggccggcccragcatcaccattttgtaaaagttccccaggagtctctgatgtgccgctggagcagagaccccctggggtagatgtctcttaaagagtatcatatgcaacccccttacctgttttccagaaacagggccagagagggcaggaggcttccacagagacacctagcaagtcaggaacattgccgatcattgggaccaaggccaggttccagcccctctcacacccctagtcctagctctttgcacaatactacacgccttaatttttgcctcttctctggcccccaagtgcacaaagaaagag

SEQ ID NO: 126704 - DNA, 601 bp, Human
gctgcctcagggccacatgagggatggaatctccctgtgaggccccagcctcctctgggcctcagtttctcctctgcactgtgagcctgttggaccagatcagtggttttcacctgagaagattaaaaaatatataccaacgcccaggcctgaccctagagattctgattctattgttctgggccggcccaagcatcaccattttgtaaaagttccccaggagtctctgatgtgccgctggagcagagaccccctggggtagatgtctcttaaagagtatcatatgcaacccccttacctrttttccagaaacagggccagagagggcaggaggcttccacagagacacctagcaagtcaggaacattgccgatcattgggaccaaggccaggttccagcccctctcacacccctagtcctagctctttgcacaatactacacgccttaatttttgcctcttctctggcccccaagtgcacaaagaaagaggttacaggtcttatctgaaattttcagggaggattttctaaatctgtttaccagaaagttctccccagatttcagtcgtccgggacaaagcctaaaccttttgcccattc

SEQ ID NO: 126705 - DNA, 601 bp, Human
attgtggctgggggccttgaaacagaagggttgaaatatgtggcctcaggactggttgtatcccactaacaaagagctctatgtggtacagtggaaggcattggaccaggagccatgaggggtgtagagggaacagccatcacctggcaccacctacacgtcatcctggccaatcctcacacccacttctggtctcagatgtgcagttctccccactttgcacttaaaaaatctagggttcggagaggtcaggcaacttgttttgtccagtcacacagcaagtgagaggtggacctgcaaktccagtgcagtcacgtgacccctaaatcttcactcggcacatcatattagaacaagagcctgcccttccctgttcctcagtttttccatctctaaaatcaatggttttggttgggcgcagtggctcacacctgcaattccagcactttgggaggtcaagacgggtggatcacttgaggtcagaagttcgagaccagcctggccaacatggtgaaaccccgtctctactaaaagtataaaaattacctgggcttggtggtgcatgcctgtaatcccagctactcgggaggctgaagcagga

SEQ ID NO: 126706 - DNA, 601 bp, Human
atatgtggcctcaggactggttgtatcccactaacaaagagctctatgtggtacagtggaaggcattggaccaggagccatgaggggtgtagagggaacagccatcacctggcaccacctacacgtcatcctggccaatcctcacacccacttctggtctcagatgtgcagttctccccactttgcacttaaaaaatctagggttcggagaggtcaggcaacttgttttgtccagtcacacagcaagtgagaggtggacctgcaagtccagtgcagtcacgtgacccctaaatcttcactyggcacatcatattagaacaagagcctgcccttccctgttcctcagtttttccatctctaaaatcaatggttttggttgggcgcagtggctcacacctgcaattccagcactttgggaggtcaagacgggtggatcacttgaggtcagaagttcgagaccagcctggccaacatggtgaaaccccgtctctactaaaagtataaaaattacctgggcttggtggtgcatgcctgtaatcccagctactcgggaggctgaagcaggagaagcacttgagcccaggaggcggaggttgtagtg

SEQ ID NO: 126707 - DNA, 601 bp, Human
ggtcaggcaacttgttttgtccagtcacacagcaagtgagaggtggacctgcaagtccagtgcagtcacgtgacccctaaatcttcactcggcacatcatattagaacaagagcctgcccttccctgttcctcagtttttccatctctaaaatcaatggttttggttgggcgcagtggctcacacctgcaattccagcactttgggaggtcaagacgggtggatcacttgaggtcagaagttcgagaccagcctggccaacatggtgaaaccccgtctctactaaaagtataaaaattacmtgggcttggtggtgcatgcctgtaatcccagctactcgggaggctgaagcaggagaagcacttgagcccaggaggcggaggttgtagtgagccgagattgcaccactatactccagcttgggcgacagagcgaggctccatcacaaaataaataaataaataaataaaaatttaaaaaaataaaaatgatggtttcatcagcaggtcccaatgaccaattttattttataagtctcaaaagatatttctgatcaaattaaattgtacttactctgaagtagccatcaactcttcttttta

SEQ ID NO: 126708 - DNA, 601 bp, Human
cagtcacgtgacccctaaatcttcactcggcacatcatattagaacaagagcctgcccttccctgttcctcagtttttccatctctaaaatcaatggttttggttgggcgcagtggctcacacctgcaattccagcactttgggaggtcaagacgggtggatcacttgaggtcagaagttcgagaccagcctggccaacatggtgaaaccccgtctctactaaaagtataaaaattacctgggcttggtggtgcatgcctgtaatcccagctactcgggaggctgaagcaggagaagcacytgagcccaggaggcggaggttgtagtgagccgagattgcaccactatactccagcttgggcgacagagcgaggctccatcacaaaataaataaataaataaataaaaatttaaaaaaataaaaatgatggtttcatcagcaggtcccaatgaccaattttattttataagtctcaaaagatatttctgatcaaattaaattgtacttactctgaagtagccatcaactcttctttttaaacatccagcacatatgtattgagagtctctctgtgcccaacgctgaattaggttctgggaa

SEQ ID NO: 126709 - DNA, 601 bp, Human
gacgggtggatcacttgaggtcagaagttcgagaccagcctggccaacatggtgaaaccccgtctctactaaaagtataaaaattacctgggcttggtggtgcatgcctgtaatcccagctactcgggaggctgaagcaggagaagcacttgagcccaggaggcggaggttgtagtgagccgagattgcaccactatactccagcttgggcgacagagcgaggctccatcacaaaataaataaataaataaataaaaatttaaaaaaataaaaatgatggtttcatcagcaggtcccaatraccaattttattttataagtctcaaaagatatttctgatcaaattaaattgtacttactctgaagtagccatcaactcttctttttaaacatccagcacatatgtattgagagtctctctgtgcccaacgctgaattaggttctgggaatacaattgtgaccagtctcagcttccactttcataaagattctggtccatttggccaagcagacaactaaagggtaacagtacagtgcaattactgcaaagctagattcctgcaagaagggcagaagctagtttatcagggctagtaatta

SEQ ID NO: 126710 - DNA, 601 bp, Human
attgctgtcagtggggaacctctggattgatgacctctgacctcagatctccatggttccttgcccataggaacacagctggcaaagccacatgccctgtatgctactatgtcatgggtcagaaaccaagcacatccattctggccctcagctcaggtccacaaatgttttttgggcatggactctgccagaccaacagctgatatcagcctatgcacaccagtatgcccgtgtcaaacactgagatgcttctgggccagttggtaaatcaggctgccagagctctgtcagggcccccacygcctgccctagcttttctcctggccccggttcctccactgggacccagcatacaaggagttaacacctggcaagacagggcctccaggacctgctcagccaccagcatgtccagttggatcagcctagcaggttgcctactggttgttattttgattttttttattagatttgattaagccaggccaggcctttcctgggagcaggaaggttctggtggaagacacagagaggactctggctgggtcctttccctcaggagggccagccaagtcagagacagacgccatcatagagaaag

SEQ ID NO: 126711 - DNA, 601 bp, Human
tgatgacctctgacctcagatctccatggttccttgcccataggaacacagctggcaaagccacatgccctgtatgctactatgtcatgggtcagaaaccaagcacatccattctggccctcagctcaggtccacaaatgttttttgggcatggactctgccagaccaacagctgatatcagcctatgcacaccagtatgcccgtgtcaaacactgagatgcttctgggccagttggtaaatcaggctgccagagctctgtcagggcccccaccgcctgccctagcttttctcctggcccyggttcctccactgggacccagcatacaaggagttaacacctggcaagacagggcctccaggacctgctcagccaccagcatgtccagttggatcagcctagcaggttgcctactggttgttattttgattttttttattagatttgattaagccaggccaggcctttcctgggagcaggaaggttctggtggaagacacagagaggactctggctgggtcctttccctcaggagggccagccaagtcagagacagacgccatcatagagaaagctgacatgccatcccgggggcacactg

SEQ ID NO: 126712 - DNA, 601 bp, Human
tgtcagggcccccaccgcctgccctagcttttctcctggccccggttcctccactgggacccagcatacaaggagttaacacctggcaagacagggcctccaggacctgctcagccaccagcatgtccagttggatcagcctagcaggttgcctactggttgttattttgattttttttattagatttgattaagccaggccaggcctttcctgggagcaggaaggttctggtggaagacacagagaggactctggctgggtcctttccctcaggagggccagccaagtcagagacagacrccatcatagagaaagctgacatgccatcccgggggcacactgaagtgaagggcactgaggagggggcgatgatttcaaaacagagggcttcctgggagctagcctctcagcaggtctcagcaaggcaggggcgacggggtaggtattcctggctcggagcatcattttaggcagcagggcccaccgatcagtatgtcctatcagctgctggtgtctttttccctccatgacgcatcgtttccaccaactgctaattatctcatttccttcagaggctctgattgtcatctacaccccctg

SEQ ID NO: 126713 - DNA, 601 bp, Human
cctccaggacctgctcagccaccagcatgtccagttggatcagcctagcaggttgcctactggttgttattttgattttttttattagatttgattaagccaggccaggcctttcctgggagcaggaaggttctggtggaagacacagagaggactctggctgggtcctttccctcaggagggccagccaagtcagagacagacgccatcatagagaaagctgacatgccatcccgggggcacactgaagtgaagggcactgaggagggggcgatgatttcaaaacagagggcttcctggragctagcctctcagcaggtctcagcaaggcaggggcgacggggtaggtattcctggctcggagcatcattttaggcagcagggcccaccgatcagtatgtcctatcagctgctggtgtctttttccctccatgacgcatcgtttccaccaactgctaattatctcatttccttcagaggctctgattgtcatctacaccccctggctgagttcctctgaaacgtgctaggggccacctaagctcctcttctccagtttgccctggtcacttgcccagtgggtggtttcccaggcttccct

SEQ ID NO: 126714 - DNA, 601 bp, Human
caccagcatgtccagttggatcagcctagcaggttgcctactggttgttattttgattttttttattagatttgattaagccaggccaggcctttcctgggagcaggaaggttctggtggaagacacagagaggactctggctgggtcctttccctcaggagggccagccaagtcagagacagacgccatcatagagaaagctgacatgccatcccgggggcacactgaagtgaagggcactgaggagggggcgatgatttcaaaacagagggcttcctgggagctagcctctcagcaggwctcagcaaggcaggggcgacggggtaggtattcctggctcggagcatcattttaggcagcagggcccaccgatcagtatgtcctatcagctgctggtgtctttttccctccatgacgcatcgtttccaccaactgctaattatctcatttccttcagaggctctgattgtcatctacaccccctggctgagttcctctgaaacgtgctaggggccacctaagctcctcttctccagtttgccctggtcacttgcccagtgggtggtttcccaggcttccctcttctgctctgtagtgctc

SEQ ID NO: 126715 - DNA, 601 bp, Human
cagcctagcaggttgcctactggttgttattttgattttttttattagatttgattaagccaggccaggcctttcctgggagcaggaaggttctggtggaagacacagagaggactctggctgggtcctttccctcaggagggccagccaagtcagagacagacgccatcatagagaaagctgacatgccatcccgggggcacactgaagtgaagggcactgaggagggggcgatgatttcaaaacagagggcttcctgggagctagcctctcagcaggtctcagcaaggcaggggcgacrgggtaggtattcctggctcggagcatcattttaggcagcagggcccaccgatcagtatgtcctatcagctgctggtgtctttttccctccatgacgcatcgtttccaccaactgctaattatctcatttccttcagaggctctgattgtcatctacaccccctggctgagttcctctgaaacgtgctaggggccacctaagctcctcttctccagtttgccctggtcacttgcccagtgggtggtttcccaggcttccctcttctgctctgtagtgctcagatgaagaaaaccatgtctc

SEQ ID NO: 126716 - DNA, 601 bp, Human
actggaggcaagaggggcagagcagatggaacaaaggcatgcagcaggcttggcagtggccctgggccaggccctgggattggctactcatgtgaatcccagcctggcctggcaggaagtcagggtctacccagagtcagctgaaacttaactcccagggcagaatgtcagcaaaagaggactgggagcaggtcactgtggtggcagctgccagggagttgccccttccctccacacactatccccccagagtccaagatggagcccatgctaaccattgcccttaccttagctgaatacmctggttcaaaaacatttacttccctgagcctccgtttcctggcttgtaaaatgaggattataagaatctctgctcctaaggagataacagatgtaaactctgaagttgttaacttttagaatcactgggaaggtgaactaggggattcacatgctattctaagagttaatttcctgagcaggtatcatgtgccaaaaccatactgggtactttgtgtctattatctaatttaatgttcacaaagactctgtaagtggcattacaacccatccctgtatcacagatgaggaaacggagtgc

SEQ ID NO: 126717 - DNA, 601 bp, Human
aaggcatgcagcaggcttggcagtggccctgggccaggccctgggattggctactcatgtgaatcccagcctggcctggcaggaagtcagggtctacccagagtcagctgaaacttaactcccagggcagaatgtcagcaaaagaggactgggagcaggtcactgtggtggcagctgccagggagttgccccttccctccacacactatccccccagagtccaagatggagcccatgctaaccattgcccttaccttagctgaataccctggttcaaaaacatttacttccctgagcctcmgtttcctggcttgtaaaatgaggattataagaatctctgctcctaaggagataacagatgtaaactctgaagttgttaacttttagaatcactgggaaggtgaactaggggattcacatgctattctaagagttaatttcctgagcaggtatcatgtgccaaaaccatactgggtactttgtgtctattatctaatttaatgttcacaaagactctgtaagtggcattacaacccatccctgtatcacagatgaggaaacggagtgccaggcaggctatgcaacctgcccaaggccacac

SEQ ID NO: 126718 - DNA, 601 bp, Human
agtcagctgaaacttaactcccagggcagaatgtcagcaaaagaggactgggagcaggtcactgtggtggcagctgccagggagttgccccttccctccacacactatccccccagagtccaagatggagcccatgctaaccattgcccttaccttagctgaataccctggttcaaaaacatttacttccctgagcctccgtttcctggcttgtaaaatgaggattataagaatctctgctcctaaggagataacagatgtaaactctgaagttgttaacttttagaatcactgggaaggygaactaggggattcacatgctattctaagagttaatttcctgagcaggtatcatgtgccaaaaccatactgggtactttgtgtctattatctaatttaatgttcacaaagactctgtaagtggcattacaacccatccctgtatcacagatgaggaaacggagtgccaggcaggctatgcaacctgcccaaggccacacaagaagcaagaggggcaagattcaaacccaggtctgtgtgactccagagtccatgtataatgctatgcctgtctgggttcttgaagcagctgtggtttcat

SEQ ID NO: 126719 - DNA, 601 bp, Human
ttatctaatttaatgttcacaaagactctgtaagtggcattacaacccatccctgtatcacagatgaggaaacggagtgccaggcaggctatgcaacctgcccaaggccacacaagaagcaagaggggcaagattcaaacccaggtctgtgtgactccagagtccatgtataatgctatgcctgtctgggttcttgaagcagctgtggtttcatgtgatgtcagcctggcttttctcatctgtcctctggcctggggcctgagcactggtcagcaccacccgccatccagtgagcctcttytttggttcatcttgacattttgatgaatgctggctgcttgccaggactgtgctgggctgtgtgcaggactgaggctccaggtccaccctccagaagtttcctcactggatgggaggaaagatggttgcagaaatgaccatcataccaggtgctccagcatccagacagtgggctgtgaggtccatcagagggagcagtcttagtcaggaatagcaatcagggagggttgcttggaggaggcagattttgagataaacccgtagatgctgggtagaccctgacttcccacccacagggtga

SEQ ID NO: 126720 - DNA, 601 bp, Human
agtccatgtataatgctatgcctgtctgggttcttgaagcagctgtggtttcatgtgatgtcagcctggcttttctcatctgtcctctggcctggggcctgagcactggtcagcaccacccgccatccagtgagcctcttttttggttcatcttgacattttgatgaatgctggctgcttgccaggactgtgctgggctgtgtgcaggactgaggctccaggtccaccctccagaagtttcctcactggatgggaggaaagatggttgcagaaatgaccatcataccaggtgctccagcakccagacagtgggctgtgaggtccatcagagggagcagtcttagtcaggaatagcaatcagggagggttgcttggaggaggcagattttgagataaacccgtagatgctgggtagaccctgacttcccacccacagggtgaaaagtatctcaggtgacatggaggccatggcatcccaggtgcagagaggagtggggaaagccatggagcccatccacacaggctcacggtacccccagaggaaagccagaaagggggttaggagtcagagagctttgaatgggtaggtttagggaaagtg

SEQ ID NO: 126721 - DNA, 601 bp, Human
gcagaaatgaccatcataccaggtgctccagcatccagacagtgggctgtgaggtccatcagagggagcagtcttagtcaggaatagcaatcagggagggttgcttggaggaggcagattttgagataaacccgtagatgctgggtagaccctgacttcccacccacagggtgaaaagtatctcaggtgacatggaggccatggcatcccaggtgcagagaggagtggggaaagccatggagcccatccacacaggctcacggtacccccagaggaaagccagaaagggggttaggagtcrgagagctttgaatgggtaggtttagggaaagtgggctgtgctgtgctctgggaagatggttctggctggatgggaggggactgggggcaaggagagggtatcagggcccaggagatcagccaggagctatggcctccaggaccagggggctgtggggaggcgctcctgcctaactggagttgggtccggcaggggaagggctgaaggcaggtctcagggagggggctctgctgactcaggctcaggaggaggccacctgtgcctccccttcaggtgccccggccccaggctggggggagg

SEQ ID NO: 126722 - DNA, 601 bp, Human
ctcggttggagctgcagtatcctggctgcactgatggatggatgggagaaaccctgtgggccccgagggagcctgcaggcccggcccaggccaagcaggccatctccacacacggcttctgtgctgctctcaccaaactctccaaactccccacagagctgctcttccccaggacccccagggcaccagggaccctgctccccaggccagacaaggcctggggtgagtcccacaaatgagaatatgtataatgtctggggtagtggccagattccccactttttattccaatatttgacartgaggatgtgcttaatattttgaagagaagttaaagtagatggattgtgctgtcttgttttcccagattggatgatttgtgtctggctttttttactcaacgttgcgattgtatcagttttttgtagctgtgtaacaaattatccccaaatatagcaacttaaacagcctcagaatcctggcataaaacaataaacatgtattaactcaccatttctgagggccaggaatccaggagcagtgtggctggctgacttcgcccagagtgcatgatctgaggtggagaaactgcttccaccat

SEQ ID NO: 126723 - DNA, 601 bp, Human
agtgagccaagtcagagaaaaaagaaagcctcagatgccttttatgacccagcctcggaagttacacaaagtcatttccaccatattctgtttattaaaagtgagtcacaaagcacaacccacactcaaggggagagaaatcagacaccactttttggaggggggaggatcaaagaattttgcagatattaagtcatcacagtaagaattatctatattattttgtgtcacaggagttgaccagaaagacctctgtaactgagaggtgacagcatgctggcagccctcacagccctccctygctctcggcgcctcctcagccttggcgcccactctggccgcgcttgtggagcccttcagcccgccgctgcactgtgggagcccctttctgggctgggcaaggccagagccggctccctcagcttgcggggaggtgtggagggagaggcgccggcgggaaccagggctgtgcgcggcgcttgcgggccagcgcgtgttccgggtgggcgtgctctcggcgggccccgcactcggagcggccggccgaccccgccggctccgggcagtgaggggcttagcacctgggccagcagctgctgtg

SEQ ID NO: 126724 - DNA, 601 bp, Human
gcactgtgggagcccctttctgggctgggcaaggccagagccggctccctcagcttgcggggaggtgtggagggagaggcgccggcgggaaccagggctgtgcgcggcgcttgcgggccagcgcgtgttccgggtgggcgtgctctcggcgggccccgcactcggagcggccggccgaccccgccggctccgggcagtgaggggcttagcacctgggccagcagctgctgtgctcgacttctcgccgggccttagctgcctccccacggggcagggctcgggacctgcagcccgccatgcytgagcttcccccacgccgtggtctcctgagcggcccgaacctccccgacaagcgccgccccctgctccacggcgcccagtcccatcaaccacccaagggctgaggagtgcgggcgcacggcgcgggactggcaggcagctccacctgcggccccggtgcaggatccactgggtgaagccagctgggctcctgagtctggtggggacttggagaatctttatgtctggctaagggatggcaaatccaccaatcagcactctgtatctagctcaaggtttgtaaacacaccaatcagcaccc

SEQ ID NO: 126725 - DNA, 601 bp, Human
cagcgcgtgttccgggtgggcgtgctctcggcgggccccgcactcggagcggccggccgaccccgccggctccgggcagtgaggggcttagcacctgggccagcagctgctgtgctcgacttctcgccgggccttagctgcctccccacggggcagggctcgggacctgcagcccgccatgcctgagcttcccccacgccgtggtctcctgagcggcccgaacctccccgacaagcgccgccccctgctccacggcgcccagtcccatcaaccacccaagggctgaggagtgcgggcgcasggcgcgggactggcaggcagctccacctgcggccccggtgcaggatccactgggtgaagccagctgggctcctgagtctggtggggacttggagaatctttatgtctggctaagggatggcaaatccaccaatcagcactctgtatctagctcaaggtttgtaaacacaccaatcagcaccctgtgtctagctcagggtttgcaaatgcaccaattgacacctgtatctagctactctggtggggacatggagaacttttgtgtccacactctgtatctagctaatctagtggggaggtg

SEQ ID NO: 126726 - DNA, 601 bp, Human
aacacaccaatcagcaccctgtgtctagctcagggtttgcaaatgcaccaattgacacctgtatctagctactctggtggggacatggagaacttttgtgtccacactctgtatctagctaatctagtggggaggtggagaacttttgtgtctagctcagggattgtaaacgcaccagtcagcaccctgtcaaaacagaccaaccagctctctataaaatggaccagtcggctctctgtaaaatggaccaatcagcaggatatgggtggggccagataagagaataaaagcaggctgccgrataacgcagtggcaacccgctcgggtccacttccgcactgtggaaactttgttctttctctgtttgccataaatcttgccactgctcactctttgggtccacactgcctttatgagttgtaacactcaccgcgaaggtctgcagcttcactcctgaagccatcgagaccacgaacccactgggaggaacaaacaactccagaggctccgccttaagagctgtaacactcaccgcgaaggcctgcagcttcactcctgatccaggagaccacaaacccaccggaaggaagaaactcctaac

SEQ ID NO: 126727 - DNA, 601 bp, Human
tggaccaatcagcaggatatgggtggggccagataagagaataaaagcaggctgccgaataacgcagtggcaacccgctcgggtccacttccgcactgtggaaactttgttctttctctgtttgccataaatcttgccactgctcactctttgggtccacactgcctttatgagttgtaacactcaccgcgaaggtctgcagcttcactcctgaagccatcgagaccacgaacccactgggaggaacaaacaactccagaggctccgccttaagagctgtaacactcaccgcgaaggcctrcagcttcactcctgatccaggagaccacaaacccaccggaaggaagaaactcctaacacatccgaacatcagaaggaacaaactccggacacaccgcctttaagaactataacactcacctcgagggtccgcggcttcattcttgcagtcagtgagaccaagaacccaccaattccggacacataactagcaaagctacctcaggatggagcaggtatctcaaagggggaggagttcccatcctgggggtgtgtaaacagctgggagatggagggaattttaatgtcagttagggtctgg

SEQ ID NO: 126728 - DNA, 601 bp, Human
ggaccaatcagcaggatatgggtggggccagataagagaataaaagcaggctgccgaataacgcagtggcaacccgctcgggtccacttccgcactgtggaaactttgttctttctctgtttgccataaatcttgccactgctcactctttgggtccacactgcctttatgagttgtaacactcaccgcgaaggtctgcagcttcactcctgaagccatcgagaccacgaacccactgggaggaacaaacaactccagaggctccgccttaagagctgtaacactcaccgcgaaggcctgmagcttcactcctgatccaggagaccacaaacccaccggaaggaagaaactcctaacacatccgaacatcagaaggaacaaactccggacacaccgcctttaagaactataacactcacctcgagggtccgcggcttcattcttgcagtcagtgagaccaagaacccaccaattccggacacataactagcaaagctacctcaggatggagcaggtatctcaaagggggaggagttcccatcctgggggtgtgtaaacagctgggagatggagggaattttaatgtcagttagggtctggg

SEQ ID NO: 126729 - DNA, 601 bp, Human
tttaagaactataacactcacctcgagggtccgcggcttcattcttgcagtcagtgagaccaagaacccaccaattccggacacataactagcaaagctacctcaggatggagcaggtatctcaaagggggaggagttcccatcctgggggtgtgtaaacagctgggagatggagggaattttaatgtcagttagggtctgggactctggagttggataacctaattcccaggcctcctttctgttgtgttttgaagtattcccagttgtccatatcatctgggaatggccagaattggcyccgtcaaatgtccaaagtgagattcttgatgttcctgttgcgtctggccagaaagggagcctcagagccaccggctccaggatacaccttgtaacacctaaggtgttggttggtaattttgttcaagagcaaatctgatctctttctcatctgatgggtaatgctctgacatggtaaaggtgtgaggacacacagctgtcacacactgctgaagggcatgccgacttttacatccttttgtcagagcagtctcaattttaatttgaaagcgcctatctttcaacctagcagttttgattt

SEQ ID NO: 126730 - DNA, 601 bp, Human
cttcatgcatagaaacacaactcattggccatgatggttactttttttttttttctttttttgagacggagtcttgctctgttgcccaggctggagtgcagtggcacgatctcggctcactgcaagctccgcctcccaggttcacgccattctcctacctcagcctcccgagtagctgggactacaggtgcccgccaccacgtccagctaatttttttttttgtattttttagtagagaccgggtttcaccatgttagccaggatggtctcgatctcctgaccttgtgatccgcccacctyggcctcccaaattgctgggattacaggcgtgagccatcgcgcctggcccatggtggttacttctacggaagggggtgggactgggaataaatcgggtgagggagactctttccttttactcaatctgtgttaatatcatatgaattgttaataatgtggttatatttattcacaagtggttttttacttctcaagcaaatctgaaggagtatgagagttctttcccaaccatcctgtccctggctctgctgcccagagactgttgccagtccgggcatgaccaaccccttggtctctccc

SEQ ID NO: 126731 - DNA, 601 bp, Human
cggagtcttgctctgttgcccaggctggagtgcagtggcacgatctcggctcactgcaagctccgcctcccaggttcacgccattctcctacctcagcctcccgagtagctgggactacaggtgcccgccaccacgtccagctaatttttttttttgtattttttagtagagaccgggtttcaccatgttagccaggatggtctcgatctcctgaccttgtgatccgcccaccttggcctcccaaattgctgggattacaggcgtgagccatcgcgcctggcccatggtggttacttctayggaagggggtgggactgggaataaatcgggtgagggagactctttccttttactcaatctgtgttaatatcatatgaattgttaataatgtggttatatttattcacaagtggttttttacttctcaagcaaatctgaaggagtatgagagttctttcccaaccatcctgtccctggctctgctgcccagagactgttgccagtccgggcatgaccaaccccttggtctctccccctttacacactttcaggcacaggcagctcactaccttaccaggcagttcctcagcgtgtggacac

SEQ ID NO: 126732 - DNA, 601 bp, Human
cagtaatcactaaataagttacttgaaaaataagtcagagaactggtttttagtcgtggctccccagccactggttctctcttctataaaatgaatgagtccttttagtctcagggtccccggagtcagagaaagatgcaggtatgaagcttctttgacatctctttttttggagacagagtctcactctgtcaccaggctggagtacagtggcatgatctcagctcactgcaaactccgcctccctggttcaagcaattctcctgcctcagcttcccaagtaactgggactacaggtgcrctccaccatgcccagataatttttgtatttttagtagagatggggtttaccatgttggccaggatggtctcgatctcctgacctcgtgatccgcccgcctcggcctcccaaagtgctgggattacaggcgtgagccaccgtgcccggccgaagcttctttgacatcttaaggcttactgtaaggtgtatgcacgtgttctattttactccttaatgtaaaaagaatgggtttgctctgagatgaacactcctggaagatcatgattatctaatggaatcctgtaccttgtcgcacatgcc

SEQ ID NO: 126733 - DNA, 601 bp, Human
ggaagatcatgattatctaatggaatcctgtaccttgtcgcacatgcccagacacatctgtgtgtatctagggtactggacactaatgtgagaactgggcctagaggaacctggggcagtcctttcagccccaggtcaaggtcaagccttggctctgtcatgaataagccgagggagcatggtccaacttccatctacacatggattcagtatactcatctctaagatgcagatgctggctcctgcctgccctgctcacctcccagggatgtagacaggtcgaatgggggcaatgcatgtyaaggggctttgtactctgcacgaagcatcagctttgcagaggcagtcctcgaagtccctggtagccccttcactcaggggagaccagtactttctgagactagcccatcctgagttttagcagggcatttgcagcaagagacctcaaggagaggccagggttcctgctaattggggagggtgggtggaggagctgccagttccttcttggggcctcagatggttgctgtgccatctccaggccaaaacggccagattccagggctgtgctgagtcctccaaggaccgacctgacctcttc

SEQ ID NO: 126734 - DNA, 601 bp, Human
agggagcatggtccaacttccatctacacatggattcagtatactcatctctaagatgcagatgctggctcctgcctgccctgctcacctcccagggatgtagacaggtcgaatgggggcaatgcatgttaaggggctttgtactctgcacgaagcatcagctttgcagaggcagtcctcgaagtccctggtagccccttcactcaggggagaccagtactttctgagactagcccatcctgagttttagcagggcatttgcagcaagagacctcaaggagaggccagggttcctgctaaytggggagggtgggtggaggagctgccagttccttcttggggcctcagatggttgctgtgccatctccaggccaaaacggccagattccagggctgtgctgagtcctccaaggaccgacctgacctcttcccagcattctcaggagccttgccagaggggccggtggaatttcaccagtgtccctctgcctgccgtggccagctttctgagcccagtctgaacccagatgagctctggtgaactcagaatacctggggggagttctcaatcaagagtctcagctgcaattcgtgcttgtcc

SEQ ID NO: 126735 - DNA, 601 bp, Human
tttcctccattcaattcaattctgcacacctcgaccgagagaaactgggtactatgtcctacccgagagctcatggtctacagcagcactgttcaatagaacttcctgtgatgatggaactgttccatatctgcattaaccaacatggtagtctccagccagtggctatttgtttgctggtttttgtagtgacgagttttctctatgttgcctgcccaggttggtctcaaactcctggtctcaagtgatcctcctgcctcagcttcccagagtgctgggattataggtgtgagccactgtkcccggctaccagtggctatcaagcactagaaatgtggctaataggactgaggaaatgaactatacatcgttttcattttaattatttagatgtatagagcaacatgtggctagtagctactgtagctactgtattggacaataccgttctaattggtgagacagctatagaggcaggtgacccaagtaaggcagatggactctgccaggtgtagggagggacatccaatgtgcacttgagtgtggaatggggagagatcatttcctggggtcaggatcaggaaaagcctcttggggaggg

SEQ ID NO: 126736 - DNA, 601 bp, Human
gatcaggaaaagcctcttggggagggggaatttgcagtgcatattaaggcaatagggatatacttacagggaggctaaaagcattccacatggaggcacatgagctttttggagtagatctctgtctgcaccaggtaccattatcagactgccagagataaacaggccgagtaaggaaggagagagagaaggaaagcaaagagtcatttgtgagccttgagtaccaggctgaggagatggggctgtgtcctgttggcttagtgagggaatgagctgagatcatgcaagtggggcacgaggyagggcctgggacacagtaaattgcagcagttcttggcagtggggagccattagaggtggttgtgtatttctgtttggtttctatttctggtttttaaattattattattaaacttttaaaatttggggataattgcagactagtatgcagttgtaagaaataatacagaggagccgagtgcagtggctcacacctgtaatcccagcactttgggaggccaagacgggtggatcacttgaggccgagttcgagaccagcctggccaacatagtgaaatcccatctctactaaaaacacaaa

SEQ ID NO: 126737 - DNA, 601 bp, Human
ccaattgcatttttaaaaaactcaactcttgtgcacagtgtgccattttctagacccaccagtagtttatgagtgagccagtttctctacattctcaccaacgtttggtgttgttgctaatttttattttagagattttgataggtatgtagtgatatctcattgtgattttgatttgcatttctgtgataggtcatgatgttgaacatcttgtcatgtgattatctgcaatatgtacatcctcttcagtgaatgtctcttcatatcctttccccgttttctaattgtttgttttttttttactgtggagtttttttctaattgacacgtacttcacacaccacacaattcatccttttaaaattcagtgggttttgatgtattcataaggctctgcaaccatcaccactatctaattctagaaaatttttatcactcaaaaaagaaactctgtacccattagctctcattctgcttttatcccctcccccagcccctggcaaccactaacctcctttccatcgctatggatttgcctcatctagacatttcatatcaatggaatcatacaatatatggcctttgtgtctggcttctttca

SEQ ID NO: 126738 - DNA, 601 bp, Human
ctttccatcgctatggatttgcctcatctagacatttcatatcaatggaatcatacaatatatggcctttgtgtctggcttctttcatttagcataatgttttccagggtcattcgtgttgtataatagcacatatcagaactttattccctttctgactgaataatactccactgtaaggatctaccacgttgtgtgtatccattcatcagatgatggacatttgggttgtttcttcttttggctattctgaataatgctgttatgagcattcatgaacaagttttttgtgtggacttaygtttttatttattttccacccaagagtggaattgctgggtcatatggtagctctatgtttaactttttcaggaactgacaaactgtctttcaaaggagctgcaccattttatattcccaccagcaatgtatgagggtgccactttctccacattcttgtcaacacttgttactgtctgtcttttctattatagtcatcttggtatgtgtgaagtggaatctcattgtggtttgatttgcattttctgaattattaatgatgagcactttttcatatatttatttgccatttttatcttta

SEQ ID NO: 126739 - DNA, 601 bp, Human
ggagggcagtggcacaatttcggctcgctgcaaactctgcctcccgggttcaagccattctcctgcctcagcctcccaagtagctgggactacaggtgcccgccatcacacctggctattttttttgtatttttagtagagacagggtttcaccatgttgcccagggtggtctcgaactccttagctcaggcagactgcccacctccgcctcccaaagtgctaggataacaggcatgagccaccacgcctggcctcttaagaaattgtttcccttttcctggcactattataactgagactgtgatgaacatcctcatcatattcttcccaacattgttgggtctttctgtttttttttttctgattttttttctttatatctttgtcagatgatcactatagatttgggggcagggaaccattaataatatgatcagaattgggctttagaaagctaactttggcattgtcaacttaccatgtgatcttgggaaaaccttttttccttctctgggcctcaattttttcatttataatttgaagagactaaattactggttatcagacttgggtgcatattgaaatctcctgagaagtttt

SEQ ID NO: 126740 - DNA, 601 bp, Human
gtggtttaggcactgtacacatggaatgagtggtgattttattttttattttttattttttcttgactaaagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttggtgagtagaaatatgcttcctgccctgcccgcagtcctgttattccctccacctgtgctggggatgtcagggaaaattctgtakatgcctctccgagtcttcttgagccttgattttcacattgatcgcgtcttccttgttttctgtgtttgtacctcatctccaccctggactacgagctccttgacttcaggagctaaggctgagtcctctcctcctcaaagcacagctcagcacaggctgggcccagagcacacttaagtgtgtttgcagaaggaactgaaatttgggagggcacaagtctcgccgggagtattttcctcttctgaatacccttttctgaactcatagcgtcctctccaggtcacacagtctagatttagc

SEQ ID NO: 126741 - DNA, 601 bp, Human
caggcctgactcccatcaccaagaactttcagaggccattgtaagaatgtaggatggtagaaccagaaggacttagagcttatccctccagttcccttagaaagaaactggagcctggggtgggggtagggggtctaggcagcagctcagtcaggtcacaccagctgttagtgacagcaagcattttctgggcaacttttgtgtgcctaggactgtgctaggtgatatcagaggtagcagaaaggctacctctgactgaagaagctttataaccttttaggggaaaaaaaagactcaaagscatgcctaaaaattcaagaatgcctacaaattctatctaaacaaagtgaggaaatgatttattgagacagaggccagttaggcaaagcatgctggttggggatggggctttagccagccttgaaaggaagagataggttgatggaggaggtctagaggcatccctctgggggttctaggagtattaggaagtagtgctgggggtacaaaggagagacagaaggatctaaaaggattggaggaactgttaaaaggagttagacctaggaggaaaaatgagttcacaaagtaggaagggaag

SEQ ID NO: 126742 - DNA, 601 bp, Human
ggatggggctttagccagccttgaaaggaagagataggttgatggaggaggtctagaggcatccctctgggggttctaggagtattaggaagtagtgctgggggtacaaaggagagacagaaggatctaaaaggattggaggaactgttaaaaggagttagacctaggaggaaaaatgagttcacaaagtaggaagggaagggcattccaagcagagggaacagcatgagcaaaggcaggacagttgaaagtatatgggatgttcacaaggaatggggctgggtaggtgtttgggtggctrcagcccaaggcctttaatgtcaagctcaggggcctggcgatggaagcaggtgggaagcagagaccgtggcagtttcctggacggtgatgccaggtgataaaattgggcctctgggttaccccagggaactgtgggcagctgctcccttggggtttcctacagaaggaattagagatgaatcatctcagtgattacagggaacagagtgctacttggtgatgtaggatctctagctttaaaatgaaatttgcgcccatctgctaatttttgtaagagaaatgtttgttatggcagtgcctc

SEQ ID NO: 126743 - DNA, 601 bp, Human
tggaagcaggtgggaagcagagaccgtggcagtttcctggacggtgatgccaggtgataaaattgggcctctgggttaccccagggaactgtgggcagctgctcccttggggtttcctacagaaggaattagagatgaatcatctcagtgattacagggaacagagtgctacttggtgatgtaggatctctagctttaaaatgaaatttgcgcccatctgctaatttttgtaagagaaatgtttgttatggcagtgcctcagcttcctcctgactttacaacagattatttgcatcctacrttaatgccgcagtgaagcagacagacttcatgttttccaactgaatatttgtatcgtaaaagcctcctgccagctcctcctcgggactgaggctgttagcaggcctggcagcagggagcgcagattgggaagggagcaggcctctcaggcctcctgctcattctcacctgcctctgctggctctttgcccatggctggggcctctgcagtacttgggctcctccttgggggacattgagtccccaaggctatgaggacagcgactggctctgcagacaggcggtatgcccaggatgcatc

SEQ ID NO: 126744 - DNA, 601 bp, Human
agggaactgtgggcagctgctcccttggggtttcctacagaaggaattagagatgaatcatctcagtgattacagggaacagagtgctacttggtgatgtaggatctctagctttaaaatgaaatttgcgcccatctgctaatttttgtaagagaaatgtttgttatggcagtgcctcagcttcctcctgactttacaacagattatttgcatcctacattaatgccgcagtgaagcagacagacttcatgttttccaactgaatatttgtatcgtaaaagcctcctgccagctcctcctygggactgaggctgttagcaggcctggcagcagggagcgcagattgggaagggagcaggcctctcaggcctcctgctcattctcacctgcctctgctggctctttgcccatggctggggcctctgcagtacttgggctcctccttgggggacattgagtccccaaggctatgaggacagcgactggctctgcagacaggcggtatgcccaggatgcatcctgaccagtgcgtcttcggtcctccccaccctgggcaccaagctctaaacagagcgttctgtgagtgcagggtgccagggag

SEQ ID NO: 126745 - DNA, 601 bp, Human
gtaggatctctagctttaaaatgaaatttgcgcccatctgctaatttttgtaagagaaatgtttgttatggcagtgcctcagcttcctcctgactttacaacagattatttgcatcctacattaatgccgcagtgaagcagacagacttcatgttttccaactgaatatttgtatcgtaaaagcctcctgccagctcctcctcgggactgaggctgttagcaggcctggcagcagggagcgcagattgggaagggagcaggcctctcaggcctcctgctcattctcacctgcctctgctgsctctttgcccatggctggggcctctgcagtacttgggctcctccttgggggacattgagtccccaaggctatgaggacagcgactggctctgcagacaggcggtatgcccaggatgcatcctgaccagtgcgtcttcggtcctccccaccctgggcaccaagctctaaacagagcgttctgtgagtgcagggtgccagggaggagccgagctgtggatcccatctgcgttttcccacagcaatacctcagatgactgtcatctccacactatttatagcaaagagccaggccaagcatgg

SEQ ID NO: 126746 - DNA, 601 bp, Human
caatttctaaaaaaaatgtattttattgtcaattgacaatttgtaattgtatatatttatgtgatacaaagtgctgttatgatttatgaatacaatgtggaaaaattaaattaagtgaattagcatatcatcacctcaaatactttttgtggtgagaacgtttattttttagcaattttgaaatgtataatacactattattagctatattcaccatgctgtgtaacagagctttataaaacaccttattcctcttgtccaactgagatttttgtatcctgtggccattatctccccattycccacccacagcttctgtaatgacagttttactccctgcttctatgaggtcaattgttttagattccacatataatttgtctttttgtggctggcttatttcacttagtataatgttctccaattccactcatgtggttgcaaatgaacaaatttccttttttttttttttttttttaaagaaaaggctgaatcgtactccattgtgcatatatcccccagtttctttatccattcttgttgatagacacttaggttgattccttattttgggtattgtgaatgatgctgcaatgaacat

SEQ ID NO: 126747 - DNA, 601 bp, Human
caggtgagacaggtgctattgttatccacactttacaagaaggaaacagaagtctagggaagtaggtaattaacattacccacaatccgtgggcaggaccgggatttgaattggcaatgtggctccagtgcctgggtgctccacattgggagatggtcccatcaggaggtcgtctcttgacatctccaacaagccatccctttgccatgttactaccattccaggtagcctgagtgcccccaagtgaccaaggaaaagcttacccttagagggtctttactcccaatgccccccaccttcycatcctctacctttttgttgtttaaaattcagctgacctgttagttgccacctgggaaggtctgaccacttcattctttatgcctctcatacctcagagagctgccagggcatctctaatacttcatatttctcaaacagtagttctcaaacattgtatatcttggttcctgttatactgtgtctttacttctgattcttgtgcttggcacacagcactcagtacatgctgccgaatatttaaatgaatagaaagtgctttccaaaaacatgatggaaatgttcaaatttggcaagaagt

SEQ ID NO: 126748 - DNA, 601 bp, Human
taaacataaggggatacagatactgcagggtaatctttcgggtggaaactctcgtttatataggcaggaggtaggccaggagctcccagacatagctgggggaaatgtttccacctggttaagaccctaatctcattaagaagactgactaaacttttaactcttatctgaacaccggagtaaagatcttcaactggagcttctgtaagcaaagaaaatagccgacttataacgtgggactgtgtggtcagccacttagcagatatctatgaatgaatctccactaccacagaccctcataaatgaacactgacagactggagggctgttgtacaactcacacatactgtcctttcaaaacaacagacttcagactctgttaacaaaccaattagtgcgaggtttcacagtgctttctcagcaacagtgctggtccctggtctacagggaaaagtgccttatatcttatctccattcctttccagtgaggaagaggaggcttgcggacctgactgggcccatcattcccaagtgccggagtggtgtctagtgtgtggcggtggagtccatgcctttgaactggatgtgttctattgatgac

SEQ ID NO: 126749 - DNA, 601 bp, Human
cattaagaagactgactaaacttttaactcttatctgaacaccggagtaaagatcttcaactggagcttctgtaagcaaagaaaatagccgacttataacgtgggactgtgtggtcagccacttagcagatatctatgaatgaatctccactaccacagaccctcatcaatgaacactgacagactggagggctgttgtacaactcacacatactgtcctttcaaaacaacagacttcagactctgttaacaaaccaattagtgcgaggtttcacagtgctttctcagcaacagtgctggyccctggtctacagggaaaagtgccttatatcttatctccattcctttccagtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatg

SEQ ID NO: 126750 - DNA, 601 bp, Human
tctgagcccactggactgggcgcagaggggggattgccatggaaaccacaggtgtccggagaggggatcttggggctggcctcaccccttccctgcggagattggggaccctggggtagggggagccgcgcccagtcggcctcctggaggacacgggaggaagccccgaacccccgcgcctgaggctgtttctgattggcccctggaggccgcagacacgcagataggcggccctgggtgtatttttattaatattatgtccgtactgattaatattatttatcttaaataaatttcaccygtgtccaagttcaccgcgcccccaaaaccgagtctggggcggcagggggaactcctggccaacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggagcctgggtactgcg

SEQ ID NO: 126751 - DNA, 601 bp, Human
aactgttttattccactttccctcagcatttatgtgtgtggtttcagtagctctgtggctatatgtacgaacacgtgttatttttccaattggacatgtgataattttccaactggaccttgccttctattgatgtatttatttagcatcttccttactccctccttgaaaaagaatcactcaaaaacaaataaaaacagccgtaggggcctaatacagtgctagacatacaagaggtattcggtccataccaaatggattttatccatgaaggataaatggggaaatacagtgggaagcrggtgggaaactgcgtttgactctgctctttcctccaccaccactttcctcatcaccgtgttcagagacccccaaagccccctcacactcccagaaacacccccctggccactcctaacttgccatgcccaggagttaggtgcttccactagtgacatggagctggcgtttggggggcacctcagcaggtgacgggaagagaagaccccagcctcaccagctgggctgcagcagggagaggagtcctcatgttccagcagggactctcagctgttttcctgtaaaaccatggttctcaact

SEQ ID NO: 126752 - DNA, 601 bp, Human
ctgtaaaaccatggttctcaactgggggccactgagatgtctagagagatgtttttgttttcacaactcggggagggtgctactgacatcttgtgggtagaggccaggaatgctgttaaacatcctacaaggaaggcacaggacagtctcctacatcaaaatatgacccagtcccaatgtcaccactgctggggttgacactggcactgctatcttaattacattcattgagtgtcttttaggaggccctattctaagtgcttgctaagattatctcatttaatcctcacaacacttccgmtatgtagcaggtgctgttattatctccgtgatggggaaactgaagcacagagagggttagtaacttgctaaaggtcacagagccagtgggtggtggagctggttgcctgacactagttccctcccctctcagccacatgtgggtttacttggccattgtggactagtctgggaacccagatatgatctataacattgacccagtagaatattgattccaaaaccactgtctcacaaatgaatttttacaagagtctgtaatcggagcatgacccagaataaggttagggagatgtggagt

SEQ ID NO: 126753 - DNA, 601 bp, Human
gagaaggctggtgatgttatcttgggatctaagtctgcagtttcaccacaaaaagtccagggatgcactttcatgcttgtgtcctcctccctgggatagcaaggatattagaagacccctggctctgtaattgcttgtcatgtgctctacagacgccacagaatgccaagaacgaagtgctgggaaggacaaattcatggaaccgtgggacggtgctcctcccccagcgtaaaggacagctcctcctcctgaattggagccagcgttctaaatcatgtgtcaacagagttgtcctggatcsgatccagttctgccattgatttgcaggtcatttcagtggtacctgtttccagttgttcttaattgaacagtggcaccaaactattgtcttgcctcatccccctcccatggcctgtcccccaaaaagagacttcttgggtaattaatcagggcaacatcaggcagtctgggcgcggtggctcacgcctgtaatcccagcactttgggaggccgaggcgggcagatcatgaggttaggagattgagaccatcctggctttgtgaaaccccgtctctactaaaaatacaaaaaattagccggg

SEQ ID NO: 126754 - DNA, 601 bp, Human
gtgagaggggaggtgaggagactgagtctgtattttctagtctgttgggctacactacctgatcccccttcctcaaaaatccactttactttccccatgtctacaccaatgtggttcacactctgggaccaggaaaagggggagtgatggggaacagagaagggaggagctcacacagctgaggctggggttatgcatatcgaattacttagaatttgcaacctcacagggtactttcatggcgttgaaatacacttcccacagccaccctccctctaactaaaagcaagagtcatttctyagttctggtcttgcctcccacgttctcctccacatttaaaaaaatccaccagctacaaagtgaagataccatatgtgatatcccaccctagtttctgttttatcagggtttggagcaggtggagcaggcagagggatcatttcagcctataaattgtattaagggtgagtactgagtcattcttcaagaaaagttttagaagcatccaaaactgaagggtggagccacctggagacagtatcatcagtcctggccccgagcatggcctgcataggcccccatggatcccagcgggagctg

SEQ ID NO: 126755 - DNA, 601 bp, Human
tctgttgggctacactacctgatcccccttcctcaaaaatccactttactttccccatgtctacaccaatgtggttcacactctgggaccaggaaaagggggagtgatggggaacagagaagggaggagctcacacagctgaggctggggttatgcatatcgaattacttagaatttgcaacctcacagggtactttcatggcgttgaaatacacttcccacagccaccctccctctaactaaaagcaagagtcatttctcagttctggtcttgcctcccacgttctcctccacatttaaraaaatccaccagctacaaagtgaagataccatatgtgatatcccaccctagtttctgttttatcagggtttggagcaggtggagcaggcagagggatcatttcagcctataaattgtattaagggtgagtactgagtcattcttcaagaaaagttttagaagcatccaaaactgaagggtggagccacctggagacagtatcatcagtcctggccccgagcatggcctgcataggcccccatggatcccagcgggagctgcagagtgcgggcaccttggcacacagccctgagtgcaaaa

SEQ ID NO: 126756 - DNA, 601 bp, Human
actaaaaatacaaataattaggctgggtgtggtggctcatgcctgtaatcccaacagtttgggaggctgaggcaggtggtcacctgaggtcaggagtttgagaccagcctggccaacagggtgaaaccccgtgtctactaaaaacataaaaattagccaagcatgatggcatgtgcctataatcctggctactagggaggctgagacaggagagaatcgcttgaatccaggaggtggttgcagtgagctgagatggtgccactgcactccagcctggttgacagagcaagactctgtctcaaaaaaaaaaaaaaaaaaaaaaagccatgcctggtggagcactacgtgtaatctcagctatttgggaggctgaggcacgagaatcacttgaacctgggaggcagtggttgcagtgagctgagatcgcgccactgcactccagcctgggcgacagagtgagtgagactccatttcaaaaaaataataaatctgagtcactttaatattgttatttggatgtcaacctctaggtgtttgagacaggagagtgatatgggggcactggaaacacacaggcacggggtgtcctcacacttgggta

SEQ ID NO: 126757 - DNA, 601 bp, Human
cctgccccgctgtttattaattaaggatcactctgcttgcagaaccctgaactccccagaactgtgaggtgggagaaccccgagaggccacctggccccacttcccacctgctgcccaaaccccctctctgccttcctgacagtcaccccaactcccagtgatccccatcaaccatctgacaaggggactgagagggaagagaaaggaggggcccaaagaggaaggtaaaactgtcgggaacagcccccaaatgtgtgacagccttcagtggagttgcccactttcccttttctcctcccygcaggacctcccttctccccagtcctccccaacttctgaggttacattgagaaaagtctgcagagaggtgccagcatcacaaggtgttaaggaccacgagtttggcattttaacagatgccagagccacttgagaaatgtggtaactaagcccagagaggtacagttaacctccccagagtcacacagcaggttcatggcaaagctggactagcacaggtgtccttcccctgcagatccccttctgtgccccacatcacctccctccagtgtctgggccacctggagatgggccctcaga

SEQ ID NO: 126758 - DNA, 601 bp, Human
agctggactagcacaggtgtccttcccctgcagatccccttctgtgccccacatcacctccctccagtgtctgggccacctggagatgggccctcagactcacccggccagaggtgccatctcatgggagaggtctggccaggaagcatcgatatttgagatcccaagaaatgaagacttggcctgtcagatgacagacttcggtcatgggaacacgtgatctgttttacacatgcgtcccctcagcagcagctttccagaacattcccactttcttctgtagtgagaagaactctttccmtgcagcctcctgcccaactcctccttcagtgtctttgcttcagtgtctttgataaaccattctgctttgcagagtgcgagctctgccttgcagggttcgcatctgcctgtgctgagtaaccaacgctaaggtcgagtggtcggtcacctctcataagagctagggttgtctcatgctgatgactaggacttgccctcaaggagaaaaataaatcaaaacaaaagcaaaaacagcaaacatgcatctcttaaagaaggctctgagtccaggtaaatttccttccactgaagcagccaggct

SEQ ID NO: 126759 - DNA, 601 bp, Human
ccctcagcagcagctttccagaacattcccactttcttctgtagtgagaagaactctttccctgcagcctcctgcccaactcctccttcagtgtctttgcttcagtgtctttgataaaccattctgctttgcagagtgcgagctctgccttgcagggttcgcatctgcctgtgctgagtaaccaacgctaaggtcgagtggtcggtcacctctcataagagctagggttgtctcatgctgatgactaggacttgccctcaaggagaaaaataaatcaaaacaaaagcaaaaacagcaaacrtgcatctcttaaagaaggctctgagtccaggtaaatttccttccactgaagcagccaggctgaattcgaattatctttgcccctgcttaaaaactaatgcaaattttcctagagaatatccactaattcctggagggggcatgggcattcctgatgcccatgagaggaccatttgctcttccctcagtatgctaaataacagaagcgacatttgttgctggaaagtatcagtgaagttaataaggtttttcttgcccagggtgagggaacagttcccaatgacaaatgctgtatgggaag

SEQ ID NO: 126760 - DNA, 601 bp, Human
ttattgttattatgccttacttaagaaatggatatgagatgcatttacctgtctcttcctgccactctgcagagccagtaagatgtggtggaaagggcccaggctttggaggagggctggctggggttggatcttggctgccccctactagctgtgtgaccttgggtaagtagctggacctctctgagcctggttcggaatcatagcacctctctttcagggctgctgtaaggaatagcagtggtgtgtataaagcagagcgcacagccagcaactggcccctagccacactgctgagcasctactgtgataagctgccattgtggtgtgtgaagcaaaggggaaacatgcctgctgtagtgagcttcctgtagggcaggttgtagaaccagaggtgggttccaaggttacaaagggactcttagtgtattagtctgttctcacattactataaagacctacctgagactggatcatttataaagaaaagaggtttaattggctcacattggctgggtgcggtggctcacgcctgtaatcccagcattttgggaggccaaggccggcggatcacttgaggtcaggaatttgagaccagcct

SEQ ID NO: 126761 - DNA, 601 bp, Human
cctctctttcagggctgctgtaaggaatagcagtggtgtgtataaagcagagcgcacagccagcaactggcccctagccacactgctgagcacctactgtgataagctgccattgtggtgtgtgaagcaaaggggaaacatgcctgctgtagtgagcttcctgtagggcaggttgtagaaccagaggtgggttccaaggttacaaagggactcttagtgtattagtctgttctcacattactataaagacctacctgagactggatcatttataaagaaaagaggtttaattggctcacaytggctgggtgcggtggctcacgcctgtaatcccagcattttgggaggccaaggccggcggatcacttgaggtcaggaatttgagaccagcctggccaacatggtgaaaccctgtctcttctaaaataaaatacaaaaattagctggccatggtggtgtgcgcctggaatcccagctactcaggaggctgaggtggaagaattgcttgagcccgggaggtggaggttgcagtgagccaagatcgccccactgcactctagcctgggcagcagactgagactctgtctcaataaaaaaaaaa

SEQ ID NO: 126762 - DNA, 601 bp, Human
taaaataaaatacaaaaattagctggccatggtggtgtgcgcctggaatcccagctactcaggaggctgaggtggaagaattgcttgagcccgggaggtggaggttgcagtgagccaagatcgccccactgcactctagcctgggcagcagactgagactctgtctcaataaaaaaaaaaaaaaagaaaagaaaaagaattgcaagaaataaattattgtttatgagctatatggtctgtggtaccttgttgtgggactgggagtcttggcgtctccctgaccctgcctgttgctgcagcrccgctcagccctgcctgctccctacctgcctcccctcggcctctcctgcctccaccgggcccctggtgcctcctctagagacagtcctcctgggaccgattgtgttctcacttacacgaggcatccaggactacagataaccagaggaaggggcgccccccccgcctgccctcctccctggcatcctcacgctgcagaggtcagagcctcatcccagccccttacctgcccctactctgtggagaaccgtggtcagttcgccaggccggatccacgaacggccttgtggaagatggtgag

SEQ ID NO: 126763 - DNA, 601 bp, Human
ttgcacatcatgcagctattcattgactcagcaagtatcagctttgcatgcgaccttggcctacccactttagcttttagtaatagctcccttcttgaataatacaaccagtggggaaacagaacctaactcttacctctgggaggcttatttgctttgagaacatatgtcctgcagttttgttcatatggcagtgaagtttcgtgcacacactctagagccaggcagcctgggttcaaagcgcagctctgccaggtcctaactgcatgaatttgggcaagtcgctcaacctctccatgcytgagtttcctcatctgtaagattggagcaatggtaatacctgctttttagggttgagaagagaattaaatgaattaagatgggtaaagtgcttagagtggagctttgcaagtagtaagtgctatgtaagtgttcgatttaaaatgaaagacccttaaatacattctttgttcatttcacaagcccttcatttcacaaccttacatttcacaaccaagctctgtctcccctggaatccagccataactctgctcacaagtgtgagacaggccccagcagagctgcacgaagaggagagaag

SEQ ID NO: 126764 - DNA, 601 bp, Human
cccaagcccccatttccatcacatgcgtacacccatgtgtgtccatagccgcccatctcagtcaataaggctgctcctgcccacttggaatagtggtgacaaccaggagtggcttatgggaactatcccaatggcctgacagcatgtccgctgcaaaccgctgaggtaggacactgccctcatgtctagctgatcagcaagaggcgcagttgctttcttaggtaacattgctgctgtgtcctggccattgctggggggtggcacttaatctacaccagatttttccctcctgtatcttccragctgcttggatcttggtgctgaattaggttggactttgtcttgtggggaagggaggactatagaccctcaacgtaagcaatggtcagactattctaagaaaactcgccgaattaaagcatgaggtaaatttagttctgacttctgtccaccccactgccactgtccccttttatcccatgatcccttgcttttcttttcctcctctctccctatctcttgtgtttgacgcatgataggaattcagaaatatatgtttgtggatttgtttattcacgtagcaaaccatttcttgagtgcc

SEQ ID NO: 126765 - DNA, 601 bp, Human
gcagtgacaaacaagatcccaaattcttgtggcttcacacatctggcaccacctcatcttccagccttaggagtcatcttttagttccttgaaaactctttacagttttctgttggggccttgtcatatactattcccctggaatgttctttcctatcccctccctttcaccttgctaacttgtgcccatccttcaggtctcagcagaaacatcacttccttggggaagttttctccaacacccacactacacaggtgtcccatctacactcctatgactttgtggtacttgtctcacttsattttccactgccttccccacaaggcacctgcacaagggcaaggaccgtaccactgtacctatgtcactcattgctgtggtcacctgcactctggctgcctaccttaactacacattagaatcacctgaggagcttttaaagccacaatgcaagactccaccctaggccaattggatccaaatccctggggtagggccagacatcagtggagttatatatacatatatatattttgtttgtttgtttgtttgttttttgagacagagttttgctctgtcacccaggctggagtgcagtgg

SEQ ID NO: 126766 - DNA, 601 bp, Human
gctaaaggagagagactaaaatgatatcaggttcctggagaacaaacagacatgattttgcttcatggcaggacagccggaagaagtgggattatatcctcacattacaaataagaaaactgagactcagaatggttaagtcacttgtcccaggccacacagccagtaaattacagaaacagaatttgaacccaaatcttccagctccaaagcttgtgttcttttcactacctcctgcttaattttttaatttctaagattagacccttcatctatccatgacacctgcctgtcatccccygaaaaaaggtgaacgccgttcagaaatttttctagcctgagctcactcccagttcacttatttttgctttgtcatggctgcccagtccccacttgtagaccaggaataggtcatggctgcggggactacacgctgtcgctgctgcaagggccggcctctgtttccggggctgagtgggggccagacctgccaggagcaccatcttctgtgggtcctgcctggatgtcacatcccggccccaagaagtcactgcaaaccttcgtattattgagcttcacatcctagaatttgctgtcactg

SEQ ID NO: 126767 - DNA, 601 bp, Human
aaaaactccaagtaggctgggtgtggtggctcacacctgtaatcccagtactttgggaggctgaggcaggcatatcgcttgagttcaggagttcaagatttgcctgggcaacatagtgagatcctgtctctactgaaaacaattagctgggtgtggtggcacatgcctgcggtcccagctactcaggaggctgagataggaggatcacttgaaccctgggggacagaggttgcagtgaggcaagattgcaccactgcactccagcctgggtgacagattgagaccctgtctcaaaaaaagaaaaaaaaaaaagaaacacaaaaactccaggtggtcgcacagaatgacaggactgaagtaacttagctccaatttctgtcttcataatcactgtcctaccattgtctgtgcttagaatctacttgcttaatgcaggaacatgtgttctcacagagatggaaaatgcaaatggcgccagaagcaagctggaaattctgaaccattaagaatttactctctgccaggcacggtggctcacgcctgtaatcccaggactttgggaggctgaggcaggcagatcatctgaggtcaggagttcaag

SEQ ID NO: 126768 - DNA, 601 bp, Human
tgtttttgaactctctagagacagtccagccccttattacttgtcctgaggcagctgctcccttcacctggccccccgcattgtgttccggacccttgtcctggtggtgctaaagaatatctctgtcgatcctttggggactggggaaactgaggcccagtgccacgcgatgccatttgttcagggaagattaggtcatctgctaggtccccagtcacttgaccttcttcccagacaggaagaagctgctctgggtctctcagtgctccacgtgtctttgcacattgaaatgttttctgatttttttttttttttttttgctgttacatttacttttaaaaaataacaagcaataaaatgttacatttgagaaggttgaaatgagaattgatttgagttaaattctagcagatttttcttagaagaatgatatcatcatctccagctacctgcaattgatctactctgaattaagaaagagacttccatttgttgtttatattttgcactcttgatgtgtttctttaaattatggtcatgggccaggtgtaggagctcacacctgtaatcccagcaccttgggactctgaggagggaggat

SEQ ID NO: 126769 - DNA, 601 bp, Human
actgccctctagcctggctgacagagcaagacctgcctcaaaaaaataagtaaaaaataaattaaatttcaatcattagcagtcattaggatatttaaatacagtatgttgaatcaaagttacgcatgtgtgtatttttttttccagagagttgtttatcatgtgggttttaatttaactttaaaaaaatgttggctggacagttgcccaaatggtatcatcagccatttggttgagaacgtatgtcctgcgggctcctctgtcactggagttttgctagctgacagccactggctagttagagactgcagtcagcacagatgcaggcgtggacttgcgcacgtaaccatgtcaatgcaaagccatcacttcttaaaaattctgaaccctgctgtctgagatggtggtgcagcggatagaactctgctctaagaggcagtagctaattccatgtcttctttgcccttgactagctgagtgactttgcacatggggcttgcctctctgttgccttgtctgcaaagtggaatcatcttttccttgctagacagaaggtggaccctggacctatggcctttttgagtttcccccccgcttctta

SEQ ID NO: 126770 - DNA, 601 bp, Human
tccagctgagagccagtggtgccatggttccttagggagccggtcccctgatgccggctcctggccccaaatctctctgatccgggctcttccagaatgtcttgtctccaccatcgcctttgaccaatggtgtccctttgcctggtaatgtcccctttgcctgatgatggccctgtcactcctctctttagcacagaggaggctgtttcatcccttcaagcctgccctcccttcaagtcttagctcaagttcaccttctccgcagagccttctccaatcttcttgactacgtctcctctcrgctccagcaacctctgtctctggcactgattccttacttagctaagagaatcacagacacttggggctcaggacaatctgctttctctcttcttacccatggccttggactgtgtgtacctctttgtctccactcccaaacccaacccccagagggcagagagcatgttgtctgtccctttgctcagcatgaagccatgcgtgtggtagatcggcagagttccataacttgtgttgaccgaggggtcactttgctctgaaattacccctgtgtccttcagtatttgcacagatagcttcc

SEQ ID NO: 126771 - DNA, 601 bp, Human
aaagagagtagtaaaatctattaaaggggacaaagacagcctatatactacaagctttctatttttatggcagagaatgccattttctaagtaaacagagaactgcatttgacctgcaatatcaaatgcatggatttgatgctttggaaagcaactgttttctgcgttaatctgggtgtcttccgtgaaatgtcctcctgcctttggcttaaacactagctttgtctacagccattccatcctgaacctgcccaatcttgtctgaatcctggtttcaccactgacaagctgtgtgtccttkggcaagttacttcacctgtctgtgcttcagagtcctcatctgtgagttggggaatctggacagaatctaccccatagggcgtagtgaggatgtgttgaattatcccaagtggctacacagagtaagcactcaaatgatgtcatcgttgtcatgattgctgttaccagagcctagagttcattctgatactcgagtctgtggcccatccagcccaggtaaggaatagttggaggagttgggcatgttcagcttgaagaggagacgacaggggatatgggatagttgaatctgtgaagggcc

SEQ ID NO: 126772 - DNA, 601 bp, Human
tctcgaactcctggcctcaagtgatctgcccaccttggccttccaaaatactgggattaaggtatgagccaccgcacccagccctcctgggctcttttcctttagttgcactcgctccccgctcctggagtagagggatttccgagagactgtgggctccagccttcacctaggcccaggactaggatgcctgccctaacatttatctttataccttaaagcaaaacagctggaccataagcattcaagaacaaactgtgaataaggagaaagttctcccaggaaacaagagctttagttmtgttgggccagcccttatattccttagctgttaccagtcactgcttgatttaatctcggctatcacttggcctgacaggtctgctgctggtgccaggatgtctgggttttgaagcctggctccattacatacttcctgtgtgaccttgggcaacttactcaacctgtctgttcctcagtttccccagctgtattatgtcagcataatagtttgttgtgtgaattaaatgaggtaataactggaaatgcttcaaacatggttcctatcatgagaaatcctgctttccgcctaaatgtgctg

SEQ ID NO: 126773 - DNA, 601 bp, Human
caaggctgtgcagccttccctgtccttgattccagtctgagtttttaactgaagggataaggaggaccacgctttccccagaccagaaccgcgggccagggggcgattccgctgagtcaccgcgggcgcctggtgcgcggcggcggagcccgggaccttccttggctgccccctagcgagggccgcagcgcagcctgagacacccgccggggccgctccacggccgtcggatttagactggaagctcggtccaggtccccagcttgatgcgcccgcggtgtaggagaccagcccgactcgrgcttcccctgagcccctggactcttgactccagcagggcctgggtaatgaacgtcagctcccctttcccaaaggggttgctctgttgggaaggcacccgtttgatacagtagcatagagatgggttttagcatcaaaatatcagaattcaagccttgctctctgcttactagctgtgtgaccctaaaaaggtttctgaacgtctctgagcttcagtttcctcatcattccttctcacggggtggttgtgagcattacagagatcctctctgtgaagcccctgtgagtggctcatcctgag

SEQ ID NO: 126774 - DNA, 601 bp, Human
ctggcctcaagtgatctgcctgcctgagcctccggaagtgctgggatttcaggtgtgagccaccgcactcggctccacacttttcacttattaaaagactgtggtgtccatcaatggatgaatgaataaaccaatgtggactatccctcccattacccaaggaatgaagcacggagccgtgccaagatctggattcacagtgaaagaagccagtcaccaaaagccacgtgctgtgtgacttcccttatacgaaatatccagaagagatacatccatggtgacagaaagtagatgagcagcyggggactggcgaaggggagaagggggagcagctgtctatgaggtccagcctttcttctgggtttggtgagaatgttttggaactagatagaggtgatagttgtacaacattgtgaatgtactaaatgccactgaatcattcattttaaatcgttctttacgttgcatgaattttaagtcaatcaaaaacagttgtttgaaaagagaaaagcctatgggtagcggcagcagtgattggatttatgattcgattccatggctcatccctcccctgcctcaccccctcgccctccgacgtctt

SEQ ID NO: 126775 - DNA, 601 bp, Human
gagatggctgggtcaaatggtatttctagttctagatccctgaggaatcgccacactgtcttccacaatggttgaactagtttacagtcctaccaacagtgtaaaagtgttcctatttctccacatcctctccagcagctgttgtttcctgactttttaatgatcgccattctaactggtgtgagatgttatctcatggtggttttgatttgcatttctctgatggccagtgatgatgagcattttttcacatgtctgttggcgaactctagcagcttcttttcacaagttcatggagagrggtttcccactgagggaatcacatctgtctgatcaaaagaggcttgggaaatggctctcctgttcattccctgaaaacctctgatggaaccactgccactgtggcagccccagcactggcaccccagccatgattggtgccccagccacatctctgctgtgagccccagagccctggttaattaatcatccacgtgttgatggggagaggcccattcacaaaagcgacataaagcccagggagacgtggccgtggcaagaagggtgtgggactacattccgcccccaactgagagattca

SEQ ID NO: 126776 - DNA, 601 bp, Human
ctcgatcccctgacctcaggtgatccacccacctcggcctcccaaagtgctgagatcacaggcgtgagccaccatgcctggccgtcacctggtggtgttgaatatgaactgctgcggtgttggtaaattaagcaagcagatagatgtaaataacgcttgggcaggaatatggagcacgggatgaggatgggcggccaactgttagagagggtagcagggaggctgagatctgcctgccatgaactgggaggagaggctcctctctctcttcacccccactctgccccccaacactcctcaraacttatcctctcctcttctttccccaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaaggttagtggacagccatgcacagcaggcccagatcactgcaagccaaggggtggcgggaacagtttgcatccagaattgcaaagaaattttaaatacattattgtcttagactgtcagtaaag

SEQ ID NO: 126777 - DNA, 601 bp, Human
gggcctgccctggagtcttttgctctgtgtggccatccttcctccctcaggagagtgtgtgctcccagagcacaggctgtatcttctgagcattttgtcccttcccagtacctagcactcagctctgtatacattgggctctcaagaattctcaaccttccagagtgtaaggccttgacctgctcagccctggatactgcatgatgcattgataagcccataaaataaccagggcagattgactcccagtggccaaagtgccacagggaagggacaattcagcccttctaggaggaggagraggtagttttctcatttctattaaggcaacaaaagctgccttactaaggacattcttggtggagggcgtgactgtcaaccactgtgatcatttgggcctctcttgcccaggcttcccattctgaaaggacagttttattgtaggtacacatggctgccatttcaaatgtaactcacagcttgtccatcagtccttggaggtctttctatgaaaggagcttggtggcgtccaaacaccacccaatgtccacttagaagtaagcaccgtgtctgccctgagctgactccttttccaaggaag

SEQ ID NO: 126778 - DNA, 601 bp, Human
tttccctcctgcctctgctgtgaaggtggacccatccaacagtcaaatgcctgactctggacaggagcggacctatttattgccatgcaagggactctgcacttttgaattgtgggtcatgggcttggatttaggggttagagctgggagaagtcttggaagtcacctagagatgacactgccattttgcagatgaggaaaccgtccaatcaaaatggaccaaggacttgcccaaagcctcacagcaaaaccataggcccccgcactaaccccagagtccctgtgctgtcttaaggatcawatagttgtaagcaatcatctggttttcagtatttcttcttttaaaatgcctggggccatgcccagcagtctgtttcactgcagcgtttacacagggctgccgggctttcctggtggatgagctgggcggttcatgagccagaaccactcagcagcatgtcagtgtgcttcctggggagctggtagcaggggctccgggccctacttcagggctgctttctggcatatggctgatcccctcctcactcctcctccctgcattgctcctgcgcaagaagcaaaggtgaggggctgggtatgg

SEQ ID NO: 126779 - DNA, 601 bp, Human
accacctgctgtgtggcatgcactgtggtcgatgccaggaacaggaattggaggggcccatgagcatggccagtatcacaggctggaggtgctgctgcgctctgaccgggcctcttggggatgagcccatgtcaaccaccttgcctccgatggggtcgggcccacaggttacctttgtgtgtccatgaccacaccttcctccccgacctcatccaaatctctttcttttccaagcccctgaatccttcagggctgcaggttttgtttaaagcagagctggtgagttgcataggttgttgcrttgggactagatggggtgttcaaagagttgggagttaaaaaacataaagggtatttattaggagaaccaaggagtgtaattctcctgttcttaatatgcggccaggttaatgaatgtcacgtgaatgaaccagaaaaaaatgaagtgtgcccttgatcagctgggttggtgtgcagcaagctgtgtgaccaggggacagcagtggtcctgagggccgtcactgtctgccgtgcagagcccttcctcccacgggggcctacctcacctgtgccaagggcttgtctgtggtcagtgacctgg

SEQ ID NO: 126780 - DNA, 601 bp, Human
cctggaccctgcggagaggcctctggggtctctgggccgtgcctcggggagaaagagccagaagctcccgtcccgctgaccgcgagccttcctcagcaccgtcccgtttgcccagcgcctcctccaacaggaggccctcaggagccctccctggagtggggacaaaaaggcggggactgggccgagaagggtccggcctttccgaagcccgccaccactgcgtatctccacacagagcctgaaagtggtaaggtggtccaggaaggcttcctccgagagccaggccccccaggtctgagcyaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctcccc

SEQ ID NO: 126781 - DNA, 601 bp, Human
cctgctgctgctccgcgggggaagcccgtcagccgggtccctcaactcaaaggtctgtgtcttgagcttcttcgctccttccctggggacctcccaggcctcccaggctgcgggcactgccactgagcttccaggcctcccgactcctgctgcttctgacgttcctaggacgccactaaatcgacacctgggtgcagctgctccactccctcggcctcctcccgtgctcaggctgtggccgcacgcgcccctcacgcttgcccgccactctgcatgtcaccagcacccccgctccgtgctmcccaccttgtttgactctctggccacttgatttgtccacaacggcccatcagcccacaggaggtttggtgggtgccttccaccgacaggatgacgggtgccctcatggtgtctagaactctccaaccctcccatgtaggcataagcagccccactttgcagatgaggaaacggaggctcagagaagtacagtaacttgccgaaggccaatgagtagtaagtgacagagccaggtttgggatccaggtaggttgtctctgaaagacacgcctgtcctgcatcccacaacgcctcccaggag

SEQ ID NO: 126782 - DNA, 601 bp, Human
aaatgcttccagattgccctgatctgggtaggacagcatcacgccatagcaacactgccccgtgagctcactgccccctcaactagcttgtggtccttggttaatgtcagtttcttttttgagtttgtgttatgtctaagggtcatctgctgggtaacggaacccagggactgccctagtccctagactgtgccatgcccgactctgccagctttgtcagtgatgctggtgctcgcctcctcgggtgctcgcctggtctgagcacacccaaggagttcttgaggccttagggttgtttgcragagaatgaaagaacacgacctagctctctttagcatccttggtcaggttcaacactgcccccaggggcctctggtggagccaaccaccatcagccaaataaatccataattagagtcagaaaatggatgtctgcatatgtgtagtgcactaatgtcctgccgatgattgacatggagtggagagtgacctgatcattgctgtgagctctgctggccttggcacaactcatgctgataactaatgcacacagttcctctgggaggaaatgtcctcagggaacttggagtttgggtgggga

SEQ ID NO: 126783 - DNA, 601 bp, Human
gtaacggaacccagggactgccctagtccctagactgtgccatgcccgactctgccagctttgtcagtgatgctggtgctcgcctcctcgggtgctcgcctggtctgagcacacccaaggagttcttgaggccttagggttgtttgcgagagaatgaaagaacacgacctagctctctttagcatccttggtcaggttcaacactgcccccaggggcctctggtggagccaaccaccatcagccaaataaatccataattagagtcagaaaatggatgtctgcatatgtgtagtgcactartgtcctgccgatgattgacatggagtggagagtgacctgatcattgctgtgagctctgctggccttggcacaactcatgctgataactaatgcacacagttcctctgggaggaaatgtcctcagggaacttggagtttgggtggggatgtgggtttgtgtgcccagcaagcccttgtggttgtagcagacactagtggcatctaggaggcaaagggtcaccccagtcttagccacgttttgagtcaaggtggcggagtggggctggtgttgactcttggtggcagtaacttttcccaatg

SEQ ID NO: 126784 - DNA, 601 bp, Human
tgacgcagggttccgtgggccacactttggaaaatacagacccatgagatagaataccagactgttgaagtgtaacgggggcctgggaagtgcagtaacagaagcaagtttgagggtaaaggacacccagaggagggagggacagcatctgcatggagaggagaagagaccccccagcagcttccagggtgttggaagggtgcgctagtaactgctatgcatggcaggtggggaactgtacgtcagggcacagcagcatgaagcggtatggctcgtgtggacagctagggacaggcaggcrtggagcaggcatcctgttctgaaggccaaatcccacagaggagccagggtgctggcaggagccctgaactagccgaacagctgaacagctgaacattcaccctgtggggaaagggtcagaagcgtccaggcttgagggcacagctgggtctcgtcactgcatcacccttatttaggataaaggccctgaagaattgtattagaggttggcaaagcatatctaccacctcctggagccacgctggccgcagggattataattatttccattttcaaattaaggcctctgagctcagagagg

SEQ ID NO: 126785 - DNA, 601 bp, Human
ctctaaaggccctgtctccaaatagagtcacattctaaggtacgggggtgttggggaggggggttagggcttcaacatgtgaatttgcggggaccacaattcagcccaggaccccgctcccgccacccagcactggggagctggggaagggtgaagaggaggctgggggtgagaaggaccacagctcactctgaggctgcagatgtgctgggccttctgggcactgggcctcggggagctagggggctttctggaaccctgggcctgcgtgtcagcttgcctcccccacgcaggcgctctscacaccattgaagttcttatcacttgggtctgagcctggggcatttggacggagggtggccaccagtgcacatgggcaccttgcctcaaaccctgccacctccccccacccaggatcccccctgcccccgaacaagcttgtgagtgcagtgtcacatcccatcgggatggaaatggacggtcgggttaaaagggacgcatgtgtagaccctgcctctgtgcatcaggcctcttttgagagtccctgcgtgccaggcggtgcacagaggtggagaagactcggctgtgccccagagcacct

SEQ ID NO: 126786 - DNA, 601 bp, Human
ggtgcacagaggtggagaagactcggctgtgccccagagcacctcctctcatcgaggaaaggacagacagtggctcccctgtggctgtggggacaagggcagagctccctggaacacaggagggagggaaggaagagaacatctcagaatctccctcctgatggcaaacgatccgggttaaattaaggtccggccttttcctgctcaggcatgtggagcttgtagtggaagaggctctctggaccctcatccaccacagtggcctggttagagaccttggggaaataactcacaggtgacycagggcctctgtcctgtaccgcagctgagggaaactgtcctgcgcttccactggggacaatgcgctccctcgtctccagactttccagtcctcattcggttctcgaaagtcgcctccagaagccccatcttgggaccaccgtgactttcattctccagggtgcctggccttggtgctgcccaagaccccagaggggccctcactggcctttcctgccttttctcccattgcccacccatgcacccccatcctgctccagcacccagactgccatccaggatctcctcaagtcacataaca

SEQ ID NO: 126787 - DNA, 601 bp, Human
aaccagaaaacacaaccttgcactcctaacttaaaaaaaaaaatgaagaaaacacaaccagtaaaacaacatataacagcattaagagctggctcctggctgggcgcggtggcgcatgcctgtaatcccaacactttgggaggccgatgctggaggatcacttgagaccaggagttcaaggttgcagtgagctatgaacataccactacaccctagcctgggcaacacagtgagactgagactctattaaaaaaaaaatgctggttccttccttatttcattcctttattcattcattcaracaacatttatggggcacttctgagcaccaggctctgtgctaagagcttttgcccccagggtccaggccaggggacaggggcaggtgagcagagaaacagggccagtcacagcagcaggaggaatgtaggatggagagcttggccaggcaaggacatgcagggggagcagcctgcacaagtcagcaagccagagaagacaggcagacccttgtttgggacctgttcagtggcctttgaaaggacagcccccacccggagtgctgggtgcaggagctgaaggaggatagtggaacactgca

SEQ ID NO: 126788 - DNA, 601 bp, Human
aatattcaagatggccacaagatggcaatagaatgctgtaactttcttggttctgggccgcagcctgggtggctgcttccttccctgtgtgtattgatttgtttctcttttttgagacagagtcttgctgggttgcccaggctggagtgcagtggtgcgatcatagctcactgcagccttgaagtcctgagctcaagagatccttccacctcagcctcctgagtagttgggaccacaggcttgcaccacagtgcccaactaatttcttatattttttgtagagatggggtttcactgtgtygcccaggatggtcttgaactcctgggctcaagtgatcctcctgcctcagcctcgcaaattgctgggattacaggtgtgagccaccatgcccgaccttctctttttaagggcgtgtgtgtgtgtgtgtgtgtgtgggcgcactctcgtcttcaccttcccccagccttgctctgtctctacccagtcacctctgcccatctctccgatctgtttctctctccttttacccctctttcctccctcctcatacaccactgaccattatagagaactgagtattctaaaaatacattttattta

SEQ ID NO: 126789 - DNA, 601 bp, Human
tgtgggattccttaaaatcggagggtggcatgaattgattcaaagacttgtgcagagggcgacagtgactccttgagaagcagtgtgagaaagcctgtcccacctccttccgcagctccagcctgggctgaggcactgtcacagtgtctccttgctggcaggagagaatttcaacattcaccaaaaagtagtattgtttttattaggtttatgaggctgtagccttgaggacagcccaggacaactttgttgtcacatagatagcctgtggctacaaactctgagatctagattcttctgyggctgcttctgacctgagaaagttgcggaacctcagcgagcctcacatggcctccttgtccttaacgtggggacggtgggcaagaaaggtgatgtggcactagagatttatccatctctaaaggaggagtggattgtacattgaaacaccagagaaggaattacaaaggaagaatttgagtatctaaaaatgtaggtcaggcgctcctgtgttgattgcagggctattcacaatagccaagatttggaagcaacccaagtgtccatcaacagacaaatggataaagaaaatgtggtgcat

SEQ ID NO: 126790 - DNA, 601 bp, Human
tcacttcttagagcaagatacaaaattgcatgtgcacaataattctaccaagtataggtatacaggggtagttatatataaatgagacttcaaggaaatacaacaaaatgcaatcgtgattgtgttagggtggtaagaaaacggtttttgctttgatgagctctgttttttaaaatcgttatattttctaataaaaatacatagtcttttgaaggaacataaaagattatgaagaaatgagttagatattgattcctattgaagattcagacaagtaaaattaaggggaaaaaaaacgggrtgaaccagaagtcaggctggagttccaaccccagatccgacagcccaggctgatggggcctccagggcagtggtttccacccagcattctcaaaagagccactgaggtctcagtgccattttcaagatttcggaagcggcctgggcacggctggtccttcactgggatcaccacttggcaattatttacacctgagacgaataaaaaccagagtgctgagattacaggcatggtggcttacgcttgtaatcggctttgggaagccgaggtgggctgattgcttgagcccaggagtttcaa

SEQ ID NO: 126791 - DNA, 601 bp, Human
gtcttttgaaggaacataaaagattatgaagaaatgagttagatattgattcctattgaagattcagacaagtaaaattaaggggaaaaaaaacgggatgaaccagaagtcaggctggagttccaaccccagatccgacagcccaggctgatggggcctccagggcagtggtttccacccagcattctcaaaagagccactgaggtctcagtgccattttcaagatttcggaagcggcctgggcacggctggtccttcactgggatcaccacttggcaattatttacacctgagacgaatraaaaccagagtgctgagattacaggcatggtggcttacgcttgtaatcggctttgggaagccgaggtgggctgattgcttgagcccaggagtttcaaactatcctggacaacatagcatgacctcgtctctacaaaaaatacaaaaaatttgccaggtgtggtggcatgtgcctgtggtcccagctacttgggaggctgaagtaggagaatcccctgagccctgggaagtcgaggctgcactgagccgtgatggtgtcactgcactccagcctgggtgacaaagtgagaccctatctcac

SEQ ID NO: 126792 - DNA, 601 bp, Human
cggcaggcttgagaacagccgcagggagttctctgggaatgtgccggtgggtctagccaggtgtgagtggagatgccggggaacttcctattactcactcgtcagtgtggccgaacacatttttcacttgacctcaggctggtgaacgctcccctctggggttcaggcctcacgatgccatccttttgtgaagtgaggacctgcaatcccagcttcgtaaagcccgctggaaatcactcacacttctgggatgccttcagagcagccctctatcccttcagctcccctgggatgtgactcracctcccgtcactccccagactgcctctgccaagtccgaaagtggaggcatccttgcgagcaagtaggcgggtccagggtggcgcatgtcactcatcgaaagtggaggcgtccttgcgagcaagcaggcgggtccagggtggcgtgtcactcatccttttttctggctaccaaaggtgcagataattaataagaagctggatcttagcaacgtccagtccaagtgtggctcaaaggataatatcaaacacgtcccgggaggcggcagtgtgagtaccttcacacgtcccatgcgccgtgc

SEQ ID NO: 126793 - DNA, 601 bp, Human
tccctggcctgagccctagcctctccccagcctgggggccccttcccagcaggctggccctgctccttctctacctgggacccttctgcctcctggctggaccctggaagctctgcagggcctgctgtccccctccctgccctccaggtatcctgaccaccggccctggctcccactgccatccactcctctcctttctggccgttccctggtccctgtcccagcccccctccccctctcacgagttacctcacccaggccagagggaagagggaaggaggccctggtcataccagcacgycctcccacctccctcggccctggtccaccccctcagtgctggcctcagagcacagctctctccaagccaggccgcgcgccatccatcctccctgtcccccaacgtccttgccacagatcatgtccgccctgacacacatgggtctcagccatctctgccccagttaactccccatccataaagagcacatgccagccgacaccaaaataattcgggatggttccagtttagacctaagtggaaggagaaaccaccacctgccctgcaccttgttttttggtgaccttgataaaccatctt

SEQ ID NO: 126794 - DNA, 601 bp, Human
ctggccgttccctggtccctgtcccagcccccctccccctctcacgagttacctcacccaggccagagggaagagggaaggaggccctggtcataccagcacgtcctcccacctccctcggccctggtccaccccctcagtgctggcctcagagcacagctctctccaagccaggccgcgcgccatccatcctccctgtcccccaacgtccttgccacagatcatgtccgccctgacacacatgggtctcagccatctctgccccagttaactccccatccataaagagcacatgccagcygacaccaaaataattcgggatggttccagtttagacctaagtggaaggagaaaccaccacctgccctgcaccttgttttttggtgaccttgataaaccatcttcagccatgaagccagctgtctcccaggaagctccagggcggtgcttcctcgggagctgactgataggtgggaggtggctgcccccttgcaccctcaggtgaccccacacaaggccactgctggaggccctggggactccaggaatgtcaatcagtgacctgccccccaggccccacacagccatggctgcatagagg

SEQ ID NO: 126795 - DNA, 601 bp, Human
ctgtccagtatagtagccactagctacatgtggcacttgaaacatggctggtacagttgaggaagagtggctgccatatcggacgacacagctatagattctgtcaccccaccccgagagtccagagcggggacttctgccttaggccctattcagggctgatttttacttgaacccttactgtgggaagagaaggccatgagaagttcagtctagaatgtgactccttattttctggctcccttggacactttgtgggatttagtctccctgtggaaagtattccacaagtggtgccacyaccccagctgtgagagcagctgggagctgcttttgtcatctttccctggaaagtcctgtgggctgtctcttcctcatgccttgtcccatgcttgggcatggtgtcaagcgtcaggagggagaaagggtccttatttatttatttagagagggacccttcttctgttcccaggctggagtgcagtggtgcgatctcggctcactgcaacctccgcctcctgggttcaagtgattctcctgcctcagcctcctgagtagctgagattacaggcacatgccaacatgcccggctaattttttt

SEQ ID NO: 126796 - DNA, 601 bp, Human
tggcatgaacccgggaggcggagcttgcagtgagcagagaccatgccactgcactccagcctgggcgacagagcaagactctgtctcaagaaaaaaaaaaaaaaacagactttacttactggaagccaaccaatgtatatttagagtaatttttcctgggctgagctgtcatttacttttgcagtatctcaagaagaagagtttacagtgtaaatatttgatgcacactttgattatatagatgaagcaaactattttcaagagctttgcaaggacttacttgtatccaaacaccattctaaaggagtcttacctacttctaaaggctggtctctacttggaaccacttgcttggccctggttcaagtcctgctgcaaacctggaagtcctgtcattgtcttcttccctccagagcagtggcacccaatctaatttttgctgtgccccagcagcccctggcactttgccctgtagactgcagacctcatgtaatgtatgttaagtccacagaaccacagaagatgatggcaagatgctcttgtgtgtgttgtgttctaggaggtggccaggtggaagtaaaatctgagaagcttgacttca

SEQ ID NO: 126797 - DNA, 601 bp, Human
tcaaaaaacattaacataaatatttttatcaaagcctgtattaaatggtctttcaagaaaatacagtaacaggtcaggcatggtggctcatgcctgtaaccccagcactttgggaggccaaggcaggcagatcacctgaaatcaggagttcaagaccaacctggccaacacagccaaatcccatctctacaaaaaatacaaaaattagctgggtgtggtggcacacacctgtagtcccagctacttgggaggccgaggcaggagaattgcttgatcccggaggcggaggttgcagtgagcygagatcgtgccactgcactccagcgtgggtgacaaggtgaatctttgtctcaaaaaaaaaaaaaaaaaaaagataaaatacagtatacagtaatagagaacaatccttttttcaaagtagtgaccccaaatgaacaaaatatgcatctagcttaaatgcgaacctggttttctctacgcccattcaagcccctgcaataggggcccttcaccccgcatccatggactcctaaaattatatggaaaatggctgtgtgtgagtgtggatggacatgtgcacacatatttttggctttaccag

SEQ ID NO: 126798 - DNA, 601 bp, Human
tcaagaaaatacagtaacaggtcaggcatggtggctcatgcctgtaaccccagcactttgggaggccaaggcaggcagatcacctgaaatcaggagttcaagaccaacctggccaacacagccaaatcccatctctacaaaaaatacaaaaattagctgggtgtggtggcacacacctgtagtcccagctacttgggaggccgaggcaggagaattgcttgatcccggaggcggaggttgcagtgagccgagatcgtgccactgcactccagcgtgggtgacaaggtgaatctttgtctcaaaaaaaaaaaaaaaaaaaagataaaatacagtatacagtaatagagaacaatccttttttcaaagtagtgaccccaaatgaacaaaatatgcatctagcttaaatgcgaacctggttttctctacgcccattcaagcccctgcaataggggcccttcaccccgcatccatggactcctaaaattatatggaaaatggctgtgtgtgagtgtggatggacatgtgcacacatatttttggctttaccagatgctcaaagagcctaggacccaaaaagggctgagaatgaccgtgtcggcca

SEQ ID NO: 126799 - DNA, 601 bp, Human; identical to SEQ ID NO: 126750

SEQ ID NO: 126800 - DNA, 601 bp, Human; identical to SEQ ID NO: 126751

SEQ ID NO: 126801 - DNA, 601 bp, Human; identical to SEQ ID NO: 126752

SEQ ID NO: 126802 - DNA, 601 bp, Human; identical to SEQ ID NO: 126753

SEQ ID NO: 126803 - DNA, 601 bp, Human; identical to SEQ ID NO: 126754

SEQ ID NO: 126804 - DNA, 601 bp, Human; identical to SEQ ID NO: 126755

SEQ ID NO: 126805 - DNA, 601 bp, Human; identical to SEQ ID NO: 126756

SEQ ID NO: 126806 - DNA, 601 bp, Human; identical to SEQ ID NO: 126757

SEQ ID NO: 126807 - DNA, 601 bp, Human; identical to SEQ ID NO: 126758

SEQ ID NO: 126808 - DNA, 601 bp, Human; identical to SEQ ID NO: 126759

SEQ ID NO: 126809 - DNA, 601 bp, Human; identical to SEQ ID NO: 126760

SEQ ID NO: 126810 - DNA, 601 bp, Human; identical to SEQ ID NO: 126761

SEQ ID NO: 126811 - DNA, 601 bp, Human; identical to SEQ ID NO: 126762

SEQ ID NO: 126812 - DNA, 601 bp, Human; identical to SEQ ID NO: 126763

SEQ ID NO: 126813 - DNA, 601 bp, Human; identical to SEQ ID NO: 126764

SEQ ID NO: 126814 - DNA, 601 bp, Human; identical to SEQ ID NO: 126765

SEQ ID NO: 126815 - DNA, 601 bp, Human; identical to SEQ ID NO: 126766

SEQ ID NO: 126816 - DNA, 601 bp, Human; identical to SEQ ID NO: 126767

SEQ ID NO: 126817 - DNA, 601 bp, Human; identical to SEQ ID NO: 126768

SEQ ID NO: 126818 - DNA, 601 bp, Human; identical to SEQ ID NO: 126769

SEQ ID NO: 126819 - DNA, 601 bp, Human; identical to SEQ ID NO: 126770

SEQ ID NO: 126820 - DNA, 601 bp, Human; identical to SEQ ID NO: 126771

SEQ ID NO: 126821 - DNA, 601 bp, Human; identical to SEQ ID NO: 126772

SEQ ID NO: 126822 - DNA, 601 bp, Human; identical to SEQ ID NO: 126773

SEQ ID NO: 126823 - DNA, 601 bp, Human; identical to SEQ ID NO: 126774

SEQ ID NO: 126824 - DNA, 601 bp, Human; identical to SEQ ID NO: 126775

SEQ ID NO: 126825 - DNA, 601 bp, Human; identical to SEQ ID NO: 126776

SEQ ID NO: 126826 - DNA, 601 bp, Human; identical to SEQ ID NO: 126777

SEQ ID NO: 126827 - DNA, 601 bp, Human; identical to SEQ ID NO: 126778

SEQ ID NO: 126828 - DNA, 601 bp, Human; identical to SEQ ID NO: 126779

SEQ ID NO: 126829 - DNA, 601 bp, Human; identical to SEQ ID NO: 126780

SEQ ID NO: 126830 - DNA, 601 bp, Human; identical to SEQ ID NO: 126781

SEQ ID NO: 126831 - DNA, 601 bp, Human; identical to SEQ ID NO: 126782

SEQ ID NO: 126832 - DNA, 601 bp, Human; identical to SEQ ID NO: 126783

SEQ ID NO: 126833 - DNA, 601 bp, Human; identical to SEQ ID NO: 126784

SEQ ID NO: 126834 - DNA, 601 bp, Human; identical to SEQ ID NO: 126785

SEQ ID NO: 126835 - DNA, 601 bp, Human; identical to SEQ ID NO: 126786

SEQ ID NO: 126836 - DNA, 601 bp, Human; identical to SEQ ID NO: 126787

SEQ ID NO: 126837 - DNA, 601 bp, Human; identical to SEQ ID NO: 126788

SEQ ID NO: 126838 - DNA, 601 bp, Human; identical to SEQ ID NO: 126789

SEQ ID NO: 126839 - DNA, 601 bp, Human; identical to SEQ ID NO: 126790

SEQ ID NO: 126840 - DNA, 601 bp, Human; identical to SEQ ID NO: 126791

SEQ ID NO: 126841 - DNA, 601 bp, Human; identical to SEQ ID NO: 126792

SEQ ID NO: 126842 - DNA, 601 bp, Human; identical to SEQ ID NO: 126793

SEQ ID NO: 126843 - DNA, 601 bp, Human; identical to SEQ ID NO: 126794

SEQ ID NO: 126844 - DNA, 601 bp, Human; identical to SEQ ID NO: 126795

SEQ ID NO: 126845 - DNA, 601 bp, Human; identical to SEQ ID NO: 126796

SEQ ID NO: 126846 - DNA, 601 bp, Human; identical to SEQ ID NO: 126797

SEQ ID NO: 126847 - DNA, 601 bp, Human; identical to SEQ ID NO: 126798

SEQ ID NO: 126848 - DNA, 601 bp, Human; identical to SEQ ID NO: 126750

SEQ ID NO: 126849 - DNA, 601 bp, Human; identical to SEQ ID NO: 126751

SEQ ID NO: 126850 - DNA, 601 bp, Human; identical to SEQ ID NO: 126752

SEQ ID NO: 126851 - DNA, 601 bp, Human; identical to SEQ ID NO: 126753

SEQ ID NO: 126852 - DNA, 601 bp, Human; identical to SEQ ID NO: 126754

SEQ ID NO: 126853 - DNA, 601 bp, Human; identical to SEQ ID NO: 126755

SEQ ID NO: 126854 - DNA, 601 bp, Human; identical to SEQ ID NO: 126756

SEQ ID NO: 126855 - DNA, 601 bp, Human; identical to SEQ ID NO: 126757

SEQ ID NO: 126856 - DNA, 601 bp, Human; identical to SEQ ID NO: 126758

SEQ ID NO: 126857 - DNA, 601 bp, Human; identical to SEQ ID NO: 126759

SEQ ID NO: 126858 - DNA, 601 bp, Human; identical to SEQ ID NO: 126760

SEQ ID NO: 126859 - DNA, 601 bp, Human; identical to SEQ ID NO: 126761

SEQ ID NO: 126860 - DNA, 601 bp, Human; identical to SEQ ID NO: 126762

SEQ ID NO: 126861 - DNA, 601 bp, Human; identical to SEQ ID NO: 126763

SEQ ID NO: 126862 - DNA, 601 bp, Human; identical to SEQ ID NO: 126764

SEQ ID NO: 126863 - DNA, 601 bp, Human; identical to SEQ ID NO: 126765

SEQ ID NO: 126864 - DNA, 601 bp, Human; identical to SEQ ID NO: 126766

SEQ ID NO: 126865 - DNA, 601 bp, Human; identical to SEQ ID NO: 126767

SEQ ID NO: 126866 - DNA, 601 bp, Human; identical to SEQ ID NO: 126768

SEQ ID NO: 126867 - DNA, 601 bp, Human; identical to SEQ ID NO: 126769

SEQ ID NO: 126868 - DNA, 601 bp, Human; identical to SEQ ID NO: 126770

SEQ ID NO: 126869 - DNA, 601 bp, Human; identical to SEQ ID NO: 126771

SEQ ID NO: 126870 - DNA, 601 bp, Human; identical to SEQ ID NO: 126772

SEQ ID NO: 126871 - DNA, 601 bp, Human; identical to SEQ ID NO: 126773

SEQ ID NO: 126872 - DNA, 601 bp, Human; identical to SEQ ID NO: 126774

SEQ ID NO: 126873 - DNA, 601 bp, Human; identical to SEQ ID NO: 126775

SEQ ID NO: 126874 - DNA, 601 bp, Human; identical to SEQ ID NO: 126776

SEQ ID NO: 126875 - DNA, 601 bp, Human; identical to SEQ ID NO: 126777

SEQ ID NO: 126876 - DNA, 601 bp, Human; identical to SEQ ID NO: 126778

SEQ ID NO: 126877 - DNA, 601 bp, Human; identical to SEQ ID NO: 126779

SEQ ID NO: 126878 - DNA, 601 bp, Human; identical to SEQ ID NO: 126780

SEQ ID NO: 126879 - DNA, 601 bp, Human; identical to SEQ ID NO: 126781

SEQ ID NO: 126880 - DNA, 601 bp, Human; identical to SEQ ID NO: 126782

SEQ ID NO: 126881 - DNA, 601 bp, Human; identical to SEQ ID NO: 126783

SEQ ID NO: 126882 - DNA, 601 bp, Human; identical to SEQ ID NO: 126784

SEQ ID NO: 126883 - DNA, 601 bp, Human; identical to SEQ ID NO: 126785

SEQ ID NO: 126884 - DNA, 601 bp, Human; identical to SEQ ID NO: 126786

SEQ ID NO: 126885 - DNA, 601 bp, Human; identical to SEQ ID NO: 126787

SEQ ID NO: 126886 - DNA, 601 bp, Human; identical to SEQ ID NO: 126788

SEQ ID NO: 126887 - DNA, 601 bp, Human; identical to SEQ ID NO: 126789

SEQ ID NO: 126888 - DNA, 601 bp, Human; identical to SEQ ID NO: 126790

SEQ ID NO: 126889 - DNA, 601 bp, Human; identical to SEQ ID NO: 126791

SEQ ID NO: 126890 - DNA, 601 bp, Human; identical to SEQ ID NO: 126792

SEQ ID NO: 126891 - DNA, 601 bp, Human; identical to SEQ ID NO: 126793

SEQ ID NO: 126892 - DNA, 601 bp, Human; identical to SEQ ID NO: 126794

SEQ ID NO: 126893 - DNA, 601 bp, Human; identical to SEQ ID NO: 126795

SEQ ID NO: 126894 - DNA, 601 bp, Human; identical to SEQ ID NO: 126796

SEQ ID NO: 126895 - DNA, 601 bp, Human; identical to SEQ ID NO: 126797

SEQ ID NO: 126896 - DNA, 601 bp, Human; identical to SEQ ID NO: 126798

SEQ ID NO: 126897 - DNA, 601 bp, Human
cagagatgctgctaaacatcctacactgcacaggacagcctccaccccccaacaaataattacctgtccctaaatatcaatagtgccaaggctgagataccccataaccctgttataggataagaattcagatgtcctgacccctttccttcccatccattattggttaaaaaaaaaacccctcccgtctagactcaagcatcaaaagcagagctgagaggaggccccatcctcctgcctctctccttcttccccaagtacacacacaaacctgccaatgccagtggacaggatggcagtrgaggtcttcagttcctcgtagagatcagcgccattcacggggaaagccgagaactgagccagcagcacccgcctcagggcaaccagggcctgccaaagggccccagactgctcagcaacaaattgcccgtagaagctggcatcccagggtgtcattcaccctacttctcaatatctgagaaccctctgctccctttggcttgggatggacttttgttattgttgttgtttcagacagggtctcactctgtcgcccagattggagtgcagtagcacgatctcggctcactgcaacctctgc

SEQ ID NO: 126898 - DNA, 601 bp, Human
aacagaccaggaaaaaggtcaagactcacttggccagcaaacgtctgtcgtctttgcaactcttccccaacccaccaaacaacgtggcgggacataactgctccttttttttgagagagtctcgctctgccaccaaggctggagtgcagtggtgcgatcttggcctactgcaacctccacctcccacattcaagcaattctcctgctgcagcctcccaagtagctgggactacaggcgcccgccaccacgcccgactaatttttgtatgtttagtagagacggggtttcatcattttgggygggcaagcaggccaggcaggtctcaaactcccggcctccagtgatctgccgcctcagcctcccaaagtgctgggattacaggtatgagcactgcatctggaccgcaactccttctttctctgaactctcctgttctctactgctgcagatgtggtgaataagttctgggccacatactcccgcgcttgagcctcacctttgccacttgctcctcttaggctaaactcaagtagggttaattatctctaactggtagagtcactgaagagattacctagaacatacaggtaatgcctgcac

SEQ ID NO: 126899 - DNA, 601 bp, Human
ccctggaggcggaggttgcagtgagccgagatcacgccactgcactccagcctggcaacagagtgaaactccgtcaaaaaaaagaaagaaagaaggaaagaaggaaaggaaggaaggaaggaaggaaggaaggaaggaaggaaggaagaaagaaaaggaagaaaggaaagaaagaaagaaagaaagaaagaaagaaagaaagaaagaaagaaagaaagaaagaaagaaagaaaggctagaaacctggtgagtcagctttgattcttcacaatacattccaaactccgacaaaaaaaaaaaagaaagaaagaaagaaaggctagaaacctggtgagtcagctttgattcttcacaatacattcctcctggtagtaggtcttgtcacagttcctcttcaacatgtctcccactgttctagactggactcacataccccaggccagcactgccagggccctgcttggcctctgccacccttccaccctgcacacctctaccccactgtctataaccctgctttcacaatggcctcccgcctccagggagacagccgggcagatgagttaagagccgcgttcttagacttaggagtgtgacaagc

SEQ ID NO: 126900 - DNA, 601 bp, Human
ctgcaccccagcctgggcgacagagcaagattccgtctcaaaaaaataaaattaattaattaaataaaataaaatcaggggagttttttaaaaaatgcctatgtcagcagtacccaaagttgtctgcacattggattcacctgggagcttcaaaaaaatactgatgcctggccaggcatggtggctcatacctgtcatctcaacactttgggagacagaggtaggattgcttgagcccaggaatttgagaccagccttggcaacacagcaagacccctgtctctacaaaaaaaaaaaattwtttttaattagccaggcatggtggtgagcacctgtagtcccagctacttgggaggctgaggcagggagactgcctgagtccaggagttcaaggctgcagtgaactatgattgtgcaccactgcactcctgcctgggcaacagagcaagaccctgtctctaaaaaacaaattaaaaaattaaaaaatactgatgcctgtgtcccactcacagtgaatgagattaattggtctgggggagacttggacttcgtaatgtttaaaagagtcctcaggtgactccaatgggcacacaagtttggg

SEQ ID NO: 126901 - DNA, 601 bp, Human
ccactgcaccccagcctgggcgacagagcaagattccgtctcaaaaaaataaaattaattaattaaataaaataaaatcaggggagttttttaaaaaatgcctatgtcagcagtacccaaagttgtctgcacattggattcacctgggagcttcaaaaaaatactgatgcctggccaggcatggtggctcatacctgtcatctcaacactttgggagacagaggtaggattgcttgagcccaggaatttgagaccagccttggcaacacagcaagacccctgtctctacaaaaaaaaaaawttttttttaattagccaggcatggtggtgagcacctgtagtcccagctacttgggaggctgaggcagggagactgcctgagtccaggagttcaaggctgcagtgaactatgattgtgcaccactgcactcctgcctgggcaacagagcaagaccctgtctctaaaaaacaaattaaaaaattaaaaaatactgatgcctgtgtcccactcacagtgaatgagattaattggtctgggggagacttggacttcgtaatgtttaaaagagtcctcaggtgactccaatgggcacacaagttt

SEQ ID NO: 126902 - DNA, 601 bp, Human
ataaacctcatgacatgccaattcctaaaccaggttctctccctcaaccacatgaaacaggtcaccacctaccctccatgccctgccctatctctaggctgaagtttcttctatgccacggcctgtaccaatgcctgatcacatgcgtacctttcctagccctacaatcaccttcctaggttccagtccttgagatggttcttgatgacctcccatgacctctctgtatatgccgaacagcactttagtaagcatcccatccattttttttttctttttgagacggagtctcgctctgtcrccaggctggagtgcagtggtgtgctctcggctcactgcaacctccgcctctcgggttcaaacaattctcctgcctcagcctcccgagtagctgggattataggcacccaccaccacgcctggctaatttttgtatttttagtagagatggggtttcgccatgttggccaggctggtctcaaactcctgacctcaggtgacccactcgccttggcctcccaaagtgctgggattataggcatgagccaccgtgcctggcccccaaccattttaattccagggactccccatgattataccc

SEQ ID NO: 126903 - DNA, 601 bp, Human
ggggcaaggactgggtccgatccctgtcgcatccccagcactagcacagtgcctgaaacacaggaggcacccaataatcattccagaaaaatgagtaacagaaaggtgctatcacttttatttcgcttctgtatcatcaacactggctgtgaaagacttgggataaacctcatgacatgccaattcctaaaccaggttctctccctcaaccacatgaaacaggtcaccacctaccctccatgccctgccctatctctaggctgaagtttcttctatgccacggcctgtaccaatgcctgaycacatgcgtacctttcctagccctacaatcaccttcctaggttccagtccttgagatggttcttgatgacctcccatgacctctctgtatatgccgaacagcactttagtaagcatcccatccattttttttttctttttgagacggagtctcgctctgtcaccaggctggagtgcagtggtgtgctctcggctcactgcaacctccgcctctcgggttcaaacaattctcctgcctcagcctcccgagtagctgggattataggcacccaccaccacgcctggctaatttttgtatttt

SEQ ID NO: 126904 - DNA, 601 bp, Human
ggcatcaaatctaagaactctttgcctagattttctcctgttttgttctaaaaattagacaatttggttttacatttaagtctatgatccattttcaatttttgtataaggtataaggtttaggttgattattgtatatttttagcctatgatgtccaatagctccagcgccctttgttcaaaggctgtctttcctccaacacattgtttctgtacccttgtcaaaaatcaattgtgtgtaatcccagcattttgggaggctgaggcgggagcattgcttgagcccaggagtttgaggccrgcctgggcaacataatgaaaccctgtctctataaaaaaaatacaaacaggctgggcgcggtggctcacgccagtgatcccagcactttgggaggccgaggcgggcgatcacctgaggtcaggagttcaagaccagcctggccaacatggtgaaaccccatctctattaaaaatacaagattagctgggcatggtggcatgcacctgtaatcccagctacccgtgaggtcgaggcaggtgaatcaaacccgggaggcgggggttgcagtgagccgagatcacgccattgcactccagtctg

SEQ ID NO: 126905 - DNA, 601 bp, Human; identical to SEQ ID NO: 26175

SEQ ID NO: 126906 - DNA, 601 bp, Human; identical to SEQ ID NO: 26176

SEQ ID NO: 126907 - DNA, 601 bp, Human; identical to SEQ ID NO: 26177

SEQ ID NO: 126908 - DNA, 601 bp, Human
cgaggctgccctgtctcttccaagcttgaaggggcttctgggccgagtcaggctcagaccctttcttcccaggcacatgcagccaaacccagacccatagtttccaggatgcaagcagggccgcgtcccgggctcccagcgcgccagctggcggagaggcgggcgcccgcgggacttggctgccctctctagaagcagttcctaactgggcagcgaggccacgctaacctctgatccgaagctggccgggaagggcccgcggggaggtagcagcagaggcgtgggaggaaagtactcacckgaagaagtcgttcttgcagtagagtttgccttccctggagaagcacttctcggtcaggttgcatttacattcacagcactggacgcacttgacgtgccaggccctgtccagcacgttcaagagaaagcggtccaggatgggccttttgcagccggcacagtgaaccatggtctttggtttggtctgatgaggcccagagagagagaggggcaaagtagagcccaggggatgactcctgaagacaatcggcacgagctccccagtctctccaaaaagaggacacacactcggccgtgcaag

SEQ ID NO: 126909 - DNA, 601 bp, Human
tatgaccacaaactcagaaaagcagagaccaagtcagccgagtaaattgcgatatttcacatccgtagggtggaattacaattcgcatttgtgcccgttcttctctgttgacttgtgtgtttgtgtgaatggagcggcaaaattgtgagtgtacgataatataattaaaatgctaaacgaataaggggggtagggagaagtctccccaccagcaagctggaggtctcggctttcccccaggtttcatcaaggaggttgctggctgtggctggcagtttcctaggaggactactgagcggascccgtgggagtcggagtcacctggggctgaagccgaaccaccagacaacttcggcagccagggaagcaggaaaaagctccgggcacttcgcaggctacagtgcagcagtttgtccaggtctgcactcggaggcatgtccgggtttggggaagacccccgggcgtgcaggatcggctttaaggccgagttctttcctgccgctgacagggcagttggcccagacactctacgcaaaaggctcggagcttaccgccaagaccgctcggggtcggaaaaggtagtggccgggagggagcctgg

SEQ ID NO: 126910 - DNA, 601 bp, Human
cccgaaataccagcgagcacggagctttgcttcatggttccacgcaacccaaccccagccacgagtcctggagcggcactggggacagcgcgtcttggccctctgagtggctttgaatccctcttcctcctgctccctggtttgaactatgaccacaaactcagaaaagcagagaccaagtcagccgagtaaattgcgatatttcacatccgtagggtggaattacaattcgcatttgtgcccgttcttctctgttgacttgtgtgtttgtgtgaatggagcggcaaaattgtgagtgtasgataatataattaaaatgctaaacgaataaggggggtagggagaagtctccccaccagcaagctggaggtctcggctttcccccaggtttcatcaaggaggttgctggctgtggctggcagtttcctaggaggactactgagcggagcccgtgggagtcggagtcacctggggctgaagccgaaccaccagacaacttcggcagccagggaagcaggaaaaagctccgggcacttcgcaggctacagtgcagcagtttgtccaggtctgcactcggaggcatgtccgggtttggggaaga

SEQ ID NO: 126911 - DNA, 601 bp, Human
aagagggaagatgtaaaaagtggaggaagtaggagaggaggaatggagcacagaaagaagggaagagagagataaagagaggcagaattccggttaagcaggtgaggaggcagcaggagagagagcgcggcaccagggaagagttagggaggggatacacgcggttagagccaggggcccaagctacccgccaagccccagcctcactcccagcgttatcccagaggaaagatgcatcgtctaaagaaggtggcaaggcagtgacctgtgtgggcggggggaacggggcacttattttcckattagattcagaaaagtcgaattacaattagaactctatataaacgtgcgcggagcgccgcttttctctccttcatcgcaaaaggacccgcacataggcatggggttggcgatgtctagccccgctgttggtaaacaaacatagccgcggagagcccccctccgtagccttagcggggccgccgccacgctcttgcctaaagcgggacaggttggcaaaagcgggagctgcgggagctggctctgggcgctctgccgcgggttgtggaagccaggctcagggacccactggcagcgggta

SEQ ID NO: 126912 - DNA, 601 bp, Human
aagggagggaagacgcgacctcggcgggctgaggaaggccacgcggggaactcgcggatcgcggggagccctcgcgggcctgggtgcagggaggaggctgggcgcaagcccgggagctgccccttaccagctacccccgttattcagggccgtgaattgggtcctcggtctcgccgcctccccttgatttactcccagccttctccctactcgccccaactctccagtggcttacagagagcgaggcgtgcccccccgcgctgccacccgcttccaacgaagcccgccccgacctggccgygccccgccattcggcgcgcacccacctccgtagaaggagaagggaccattggggatgagctcgcccggctccaggcggtccaccagcggccgcatccggcgcggactgcggaagaaggcgtggcgccgggcgcccagggcgctcagctgcttcatcctccgctccttggagcgccggttctggaaccagacctgcagcacatggcggcggggtgaggccaccgagactccacccccgaccccggggtgctccgggcctagccagcaccccttcaccgcctggctagccgacaccgcgcgc

SEQ ID NO: 126913 - DNA, 601 bp, Human
ttacaaacaaccaaatggggtggggatggagctataaataagtagattttttggccaggcatagtagctcacacctgtaatcccagcactttgggaggctgaggtgggcagactgcttgagcccaggagttcaagaccagcctaggcaacatggtaaaacctcatctccccactggctgctctgaaaagccatctttgcattgtgcctcgtcagcctccttgctcgccgcagccgcctccgccgcgcgcctcctccgccgccgcggactccggcagctttatcgccagagtccctgaactstcgctttcttttttatcccctgcatcgcgtcaccggcgtgccccaccatgtcagacgcagccgtagacaccagctccgaaatcaccaccgaggacttaaaggagaagaaggaagttgtggaagaggcggaaaatggaagagacgcccctgctaacaggaatgctaatgaggaaaatggggagccggaggctgacaacgaggtagatgaagaagaggaagaaggtggggaggaagaggaggaggaagaaggtgatggtgaggaagaggacggagatgaagatgagggagctgagtcagcta

SEQ ID NO: 126914 - DNA, 601 bp, Human
gataatgttcattattggttaatccaaatagtttatctatgtatagcctttttgtctttatttattaattgagacggagtttcgctcttgtcgcccaggctggagtgcaatggcgcgatctcggctcaccacaacctccgcctcccgggttcaagcgattctcctgcctcagcctcccgagcagctgggattacaggcatgcaccaccatgcccggctaattttgtatttttggtagagatggggtttctccatgttggtcaggctggtctcgaactcccaatcttaggtgtccgctcgcstcggcctcccaaagtgctgggattacaggcgtgagccaccgcgcctggccgcctttctctctttacatctacccacattagtgttgtttagttttatttcctgaagatagggatggtcaaagatttgtttattgatgtttcaggttgttttggatttggacttttttattttaaggaatcagacttctaaaatttgccagtttttaaagtaaaaaccgtccttctttgtgcttctcagcgtcttctgtttcacagtctttggcatactctttacgatagctttgtcctttgtttgggtgt

SEQ ID NO: 126915 - DNA, 601 bp, Human
tggggtttctccatgttggtcaggctggtctcgaactcccaatcttaggtgtccgctcgcctcggcctcccaaagtgctgggattacaggcgtgagccaccgcgcctggccgcctttctctctttacatctacccacattagtgttgtttagttttatttcctgaagatagggatggtcaaagatttgtttattgatgtttcaggttgttttggatttggacttttttattttaaggaatcagacttctaaaatttgccagtttttaaagtaaaaaccgtccttctttgtgcttctcagcrtcttctgtttcacagtctttggcatactctttacgatagctttgtcctttgtttgggtgtctttttttgctgctgctgcagtttttgtttcacatatcctcagagagattcaaaaaatttccaacttctctgtgttccttgttttattctttccttcttgttttctcttcctcttcatgtagaaggctgtgaggaagtgacagatggaagggaaagcccagtgcagtactctggaattgttactcacctagaggaacggattgcttgtgaagtagtaaacccctcttaataggaagtggt

SEQ ID NO: 126916 - DNA, 601 bp, Human
caggttgttttggatttggacttttttattttaaggaatcagacttctaaaatttgccagtttttaaagtaaaaaccgtccttctttgtgcttctcagcgtcttctgtttcacagtctttggcatactctttacgatagctttgtcctttgtttgggtgtctttttttgctgctgctgcagtttttgtttcacatatcctcagagagattcaaaaaatttccaacttctctgtgttccttgttttattctttccttcttgttttctcttcctcttcatgtagaaggctgtgaggaagtgayagatggaagggaaagcccagtgcagtactctggaattgttactcacctagaggaacggattgcttgtgaagtagtaaacccctcttaataggaagtggtatttccaagacagaaggggggcgagtttcaggaagctatcagctcataagagtgcttaatatgctcagtacacacattaattcccttgacaagaatcttgcccttgtttgtttacaacaatgcaacagaatgcgggataacattgtagactcttcagttttactatagtaacattcgtggggtatgatattggggaagtgg

SEQ ID NO: 126917 - DNA, 601 bp, Human
tgtatcgcccaggctggagtacagtggcacgatctcggctcactgccgagaattgctcttgggttcaagcaattctcctgcctcagcctcctgagtagctgggactacaggcgtgtgccaccacatccagctaaatttttatttttcgtagagacagggtttcaccatgttgatcaggctggtctcaaactcgagtgacctcaggtgatccgcccacctcagcctcccaaagtgctaggaatacaggtgtgagccactgcgcccggccaggacatcacacttctactcaatgaagataaamgtttttacaccttttgtcttttttacccctattatgccacgaattcatagggaataagttctagtagctcaggctgttttccactggtggagtaggctggtgcttcaattgaacccaggtacctttcttatttagtttccttttttttttttttttttgaaatagggtcttgcactgttgcccaggctggagtgcgttggtgtgatcacaactcactgcagcctcgaactcctgggctcaaagcaatcctccacctcagcctcccaagtggctgggactacaggaatgcacatccattcc

SEQ ID NO: 126918 - DNA, 601 bp, Human
tttttcgtagagacagggtttcaccatgttgatcaggctggtctcaaactcgagtgacctcaggtgatccgcccacctcagcctcccaaagtgctaggaatacaggtgtgagccactgcgcccggccaggacatcacacttctactcaatgaagataaacgtttttacaccttttgtcttttttacccctattatgccacgaattcatagggaataagttctagtagctcaggctgttttccactggtggagtaggctggtgcttcaattgaacccaggtacctttcttatttagtttccttttttttttttttttttgaaatagggtcttgcactgttgcccaggctggagtgcgttggtgtgatcacaactcactgcagcctcgaactcctgggctcaaagcaatcctccacctcagcctcccaagtggctgggactacaggaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttc

SEQ ID NO: 126919 - DNA, 601 bp, Human
ttggtgtgatcacaactcactgcagcctcgaactcctgggctcaaagcaatcctccacctcagcctcccaagtggctgggactacaggaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttcmagttttgccatagtaagatttgtagggcattagtttttttttttttttttgagatggagtctctctctgtcccccaggctggagtgaagtggcacgatctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcc

SEQ ID NO: 126920 - DNA, 601 bp, Human
gaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttcaagttttgccatagtaagatttgtagggcattagtttttttttttttttttgagatggagtctctctctgtcccccaggctggagtgmagtggcacgatctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcctgcgtcagcctcctgagtagctgggattacaggtgcatgccaccacaaccgattaatttttgtatttttcttagagatagggtttat

SEQ ID NO: 126921 - DNA, 601 bp, Human
ccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttcaagttttgccatagtaagatttgtagggcattagtttttttttttttttttgagatggagtctctctctgtcccccaggctggagtgaagtggcacgrtctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcctgcgtcagcctcctgagtagctgggattacaggtgcatgccaccacaaccgattaatttttgtatttttcttagagatagggtttattagagcctgc

SEQ ID NO: 126922 - DNA, 601 bp, Human
gtctcctgacctcctgatccgcccacctcggcctcccaaagtgctgggattacaggcatgagccaccgcacctggctacaatatcacctttcttgtaggtttccatgtatgtggccgaaggaacaactccatgtgttctaaaaggcctggagaacatctgttggtgccttttctctttgcctttgtgttaatcattttggtgaattactggaagatggcagttccagccaaaaggcagaaataatatttcataaaagtctttggtagcttgatctttcagtgttaattttgaaattaaatrttaacactgtatctattatcttgatgagaaaataatactaatgttatgggtatttaaggatggtagaagaacatactgttctttatttttcctaacttgagattcagaatatattctttctgattttcagttttttccttttcagacctttgaaacatttaacaactttctgaaagtcttcaataatttcaaataagtcgaagaaaaatacataggattttgggctacttagctgtaagatcatataaaggttatttctaaaactagcaatctggtggggtgaaggaaggttcaaaatgt

SEQ ID NO: 126923 - DNA, 601 bp, Human
ataaaagtctttggtagcttgatctttcagtgttaattttgaaattaaatgttaacactgtatctattatcttgatgagaaaataatactaatgttatgggtatttaaggatggtagaagaacatactgttctttatttttcctaacttgagattcagaatatattctttctgattttcagttttttccttttcagacctttgaaacatttaacaactttctgaaagtcttcaataatttcaaataagtcgaagaaaaatacataggattttgggctacttagctgtaagatcatataaargttatttctaaaactagcaatctggtggggtgaaggaaggttcaaaatgtcattgtttagcctgaaagagtgaagttaaaatttgagggcaagctatccgtgaattacttcctaaaggatacacaggtaagcacagtgaatttgattctcactctttattaattcattgtttttataagtacttagaaaccagcagctttgaaaaccttagtgagcatcaaaaagaaaattcatttaaatgtctctggatggagagtgcctctggaatactctacttgcactttgaatgcatgttgtagt

SEQ ID NO: 126924 - DNA, 601 bp, Human
tctcccttgacctgctgcattcaattagaaaatagaaatgtgttattttcagaggctttgatcatagatagaaggttcttattttttattttatgttggactttattgaatgaacacatgaatgaattgaaatatcctaaggcgtcaagatccagttgagggactgatgcaggagtgggccaactactggctgcagcatgccaatgtgagctgccatttccctccacacttcttttctaccttgtgttctacgtgattatctggaaatgaggtttcttacactttccttacccttttaacmctctccctctgccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaatctctgacagtagacattaatgtgcttgctttcttttct

SEQ ID NO: 126925 - DNA, 601 bp, Human
ggaaatgaggtttcttacactttccttacccttttaaccctctccctctgccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaawctctgacagtagacattaatgtgcttgctttcttttcttttctttttctttttttttttgagacggtctcactctgtcacccaggctgggcacaagtggtgcaatcatggttcactgcagcctccacctccctggctcaagcgatcctcccacttcagcctctggaatagctgggatcacaggcacctgccaccatgcctgactaatttaaaaatattttttgtagagacagcctgtgttgtccaggctggtttcagactcccaagctcaagcaatctgcccgcctctgcctcccaaagt

SEQ ID NO: 126926 - DNA, 601 bp, Human
gccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaatctctgacagtagacattaatgtgcttgctttcttttcttttctttttctttttttttttgagacggtctcactctgtcacccaggctgggcacaagtggtgcaatcatggttcactgcagcctccacctccctggctcaagcgatcctcccacttcagcctctggaatagctgggatcacaggcacctgccaccatgcctgactaatttaaaaatattttttgtagagacagcctgtgttgtccaggctggtttcagactcccaagctcaagcaatctgcccgcctctgcctcccaaagtgctgagattacggacatgagccaccatgcccggccgccttcctttcttg

SEQ ID NO: 126927 - DNA, 601 bp, Human
aaagtaagtattttggtacagctagagaaggatcgacagactttctgtaaagggccatgcacaccatatggtctctgttggaattattccactctgccattgtatcatgaaagcaaccataagcagaatataatgaatgggcatggctgtgttccagtaaaactgtattttcaaaaactgggccaggcacagtggctcacgcctgtaatcccagaactttgggaagccaaggcgggcagatcacctgaggtcaggagttcgagaccagcctgactaacatagagaaaccccatctctactraaaatacaaaattagctgggcatggtggtgcatgcctgtaatcccagctactcgggaggctgaggcaggagaattgcttgaacctgggaggcagaggctgtggtgagctgagatcacaccattgcactccagcctgggcaacaagagcaaaagtccgtctcaaaccaaaaaaaaaaaaaaaaaaaaactggcagcaggctatatttgagttgccagcagggcggtgatatattaaccctgagctacagcgtaaagcagaagtagaggtgtggtcagagatgaggatgaaagataagcagg

SEQ ID NO: 126928 - DNA, 601 bp, Human
ccagtaaaactgtattttcaaaaactgggccaggcacagtggctcacgcctgtaatcccagaactttgggaagccaaggcgggcagatcacctgaggtcaggagttcgagaccagcctgactaacatagagaaaccccatctctactaaaaatacaaaattagctgggcatggtggtgcatgcctgtaatcccagctactcgggaggctgaggcaggagaattgcttgaacctgggaggcagaggctgtggtgagctgagatcacaccattgcactccagcctgggcaacaagagcaaaastccgtctcaaaccaaaaaaaaaaaaaaaaaaaaactggcagcaggctatatttgagttgccagcagggcggtgatatattaaccctgagctacagcgtaaagcagaagtagaggtgtggtcagagatgaggatgaaagataagcagggaccaaattacaatatacctggtaaacaaggctgacaaatttgggtcagtatctttcagagtggaagagacctggtgaatcagattctttcgggatagggtctgggaatttaaattttaataggcttcccagttgagtggctcttatgtgtaa

SEQ ID NO: 126929 - DNA, 601 bp, Human
gctagccacattcatatttatcttaatttttctttaatccgtgggagataacttttctctttatgtttttaagagaaagacaaaacaagccctcctgttttcctttttggctgaggctgctggtacttcttcatctaaatacagtagttctcttaactttaacaacttgaaacttttattagttgccttaattagagcatcaggatgtaaataagtgtaaaaagggtgataaaagaagagttcttaattgcttttcagattttacatccctgagagggagcatttctttgtaacaacttcttttttttttttttttttgtaacaacttctttaaagttgttggtgatagtagtatcagtttaaatcactttcaaaatattgctgatttttctttttcatttcattaaattatcaatcttttaataaatatctcttaaatgcctggctctgtgctggatactatggggttgcaaaagaagtagaaaacacagcttctgtgctcgaggagctcagactacttggggagatagaaaaatgtgtgagtccactaaaaaaaaaataaagcatataaattcagtgggatattaactctgtgttccag

SEQ ID NO: 126930 - DNA, 601 bp, Human
caccttatatggtaaaacaatgaatattaccttgtatggcaaaagatgtgattaaggattttgagaagaggagcttatcctccattatgtggatgggccgtaaatccagtgacaagtgtccttataagactaaggtagagggagctttgatggacagatgaggaagcagcgtgaccactgaggcagattgcagtgatgtggctacaagtcaaggaatgctggcagccaccagaagctggagaggcaaagaatggattcttccccatgacctccagagggaatgcagctccaccagactgcyccagtctggacttccagagccagagaataaatttttgttggtttaagccaccacatttgtggtaatttgttacagcagccccaagaaatgagtatactggatatggtgacttagtaagtagtgctgagccagaggtcttttcttgaactcgagggtgacatggccaggggccattagagaaaatttattatttctataatgatcaggtattacttttttacagggaagaaaaacaccctaaagttattaaaagaaaggttaatctggcagctctttgcaaaatgaattgactagggaagt

SEQ ID NO: 126931 - DNA, 601 bp, Human
ttatagttttatctctgacatttaggcctttgttctattttttttaaatttgagacagggtctcactctgtcatctaggccggactgcagtggcacaaacccagcttcactgcagtcttgacctcctgggctcaagagatcctctcgccccagcctcccaaagtgctgggattacagtgtgaaccactgcacccggcttgttcaatttttaatttttgtatatggtacgaggtagtgatccaacttaattattttgcaagtggctatccacctgtcccagcaccctttattgaagagactrttctttccccatttaattgctttggcaccttgtcaaaaatcaattgaccataaacgtaaggatttatttctggattctctatgcttttccattggtctgtatgtctgtccttgtgccagtattacactgtcttgattactgtagctttctaataaattctgaaatcagaaagtgtgagccctccaatttgcgtctttttcaagattgttttggttattctgggtccctcgtatttccatatgaactttaggattaacctgccaatttcagcaaaaaggtagctgagattttgataggaat

SEQ ID NO: 126932 - DNA, 601 bp, Human
caagtggctatccacctgtcccagcaccctttattgaagagactattctttccccatttaattgctttggcaccttgtcaaaaatcaattgaccataaacgtaaggatttatttctggattctctatgcttttccattggtctgtatgtctgtccttgtgccagtattacactgtcttgattactgtagctttctaataaattctgaaatcagaaagtgtgagccctccaatttgcgtctttttcaagattgttttggttattctgggtccctcgtatttccatatgaactttaggattarcctgccaatttcagcaaaaaggtagctgagattttgataggaattttgttgaaactgtagatcaatttgaggagtattcctttcttaataataataaatcttccagcccactaacatgggctgcctttccatttatcagatcttctttaatttcttttaatgatattttgtggtttttagtgcacagatttgacactccttatgctaaatttattcctgagtattgtattcttttttaggctactgtaagtggagtcattttcttaatttcattttcagattgttcattgatagtgtgta

SEQ ID NO: 126933 - DNA, 601 bp, Human
tgtgatactaatagtgatttcaaacaaatcagagtttttgtttccaaacagatattgaccctttgagttttgctatctgggaaggcacctacatttattctaatgatttgccagtgtttgaattttgcatcttctcttttagaattgcctttaaagccttagcaatattcctgtcaggacactaaagatataaaatgtttattcttcgagggcgattttcagaaagagctagacatcagtcattcagaaccatgtcagaaaaataaagtggataatcagattgggaatttaaagaatagtrtatagttctaacatattgtgttatgccttataaaacttataaaaacaggctccaatactacttttcagaaaatctttgaactgtggcattattggaataaatgtaccccctttcaaggtgactgcattaaagaacacttacttgatgtgtaagttcaggttcaagtgtttagtaattcatcatctttaccatatagttacatcttgcataaaaacttgggaaggtttcaaagctaaacaatgaagaagattaaattactttggcagtcacctaataattgtgcctaggcaggtaattgag

SEQ ID NO: 126934 - DNA, 601 bp, Human
tgatttgccagtgtttgaattttgcatcttctcttttagaattgcctttaaagccttagcaatattcctgtcaggacactaaagatataaaatgtttattcttcgagggcgattttcagaaagagctagacatcagtcattcagaaccatgtcagaaaaataaagtggataatcagattgggaatttaaagaatagtgtatagttctaacatattgtgttatgccttataaaacttataaaaacaggctccaatactacttttcagaaaatctttgaactgtggcattattggaataaatgtaccccctttcaaggtgactgcattaaagaacacttacttgatgtgtaagttcaggttcaagtgtttagtaattcatcatctttaccatatagttacatcttgcataaaaacttgggaaggtttcaaagctaaacaatgaagaagattaaattactttggcagtcacctaataattgtgcctaggcaggtaattgagtaacaggaatattgagaggttgctttatgacatcagtgggagcagggagaaatctactgagacagttgaggctttctgtttgttcctttgggctcaacaaatt

SEQ ID NO: 126935 - DNA, 601 bp, Human
acgtgactgttaacactaagggattgtttatgagagaagaaaatggaaaataacccagatggacaataataaaggactggttaaataaatgttactacatccatgtattagactacttcgtagccagtaaaaatcacaatgcacatatatttactgatgtagaaagatacaatatattgctaagtagacaaagcaatataacaatatgtaactatgcatagcataccatttgtgtttaagtgactttatttatttatttttattttttattttttatttttttgagatagagtcttgctcygtcgcccaggctggagtgcagggcgcgatctcagctcattgcaagctctacctcccaggttcacgccattctcctgcctcagcctcctgagtagctgggactacaggtgcccatcaccatgcccggctaattttttttgtatttttagtagagatggggtttcactgcattagtcaggatggtctcaatctcctgacctcatggtccactcgccttggcctcccaaagtgctgggattacaggcatcagccactgcacccagccaagtgattttgtttattttacatgttttattcactc

SEQ ID NO: 126936 - DNA, 601 bp, Human
tttttattttttattttttatttttttgagatagagtcttgctctgtcgcccaggctggagtgcagggcgcgatctcagctcattgcaagctctacctcccaggttcacgccattctcctgcctcagcctcctgagtagctgggactacaggtgcccatcaccatgcccggctaattttttttgtatttttagtagagatggggtttcactgcattagtcaggatggtctcaatctcctgacctcatggtccactcgccttggcctcccaaagtgctgggattacaggcatcagccactgyacccagccaagtgattttgtttattttacatgttttattcactcatccattcagcctttgggcagtggctgtaaaaatgtgaaagagagtagataaaacagaattgaaactccattattgtgagctgagggaggaagtgacagaagagagagatgatattactgtgatcattacacaactgggacaggcttctacaggtttttagaaagtaagacaacaaggttggaacatgaagaggagggacatgaacagtgttgtatatattgtccagatatatgctattcagtagatttttttgat

SEQ ID NO: 126937 - DNA, 601 bp, Human
gacaagtaaaagttaatttaaatatgttttaaatttatatttatatttaaaattaaatatgtttcagtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctgtaagtgccatcaatgggagaatttatatttaagagagtgtctcggttgggcgcagtggctcatgactgtaatcctagcactttgggargccgaggtgggcagatcgcttgagcccaggagttcaagaccagacagggcaacatggcaaaaccccatctctacaaaaaaatacaaaaattcgctgggcatgggggtgcatgcctgtaatcccagctatttgggagactgaggtgggaggatcacctgagcccagggatgttgaggctgcggtgagccatgatcatgaaaccctgtctcaaaaggggggaacaaaaagagggtatctcaaggtagggtatctcagggtagggtttctgttgaccacttttcttagtatgtctttaaataa

SEQ ID NO: 126938 - DNA, 601 bp, Human
ttcatacctgttttgaattcatttgtatgtatacctaggagtcaaattgctgggtcatatgacaattctgtgtttaatttttgaggaatagtcaaactgttttccacagtacctgaaacattttacattcccaccagcaatgtatgtctgctccaatttgtccacatctcatcaacttattttccattttttaaaactatagccatcctaatgggtatggagtggtatctcattgtgtttggtttgcatttccctaatgcctaatgatgctgaacatattttctatgcttgttggccattmgtatgtattctttggggaaatgtctaggtcccctgctcatgttttaattaggttgtttttgttgttgagtggtaacagttctattgggggaacctgcccccaatatttcaatgtaggttctttctattttccataaatgtcggccaactgagaaataaagagagacagtacaaagagaggaattttacagctgggccgccaggggtgacatcacatatcggtaggaccgtgatgcccgcctgagtctcagaccagcaagtttttattaagggtttcaaaaggggaggtggtgtaagaaca

SEQ ID NO: 126939 - DNA, 601 bp, Human
gccaaatgcacagttatgaagatttacctgcctcatgttttctaagaattttatggttttaactcttttatttgggtgattgatccattttgaattaatttttctatatggtataaagtgggagtccatatgttgcatgtgagtatctagttgtccaagcaacatttgttgaagaaactggaaagactttaaaatgaatatgtcctatgttgatttcttcattattgtgattgctctgggagcactttaaatagctataaagaaatgtcacaaacctttattattattattattattattwtttttttttttttttttttttttttttttttaggtcaacctctgggagcacagaacaatgtttcaatatttttttttttgagaagaagtctcgctctgtcacccaggctggagtgcagtggcacgatcttggctcactgcaacctctgcctcccaggttcaagcgattctcctgcctcagcctcccaagtagctggggttacaagtgtatggcactgcacccggctaattttttgtatttttagtagagacagggtttcaccatgttggccaggctggtcttgaactcctgacttcaggt

SEQ ID NO: 126940 - DNA, 601 bp, Human
agaggagagaaatcctggtaatggaatacagttggctatgagaaaaaaattccctaggaaacagttcctctagtttaacaactcagatttttttttttttttttcccctttgcgggtttcctaggctaagatagaggcagagagcaaagagataatcagggtaatagtttctgctcggacacattctacaaactttgagtagatggaatccggccaggcaggaggtgagcagctctgggatcactctgcaggaaaagaatagagggagaaagatctcagaggacccgaaggtactgggagyggagggggagtgggaaacaaggggcaggggcaggagggaggacacggtgacagctactattttacccagatgctgcaaaaagcccttctgagttttgggaattagatctagaagcccatcccttttctcttgatgtgtgggcggtcagttccactctggtgtgccttgagttgctcagaaacctgggacagatgaaagttgaatgtgcactgagagtgcaccttccactaccgactttatggataggatttgggaatagcatagatgctgttccatctggtcccttaaacatccatgggg

SEQ ID NO: 126941 - DNA, 601 bp, Human
ccggccaggcaggaggtgagcagctctgggatcactctgcaggaaaagaatagagggagaaagatctcagaggacccgaaggtactgggagtggagggggagtgggaaacaaggggcaggggcaggagggaggacacggtgacagctactattttacccagatgctgcaaaaagcccttctgagttttgggaattagatctagaagcccatcccttttctcttgatgtgtgggcggtcagttccactctggtgtgccttgagttgctcagaaacctgggacagatgaaagttgaatgtgcrctgagagtgcaccttccactaccgactttatggataggatttgggaatagcatagatgctgttccatctggtcccttaaacatccatggggaaggctggcaaatagctttattttattttttgagatggagtttcactcttgttgcccaggctggagtacaatgttgcgatctcagctcaccgcgacctccacctcccgggttcaagcgattctcctgcctcagactcccgagtagctgggattacaggcatgcaccaccactcctggttaattttgtatttttagtagagacggggttt

SEQ ID NO: 126942 - DNA, 601 bp, Human
agggaccacgggaggggtgagggcggagggggcacacaccctccaggtttgcatgccggtgtctgctaggtgagggaaggaatgaggggaaggaagggccgggagaggcgctacgtgggaaacaagggacctctccaagggcgtggagaggtgagtgcctcaagggcagaatggaatgagcagaaccctttggtttcccgggaagagctctcaaccttgagtcaggaagactgatttctcctcccagctccgcaggaacatggaactgtgatcaggcaaggggctgggcctgagttcctcrtaggggtcttggggaggcccccagtttcccctcctgtgtttcgattctggcccctctccatctgcacacgtcgccttggaagttccctttagaactggcttttttgtattctagtcttgaatggtaatcgaagacaacagggtatgaagaacaattttgacggcgtgattttattcttctcattctgggtccactactatttaaagtcccaagattaagctgaggaattaatatggtggtatagtaaacaataaattgaggagtatttttgcttgaggaatctttgacttcctgagtagt

SEQ ID NO: 126943 - DNA, 601 bp, Human
gggaaggaagggccgggagaggcgctacgtgggaaacaagggacctctccaagggcgtggagaggtgagtgcctcaagggcagaatggaatgagcagaaccctttggtttcccgggaagagctctcaaccttgagtcaggaagactgatttctcctcccagctccgcaggaacatggaactgtgatcaggcaaggggctgggcctgagttcctcataggggtcttggggaggcccccagtttcccctcctgtgtttcgattctggcccctctccatctgcacacgtcgccttggaagttcyctttagaactggcttttttgtattctagtcttgaatggtaatcgaagacaacagggtatgaagaacaattttgacggcgtgattttattcttctcattctgggtccactactatttaaagtcccaagattaagctgaggaattaatatggtggtatagtaaacaataaattgaggagtatttttgcttgaggaatctttgacttcctgagtagttcagggtgtttgcttcttttattctcatttttattgcactgtggtcagactatatggtctgcacatttcttattttctaattccag

SEQ ID NO: 126944 - DNA, 601 bp, Human
gacaggagatggggcaagaatgaggatgagggggagaaagaaagacatctggaagttttgtacatgaagctccccaggtgggtgaacggtggagctgaacatgagttcagaccacgtagttcagcagcgtgtcctgcattttatagatgagaggaggctttgagaggtcaagtgacttacttgttcacacagcctggcagctgaaaccccttctccctaaaggggaggaggaacagagggcttggagttgacccaagaaatgacttcgccctcctcttcctttcctccctcttcctcttgytcttattcttcccttccctctccctcttccccactggtttttctaaacctttcttttggggccgggcacagtggctcacgcctgtaatcccagcactttgggaggccgaggcgggcctgaggtcgggaggtcgagaccagcctgaccaacatggagaaaccccatctctactaaaaatacaaaattagccgggtgtggtggcacatgcctgtaatcccagccactcgggaggctgaggcaggagaatcacttgaacctgggagatggtggttgcagtgagctgagatcatgccattgcac

SEQ ID NO: 126945 - DNA, 601 bp, Human
actcgggaggctgaggcaggagaatcacttgaacctgggagatggtggttgcagtgagctgagatcatgccattgcactccagcctgggcaacaagagtaaaaactccgtctcaaaaaaaaaaaaaaaaaaaaaacaaaaaaaaaacaacccagaaaaacccaaaaaacaaacaaacaaaagaaccaaaaacccctttctttcatgcctagattcattccaaaaaggtttaagacagcaacaagtgattccaggatctcagctgtgggcatccttgtgttactggatggctgtgtgttaaytgttagcagctggaataagtgaagagggtctcgtcctcatactcaaagtcctttgctcatgcccaaggccagaggctactcatgctgaaacattaccatctccctccaaagtgcagggtttagtcactgagtactgggtggagcacatgactggatcccagttaatccctcccagcttaccagtaaaacctcaggattcatgctttcctgggagccacctgcggccactaagataggagcggggttcagacatggccaggcgctcctaatctcagacccaaagtgcaatttttggcagcc

SEQ ID NO: 126946 - DNA, 601 bp, Human
aaaaggtttaagacagcaacaagtgattccaggatctcagctgtgggcatccttgtgttactggatggctgtgtgttaattgttagcagctggaataagtgaagagggtctcgtcctcatactcaaagtcctttgctcatgcccaaggccagaggctactcatgctgaaacattaccatctccctccaaagtgcagggtttagtcactgagtactgggtggagcacatgactggatcccagttaatccctcccagcttaccagtaaaacctcaggattcatgctttcctgggagccacctkcggccactaagataggagcggggttcagacatggccaggcgctcctaatctcagacccaaagtgcaatttttggcagcctgcatgagaaggagggtgggaggaaaggtggctagaaccaagggtagcagcctgggggcttgagaggaaaccaggcacagcccatcctaccctgtctcacgagcagcccgtcctcctcctgactccccttaccccacacaccgagcgccattctcttgctgcctcatctattctggttaggtacttactgagcatcaggtgctaggcaagtggctggggag

SEQ ID NO: 126947 - DNA, 601 bp, Human
tagcagctggaataagtgaagagggtctcgtcctcatactcaaagtcctttgctcatgcccaaggccagaggctactcatgctgaaacattaccatctccctccaaagtgcagggtttagtcactgagtactgggtggagcacatgactggatcccagttaatccctcccagcttaccagtaaaacctcaggattcatgctttcctgggagccacctgcggccactaagataggagcggggttcagacatggccaggcgctcctaatctcagacccaaagtgcaatttttggcagcctgcrtgagaaggagggtgggaggaaaggtggctagaaccaagggtagcagcctgggggcttgagaggaaaccaggcacagcccatcctaccctgtctcacgagcagcccgtcctcctcctgactccccttaccccacacaccgagcgccattctcttgctgcctcatctattctggttaggtacttactgagcatcaggtgctaggcaagtggctggggagagacaacgtttaatgactcagtctccgcctgcacagagcctttgagtctagagggagacacagacttactgacaggctgggtt

SEQ ID NO: 126948 - DNA, 601 bp, Human
ttttcagtttttcagaaccctgtccatctcttccaatcccctggtgtctttcccttacctgggtcattctctgggcaacatggcaccctttcagtgcagacttgtttattaataactccagtgagttttattttcctcttactaaattcaaagtactcagaacattttagacttgttgagcaatccctatcagcttagggatggggtgggggaggctaacagaggtgaattaagaatgataattccaaactaattagtcatccagattaaaaaaaatagactaagatggttttttttttttaaagacatttgtgagagaattgggaaatatgaatcctaactagatagttgataataaaggattcttgttagttattaaagtgtggttaagaaggagtttttatcttttagagagacgttctagactggacatgggggctcacacctgtaatcccagcactttgggaggccgagagggggaggatcctttgaagccaggagttcaagaccagcctggggaacatagcaagactccatctctaaaaaaataaagattaaaaaaattagccaggtgtggtggcatgcgcttgtagtttcagct

SEQ ID NO: 126949 - DNA, 601 bp, Human
tagtggtgctcggtaaatatttgttgaatgaatgactacataaaataaagttgagattggagagccaaattttattaaaattcgggaagatcgatttaagctatatctggtgtcactttaacacactatacataatatcgtgataatatatattcacatgatattcacatatgtatcatacatatgtatgtatatgtatatattgcatatatacatatgtacaatcttcctacttgctatatgaattaaataattttggtaagatgactatctcttctagtggaaaagaaaattttgtggkttttttttttttttttttgagatggaatctctctctgtcacccagcctggagtgcagtggcatgatccccgctcactgcacctctgcctcccgggttcaagcaattcttctgcctcagcctcccgagtagctgggattacaggtgcgtgccactatgcctggctaatttttgtatttttagtagagacagggtttcgccatgttggccaggctggtctcaaactcctgacctcaggtgatctgcccgccttggcctcccaaagtgctggaatggcataagccactgtgcccggccaagaa

SEQ ID NO: 126950 - DNA, 601 bp, Human
ttcctgctgcaacatagttctcttctagtccgttcaaaactttttattgccacgtgaacaatctcattgggaaacaaaaaactcaagaaaaaaaatcccatgcccaaaaagcatggaacacaacaaaaagaatagtgtagaagacacttaaataagcaataaaataatttgaatgaaattgttgacaaactggactatagttatgtctagccttgttgaatctcaacatcttattcgacattgactttggaatttgtgagccacctgttttgaggaaatggggacactcctttctcttttycgatttcccaatttatcttcccacttgtgccctgaatcctgaggacttagatttcctaggggtatggtcaaggagctgggtctaaaattcacacgaagattgtaggggcagagaaagaagcctttctcctgacaaaggacagatatatgggaagtaaactgtaatacagctagtggcttcctgattatccgaatgagtaagtagatttctcactttgtggatggtccgttacctgggatctcctatcctcctggggctgaactaggagagtggaaccagagtcataatgaggcatctgat

SEQ ID NO: 126951 - DNA, 601 bp, Human
tccgttcaaaactttttattgccacgtgaacaatctcattgggaaacaaaaaactcaagaaaaaaaatcccatgcccaaaaagcatggaacacaacaaaaagaatagtgtagaagacacttaaataagcaataaaataatttgaatgaaattgttgacaaactggactatagttatgtctagccttgttgaatctcaacatcttattcgacattgactttggaatttgtgagccacctgttttgaggaaatggggacactcctttctctttttcgatttcccaatttatcttcccacttgygccctgaatcctgaggacttagatttcctaggggtatggtcaaggagctgggtctaaaattcacacgaagattgtaggggcagagaaagaagcctttctcctgacaaaggacagatatatgggaagtaaactgtaatacagctagtggcttcctgattatccgaatgagtaagtagatttctcactttgtggatggtccgttacctgggatctcctatcctcctggggctgaactaggagagtggaaccagagtcataatgaggcatctgatgaggggaggggtagggagagagagaaag

SEQ ID NO: 126952 - DNA, 601 bp, Human
cctggttgtatgatgttgggcatgtaacttgacttctctgcctcagtttcctcatctgtaaaataggataatagttttacctcatagggttgctatgaaatgaagtaagtaatgtatatatagagtgattagaagtaaaaattcgaggctgggcggggtgactcaacacctataatcccagcactttgggagggcaaggcaagaggattaattgagcccaggaatttgcgaccagcctgggcaacatggtgaaaccccatctctacaaaaatacaaaaattagcggggtgtggtggcacaygcctgtaatcccagctactcaggaggctgaggtcgggggaggatggcttgagcccaggaggtggaggttgcagtgggtcgagatccagcctgggtgacagagcgaggctctgttccccccatccccccaaaaaggagtaaaaattggagcaatactaaaaatgaacatgttagctatgaagattattttttgttggattacccgctatttatgtgccatccaggacgttcctctttacaggtagccaatttagagctggttatgacagacaagacccctttcataacttttcggaattag

SEQ ID NO: 126953 - DNA, 601 bp, Human
aggctctgttccccccatccccccaaaaaggagtaaaaattggagcaatactaaaaatgaacatgttagctatgaagattattttttgttggattacccgctatttatgtgccatccaggacgttcctctttacaggtagccaatttagagctggttatgacagacaagacccctttcataacttttcggaattagtggagccatctttacacatcttaaggaggaggccgggcacggtggctcacacctgtaatcccagcactttgggaggctgaaggagtttgagatcaacctgaggtygggagtttgagaccagcttgaccaacatgcagaaaccccatctctactaaaaatacaaaattagctgggcatgttggcgcgtgcctgtaatctcagctactcaggaggctgaggcagaattgcttgaacccaggaggcggaggttgcggtgagccaagattgtgccattgcactccagcctgggcaaaaagagcgaaactccgtctaaaaaaaaaaaaacaaaaactcaaaaacaaatcttaaggaggaggggcagaataattctgaaccacagagcctaagaagaggacccagccgctg

SEQ ID NO: 126954 - DNA, 601 bp, Human; identical to SEQ ID NO: 29170

SEQ ID NO: 126955 - DNA, 601 bp, Human; identical to SEQ ID NO: 29171

SEQ ID NO: 126956 - DNA, 601 bp, Human; identical to SEQ ID NO: 29172

SEQ ID NO: 126957 - DNA, 601 bp, Human; identical to SEQ ID NO: 29173

SEQ ID NO: 126958 - DNA, 601 bp, Human; identical to SEQ ID NO: 29174

SEQ ID NO: 126959 - DNA, 601 bp, Human
ttgggagctctgtatacagctgcactgtttaaactacctgtccaccaggagattataatctagcagcactctccttgttttcaggggtgcagtccagttagcccatgttagcactgatataaatttgggggaagacagcaattatgctcttctcactcattctgtattctaggtacccaactccagaggatctaactggccaaaagcaatggtacagctctgggcctttgtgcatgctcttctctgttgtgtgcactcctacacatccctgaggccccagctcaggacactccactgaagkccccatcatagccccctggcagaattgactgcctctgtgctccctgcgtagcgcatttatatctattctgcacagatcttgttcttttacacagtagtcccccttatctatagtagataccttccaagccccccagtggatacctgaaacggtggacaaaactgaaccctgtatctactacgttttttcctatacatacatacctatgatatagtttaactttatcaattaggcacagtaagagatgaacaacaataataaaataacagcaattataacaatatgccagcattgctaagc

SEQ ID NO: 126960 - DNA, 601 bp, Human
tattgggagctctgtatacagctgcactgtttaaactacctgtccaccaggagattataatctagcagcactctccttgttttcaggggtgcagtccagttagcccatgttagcactgatataaatttgggggaagacagcaattatgctcttctcactcattctgtattctaggtacccaactccagaggatctaactggccaaaagcaatggtacagctctgggcctttgtgcatgctcttctctgttgtgtgcactcctacacatccctgaggccccagctcaggacactccactgarggccccatcatagccccctggcagaattgactgcctctgtgctccctgcgtagcgcatttatatctattctgcacagatcttgttcttttacacagtagtcccccttatctatagtagataccttccaagccccccagtggatacctgaaacggtggacaaaactgaaccctgtatctactacgttttttcctatacatacatacctatgatatagtttaactttatcaattaggcacagtaagagatgaacaacaataataaaataacagcaattataacaatatgccagcattgctaa

SEQ ID NO: 126961 - DNA, 601 bp, Human
ctgatattaataactggcatccttattgcatttgtgtccagcctatgcacaactatgtcagtttccctactcaaaatcacagcctcactcctaatactccctattcctcactccccttccctgcttgcttttcttcacagcactgatcactatctgatccatgatacattttatttgttcattagccaataaaacataagttccatgagggcagagaattttgctggttttaatcttttatcccattgcctagaagagtgcctggcacatagcactcaaaaaacagtttttgtcgaattawttttaaattgggtgatttcgctaagaatctggatgtatggttttccttaagaatttggcaacactgtttcatatatcactgcatagcaacaagtggctggaactgccgtttagagatggggacctgagttcactctctgatttgcctcagtccccactatgccttatagcctaaaacagccagcttcatccatttccattacctgcctggttgctgcaggtattcaaatgtgggacctctgatcagggctaaactgttcattctacatagagctggggaaacggagataagaacaggtga

SEQ ID NO: 126962 - DNA, 601 bp, Human
taggttactgggtagaagctagaatcatggtggcctgtgtagcggaagccaaagccacagagaagctcctagtagtatggatctgatggggtggagaaggaggagaaatactctggtttctccctttttatctcccagtagagactcccactgagcaaacgtagctgggcgccggctgacatctggcctgggaaacaggccgaatgggtcagcttccactccacaggaagacagcagagcagggaatgggtgaggaaggaatctgagggcacaggccacgaaccagcccagacccctctcygcctgtgtgggccatcatcattaatccaaaaagacaaagtgagccccattccatgacaaaagcaagaacacatggattcttaaagtgttagaatcacaggaaccttcatcagggctgttaggagaaaggctgtggttctgagtagggcaactacttgatggggaggccagtgatgctgcagaccttatcaggtgcctttttcattgcccagggaggcggatagacagctctctgtgttggcttgggtgggtcctttggatgctcacagcaggactgatattaataactggcatccttatt

SEQ ID NO: 126963 - DNA, 601 bp, Human
gggacagagaggcaacctagaggttagtaagcaccctaggagacacagagggagaattacctgttacctaagttcagatacctaggttactgggtagaagctagaatcatggtggcctgtgtagcggaagccaaagccacagagaagctcctagtagtatggatctgatggggtggagaaggaggagaaatactctggtttctccctttttatctcccagtagagactcccactgagcaaacgtagctgggcgccggctgacatctggcctgggaaacaggccgaatgggtcagcttccaytccacaggaagacagcagagcagggaatgggtgaggaaggaatctgagggcacaggccacgaaccagcccagacccctctccgcctgtgtgggccatcatcattaatccaaaaagacaaagtgagccccattccatgacaaaagcaagaacacatggattcttaaagtgttagaatcacaggaaccttcatcagggctgttaggagaaaggctgtggttctgagtagggcaactacttgatggggaggccagtgatgctgcagaccttatcaggtgcctttttcattgcccagggaggcg

SEQ ID NO: 126964 - DNA, 601 bp, Human
ccatctccaaccaagtactaacattgaacagttttataattggttatctcatttgaacttcaaaacaatctattaatatatgaactattattttcttccacaattagcttcagaggggctaagttggcctgtgaccacacagctagaaagaatgaagctgagatgagcactgatataatgctattactatatttgtagggtatgtatactactttacaaaatgttttcatggttttaaagaatttaatacttatagtaactctggaaatagatggaaaagatatttttatactcattttayagctgtagaaacaggttcatttgggttaaatgatttgctttagcctggtaccaatatcccatatggccccatattcccatcaaacactgagagaagatgcttattagggagttctccttatcccagaggccccaaattaacggcaagtgacactgtatcaataagagtcaaacaggaaacagaaactactagagtatttagagcagaagcacttcgatgcaagggattggttgcacagataacagaggggctgagatgccagcaggggacagagaggcaacctagaggttagtaagcacc

SEQ ID NO: 126965 - DNA, 601 bp, Human
aagatctcactggagaaagagctaactggctctttcctttggtctttttcttcttttattcatttaaccaacaactactgagtatctaccacgtgctgaacattgttacaggtgctataagggaagatgccaggaaaacagaaggttatcatctaatgatatttttagggggcaaggagtgccagggcagtatgggaacacaggaaaggaccacttaggttagtttatggggcatgggtgtatgtgataacatgtttggggaggtcaagctgactttgaggtggtcacagatcacccaacyggacgttcagtcactactttattaattcatggaataaacattgtcgaaaaactttgccaggtggtacagatttggagattaatatgatagggataatcaggaggatggtgaggagtattacacaaattattgtacaatgcagtaaatgctctgatcatttggggaggatattccaggtagtgggtaccataagagtaaacgaggaggggtcaagaacagtatgatgactgtgagtacaaatattacaaatagttgtggctggagcaaagactgtcaagcaggacacaaaaaaggtgttct

SEQ ID NO: 126966 - DNA, 601 bp, Human
attaggctcattctagtaggaggactgcaattcaaggaatcagagttcatttttcccttggcctccttgggggactggatccaggacctctatggataccaaaatccatggatgctcaagtccctgatataaaatggtgtagtattttgcatataacccacacacatcctcatacatactttaaatcatctctacattacttataatacttaatacaatgtaaaagccaagcaaatagttgctactctctgtgcacacacacacacacacacacacacacacacacaaacacacacacatrtattttatttatttatttatttttgagacagtgtttcactctgtcacccaggctggtgtgcagtggtatgatcatggctcactagcctcgacctcctgagctcaagcgatcctcctacttaggcttcctgagtaagtgggaccgcaggtgcataccaccatgccctgctaattaaaaaaaaaaattttttttttttttggtaaagtctccctatgttgtacaggctggtctcaaactcctgggctcaagcaatcctcctgtcttggcttcccagtgttggcattataggcatgagccaca

SEQ ID NO: 126967 - DNA, 601 bp, Human
tgtgaagctcccaaaattaggctcattctagtaggaggactgcaattcaaggaatcagagttcatttttcccttggcctccttgggggactggatccaggacctctatggataccaaaatccatggatgctcaagtccctgatataaaatggtgtagtattttgcatataacccacacacatcctcatacatactttaaatcatctctacattacttataatacttaatacaatgtaaaagccaagcaaatagttgctactctctgtgcacacacacacacacacacacacacacacacacaaacacacacacatatattttatttatttatttatttttgagacagtgtttcactctgtcacccaggctggtgtgcagtggtatgatcatggctcactagcctcgacctcctgagctcaagcgatcctcctacttaggcttcctgagtaagtgggaccgcaggtgcataccaccatgccctgctaattaaaaaaaaaaattttttttttttttggtaaagtctccctatgttgtacaggctggtctcaaactcctgggctcaagcaatcctcctgtcttggcttcccagtgttggcatta

SEQ ID NO: 126968 - DNA, 601 bp, Human
caaaactgtgaagctcccaaaattaggctcattctagtaggaggactgcaattcaaggaatcagagttcatttttcccttggcctccttgggggactggatccaggacctctatggataccaaaatccatggatgctcaagtccctgatataaaatggtgtagtattttgcatataacccacacacatcctcatacatactttaaatcatctctacattacttataatacttaatacaatgtaaaagccaagcaaatagttgctactctctgtgcacacacacacacacacacacacacacacacacaaacacacacacatatattttatttatttatttatttttgagacagtgtttcactctgtcacccaggctggtgtgcagtggtatgatcatggctcactagcctcgacctcctgagctcaagcgatcctcctacttaggcttcctgagtaagtgggaccgcaggtgcataccaccatgccctgctaattaaaaaaaaaaattttttttttttttggtaaagtctccctatgttgtacaggctggtctcaaactcctgggctcaagcaatcctcctgtcttggcttcccagtgttg

SEQ ID NO: 126969 - DNA, 601 bp, Human
aacaaaactgtgaagctcccaaaattaggctcattctagtaggaggactgcaattcaaggaatcagagttcatttttcccttggcctccttgggggactggatccaggacctctatggataccaaaatccatggatgctcaagtccctgatataaaatggtgtagtattttgcatataacccacacacatcctcatacatactttaaatcatctctacattacttataatacttaatacaatgtaaaagccaagcaaatagttgctactctctgtgcacacacacacacacacacacacacacacacacaaacacacacacatatattttatttatttatttatttttgagacagtgtttcactctgtcacccaggctggtgtgcagtggtatgatcatggctcactagcctcgacctcctgagctcaagcgatcctcctacttaggcttcctgagtaagtgggaccgcaggtgcataccaccatgccctgctaattaaaaaaaaaaattttttttttttttggtaaagtctccctatgttgtacaggctggtctcaaactcctgggctcaagcaatcctcctgtcttggcttcccagtgt

SEQ ID NO: 126970 - DNA, 601 bp, Human
attcattacagcagaattataaattctgttcaaaacaggaatatgtctgtgtaaattacagacacatgatacaatataatgtagctaggaattatgcttaagaagactctggtactagtggaaaataattatgaaataataactaacagaagcaggatatgtaattataggaacactaagattacattaaaaagccctaaaaaatacattcaaaagacaacattgattgtattgaatgggggaattagggaatactgttttgttattttaaaggttttctttagtgagttttataattctyatacatattttcatttaaaaaaatgttaagacagtgttaagaaggaaaagatttcttcctgacctcctacaggttaacgtatcttccaaagcctgactactttagtcctagtaaattttttttttaaagcaagttttttaagtaagtaaaggaataaaagaatggttactcaatagacagagcagctcctagtaaatgttactaaggctaacacatgtttttagctctctaaattatcagcttgagaaatatcctaaaaattaaacacatctcttttttttcctcttgctttctgaccca

SEQ ID NO: 126971 - DNA, 601 bp, Human
tgtataatccctttgtaaacatctcttcacaaggtcataaagaaggaagactgaatgaaggacgccaggctttcattttagaattaattttgtcattgaatgcactcactgcattatttgatagagtacttttgcatttgaagtagtacatttgccttctaccatctcattaacattgctttcaacagaatcagaaataacacaaaccactgcagggtaattttgaatgctcatttgactatgcagtgacatcaagtggcgagttgaggaatgatcatatgctgtgtgagaactccgtgtyaaaaattccatggagccaggctagacaccacatttggcactttcagctgtttagatttcagagaattaaaaggaaatggtcaccgacctgcctttgatagtacccgtataccccttcccaccataagaaaccagcgttccttagagaaatggctaattctagctctagggcaagaaatgctaagatgtgctcaaaacatctcattataccagcaagccagggagccatcaacgactactggagctgtgtcaaaaggaccaacaaaccaacttgaagaggctcccgctggccaacagtggg

SEQ ID NO: 126972 - DNA, 601 bp, Human
ttgagcccctaaaagaaagaaacgtgaagtctatacattatctttgtaagcctgtgaatacgtctttatctataaacgcctcatcttgaaagaagctctcctccagggcagtgttttatctcacccaatgtcagagctcagtattctgaataaagaatttggttaccatgggaactgaggaatctcaaacatacacacacccctgattccagaaacacaacaggagctgactcaaaaggtctggaagagttagaaaggggaaagatgacacaagcaatagtgaaggctagtggagggaagyggggctttcgtccaaggaagcaaaaaatcataatgtgttattttttagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcac

SEQ ID NO: 126973 - DNA, 601 bp, Human
gggattacaggtgtgagccaccacgcccggcctggaaagggttttaaagtagaggactggcacgatccaattgtgctttggaaggatccctctgctggcagtggagggacaggggaaatggcaaggggttgagagatgtggggccaccggagcccaggaacagccaagtgtgagatgatgaaggtgggagaaaggcagatttgagaggtacctgtatgtggagggaggtaagagagaggaaggaagagaggattctccagggcttccagttaagcctctgggtagaagaagatgccgctarccagaatagggattaaaggctgaagagtaacattaggcaggaggggcagctgtaggggtgttcatgatttagtttggggggcatatgaatattaagggccctctgtgaaatacattcatgcaacaattattatctaaatgtgtgtctgaccatgtaaaaatctccttagacttgggacagaactggagtcagagataccaatttgggaaggagaaggatctagtgacagaaacttgggagtgcccagtgggtaggtactggctataatcatggtaagaagtgacatgtggtagagatgtt

SEQ ID NO: 126974 - DNA, 601 bp, Human
gggaggctccgtggggatgagtgtcagtgcccacgagatccactcaggcctcaactgtgtgtcctgagcacatgaagtcagctcttctgctgggacagccaccaagggattctccacacccctcaccgctgggacaggcagaggcacagcgaaccaggtgtccagcgtaactggggcactgggtggtggccgcctctgtgtgtggaaacacgaggtgcttgctgcagtttcctctgtgtgcttatccgttagctgccacccaccgggagggaagtgaaatctcacctcaacaagtgagtcygcagagcgagaaccgtgcgacagtgcgtctgccaatacctggaatgtaggtgttcgttgcagtgtggccttcccagccggcctctcagcacacccggccaggcagccagtgttcccagaggacacgctggggccagacgtggaggaccccggccacctcggggagggaaagagaccaagaaaagaacctctgtagccttgcttctgagagtgcaggtttgttacaggtaaggatcaggaaggtaaacatagggcagtgaagcagggttgtgtcctctgcggccctgaattagaataagcc

SEQ ID NO: 126975 - DNA, 601 bp, Human
cagccaccaagggattctccacacccctcaccgctgggacaggcagaggcacagcgaaccaggtgtccagcgtaactggggcactgggtggtggccgcctctgtgtgtggaaacacgaggtgcttgctgcagtttcctctgtgtgcttatccgttagctgccacccaccgggagggaagtgaaatctcacctcaacaagtgagtccgcagagcgagaaccgtgcgacagtgcgtctgccaatacctggaatgtaggtgttcgttgcagtgtggccttcccagccggcctctcagcacaccyggccaggcagccagtgttcccagaggacacgctggggccagacgtggaggaccccggccacctcggggagggaaagagaccaagaaaagaacctctgtagccttgcttctgagagtgcaggtttgttacaggtaaggatcaggaaggtaaacatagggcagtgaagcagggttgtgtcctctgcggccctgaattagaataagcctcacaggtctcacccaggaacggaaatctcccctccaggttctgaaccagcattcaggggccccacccagggcttctgtcaacataagcataaaa

SEQ ID NO: 126976 - DNA, 601 bp, Human
ccagtgttcccagaggacacgctggggccagacgtggaggaccccggccacctcggggagggaaagagaccaagaaaagaacctctgtagccttgcttctgagagtgcaggtttgttacaggtaaggatcaggaaggtaaacatagggcagtgaagcagggttgtgtcctctgcggccctgaattagaataagcctcacaggtctcacccaggaacggaaatctcccctccaggttctgaaccagcattcaggggccccacccagggcttctgtcaacataagcataaaacttatggtttrcctttccataaaccccaaagttgggcttcttgtatagagtacaatttctgtaggaagagctgaaagcagaagggatctaacctgtgataatactcgatcgctgctgcttgaaagtaagacttagctatacactgaacaatcaagtaatttataacaaggattagaggaaacaaaaactctgtgtttgtgtgggtgggttttttttttctttatttttgtttcttaagagagtgtctccctctgccacccaggctggagtgcactggcgcgatcatagctcactgcagcctccaactccca

SEQ ID NO: 126977 - DNA, 601 bp, Human
tcaggaaggtaaacatagggcagtgaagcagggttgtgtcctctgcggccctgaattagaataagcctcacaggtctcacccaggaacggaaatctcccctccaggttctgaaccagcattcaggggccccacccagggcttctgtcaacataagcataaaacttatggtttacctttccataaaccccaaagttgggcttcttgtatagagtacaatttctgtaggaagagctgaaagcagaagggatctaacctgtgataatactcgatcgctgctgcttgaaagtaagacttagctayacactgaacaatcaagtaatttataacaaggattagaggaaacaaaaactctgtgtttgtgtgggtgggttttttttttctttatttttgtttcttaagagagtgtctccctctgccacccaggctggagtgcactggcgcgatcatagctcactgcagcctccaactcccaggctcaagcgattctcccccctcagcctcccaagtggctgggactgcaggtgcacaccaccacgcccagctaatttttttcattttttgtagagacggagccaaggctggtcttgaactcctgggctt

SEQ ID NO: 126978 - DNA, 601 bp, Human
actgaacaatcaagtaatttataacaaggattagaggaaacaaaaactctgtgtttgtgtgggtgggttttttttttctttatttttgtttcttaagagagtgtctccctctgccacccaggctggagtgcactggcgcgatcatagctcactgcagcctccaactcccaggctcaagcgattctcccccctcagcctcccaagtggctgggactgcaggtgcacaccaccacgcccagctaatttttttcattttttgtagagacggagccaaggctggtcttgaactcctgggcttaakcgatcctgctccctgggcctcccaaagtgctgggattacaggcgtgagccactgggtccggcatctacatttgttaaatacattaaaaccctcttaatcctttgtctccgtttgttctcttttgctccctgctctccaggctcttgtggcggaggcccccgctccctccgctgtagggtagcctccttctggggctggctcctgagcactgttctttctcctctctctcatcctctctcattcttagctttgcctgtcgactgggccaagtcacagcctttctggcctgtaagacaacaa

SEQ ID NO: 126979 - DNA, 601 bp, Human
tagagacggagccaaggctggtcttgaactcctgggcttaagcgatcctgctccctgggcctcccaaagtgctgggattacaggcgtgagccactgggtccggcatctacatttgttaaatacattaaaaccctcttaatcctttgtctccgtttgttctcttttgctccctgctctccaggctcttgtggcggaggcccccgctccctccgctgtagggtagcctccttctggggctggctcctgagcactgttctttctcctctctctcatcctctctcattcttagctttgcctgtcractgggccaagtcacagcctttctggcctgtaagacaacaaaaatctcacattttactaaatggaaggactaagtactctgtcttgacttcagtggtttccccgatttctgatgttgctgctgaaatagcattagcaagcttgtttcttaaagaagccctctctccagtgacaatactccccccgccacacacacacacatgcacacgcacacacaaacatgcatgcacgcgcacacacacacacaattttaaagccctcgtgttatattaaaaaggtctggatgtttttaacatacatg

SEQ ID NO: 126980 - DNA, 601 bp, Human
caagcttgtttcttaaagaagccctctctccagtgacaatactccccccgccacacacacacacatgcacacgcacacacaaacatgcatgcacgcgcacacacacacacaattttaaagccctcgtgttatattaaaaaggtctggatgtttttaacatacatggaaatttcttcagcagcacagtgttactggtctgacgagggcgcacagcctcctacccaaggacacagttcctgaaggaccagggtgcacatctggcctgcagtgccctgagccactctgtccaaaaggaagcctygaatcaaaagcctcatgaatcctctcctgagaaattccatgtctggtctcttgctagactcagccttttccccaccaagtctgccgcacctaattctgacctcaccctgcttggtggcccgctttgcctgcttgcacgcacctcaggtctcagtgtgtctcagcaacagcttcccctcctagggtggccagagttagcaagcaagaatgcaagacagccagttatgtttgaatttcagataaataacaaatataagtgtcttttagcatataatattttatttgggacatatactaatat

SEQ ID NO: 126981 - DNA, 601 bp, Human
cctaccatgtatcaagcactattctagagagcccggatagctcagtcagtagagcatcaagcgctactctaggtgctggggaagccagccaaagtcccgccttcatatcttacagtatgtctactttgtttttatatacatgtacactatatatacttgaagatatgtacctttttctttttttctttttattatttttttttgagacggagtctgactctattactcagtgcagtggcaccatctcagctcactgcaacttctacctcctgggttcaagtgattctccagcctcagcctcccaagtagctaggattacaggcatgtgccaccatacctggctaatttttgtatttttagtagagacaaagtttcaccatgttggccaggcttgtcttgaactcctgacctcaagtgatctgcccacctcggcctcccaaagtgctaggattacaggcgtgagccaccgcgcccagcccagatatgtactttttaatggcaatgttaccacatttaatgagattatctttttaaaaaatgttttaatttttaaattttaaaaaatagggatgggatcttactttgttgcctagactggtct

SEQ ID NO: 126982 - DNA, 601 bp, Human
tttatatacatgtacactatatatacttgaagatatgtacctttttctttttttctttttattatttttttttgagacggagtctgactctattactcagtgcagtggcaccatctcagctcactgcaacttctacctcctgggttcaagtgattctccagcctcagcctcccaagtagctaggattacaggcatgtgccaccatacctggctaatttttgtatttttagtagagacaaagtttcaccatgttggccaggcttgtcttgaactcctgacctcaagtgatctgcccacctcrgcctcccaaagtgctaggattacaggcgtgagccaccgcgcccagcccagatatgtactttttaatggcaatgttaccacatttaatgagattatctttttaaaaaatgttttaatttttaaattttaaaaaatagggatgggatcttactttgttgcctagactggtctccaaatccaggtctcaagtgatcctcccaccttggcctcctaaggtggtgggattacaggtgtgagccacggtgccagccaagatgatcaatacttccttaatatcatctaaaacatacactgtgtttag

SEQ ID NO: 126983 - DNA, 601 bp, Human
ctttttctttttttctttttattatttttttttgagacggagtctgactctattactcagtgcagtggcaccatctcagctcactgcaacttctacctcctgggttcaagtgattctccagcctcagcctcccaagtagctaggattacaggcatgtgccaccatacctggctaatttttgtatttttagtagagacaaagtttcaccatgttggccaggcttgtcttgaactcctgacctcaagtgatctgcccacctcggcctcccaaagtgctaggattacaggcgtgagccaccgcrcccagcccagatatgtactttttaatggcaatgttaccacatttaatgagattatctttttaaaaaatgttttaatttttaaattttaaaaaatagggatgggatcttactttgttgcctagactggtctccaaatccaggtctcaagtgatcctcccaccttggcctcctaaggtggtgggattacaggtgtgagccacggtgccagccaagatgatcaatacttccttaatatcatctaaaacatacactgtgtttagttctctatcatctcaaagatatctacatctttatacagta

SEQ ID NO: 126984 - DNA, 601 bp, Human
gacctctggtgaactacccgccttggcctcccaaagtgctaggattacaggcgtgagccatcgtcccctgccggatatgtttcttatgtctcttttaagctgtagcagttctctgtcttcacctttttttggcgccatttatttgttgaagaaaccggccatttgtcttgcagaacttaccacatactgaatttggatagctgccttcttgtggtcattagtttatttctctgtcccctgtatttcctgtaaactgatcattagatccagaggcttgatcagattcggatccaatgttttyggatcaggagacacataatggttgtctcacctttagtgagaccaagattggtcattgggaacagggaagtggagctggggtgagtatagggtcaccagatgtccagtacaagcagaatggacagggctgtgctgcaggatggatgaggggagggtgggatgcccggaaaatgcatgggggagggtgggatgcccggaaaatgcatgggggagggtgggatgcccggaaaatgcatgggggagggtgggattggatggaattggggagcgggaaggggtaagtggaaaagcagtaaggaac

SEQ ID NO: 126985 - DNA, 601 bp, Human
ccctccagcatcacctgatgttgcagcatagcccgctgcatccctcccaggctcacttccatcagaacgcacctagccagggacccttgctttcctggggcctggccaaggagcagttcctcagatcaacagcttcgctatcagccaatgtgagcctcttctaagtaaaggagaggagacagtgatggaaaaaggcagcatccagcaggccctcaggggagatatttcagctcctacacctccttccaatagcagaaccagggggaaaagttagagaatatccttattctatctaacaacktggacaccgaggaacaaaaaggtggcgtgacttgcccaaggatgttgcaggttagaagctgagccagccgtggctatccatccttcagacacccaggccaatttgtctgtaccacctcacattgcctcaaaccctgtctgcagttactgtcccatttctttatcatttggtcctggtatgacaaggtacagtggaaagaaaaagaggaacatgccagccagtccccttaatattactgcagcttctttatcatcacagcagcttacatgccgaaagaccgtcttaaattaggaccagaaa

SEQ ID NO: 126986 - DNA, 601 bp, Human
aggaagttcatgtttggagagatggagtaacctgccacaggtcacaaaactagtcactggcatggccacaatctgaatttgggactgttagactgagaagcccaagctaattcttgatacgctcactgcctgggacatttcacacggtagatctgagctttctcgcatctgagactaaaaggaaaatgtagtccttaacagacagcagaaggaaacagattattagcaaaaagaactgctttcctagcaggaaaccagagaaggagttatttcatgtaagctcaagcaaaggaaattgaasaaaatcagttctttatctatcctgttattcgtatggaaataaagaagaaatgcttgcatcctgttgttttagtgcttgtactgatctttttcaaacatgcctgtgatcacatcactctctactcaaaactttgaacagctctccattgcctccatcagtgtgtttcaaattcgtaaaaagtaaaataaaataacaggatgcttttttcagatgaaatcttacatggcataccaaatatagcaagaaaaaagaaagacagagagagaggagagagaagccgggacaagctaaagcagaggg

SEQ ID NO: 126987 - DNA, 601 bp, Human
gtatggaaataaagaagaaatgcttgcatcctgttgttttagtgcttgtactgatctttttcaaacatgcctgtgatcacatcactctctactcaaaactttgaacagctctccattgcctccatcagtgtgtttcaaattcgtaaaaagtaaaataaaataacaggatgcttttttcagatgaaatcttacatggcataccaaatatagcaagaaaaaagaaagacagagagagaggagagagaagccgggacaagctaaagcagagggtagagggagaaggaaccgaggaagggaaggrtcaggtcccaggcatttctcttccctgaattggcctccctcttttgccacctccccagcaagacctttaactccacagtccacagctcattttgaaatgtactgatcaacgtgagaaaatgcgaagcttcagcctgatagtcaaagaccaccataatctggacccaagtgctagttcacttattttccctccactattttcaagccctggctatttgcaaactgcatacgtatgctgtcccagttctctcaccactcttcaaacacattctgaattcacctataatctcccctctgcccg

SEQ ID NO: 126988 - DNA, 601 bp, Human
tggtttttcccttctttgtgtccagagtggtacatctcttctcatgttgtaaagtggctttagagaaggcatgcgttgtgcctcagctttccaacttattagtgttcaatcataattgccctgcttttctcaagactaaaaggagttgctgcctgggcgcggtggctcacgcctgtaatcccagcactctgggaggccaaggcgggcggatcatgaggtcaggagattgagaccatcctggctaacacggtaaaaccccgtctccactaaaaaatacaaaaaattagccgggcgtgttggygggtgcctgtagtcccagctactcgggaggctgaggcaggagaatggcgtgaacccagcaggcggagcttgcagtgagccaagatggcatcactgcactccagcttgggtgacagagtgagactccgtcaaaaaaaaaaaaatgactaaaaggaaatgatggaagttaagggtgctgggactggttttctttctccactgtctataaataagcttgtttcccaaattcctagtcctctgtaccagacaccaatataaaagaaggaggctaggcgcagtggctcatgcctgtaattccagc

SEQ ID NO: 126989 - DNA, 601 bp, Human
cagcctggcatcatagcaagaccctgtctccattaaaaaattaaaataaaaaaattagcgaggcatggtggcacatgcctgttgtcccagctactatggaggctgaggtggaaggatcacttgagctcaggaggtcaaggctgcagtgagcgaagatcacatcactgcaccccagctctgggtgacataatgagactctgtctccaaaaaaaaaaaaaaaaagacagttgcccttcatgcgcacaccttggcataagcatcttcttccccttcaacaaagcccagtgcccaaagcccagattttttttttttttttaaggtgttttagatggagtcttgctctgtcgcccaggctggagtgctgtggtgtaatctcggctcactgcaagctccgcctcccaggttcaagcaattctcctgcctcagcctcctgagtagctgggatcacaggcgcgcaccaccaggcctggctaatttttgtatttttagtagagacagcgtttcaccatgttggtcaggctggcctcgaactcctgacctcgtgatctgcccaccttgggctcccgaagtgctgggattacaagtgtgagccactgcaccc

SEQ ID NO: 126990 - DNA, 601 bp, Human
tttttttattttctaaaatttcaagagaagcttttatttcttttttcagtagggaaagaaaacttttatgtgagattgagaattaaagattacattcaaaaacacttaggtgatgtgttaatgtgctgaatagctgaatagtacctatggctgaataatattctccataaaaaatgaaaaatgattacctcctaagaaggctttaaacacatatttacagcttatcttcccttatcacctttctcctcacgcttgcatttagtcagttaattgtgtgttttttacttgtgttacttgtgtyggttttacattgagcgtgatccaagagagcctcacattctatttctattttgccacatacaaatcaggccttgcaaatttggtttctcctgggttcttttttgtttgtttgtttgttgtttttgagacagagtcttgctctgtcacccaggctggagtgcagtggcctgatctcggctcactgcaacctctgcctcctgggttcacaccattctcctgcctcagcctcccgagtagctgggactacgggcgcccaccaccacgcccggctaattttttgtatttttagtagagacagggt

SEQ ID NO: 126991 - DNA, 601 bp, Human
gattgagaattaaagattacattcaaaaacacttaggtgatgtgttaatgtgctgaatagctgaatagtacctatggctgaataatattctccataaaaaatgaaaaatgattacctcctaagaaggctttaaacacatatttacagcttatcttcccttatcacctttctcctcacgcttgcatttagtcagttaattgtgtgttttttacttgtgttacttgtgtcggttttacattgagcgtgatccaagagagcctcacattctatttctattttgccacatacaaatcaggccttrcaaatttggtttctcctgggttcttttttgtttgtttgtttgttgtttttgagacagagtcttgctctgtcacccaggctggagtgcagtggcctgatctcggctcactgcaacctctgcctcctgggttcacaccattctcctgcctcagcctcccgagtagctgggactacgggcgcccaccaccacgcccggctaattttttgtatttttagtagagacagggtttcaccgtgttagccaggatggtctcgatctcctggcctcgtgatctgtccgcctcagcctcccaaagtgctg

SEQ ID NO: 126992 - DNA, 601 bp, Human
attgagaattaaagattacattcaaaaacacttaggtgatgtgttaatgtgctgaatagctgaatagtacctatggctgaataatattctccataaaaaatgaaaaatgattacctcctaagaaggctttaaacacatatttacagcttatcttcccttatcacctttctcctcacgcttgcatttagtcagttaattgtgtgttttttacttgtgttacttgtgtcggttttacattgagcgtgatccaagagagcctcacattctatttctattttgccacatacaaatcaggccttgmaaatttggtttctcctgggttcttttttgtttgtttgtttgttgtttttgagacagagtcttgctctgtcacccaggctggagtgcagtggcctgatctcggctcactgcaacctctgcctcctgggttcacaccattctcctgcctcagcctcccgagtagctgggactacgggcgcccaccaccacgcccggctaattttttgtatttttagtagagacagggtttcaccgtgttagccaggatggtctcgatctcctggcctcgtgatctgtccgcctcagcctcccaaagtgctgg

SEQ ID NO: 126993 - DNA, 601 bp, Human
atagctacgatttgctcacgtggaatgttatagttaaggtgaggttcagcgatatacagtggaacactcaaatacccatggcttaaataatatacaggtttgcttttctctcctttaaaagaggacaaaagtttggcagctcaggcatgatatgacagctccacaaagttattaagaatttctgggaatggccaggcagggtggctcatgcctataatcccagccctttgggagtctgaggtgggcagatcacttgagccaaagagtttgagaccagcctgagcaacatgacaaaaccccrtctctattaaaaaaaatacaaaaattagccaggcgccatggtgcgcgcctgcagtctcagctactcgagaggctgaaggaggagaatcacttgagcctgggaggcgcaggttgcactgagctgagatcacaccattgcactccagcttggatgacggggtgaaaaaaagaattcctgggaattctgccatccctcagctcgtggcttccacctcaaagtcaccttatattctaaaggtggctgttggggcttcacccatcatgtctacatctcaggcaagaataaaaaggaagcaaagga

SEQ ID NO: 126994 - DNA, 601 bp, Human
tcagcgatatacagtggaacactcaaatacccatggcttaaataatatacaggtttgcttttctctcctttaaaagaggacaaaagtttggcagctcaggcatgatatgacagctccacaaagttattaagaatttctgggaatggccaggcagggtggctcatgcctataatcccagccctttgggagtctgaggtgggcagatcacttgagccaaagagtttgagaccagcctgagcaacatgacaaaaccccgtctctattaaaaaaaatacaaaaattagccaggcgccatggtgcrcgcctgcagtctcagctactcgagaggctgaaggaggagaatcacttgagcctgggaggcgcaggttgcactgagctgagatcacaccattgcactccagcttggatgacggggtgaaaaaaagaattcctgggaattctgccatccctcagctcgtggcttccacctcaaagtcaccttatattctaaaggtggctgttggggcttcacccatcatgtctacatctcaggcaagaataaaaaggaagcaaaggaagggcaaagggtgccttctttctaggtaattcagctcccttttat

SEQ ID NO: 126995 - DNA, 601 bp, Human
accattgcactccagcttggatgacggggtgaaaaaaagaattcctgggaattctgccatccctcagctcgtggcttccacctcaaagtcaccttatattctaaaggtggctgttggggcttcacccatcatgtctacatctcaggcaagaataaaaaggaagcaaaggaagggcaaagggtgccttctttctaggtaattcagctcccttttattttattattattttttaatcttttgtaaagatggggtctgtgttacccaggctggtctcgaactcctggcctaaaatgatggcctygccttggcctcccaaaatgctgggattacgggcgtgagccaccgcacccagccttagctcccttttcgagagctttcttgaaactgcccccagcttctgacatctcattggcccttccctactgcaagggagcccagggaatatagtttgttcagctgggttcattgctgcccctcacattttagaggtctgttactaaggaagaagaagaaagtggatactgagtgggaaagagcagtccataaggaagtcacaccccaaccccctgccctttctctttaaaacaaatgcctcagacca

SEQ ID NO: 126996 - DNA, 601 bp, Human
gcctcagaccacaggcgaaatgggaccttccgaccctgttggcctgctcttcctggcgccacgatgacccccaaaacagactccaaggaacagacagcctttctgtcttctccccaccccatccagtgttccctcgcctatcagacaggaccaagtctgacaaggatataatcttttctttttcatgttttaaaattaaaatatccaagatgggaattttaactagagctagtgcatctgtgggaacatgtttgcttatagtttctcctggacatgtctcactccatgtccacaaacccayagaaatcaataccctgctgtaaccccagcactttgggaggctgaggcaggaggatcacctgaggtcaagagttcaagaccagcctggccaacatggcaaaaccctgtctctactgaaaatatacaaaaattagctggacgtagtggcgggagccactacgtcctgtaatcccagctacacaggaggctgaggcagagagaatggcttgaacccagaaggtggaggttgcagcgagccgagatcgtgccattgcactccagcctgggcaacagagcgagactccgtctcaaaaaaaaaaaa

SEQ ID NO: 126997 - DNA, 601 bp, Human
aaaattagctggacgtagtggcgggagccactacgtcctgtaatcccagctacacaggaggctgaggcagagagaatggcttgaacccagaaggtggaggttgcagcgagccgagatcgtgccattgcactccagcctgggcaacagagcgagactccgtctcaaaaaaaaaaaaaaaaaaaaagtcaataccctgtacacagttagccagattgagtaattttgtacctgttggtgatcttgtggccaccctgccttatgagaggaggaggggacagagcctttgggacccttcatggascttcttaatgtgcaagatgggcacagggtgctttctggtggtagaaccgcatgctgattaccctagatgagctgcacaaggttgaaaaggcagcagaggcctgctttcctttctcatctcctgaggacatggccagggaagtttcccttggctttggaagatagcctcttgccatttctttctttgccaggggccatgggtggccagagttccagcggaggccggctgggctgcaataaggggattacaaagtggaaagtctgtttcgcttggttcttaaaaaacgaggaggaaagacat

SEQ ID NO: 126998 - DNA, 601 bp, Human
ggctgaggcagagagaatggcttgaacccagaaggtggaggttgcagcgagccgagatcgtgccattgcactccagcctgggcaacagagcgagactccgtctcaaaaaaaaaaaaaaaaaaaaagtcaataccctgtacacagttagccagattgagtaattttgtacctgttggtgatcttgtggccaccctgccttatgagaggaggaggggacagagcctttgggacccttcatggagcttcttaatgtgcaagatgggcacagggtgctttctggtggtagaaccgcatgctgatyaccctagatgagctgcacaaggttgaaaaggcagcagaggcctgctttcctttctcatctcctgaggacatggccagggaagtttcccttggctttggaagatagcctcttgccatttctttctttgccaggggccatgggtggccagagttccagcggaggccggctgggctgcaataaggggattacaaagtggaaagtctgtttcgcttggttcttaaaaaacgaggaggaaagacattgatccttttcttcttgatctttcttctctccgtcattcgcttcttattggtttttgaa

SEQ ID NO: 126999 - DNA, 601 bp, Human
caaaaaaaaaaaaaaaaaaaaagtcaataccctgtacacagttagccagattgagtaattttgtacctgttggtgatcttgtggccaccctgccttatgagaggaggaggggacagagcctttgggacccttcatggagcttcttaatgtgcaagatgggcacagggtgctttctggtggtagaaccgcatgctgattaccctagatgagctgcacaaggttgaaaaggcagcagaggcctgctttcctttctcatctcctgaggacatggccagggaagtttcccttggctttggaagayagcctcttgccatttctttctttgccaggggccatgggtggccagagttccagcggaggccggctgggctgcaataaggggattacaaagtggaaagtctgtttcgcttggttcttaaaaaacgaggaggaaagacattgatccttttcttcttgatctttcttctctccgtcattcgcttcttattggtttttgaaccctgtggactaaccatggaaaagatggctttatgagtcagatgtccaccagaggatggcatcatggacagagcagtatcttctgtggcctttccgtgaatgg

SEQ ID NO: 127000 - DNA, 601 bp, Human
cagttagccagattgagtaattttgtacctgttggtgatcttgtggccaccctgccttatgagaggaggaggggacagagcctttgggacccttcatggagcttcttaatgtgcaagatgggcacagggtgctttctggtggtagaaccgcatgctgattaccctagatgagctgcacaaggttgaaaaggcagcagaggcctgctttcctttctcatctcctgaggacatggccagggaagtttcccttggctttggaagatagcctcttgccatttctttctttgccaggggccatggktggccagagttccagcggaggccggctgggctgcaataaggggattacaaagtggaaagtctgtttcgcttggttcttaaaaaacgaggaggaaagacattgatccttttcttcttgatctttcttctctccgtcattcgcttcttattggtttttgaaccctgtggactaaccatggaaaagatggctttatgagtcagatgtccaccagaggatggcatcatggacagagcagtatcttctgtggcctttccgtgaatggctggagggctgaagggaggacactgaagccttcagctt

SEQ ID NO: 127001 - DNA, 601 bp, Human
ataaggggattacaaagtggaaagtctgtttcgcttggttcttaaaaaacgaggaggaaagacattgatccttttcttcttgatctttcttctctccgtcattcgcttcttattggtttttgaaccctgtggactaaccatggaaaagatggctttatgagtcagatgtccaccagaggatggcatcatggacagagcagtatcttctgtggcctttccgtgaatggctggagggctgaagggaggacactgaagccttcagcttggaggaatccagggagagggatcaggagccaccttkgcagctgcatatgatgtcaaaacctgtttctcttgtggctcagtccctcccaggccccctacttgcctctcttacctccagtgctgtacaaagcccagaagtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgt

SEQ ID NO: 127002 - DNA, 601 bp, Human
gattacaaagtggaaagtctgtttcgcttggttcttaaaaaacgaggaggaaagacattgatccttttcttcttgatctttcttctctccgtcattcgcttcttattggtttttgaaccctgtggactaaccatggaaaagatggctttatgagtcagatgtccaccagaggatggcatcatggacagagcagtatcttctgtggcctttccgtgaatggctggagggctgaagggaggacactgaagccttcagcttggaggaatccagggagagggatcaggagccacctttgcagctscatatgatgtcaaaacctgtttctcttgtggctcagtccctcccaggccccctacttgcctctcttacctccagtgctgtacaaagcccagaagtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgtaatccta

SEQ ID NO: 127003 - DNA, 601 bp, Human
cttgatctttcttctctccgtcattcgcttcttattggtttttgaaccctgtggactaaccatggaaaagatggctttatgagtcagatgtccaccagaggatggcatcatggacagagcagtatcttctgtggcctttccgtgaatggctggagggctgaagggaggacactgaagccttcagcttggaggaatccagggagagggatcaggagccacctttgcagctgcatatgatgtcaaaacctgtttctcttgtggctcagtccctcccaggccccctacttgcctctcttacctmcagtgctgtacaaagcccagaagtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgtaatcctagcactttgggaggctgatgtgggaggattgcttgcgcttaggagttcaagaacaacctgggcaacataggg

SEQ ID NO: 127004 - DNA, 601 bp, Human
cattcgcttcttattggtttttgaaccctgtggactaaccatggaaaagatggctttatgagtcagatgtccaccagaggatggcatcatggacagagcagtatcttctgtggcctttccgtgaatggctggagggctgaagggaggacactgaagccttcagcttggaggaatccagggagagggatcaggagccacctttgcagctgcatatgatgtcaaaacctgtttctcttgtggctcagtccctcccaggccccctacttgcctctcttacctccagtgctgtacaaagcccagragtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgtaatcctagcactttgggaggctgatgtgggaggattgcttgcgcttaggagttcaagaacaacctgggcaacatagggagaccttatctctagaaaaag

SEQ ID NO: 127005 - DNA, 601 bp, Human
agtccctcccaggccccctacttgcctctcttacctccagtgctgtacaaagcccagaagtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgtaatcctagcactttgggaggctgatgtgggaggattgcttgmgcttaggagttcaagaacaacctgggcaacatagggagaccttatctctagaaaaagaattttaataaattagccaggcgtggtgatgcacacctgtcatcccagctactcaggaggctgaggtgggacaatcgcttgagcctgagagatccaagctgcagtgagctgtgatcacaccactgcactccagcctgggtgacagagtgagactctgtctggaaaaaagtaaataaacaaataaaaggttagaacttagtgacaaatcaacagtgaaaattttaccacccagcaactcagcca

SEQ ID NO: 127006 - DNA, 601 bp, Human
ctacttgcctctcttacctccagtgctgtacaaagcccagaagtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgtaatcctagcactttgggaggctgatgtgggaggattgcttgcgcttaggagttcaagamcaacctgggcaacatagggagaccttatctctagaaaaagaattttaataaattagccaggcgtggtgatgcacacctgtcatcccagctactcaggaggctgaggtgggacaatcgcttgagcctgagagatccaagctgcagtgagctgtgatcacaccactgcactccagcctgggtgacagagtgagactctgtctggaaaaaagtaaataaacaaataaaaggttagaacttagtgacaaatcaacagtgaaaattttaccacccagcaactcagccatgccatctgcccacccc

SEQ ID NO: 127007 - DNA, 601 bp, Human
caaaaagagtgtgcagaaggccaattgtttcaaggtgacaatcattcctgcatgcacccctcccacatcccggcctctgccaggcaactttcagtcctttctgaagaatgaccctcccccagcacacatactcccaggcagtttccttctattctggcctggtcttttcattccaggcaactttgcataccaatgagccagatgaagttctgggaagggcctctcagcaccattttgtcttgtttcagctgtggaccccaaagtcatttccattgccaaccgagtagctgaaattgtttaytcctggccaccaccacaagcgacccaggcaggaggcttcaagtccaaagagatttttgtaactgagggtctctccttccagctccaaggccacgtgcctgtagcttcaagttctaagaaaggtaagctttccttccctgggtggagtgtttgccaggcaggggcgcaggagcatttgtgtatttatccatcccagggctcggcaacttgacagtctccgctgcctggactgagggcttgacagccacaggctgtgggcaatgagctccagcttgagacaccagcccaaggcaagggggct

SEQ ID NO: 127008 - DNA, 601 bp, Human
atgcttcttgccaggcacagtggctcatgcctgtaattccagcactttgggaggccgaagtgggtggaccacctgaggtcaggagtttgagaccagcctggctaacatggtgaaacctgggtttctagtaaaaatacaaaaaaattagccaggcgtggtggcacacgcctgtaatcccagctacttgggagactgaggcatgagaatctcttgaacctgggaggcagaggttgcagtgaggcaagatcgcaccattgcactacagcttgggcaacaagagcaaaactctgtctaaaaaataaaaaataaaaaaaaaaaaaagaattagcatgcctcttcctccagcccttaccaagccacaagcattcattgtccctggaaaaatgtaagattattttttgcttctcttaaaagaaataactggaattttccccgacagatgaagaagaacaaatactagccaaaattgttgagctgctgaaatattcaggagatcagttggaaagaaaggtatggaacaccttgaactgatgcgattgatttctgtgcccatgcactagtacacgagaatggaattgtattccaggttgcaaccttattc

SEQ ID NO: 127009 - DNA, 601 bp, Human
cttgccaggcacagtggctcatgcctgtaattccagcactttgggaggccgaagtgggtggaccacctgaggtcaggagtttgagaccagcctggctaacatggtgaaacctgggtttctagtaaaaatacaaaaaaattagccaggcgtggtggcacacgcctgtaatcccagctacttgggagactgaggcatgagaatctcttgaacctgggaggcagaggttgcagtgaggcaagatcgcaccattgcactacagcttgggcaacaagagcaaaactctgtctaaaaaataaaaaawaaaaaaaaaaaaaagaattagcatgcctcttcctccagcccttaccaagccacaagcattcattgtccctggaaaaatgtaagattattttttgcttctcttaaaagaaataactggaattttccccgacagatgaagaagaacaaatactagccaaaattgttgagctgctgaaatattcaggagatcagttggaaagaaaggtatggaacaccttgaactgatgcgattgatttctgtgcccatgcactagtacacgagaatggaattgtattccaggttgcaaccttattccctttc

SEQ ID NO: 127010 - DNA, 601 bp, Human
gccaggcacagtggctcatgcctgtaattccagcactttgggaggccgaagtgggtggaccacctgaggtcaggagtttgagaccagcctggctaacatggtgaaacctgggtttctagtaaaaatacaaaaaaattagccaggcgtggtggcacacgcctgtaatcccagctacttgggagactgaggcatgagaatctcttgaacctgggaggcagaggttgcagtgaggcaagatcgcaccattgcactacagcttgggcaacaagagcaaaactctgtctaaaaaataaaaaataawaaaaaaaaaaagaattagcatgcctcttcctccagcccttaccaagccacaagcattcattgtccctggaaaaatgtaagattattttttgcttctcttaaaagaaataactggaattttccccgacagatgaagaagaacaaatactagccaaaattgttgagctgctgaaatattcaggagatcagttggaaagaaaggtatggaacaccttgaactgatgcgattgatttctgtgcccatgcactagtacacgagaatggaattgtattccaggttgcaaccttattccctttctaa

SEQ ID NO: 127011 - DNA, 601 bp, Human; identical to SEQ ID NO: 121837

SEQ ID NO: 127012 - DNA, 601 bp, Human; identical to SEQ ID NO: 121836

SEQ ID NO: 127013 - DNA, 601 bp, Human; identical to SEQ ID NO: 121835

SEQ ID NO: 127014 - DNA, 601 bp, Human; identical to SEQ ID NO: 121834

SEQ ID NO: 127015 - DNA, 601 bp, Human; identical to SEQ ID NO: 121833

SEQ ID NO: 127016 - DNA, 601 bp, Human; identical to SEQ ID NO: 121832

SEQ ID NO: 127017 - DNA, 601 bp, Human; identical to SEQ ID NO: 121831

SEQ ID NO: 127018 - DNA, 601 bp, Human; identical to SEQ ID NO: 121830

SEQ ID NO: 127019 - DNA, 601 bp, Human; identical to SEQ ID NO: 121829

SEQ ID NO: 127020 - DNA, 601 bp, Human; identical to SEQ ID NO: 121828

SEQ ID NO: 127021 - DNA, 601 bp, Human; identical to SEQ ID NO: 121827

SEQ ID NO: 127022 - DNA, 601 bp, Human; identical to SEQ ID NO: 121826

SEQ ID NO: 127023 - DNA, 601 bp, Human; identical to SEQ ID NO: 121825

SEQ ID NO: 127024 - DNA, 601 bp, Human; identical to SEQ ID NO: 121824

SEQ ID NO: 127025 - DNA, 601 bp, Human; identical to SEQ ID NO: 121823

SEQ ID NO: 127026 - DNA, 601 bp, Human; identical to SEQ ID NO: 121822

SEQ ID NO: 127027 - DNA, 601 bp, Human; identical to SEQ ID NO: 121821

SEQ ID NO: 127028 - DNA, 601 bp, Human; identical to SEQ ID NO: 121820

SEQ ID NO: 127029 - DNA, 601 bp, Human; identical to SEQ ID NO: 121819

SEQ ID NO: 127030 - DNA, 601 bp, Human; identical to SEQ ID NO: 121818

SEQ ID NO: 127031 - DNA, 601 bp, Human; identical to SEQ ID NO: 121817

SEQ ID NO: 127032 - DNA, 601 bp, Human; identical to SEQ ID NO: 121816

SEQ ID NO: 127033 - DNA, 601 bp, Human; identical to SEQ ID NO: 121815

SEQ ID NO: 127034 - DNA, 601 bp, Human; identical to SEQ ID NO: 121814

SEQ ID NO: 127035 - DNA, 601 bp, Human; identical to SEQ ID NO: 121813

SEQ ID NO: 127036 - DNA, 601 bp, Human; identical to SEQ ID NO: 121812

SEQ ID NO: 127037 - DNA, 601 bp, Human; identical to SEQ ID NO: 121811

SEQ ID NO: 127038 - DNA, 601 bp, Human; identical to SEQ ID NO: 121810

SEQ ID NO: 127039 - DNA, 601 bp, Human; identical to SEQ ID NO: 121809

SEQ ID NO: 127040 - DNA, 601 bp, Human; identical to SEQ ID NO: 121808

SEQ ID NO: 127041 - DNA, 601 bp, Human; identical to SEQ ID NO: 121807

SEQ ID NO: 127042 - DNA, 601 bp, Human; identical to SEQ ID NO: 121806

SEQ ID NO: 127043 - DNA, 601 bp, Human; identical to SEQ ID NO: 18761

SEQ ID NO: 127044 - DNA, 601 bp, Human; identical to SEQ ID NO: 18762

SEQ ID NO: 127045 - DNA, 601 bp, Human; identical to SEQ ID NO: 18763

SEQ ID NO: 127046 - DNA, 601 bp, Human; identical to SEQ ID NO: 18764

SEQ ID NO: 127047 - DNA, 601 bp, Human
ctctggaaggatggacacgtgggttggtgtaggaggctgtgggttacaggcgtaatggaaagacagagacccacacagcaacctcaggaaagcgatttccaagagagtcagaggaacatctggagctgagaggagggaaaagaagataccactcaccaagaccctcctgctcctgtggctgtgagcgccgcatgttccatggacattgtaaggaaggagatgtgaaaaatgcaagggctcccttcatggaaacaccttgcttcttctccctccctttccactggggagagcctgggaggarggctcacctgaagaagcctttgcagccttcacaggtcatagcattgaagtgaaagccagtggctcggtctccacacaccccacagatccggggcacgttccggtcaaagtctccagggtcaggcagggaagtgctggccgccattgcctccatccctgtaagaacagcaagcaggccacggtcagagccagagtcagtgccagggccagctggcatccttggtgccacccacccccagcctcatcccaccgcccccaccccccaccaccagggagctcagcaagggtgggcatctcccca

SEQ ID NO: 127048 - DNA, 601 bp, Human
gacttgaattcactgtgcccccaaggcgaggagagcactccggtttagacaacaaccaagccgacctcagcatcctcctctggacttgatttgtgctttcctcatttgatggttagagccctgccatagccacctccagtctagaccgctagacagaagatctgttttggctgccttctttcaggctattctctctctctctctccaatacatgccaaatgctaatttctcatgattcccagttcctgccccaattcatccctttcccacgctcccaccctggctttgaatgggaacctcyagtgcttttcccacacctttcacatctgtaatcctgggctcatgtaaggggagtgtgttggtaaagaaactggccctgatcaaacaggaatgcaggtacattcctgacactgcctggatgttccaaggttggctttcagaccaggacaaacagtccttgggtgaagatatgggtacagatcgtgatgacccgacaagaggtgccatttcccttgttccaaggaacagtttggattggatgggaaggcaagctctgaaaccaagttcttgggctttccccaaagacatgcctgtctcttgg

SEQ ID NO: 127049 - DNA, 601 bp, Human
ctgttcctggaggaaacacagggtgaggtttctgcaagcctctggtcacaaaattttcatcaactgatcaacacataaccttgtcttatgtgagttttctgtttaaagatatcttattcaatagatattgttggttgagttattaacattgatcaaacagccagcagcactgttgtcctcaggaagcttgtctaacacacatagtttccctgtgaggcacatcacggccttgcacttaggaacaccagacagcagtgcagcactacgcttgggaactgttttaaacagcaaagtcaccaayaaaaatcaaaaaaaggcaaaaaatgtagcactaaatagattgtgaagaccctggctgggaagataggtgccaagtcatgtgaatttttcactgctctgcacatgttcacaaatgaccacaaaggggctgcaagtattgattttggtaaattttagcaagtgggcagatttgcaaatacagaatccatgaataatgaaggttgactgtgtgtgtgtgtgtgtgtgtgcatgtgtgtgtttgtttatgtacatatcaaacaaaattcagaaccttgcagctgtctttcttgacagcttcagt

SEQ ID NO: 127050 - DNA, 601 bp, Human
aaataaaatttggatgaagcaaagaaggagaagcaggcatcaggggtggaagaagaggagaaatgatgtatgtatagctgattctcattattcatggtagttatggtctatagtcactgtggacactggattagtgaatattgaaacactgttcctggaggaaacacagggtgaggtttctgcaagcctctggtcacaaaattttcatcaactgatcaacacataaccttgtcttatgtgagttttctgtttaaagatatcttattcaatagatattgttggttgagttattaacattgawcaaacagccagcagcactgttgtcctcaggaagcttgtctaacacacatagtttccctgtgaggcacatcacggccttgcacttaggaacaccagacagcagtgcagcactacgcttgggaactgttttaaacagcaaagtcaccaataaaaatcaaaaaaaggcaaaaaatgtagcactaaatagattgtgaagaccctggctgggaagataggtgccaagtcatgtgaatttttcactgctctgcacatgttcacaaatgaccacaaaggggctgcaagtattgattttggtaaattt

SEQ ID NO: 127051 - DNA, 601 bp, Human
ccatattatgacgttacatttaaaaaatccactacccactacaactacctaaacattaaaaatgaaatgcagtctttggttagatcgatatgtttgagtttaaatcttaaagcacaaccttgggcaagttacttaaccttcccatccattagtttccacatctgtaaaatgggagcaacatttcagagagggttgtaagaactaaataaaggaaaagggaacaggacctggacaaaggaaaccctaaataaagggaaagaagagaaactagcagaaagaggcagtgggagggagtgctgasagtgggtgaaagtagattttaaagtagattttaaacatctcattaagaatttgagacccctgaagcagacaccatgtcttaggcctgctctctgggtgcctagcatgggagcctgcaggcagcagagtttgaaaccatatttctgtttcatgtgctgtagctcctgatgtctagagccacagcccctgtgctagttacagcaaccactgtccagttctgttgagcaccagccagttctacccagcctttgaccgacatgaagctctctcagagcccctggcccagcccttccctcttcat

SEQ ID NO: 127052 - DNA, 601 bp, Human
tctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagatggggtttcaccatgttggccagactggtctcgaactcctgacctcaaatgatccacccaccttggcctcccaaagtgctgggattacaggcatgagccaccrtgcccagccaggcactggtttcttatctcacagaacctccatataatactctgtgactatgaaaaagaaagaggaagaatgctgaaatgggaatgagcttgaagaagtgttctttagcagataaaaccaagatgcagaatggtgacgtgtgtgcacacacacatacacacacacacatatgcacttttacataaagaatctggaagcgaacacgatgagctggcaacagtgacagcttcctggaggaggtagggaactaagaattgggttgaataggtgatttacttttcacttacatat

SEQ ID NO: 127053 - DNA, 601 bp, Human
tgttaaacacacagacattttaacgcagtaaagccacttccaggtatttatcctgtgggtagatcggtccatgggcgcaatggtggttactgcagctctgtctggaggagccaaagaccgaacctaaatgaccatgacagaggactggtttctttcttttctctttctttctctttctctttctttctttctttctttctttctttctttctttctttctttctttctttctttctttctttctttctttctttctttcctctctctctctctctctcttccttccttccttctctttctytctttctatctgtctgtctatctgtctttccttccttccttccttcttttctctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagatggggtttcaccatgttggccagactggtctcgaactcctgacctcaaatg

SEQ ID NO: 127054 - DNA, 601 bp, Human
agcatgttaaacacacagacattttaacgcagtaaagccacttccaggtatttatcctgtgggtagatcggtccatgggcgcaatggtggttactgcagctctgtctggaggagccaaagaccgaacctaaatgaccatgacagaggactggtttctttcttttctctttctttctctttctctttctttctttctttctttctttctttctttctttctttctttctttctttctttctttctttctttctttctttctttcctctctctctctctctctcttccttccttccttctctytctctctttctatctgtctgtctatctgtctttccttccttccttccttcttttctctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagatggggtttcaccatgttggccagactggtctcgaactcctgacctca

SEQ ID NO: 127055 - DNA, 601 bp, Human
ggcaattggcaatgcgaagcatgttaaacacacagacattttaacgcagtaaagccacttccaggtatttatcctgtgggtagatcggtccatgggcgcaatggtggttactgcagctctgtctggaggagccaaagaccgaacctaaatgaccatgacagaggactggtttctttcttttctctttctttctctttctctttctttctttctttctttctttctttctttctttctttctttctttctttctttctttctttctttctttctttctttcctctctctctctctctctctyccttccttccttctctttctctctttctatctgtctgtctatctgtctttccttccttccttccttcttttctctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagatggggtttcaccatgttggccagactggtc

SEQ ID NO: 127056 - DNA, 601 bp, Human
gagggcaattggcaatgcgaagcatgttaaacacacagacattttaacgcagtaaagccacttccaggtatttatcctgtgggtagatcggtccatgggcgcaatggtggttactgcagctctgtctggaggagccaaagaccgaacctaaatgaccatgacagaggactggtttctttcttttctctttctttctctttctctttctttctttctttctttctttctttctttctttctttctttctttctttctttctttctttctttctttctttctttcctctctctctctctctctcttccttccttccttctctttctctctttctatctgtctgtctatctgtctttccttccttccttccttcttttctctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagatggggtttcaccatgttggccagactg

SEQ ID NO: 127057 - DNA, 601 bp, Human
agacttttttttttggagggcaattggcaatgcgaagcatgttaaacacacagacattttaacgcagtaaagccacttccaggtatttatcctgtgggtagatcggtccatgggcgcaatggtggttactgcagctctgtctggaggagccaaagaccgaacctaaatgaccatgacagaggactggtttctttcttttctctttctttctctttctctttctttctttctttctttctttctttctttctttctttctttctttctttctttctttctttctttctttctttctttcctytctctctctctctctcttccttccttccttctctttctctctttctatctgtctgtctatctgtctttccttccttccttccttcttttctctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagatggggtttcacc

SEQ ID NO: 127058 - DNA, 601 bp, Human
acagacttttttttttggagggcaattggcaatgcgaagcatgttaaacacacagacattttaacgcagtaaagccacttccaggtatttatcctgtgggtagatcggtccatgggcgcaatggtggttactgcagctctgtctggaggagccaaagaccgaacctaaatgaccatgacagaggactggtttctttcttttctctttctttctctttctctttctttctttctttctttctttctttctttctttctttctttctttctttctttctttctttctttctttctttctttcctctctctctctctctctcttccttccttccttctctttctctctttctatctgtctgtctatctgtctttccttccttccttccttcttttctctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagatggggtttca

SEQ ID NO: 127059 - DNA, 601 bp, Human
gaaaagagcacagacttttttttttggagggcaattggcaatgcgaagcatgttaaacacacagacattttaacgcagtaaagccacttccaggtatttatcctgtgggtagatcggtccatgggcgcaatggtggttactgcagctctgtctggaggagccaaagaccgaacctaaatgaccatgacagaggactggtttctttcttttctctttctttctctttctctttctttctttctttctttctttctttctttctttctttctttctttctttctttctttctttctttctttctttctttcctctctctctctctctctcttccttccttccttctctttctctctttctatctgtctgtctatctgtctttccttccttccttccttcttttctctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagat

SEQ ID NO: 127060 - DNA, 601 bp, Human
ctgtcaattataccccagcaaatctaaaggaataaaaagacctacatcaaatgatgtaggggcctacatgtatgtgagaggcagcatcagggggttctcctcaggtgggtttaaaaaaacattaaaggatggttagcactgtagaaaagagcacagacttttttttttggagggcaattggcaatgcgaagcatgttaaacacacagacattttaacgcagtaaagccacttccaggtatttatcctgtgggtagatcggtccatgggcgcaatggtggttactgcagctctgtctggagragccaaagaccgaacctaaatgaccatgacagaggactggtttctttcttttctctttctttctctttctctttctttctttctttctttctttctttctttctttctttctttctttctttctttctttctttctttctttctttctttcctctctctctctctctctcttccttccttccttctctttctctctttctatctgtctgtctatctgtctttccttccttccttccttcttttctctctttctttcttttttttttttttctggatggaatttcactctgtcacccacgc

SEQ ID NO: 127061 - DNA, 601 bp, Human
atttcacaatgtatatgtatagcagaacatcgagttgtgcacctgaaatatagaccatgtctatctgtcaattataccccagcaaatctaaaggaataaaaagacctacatcaaatgatgtaggggcctacatgtatgtgagaggcagcatcagggggttctcctcaggtgggtttaaaaaaacattaaaggatggttagcactgtagaaaagagcacagacttttttttttggagggcaattggcaatgcgaagcatgttaaacacacagacattttaacgcagtaaagccacttccagktatttatcctgtgggtagatcggtccatgggcgcaatggtggttactgcagctctgtctggaggagccaaagaccgaacctaaatgaccatgacagaggactggtttctttcttttctctttctttctctttctctttctttctttctttctttctttctttctttctttctttctttctttctttctttctttctttctttctttctttctttcctctctctctctctctctcttccttccttccttctctttctctctttctatctgtctgtctatctgtctttccttccttccttcc

SEQ ID NO: 127062 - DNA, 601 bp, Human
gctgctctctgagcctggaccctgtcatcctctggttggttggcatttataccccagctcaggaagggggggtaggggtggggcaaccaagctaaatatagatgcagtttctagaaagccaggggtgagagaggacattgaccgattctcatgccagagaccagtttatcaaaacagaaagagacaaaaacctcacaaaagcatcaagagcctggggccagggcctcaggcctgggacagttgggcctttctccagtaggtggcctctgccagcagagacgcacgttgcataacccaggcrtagggtcaactatcccctctgggctccatctccactgcactgtcacagagattccagcgtctgctcaggatacaggaactagcgagagctcctgatctgaaagctatgtgaggtgctgggaatgcttactagtttgattatggtgatcatttcacaatgtatatgtatagcagaacatcgagttgtgcacctgaaatatagaccatgtctatctgtcaattataccccagcaaatctaaaggaataaaaagacctacatcaaatgatgtaggggcctacatgtatgtgagaggcagcatc

SEQ ID NO: 127063 - DNA, 601 bp, Human
aaattagccaggcatggtggcatgcgcctgtggtctcagctacttgggaggctaaggtggaaggatcgcttgagctggtgaggtcaaggctgcagtgaaccaagattgtgccactgcacttcagtgtgggtgacaaagtgagatcctgtctctagaaataaaaaataaaagagaaagtactgggggtaaaaaaaaagtttggcgcccttgcttctgcttaagagttgtcatatgaagcccgagaacactgaaaaggaagaggacaccattacgctctggagcgtggggtcagtgttcaggktatagaaagtttgctccccagctccaactgccagacccagaggctctctggaactcagatcccagagctggcctttcaggtgtgtctggcccaacatgtctgtttgctgggccacagatcctcttggctcagaggtcctgttcttccctgttctcctgccttccaagggcacttccacatgtgtggctgtcatttactctctgcccacgaggagtcagggcagccagactgcccaaccctggctctgtgctttgtcctgaaggtctacaccctaccctgccttcctcccaatactaattg

SEQ ID NO: 127064 - DNA, 601 bp, Human
agctgcagggttgcctgaaaagagattccactgcttcgccatctttctctcatttttctcatgtcactttaaatatgaagctccatctcagatgtctatacgcagggagggttggagattgccactcagccccactttgcctgacaacaggaatgaggctaggaataggaagagaaggccgggcgcggtggctcacacctgtaatcccagcactttgggaggccgagacaggcggatcgcgaggtcaggagatcgagaccattgtggctaacacggtgaaaccccatctctactaaaaatrcaaaacattagccgggcgtgttggcgggcgcctgtagtcccagctactcgggaggctgaggcaggagaatggcgtgaacccgggaggtggagcttgcagtgagctgagatcgtgccactacacttcagcctgggggacagagcgagactccatctcaaaaaaaaaaaaaaaaaaaaaaaaggaataggaagagaaaatagtgcagagctgaattaagagaaagtactgggactgggtgcagtggcgtgagcacgcctgtaagcccagcactttgggaggctgaggtgggcagatagctta

SEQ ID NO: 127065 - DNA, 601 bp, Human
gtgaggatattcagcaagaagtgcaggctcctaggtctggaagtcttagggatctaaggcttagcctttagcttcctggattgttttcaaccccagaaacttaaagtgctcagtgaagttgatgccccaaacagccccaggtggctcaatgccaagaatgacccaacagtcaaggaagcagctgctgttggttttggaccttggctctggtaccctgctgtgacaaccctcatcacccaaggggcctactgcagagccagggttgtcaggaggtggagcagcaccaggctatcaggggctmcttagctccaagtctagcccgcctcaggcccagtcctaaccctgcagtagctaacaagaaagaagttatacgccaggcttttttccatcttcgtagaaacaaaaagccttttgccgttcacctctatttgtttactgctgcttttctggagggacaagagaatatggaagcatcttgggaactgttagggttccccagaaacgagatacaattatccccacagggacatctgtatgttccaggacatgagattggtgtccctcccaccaaccttgtggttcttgaggcttcatccgtcac

SEQ ID NO: 127066 - DNA, 601 bp, Human
ggccaagatcatgccactgcactccagcctgggcaacagagcaagaccctgtctcaaaaaacaaaacaaaacaaaacaaaaaaaacccagaaaactactgaagtgttcttagctagaaaggtggcacccttgaggctgggtgtggtggctcaggcctgtaatcccagcactttgagaggccgaggtgggtggatcatgaggtcaggagtttgagaccagcctgaccaacatagtgaaaccccatctctactaaaaatacaaaaattagccgggcacggtggcacatgcctatagtccccgatactcgggaggctgaggcaggagaatcacttgaacttgggagacggccgtttcactgagccgagattgtgccactgcattctagcctaggcaacagaatgagactctgtctcaaaaaaaaaagaaagaaaagaaaaagaaaagtggcacccttgtagcctatgtaagttgtgtgtgtgtgtgtgtgtgtgcacaagtgtgcacatttaagggctcattttcctaattcgaacattctctcccactgccagccacaccacgtggactttgggaggctgcataaaggacacctccctgaggc

SEQ ID NO: 127067 - DNA, 601 bp, Human
cagtggctcaggcctgtaatcctagcactttgagaggctgaggtgggcggatcatctgaggtaaggagtttgagaccagcctggccaacatgccaaaactccgtctctactaaaaatacaaaaattagttggccatgatggtgcatgcctgtagtcccagctacttgggggctgggagctgaggcaggagagtcgtttgaacccaggaggtagaggttgcagtaggccaagatcatgccactgcactccagcctgggcaacagagcaagaccctgtctcaaaaaacaaaacaaaacaaaaaaaaaaaaacccagaaaactactgaagtgttcttagctagaaaggtggcacccttgaggctgggtgtggtggctcaggcctgtaatcccagcactttgagaggccgaggtgggtggatcatgaggtcaggagtttgagaccagcctgaccaacatagtgaaaccccatctctactaaaaatacaaaaattagccgggcacggtggcacatgcctatagtccccgctactcgggaggctgaggcaggagaatcacttgaacttgggagacggccgtttcactgagccgagattgtgccactg

SEQ ID NO: 127068 - DNA, 601 bp, Human
tcacactccttcatcatgccgatgtccacacagcgtttgagccggcaggcctggcagtggcgtcggttgtccttggtgatgcggcagtccccgttgaaggggcaggtgaatagtgccttccgcttcatgcttcgcctgccgagagagcacacaccctgccctgggtcactgaacttccggctcctcaccctgtcatcacggagacctgtcttctgggccccctggtctccatttctccaacagaagacatgaggcccaccccagctgccagtcactctcacctctaggctgggcaccaaaygattcctacttctcctttcattgcctgcccagctccaatcatggcttgtacttaccttttttcttttaatttttgtttcttttggggggacagggtgttgctttgtagcccaggctggaatgcagtggcatgatctcagctcactgcaggctggacctcctgggttcaagtaatcctcctgcttcagcctccagtatagctgggattacaggtgcataccaccatgcctggctaattttttgatttttttgtaaaaatggggtctcactatgttgcccaggctagtctggaactcctggg

SEQ ID NO: 127069 - DNA, 601 bp, Human; identical to SEQ ID NO: 18765

SEQ ID NO: 127070 - DNA, 601 bp, Human; identical to SEQ ID NO: 18766

SEQ ID NO: 127071 - DNA, 601 bp, Human; identical to SEQ ID NO: 18767

SEQ ID NO: 127072 - DNA, 601 bp, Human; identical to SEQ ID NO: 18768

SEQ ID NO: 127073 - DNA, 601 bp, Human; identical to SEQ ID NO: 18769

SEQ ID NO: 127074 - DNA, 601 bp, Human; identical to SEQ ID NO: 18770

SEQ ID NO: 127075 - DNA, 601 bp, Human; identical to SEQ ID NO: 18771

SEQ ID NO: 127076 - DNA, 601 bp, Human; identical to SEQ ID NO: 18772

SEQ ID NO: 127077 - DNA, 601 bp, Human; identical to SEQ ID NO: 18773

SEQ ID NO: 127078 - DNA, 601 bp, Human; identical to SEQ ID NO: 18774

SEQ ID NO: 127079 - DNA, 601 bp, Human; identical to SEQ ID NO: 18775

SEQ ID NO: 127080 - DNA, 601 bp, Human; identical to SEQ ID NO: 18776

SEQ ID NO: 127081 - DNA, 601 bp, Human; identical to SEQ ID NO: 18777

SEQ ID NO: 127082 - DNA, 601 bp, Human; identical to SEQ ID NO: 18778

SEQ ID NO: 127083 - DNA, 601 bp, Human; identical to SEQ ID NO: 18779

SEQ ID NO: 127084 - DNA, 601 bp, Human; identical to SEQ ID NO: 18780

SEQ ID NO: 127085 - DNA, 601 bp, Human; identical to SEQ ID NO: 18781

SEQ ID NO: 127086 - DNA, 601 bp, Human
acttatgattgataactacgtgccaggtactgttataaatgctttacacagattatatcacaacaacagcaaatctatgaggtaggtactattattgttaccattctgtgaagaaactgaggctcaaaaacattaagtaacttgcccagggtcatacaaatagcaaatggcagagccaggcctgggagacagcagtttacttgttaactgttacttttaacttgttaacactttgcagcttccacttggcatgcctagtactcatctgtctgtagggctgtcttctcccactgcacagtgyttttcttgggggtggcgactgtcttgttcatcgccatatccccagcactgagctcggtggtgtggctggttagaaacattggaaggactacataacttggctggacctcagagggaacctgcagcctcgctcactgtcagcacggactatgctcagaggcccggggcacaagaccctgggaggcccttgggtgaggtgtgagagggtcagatactccctgttgcctgggaggagaagccagagagcagatccctaaccccatgtcgctggcatgaggagaggtaagcaccaccagaatgc

SEQ ID NO: 127087 - DNA, 601 bp, Human
gttctggtagatatcatggagcaggagtccctagcaccaagaagctgagatccggaagaggcgccccaaaaaatcagcctggagtgaatctagagggcccatcagggatcggaggtcggaatgtgggagcaatgtcacctccttgataaaaacttatttggccatctcagcaacccaatagtgatgttggccaacacttatgattgataactacgtgccaggtactgttataaatgctttacacagattatatcacaacaacagcaaatctatgaggtaggtactattattgttaccattytgtgaagaaactgaggctcaaaaacattaagtaacttgcccagggtcatacaaatagcaaatggcagagccaggcctgggagacagcagtttacttgttaactgttacttttaacttgttaacactttgcagcttccacttggcatgcctagtactcatctgtctgtagggctgtcttctcccactgcacagtgcttttcttgggggtggcgactgtcttgttcatcgccatatccccagcactgagctcggtggtgtggctggttagaaacattggaaggactacataacttggctgga

SEQ ID NO: 127088 - DNA, 601 bp, Human
accccttgccagagaatactgacattaattataggtcagtaaatacgcatgtagtgaagtccaggtgttggtgattgttgaaggattgacattgacaaataaagaacatgactgaaagaagttggggacagtagtcactagagttccatgcatttcagatttatattcctatcttcccacctctttcccacacttttctccccaggcagctttcggctggggccaatttggtttattaagtggcacacctgccccctggtggccaggtggtacaatgacaccttctctcagttctggtagrtatcatggagcaggagtccctagcaccaagaagctgagatccggaagaggcgccccaaaaaatcagcctggagtgaatctagagggcccatcagggatcggaggtcggaatgtgggagcaatgtcacctccttgataaaaacttatttggccatctcagcaacccaatagtgatgttggccaacacttatgattgataactacgtgccaggtactgttataaatgctttacacagattatatcacaacaacagcaaatctatgaggtaggtactattattgttaccattctgtgaagaaa

SEQ ID NO: 127089 - DNA, 601 bp, Human
taagggctgtcgaccaggctatgtgtgacttctcctttcaccaccaaggtctggaggtctaaggggagctctgcccactacccccaggagctcacgggagcttcttcctgccttcctcctctcagcaaccagtatctaggaggccatgccttccttcccagagtccagctcagacaatttgcagaacaacccagcttgaaatttgatacttgatccaccccttgtgcatcccctagatcaaataaccctggatctgtgacccttggctcagatctgtctaattcttaaagagtctgttcasacttggagtgaggctgttgagtcctgaggagggaggggctgtggcagcattgacaagttccccgcattcctgtggtacctgagtctttccaatgactcccctcacctgaggctcagtctctcattacccacccgcttcccttccttatcggtgaggtcttgaacaactgaaccaaagagcttctggttcatgagctaatgttaacctgcaagaggacacagtctttggctctgtctcagtcaactctgaatatggtctgcagacctagcttttggaagatgcaagagcaggagggatggt

SEQ ID NO: 127090 - DNA, 601 bp, Human
acaaaataatgaactgtcatcttccaaggcaaaggattgcagaagccactgatatcctgcccaccgccctccccatccactcctctaccacctccagtccttcctgtgaacacagcagaggcaggagcctcttggggtggggtccctatcagggaggaagtgcagctggcttctcccccaccccctttatcacttctcccccatccctactttatcacccagggcctccacaatcccctccctgtccctctccgggggctcctgggtaggagagggaaagacatgtaaatcagtggggctwggggaagtggaggaagcagaaaggataccaggagcatttcccctacacgcttaacctggggctcacagtccttgccaggctgggccagtggcttaggggaccaagcccttcctgataggccgcttgatctatctggccagcctagtaggcaaatggggaaatagtagtcaggagttgacaaagttggggcacctgccctcactttggccctagccccatgccggctgccacagatgttcacaggtgtctgcaggattcttttgtttttgttgttttttgacataggctctcgctctattg

SEQ ID NO: 127091 - DNA, 601 bp, Human
atgatgaaaattacagtaataaaggctaacatttaccgagcaccgaactccatgccaagcgcaattctaaatactacatagtagctcatgtggtcttcacaacacctaggaagtaagtaccattactctctttgctttacagaagacagacaaatagccagcagttccacagcgactcaggggactgccagggttcaaatcctgctcctgctagatgccacttctgctgctcttcattgctgccctagacaaggccaggccctgcggcgtgctgcgagccttccttccgttatctttaccrgctctacatggtcattcacagatgagaaagctgaagatcagagagctcacacatttcccacaaggttacacagtcagtaagagacactatcaggattccaatgacctgctgttaaagttcatctcttattcactcattgcctccctcaaggctgaagagtggggtggaggggagaccagcagagctactgagctcaatctgcctccttggccctcccagcccagagctctgccagcggtggtaggaggagtgtggtaagtatttgctgatgaatgaacaaccgaaggacaaaataatgaa

SEQ ID NO: 127092 - DNA, 601 bp, Human
atccaggacctggcccaggtggagtgatagaaaaatcttccaatgaactatcaaggtgaggggatccaaaggtctgggtggtcctgggtgagtgtttttccagaataatggggcatctacagggacaagctcaggagagctaagcctcagtccagagaccctcatgaagtcaaagactgaaggaattatccaggaaatgttgcctggctttgcttcgcctgagtgaggctggccactgagaatctgtccttcagtgtctgtctggagacatctggttggagctctggctggcccacacctstagtagggcctgcacctgtgtctgtcatgtactgcccttgtctcccgagcctggagccccacacttcacctgctgggagggtctagataagcgctgtccaatagaaacggaatgtgagccacatatgtaacttattttctattagccacatcaaaaaaaggaaaaataaacaggtgaaattcattttagtagtatatttatgtaacctaatatagtaaatctaaaacattattttggtatgcaatcaaaataaaaaattactaatgaaatcttttacattttttttccatactaagtgtt

SEQ ID NO: 127093 - DNA, 601 bp, Human
ctgtggtgagctaagcctaagacagagtgcgtgggagggagggctctagacaggaggaaggacacctctgggcttctggaaagagatccaggacctggcccaggtggagtgatagaaaaatcttccaatgaactatcaaggtgaggggatccaaaggtctgggtggtcctgggtgagtgtttttccagaataatggggcatctacagggacaagctcaggagagctaagcctcagtccagagaccctcatgaagtcaaagactgaaggaattatccaggaaatgttgcctggctttgcttygcctgagtgaggctggccactgagaatctgtccttcagtgtctgtctggagacatctggttggagctctggctggcccacacctgtagtagggcctgcacctgtgtctgtcatgtactgcccttgtctcccgagcctggagccccacacttcacctgctgggagggtctagataagcgctgtccaatagaaacggaatgtgagccacatatgtaacttattttctattagccacatcaaaaaaaggaaaaataaacaggtgaaattcattttagtagtatatttatgtaacctaatatag

SEQ ID NO: 127094 - DNA, 601 bp, Human
cccgcttaggccagaaccttgttcatggcagaaacacacagatgggcaggtgccacatccttctataacaataatgccagcagcaaaataataataatgataatgataatgataaaataaactacccatcacctgctctctgataaaacccctcagcagcaaaacctcacgatgtacccattccatttacgagaatatttgctcccaaaagctgcaagtgttttataagattatctagtctctaggatcccctaaacctaacactttatcaaaaccacgtaggctgggcgcagtggctcaygcctgtaatcccagcactttgggaggccaaggcaggtggatcatctgaggtcaggagtttgagaccagcctggccagcatggggaaaccccgtctctactaaaaatacaaaaattagccaggtgtggtggcacatgccggtaatctcagttacccaggaggctgaggcaggagaattgcttgaacccaggaggtcaaggttgtagtgcaccactgcactccagcctgggcgacagagcaagactctgactcaaaaaataaataagtaaataaaaaccacttgaaagaacctgtgaaaaaa

SEQ ID NO: 127095 - DNA, 601 bp, Human
tcccaaccctgaggtaagcgaggccccgcttaggccagaaccttgttcatggcagaaacacacagatgggcaggtgccacatccttctataacaataatgccagcagcaaaataataataatgataatgataatgataaaataaactacccatcacctgctctctgataaaacccctcagcagcaaaacctcacgatgtacccattccatttacgagaatatttgctcccaaaagctgcaagtgttttataagattatctagtctctaggatcccctaaacctaacactttatcaaaaccwcgtaggctgggcgcagtggctcatgcctgtaatcccagcactttgggaggccaaggcaggtggatcatctgaggtcaggagtttgagaccagcctggccagcatggggaaaccccgtctctactaaaaatacaaaaattagccaggtgtggtggcacatgccggtaatctcagttacccaggaggctgaggcaggagaattgcttgaacccaggaggtcaaggttgtagtgcaccactgcactccagcctgggcgacagagcaagactctgactcaaaaaataaataagtaaataaaaac

SEQ ID NO: 127096 - DNA, 601 bp, Human
ccaagaatccagagaaggaaaaattgaggcagccccagaggtggagtcatgtctgattggaagcaagagcccacagtggcctaggagggcttggccatgctggcggtgaacttcaaaccatagattctattcccttccctcaggcacagctcgggactcactatctgttgctaccggcatattcagcgtgggacttcttacttcagcccctttccttgtcccagttctccttcggcaggcagatccaacccctctgcgcttgttaacttaccctcccaaaagcctttcctggcattcaagycctcctacaacctggcaccacactccatacacatccctgcccagtgcctcctggtacttagggctcagtagtgttagtcactattattactatcattatttctgccagactgggctgctagctgcttcccatcctgtcctcacgcttccacactcccttgccttcgctcatcatgctgcctccaaaagaaatgtcctcccagcccctttctccttctgttgaaatctttccaatcctcaagacccactccctatctagtgggagggagggagggagggaaggaaggaaggaaggaaggaa

SEQ ID NO: 127097 - DNA, 601 bp, Human
ctcaccttctctcaggcccctgccgacttcaaaattaccagcccttaatgaaaggccaggagaaagaaggcaaagaggagatggggttccacaggcttctgtcttccaagtccttgggcatgcttgcccacagctaccagagggtccccactccctaccccatcacacatgagtttctctcttgctcaagggttttatatcagaattgagaaagttccagcttccatgccaagaggccaccaaggactaaagctgaggtccattatccctaagcaaactggagggggtggataatagcacwgtaccttcattctcctctccatagtcaacctcttctgctctgctctgagaagtgtgcttggaattttctccccattttactgatggggaaactgaacttcagtgtcaaagtggagtgaacagcttagacatgcaaacttccctgccccaaaacccactgtaagacccggtggccacagagacacccgccgaataagggacacagaggcctctggagaacactgcaccaggaccattccaggtgcaacatcaggaggcagctctgagcttgcctctgagcctggccctgctgggcaaggag

SEQ ID NO: 127098 - DNA, 601 bp, Human
gttagggaggtggctagatctggggactcctcctaatactcaggcctctaaggaaagggctgtctgggggcaccttcctgtagccctaaggcctggggcctccagggaaggttaccacagaaacagggggaaaatattacaaggaaacacaatacccggcagggtcacctgctgaccgggcttcctgctgtgttgcccacccccagctcactgctctcacagcctccttctccagccttggcctgggcctcctcaccaaggctctccttcctgcctccccagagctgggagaagcagtctkaagcagaaactctgcccctccgtggttccaaacaacaacatcgaggatggcccagagctgagccccccactcctaatccttaccaacccctcctcaccatcaccacaggaaatcaaagcttcctgccccaaaggaagtgccccatctagtgaacaaatccaacacacacaaatgcacagtcctgggagcctccgggaggacagatgccctcccgctagccccagactttattcaggccctgcttccagcaataccccacaccccactggaggcctcagtccgaagtctaactgagggcag

SEQ ID NO: 127099 - DNA, 601 bp, Human
gacttttgaccttgttcctttcacacacataggctattcctcaagctactgagaagcccctctcttcacagattttttggttttgatgccttcaacttaaggttgtgaacttaggcttctagacttcatggggctttgccttagtgatgtcataagtaagctttgacatcagtgctcaccaatggcttcttgttgacaagcccaaactttcaggccttaccttagatcagttatcagaagcatttggcactgttccaacttcttgaaactgtccacttttggcttctaagacattgctaartcctggttcttttgtatttcttgctgccccttattagtttttatcatggaaccccccttccccttcctgttccttcaatgttggttttcctcagggttgcattccttgcccctttcccttataattctgcatattctcttgagatagtctcttctgtgttcacatggatactccacaagaacttcaaacagcatatccaaatatgaatgtatcacccccactgccacctgcccaaaccaaaacctgcctctgctgagtcagtggaccacgcttttaccctttgtctaaatcaatcacggg

SEQ ID NO: 127100 - DNA, 601 bp, Human
tatccactgtgggctagcccacagtgagtgagagaaatacaatcatttgctggtttactgaaaatttgtaaattacatttgtatcccccttttttcagctcagttccctaaaaatccatgggcaaaaatttaatatgcagtgtctagtgaaggctctacctaggtgctaagtaatggtgcctgccataaagtggtctgagaatgagccagaattctccaccagtatcccaaagtcatggctgcccaggagtacatatgatatgaaaacctaagtatacttacctctctcaggtaagtataytttctctcagggatagaaagccttaatttcccagggacttatagatacctctcttggggtatctataaggctttctttacctagagctatttttcctgtgaatacctggatattgcagcttctgctgctagcaccatggattgcaaggagctaaggggaaaggattggcagtacctgggtacagttagaaatctcagtgcagagagaggaaaaatactacaaaacacattgggatgaactcctaataataatttggacacaatccagtaatgtcaggccattagggagaatttctaaaga

SEQ ID NO: 127101 - DNA, 601 bp, Human
taatatgcagtgtctagtgaaggctctacctaggtgctaagtaatggtgcctgccataaagtggtctgagaatgagccagaattctccaccagtatcccaaagtcatggctgcccaggagtacatatgatatgaaaacctaagtatacttacctctctcaggtaagtatactttctctcagggatagaaagccttaatttcccagggacttatagatacctctcttggggtatctataaggctttctttacctagagctatttttcctgtgaatacctggatattgcagcttctgctgctrgcaccatggattgcaaggagctaaggggaaaggattggcagtacctgggtacagttagaaatctcagtgcagagagaggaaaaatactacaaaacacattgggatgaactcctaataataatttggacacaatccagtaatgtcaggccattagggagaatttctaaagactgaagtcactgcttctaagatgtgaaagttggagattatttgagaagccaacatacatgtatgtattcacttgttctctttaggatagtcatggatgacaaagccttcaatgaaaggagttcttagcag

SEQ ID NO: 127102 - DNA, 601 bp, Human
tggagtggacgtattacagcttgtttaatcattcaaacatttgagttttcaatttttggctattagggataaagcgactatgaacatttgtgtacagctttttgtgtgaacttaaattttcatttctgcagagtaattgcccaggagttcaattgggttgtatggtagttttttgtttcttaaaaaaattttttttcaaagatactgcccaactgtttccagaatagctgtaccattccatcagcaatttatgaaccacctgttttgtttgcatccttaccagcatttgggggtcgtcacyttttttttttttttttttttttttactattctgataggtatatagtggtatttcttttttctttctttctttttttttgagatggagtctctctctgttgcccaggctggagtgcagtggcatggtctcagctcactgcaacctctgccccctgggttcaagggattctccggcctcagcctcctgagtagctgggattgcaggtgcctgccaccatgcccagctaattttttaaatttttagtagagatggggctttcaccatgttggccaggcaggtcttgaactcctgaccttgtga

SEQ ID NO: 127103 - DNA, 601 bp, Human
atgtgtccaggtggtaagtactgatcctaaacccctttcttaacactctcaagcccctgccttggagctcaaggggcatgagactatgtctaaggccactggtataggagcaggtggaaaggcaagatggtatagtaagagacatgtggggaaagaacacagtgggctttgcataggagctcttaactaagcttcagtgttcccatctgtaaaatgttcctaaggaaggtgggagattctacatcctccttagtaatgaaacccagtatctcataatatacaacctcaaacctttttatcwtgtctttattggaagaataatgctatattcctcctaactttattaagaacaggagaatattattaaattctagctgggtagcttttgtctctatgatttctatcttgaacatgtttctctgaaccaacacgaggttactaatgctaacgttgagggttattgtaaggattggagataagctatattagcatgtgatacagtacctagcaaatgttgagtgctcaggaaatggtggcctttattatgaaggaatcactcctttgataccacagagcgaacgtggcggctgagagcgagaac

SEQ ID NO: 127104 - DNA, 601 bp, Human
agtgagccatcatatggcttcacatcacgttaatggcacgctgggttgtataaggacaaaagagaaaaatacatttagttttaaatgcccaacaacagtgcagcaaaagacaggagttctggaaacttgagctctactaaaaacgaccttgtccaagtctgcagtttcccaaccaagtgagaattctagaattggtccagtaggattattaaaaagtataaataaggtagatccctaacccctggcacttcaacctctctctttttgcaaaaaccaggaaaattatgcaatggtgtgaagyagctcacgtaaagatgcacttataattcagtgggtcacttcatgggtttctcacctaactaatttatgcaaaataagtaataagtttaaaatttcgtaacggcaagcaacagttgtatagaaaagggcagaggcagtatgcttgagtttgtctgtttaaatagagattcggggccgccaccccagaactagttaaccaccttctcctggggtggagctcgggaacgtgcgtacttttaacaagtgacctccccgagtgctgcacaggacaatcccaagcgacaacactgtgcccaaagaa

SEQ ID NO: 127105 - DNA, 601 bp, Human
gcaacaaaagcctgcgaaattaattatagctaagcctggtaaaataccaggttattagttatgcaatccaatagtatctgaggatcttcagaagcgagataaccagtaacagtatagtctcaagctttccagttcagaacatttgaaaaacatcaccttcctattactagtccagatgagatttcaacttctaaaatgagaacaaactctggctcaacgtaatcacaagtcagacttcaaatttcattcatcagggtactagcatgcgaaacacaggccattccaaaatgccacgtgcagycccaaaccatagtttccttgctgacgtggctgttatcagaactccaagcagtgctatgtccaattagtgagccatcatatggcttcacatcacgttaatggcacgctgggttgtataaggacaaaagagaaaaatacatttagttttaaatgcccaacaacagtgcagcaaaagacaggagttctggaaacttgagctctactaaaaacgaccttgtccaagtctgcagtttcccaaccaagtgagaattctagaattggtccagtaggattattaaaaagtataaataaggtagatccc

SEQ ID NO: 127106 - DNA, 601 bp, Human
agccaaaactatgacttaaaaaaaaaacctccattctgagtctattaagtcagtaagtcattgaaattttactgaactaaatgtaccattaactgttttaaggagtataaaatatggcgggtgtcttcaagaagcctaaagtagaaaggaaaaggtaaaaagaacatgactttgattctaaagagatgaatgaaaaatgttatgaagaataagtaaagaatgacgagtctcaaagggactgagttccaagagtattacaaaggatgggtcataccagatgcccacttgtgagggcttcccratacacagatggccatgcctcacaggaaacagtcccatacagtggaggcccacatgagctgaatcctggaatagcagctggttgaggggctgccaagcagaaagataacaaagataacccaatttatctgctggtccatcagaacagcagccacgaaaacctgagctcgtttgtgtccagaacagtagggaggaaactgctaaggccacttcagtcactgaggccattttgggacatttcttaaaataaacccctgttaactgagatcatctcaacatgtttctattcctcattccccga

SEQ ID NO: 127107 - DNA, 601 bp, Human
tttatagctgaggaatctgaagtctacataggtaaaattatgcccacggccacacatttaagagtggcagagctggcactggaacccagactgtcaacgctgaagccatcttccttctactgccaacagctacccacactcagcatcttgctggatctttgaaccttaaccatcttgcaaatctgtaggcatttcaaagtcagtagcatatttaatataaagccaaaactatgacttaaaaaaaaaacctccattctgagtctattaagtcagtaagtcattgaaattttactgaactaartgtaccattaactgttttaaggagtataaaatatggcgggtgtcttcaagaagcctaaagtagaaaggaaaaggtaaaaagaacatgactttgattctaaagagatgaatgaaaaatgttatgaagaataagtaaagaatgacgagtctcaaagggactgagttccaagagtattacaaaggatgggtcataccagatgcccacttgtgagggcttcccgatacacagatggccatgcctcacaggaaacagtcccatacagtggaggcccacatgagctgaatcctggaatagcagctg

SEQ ID NO: 127108 - DNA, 601 bp, Human
catccccagtttatagctgaggaatctgaagtctacataggtaaaattatgcccacggccacacatttaagagtggcagagctggcactggaacccagactgtcaacgctgaagccatcttccttctactgccaacagctacccacactcagcatcttgctggatctttgaaccttaaccatcttgcaaatctgtaggcatttcaaagtcagtagcatatttaatataaagccaaaactatgacttaaaaaaaaaacctccattctgagtctattaagtcagtaagtcattgaaattttastgaactaaatgtaccattaactgttttaaggagtataaaatatggcgggtgtcttcaagaagcctaaagtagaaaggaaaaggtaaaaagaacatgactttgattctaaagagatgaatgaaaaatgttatgaagaataagtaaagaatgacgagtctcaaagggactgagttccaagagtattacaaaggatgggtcataccagatgcccacttgtgagggcttcccgatacacagatggccatgcctcacaggaaacagtcccatacagtggaggcccacatgagctgaatcctggaa

SEQ ID NO: 127109 - DNA, 601 bp, Human
acccataaaatcaattgtatttttcttcctttactctttcacatcagtatgtcagaacacttccaaaattaaaaataaaaaaagacactacctgatttcttaaaataaaaacatctttgcaaacatggtttaaattatgccacgttaaaaaacaaaaacaacttctaagggctctcttagccccaacctcttcaaccctgcacataaacatttattatgtgccagactctatgcttaacatgtatgatcataatgaatcctcaccaccctctgaaattccactagcatccccagtttatagctgaggaatctgaagtctacataggtaaaattatgcccacggccacacatttaagagtggcagagctggcactggaacccagactgtcaacgctgaagccatcttccttctactgccaacagctacccacactcagcatcttgctggatctttgaaccttaaccatcttgcaaatctgtaggcatttcaaagtcagtagcatatttaatataaagccaaaactatgacttaaaaaaaaaacctccattctgagtctattaagtcagtaagtcattgaaattttactgaactaaatgtacc

SEQ ID NO: 127110 - DNA, 601 bp, Human
ggttgtcactatgtgtctttaggacgaacagtcaaccgattgtccacatgataaatcctcatgaagacattacaccagataactaagcaatttctcttctaggtctagaattttatcctcacctaccaggggcataacaaccacactgcaggtttactgcaactcaagaggaggaagccctcccctctgtcttagagctctcagaaaataaacctcactcagtgctgaacactctaaaacaaaatagaggtcacgctagtgacctagcacttagtcaactaagataacccataaaatcaaytgtatttttcttcctttactctttcacatcagtatgtcagaacacttccaaaattaaaaataaaaaaagacactacctgatttcttaaaataaaaacatctttgcaaacatggtttaaattatgccacgttaaaaaacaaaaacaacttctaagggctctcttagccccaacctcttcaaccctgcacataaacatttattatgtgccagactctatgcttaacatgtatgatcataatgaatcctcaccaccctctgaaattccactagcatccccagtttatagctgaggaatctgaa

SEQ ID NO: 127111 - DNA, 601 bp, Human
ctttagaggaataaatcaactattgtacagcacagataaaagtatctggttgtaataaaaactctaaaagtcagctattactatttccattactactactactacaattccaaaatttacctcagacaattccaaaatccaaattctttaagcaaaaatcaaaaaattttcttcaaagtacccccttttatgatggccatactttaaacaggagtcaaacctttcatctttctccttccgagacatctttctattatcagcttcagaaagttttcgagtcacttctttggaaacagcatcytccctcttctgtgctactctggaagaaaaagaaaaaaagaaaaagtttccatatgctacagaggtgaacatcacactctctcagaaacacaccgtactcatattttgtactggcaacagaatgatatttcacatttcaagaaaagaagctgagcagaaagttccaagtttattacactgcactagccaaaagagaagttcgagaaatgtccaagatgtggtttattagtgacgtgttttgatttccccttaaaaagaagaattttccacagtttaggaattaatgtggttaataaagtca

SEQ ID NO: 127112 - DNA, 601 bp, Human
taaggtacttgctcatccaccttttcctccttttaaatggtttctggtcctttaaaagtgtgttacttgttttatatgcattttaagaaaaccgtattaaatacagaaaatatattatatgcactttaacaatggaagttcacacaaagttctggagcaaagtggggtaaaaaatatgttccaacaaagcatcttcttgatactgaaacaaaagatccatgaaaaccagcagatccacaactattaaactatgtggcaattcttcagcacaagtttactcagggacttctgctactcagaygttaagattgtccaataagccttctaagagcagccggcagaaaaaattgggactaggggttaacaaacgtggcacagaattgggcaacaggagaaaaacccagttattttctttttcccaaccaatacagataactaattatgggatatccctcgggaagctcaggaacagaaataccaccacatagacatgctaacacataaacccttcagacccagaggggttaggcgatatgttcaaggttgtgcacctattaacagacaaagcctgctctgtacaaagctctgttgcctcctcaat

SEQ ID NO: 127113 - DNA, 601 bp, Human
ttttaaatttaggacccccaaatgccctcattgccaacggttctgcctagtagaagacattttcttcctagtagggaacgtggtttgggagagcacttctcaatatcttaaggatgttttcaggaagagcttcctacaagagaaatgttgagaccaagcaactgttaaatgatagatcacctgtaaatcaagaagaaaccacactcccactctggaatgaatgttaatgaatctcacattctcctctgcttatttccatccttggataaatgaacattttaaagtacttttaagcggcatrgagtatatattccaaatgaatgtagacagagctttgagagatacacatctaagcaaagaaatgctgataagccttcttcttacatcaaatctcctggaattctttcagagagaaacaagctagatcttaatgagaggctctggtcccagttatcaaggtcaatcaatacagtacaaactgtatcccgtatggcttttatggtggaaataaaaacagccaaatttctaccaatgaaaagaagagaaattttataatgttctgacactctgcacttatatatatccatgaaacctccacctc

SEQ ID NO: 127114 - DNA, 601 bp, Human
ctttttattctattttacttgttctgatagtttatcttattaatttactggtatttcatccatcttttcttttaccccttcacacatgcaaaaggaagttataggatgcctgtgaataagggagccttcattcttgttggttaattaactttgtaaagcagtttttaaaagggtaggttgtgacccattagtgggatgtgaactcaatcaagtggatcgaatgcccatagaaattaattgagttgagaccagcattttaaaaaaatgaaataggaaagaatagaaaaacatcagcagcacrtcgcacagagtaggataattatcgttttatgaaacatgtgcatgtgtccacgtgtgagtttatctggtcaaaaggtaaaatacatattttttactgtaggtcattatcaaaaaggttgaaggccactttgtagacactttgtctcccaaaaagataaacctactctggagtcagatgacacatcccctcaaccctaaggacagcactttaagtaagtcattggtaactgacacattatattcattaagtatactaatccaaagaaaacaagttttgccggaaaggagctaaatgaaggct

SEQ ID NO: 127115 - DNA, 601 bp, Human
gtgttgttatagaagatggaaaatgttgtagcttcataatcagcaacttcattcttcttccacaagattctagagacacagaaacaagtcaaacaagcttataaatatgatttaaaaaaacttttaagtaccatatggctctagttcatcataaaacaagtttttccttgagtgttctagggtaagaatgtgtttgtaatattagatttagtcagaattgtcccctttcttccactgaaaaaaaatatgtcactctatgatagtgaagaaaacatcatgctggttatgttaccatttttcycaggcaaccagggttatggaagaaaggactcattaatggcaacccgcacggtttcatcagcagctaagtcaaatatctttctcttggcccttacctaaaactcaaactccatgattagcagcctgtggagtttccttggctataccttgggcttgaggctttctacagcctacggatttcagacttcaatatcacaccttcagaagacaatcccaatgacaaaaattacctgtggtctcacagaagtaggctattgttagccatctttattaattcaaacaaaaaaagagcgcttaatca

SEQ ID NO: 127116 - DNA, 601 bp, Human
actgtggggttgaagttcttcaatatgaagaaggaagcaacaatgaccacgaccaggaacagagtgttgttatagaagatggaaaatgttgtagcttcataatcagcaacttcattcttcttccacaagattctagagacacagaaacaagtcaaacaagcttataaatatgatttaaaaaaacttttaagtaccatatggctctagttcatcataaaacaagtttttccttgagtgttctagggtaagaatgtgtttgtaatattagatttagtcagaattgtcccctttcttccactgaaaaaaaatatgtcactctatgatagtgaagaaaacatcatgctggttatgttaccatttttcccaggcaaccagggttatggaagaaaggactcattaatggcaacccgcacggtttcatcagcagctaagtcaaatatctttctcttggcccttacctaaaactcaaactccatgattagcagcctgtggagtttccttggctataccttgggcttgaggctttctacagcctacggatttcagacttcaatatcacaccttcagaagacaatcccaatgacaaaaattacctgtggtc

SEQ ID NO: 127117 - DNA, 601 bp, Human
agctgttattttaaatgtccagaaagttatctaaagtcagcactatttaatggactgactcccagagcagtttttctttccactaaaatatccagacaagtcaaaaccaaaatgaactactgtttcttgacttctaaaaaagataatcaaccttgaaaaggatacactgtggggttgaagttcttcaatatgaagaaggaagcaacaatgaccacgaccaggaacagagtgttgttatagaagatggaaaatgttgtagcttcataatcagcaacttcattcttcttccacaagattctasagacacagaaacaagtcaaacaagcttataaatatgatttaaaaaaacttttaagtaccatatggctctagttcatcataaaacaagtttttccttgagtgttctagggtaagaatgtgtttgtaatattagatttagtcagaattgtcccctttcttccactgaaaaaaaatatgtcactctatgatagtgaagaaaacatcatgctggttatgttaccatttttcccaggcaaccagggttatggaagaaaggactcattaatggcaacccgcacggtttcatcagcagctaagtcaa

SEQ ID NO: 127118 - DNA, 601 bp, Human
ttaatttcaacaatctgtcaaaaaacagccaataaacaaatactgaattacattctgctgggttttttaaaggctctagactataaaaacatcttgtgtctcccaccctgaccaccctgctacttttccatataccacaggccacccatagacacaaagccagggggtgaagctgacatggtctatttggagccagtagacaggagggcgatgagtcctgatgaagcacttatggacaatatgtagttcctgtaagaaatttaatgttatggaaaaatgagtaactccaaattggtttttygagaaaataaagagcccatctctttggaatgtactgcttccttcctgacacttggtgtaatcataatgatgtgcagccccattgtctgcaaacacaatttgcaagacagaagaccaaaaaaaaatggaaaacattcacaggaaatgtgttccaatttaaaaaaaacactttagacagaaacctagaacacatgatcacaaagaataatctgaattccatttaaccttcacgaagagctgatcaaagaacatggagagaaaagagatttgttttccttttcttcccctaagagcaatggaa

SEQ ID NO: 127119 - DNA, 601 bp, Human; identical to SEQ ID NO: 122258

SEQ ID NO: 127120 - DNA, 601 bp, Human; identical to SEQ ID NO: 122257

SEQ ID NO: 127121 - DNA, 601 bp, Human; identical to SEQ ID NO: 122256

SEQ ID NO: 127122 - DNA, 601 bp, Human; identical to SEQ ID NO: 31456

SEQ ID NO: 127123 - DNA, 601 bp, Human; identical to SEQ ID NO: 31457

SEQ ID NO: 127124 - DNA, 601 bp, Human; identical to SEQ ID NO: 31458

SEQ ID NO: 127125 - DNA, 601 bp, Human; identical to SEQ ID NO: 31459

SEQ ID NO: 127126 - DNA, 601 bp, Human; identical to SEQ ID NO: 31460

SEQ ID NO: 127127 - DNA, 601 bp, Human; identical to SEQ ID NO: 31461

SEQ ID NO: 127128 - DNA, 601 bp, Human; identical to SEQ ID NO: 31462

SEQ ID NO: 127129 - DNA, 601 bp, Human; identical to SEQ ID NO: 31463

SEQ ID NO: 127130 - DNA, 601 bp, Human; identical to SEQ ID NO: 31464

SEQ ID NO: 127131 - DNA, 601 bp, Human; identical to SEQ ID NO: 31465

SEQ ID NO: 127132 - DNA, 601 bp, Human; identical to SEQ ID NO: 31466

SEQ ID NO: 127133 - DNA, 601 bp, Human; identical to SEQ ID NO: 31467

SEQ ID NO: 127134 - DNA, 601 bp, Human; identical to SEQ ID NO: 31468

SEQ ID NO: 127135 - DNA, 601 bp, Human; identical to SEQ ID NO: 31469

SEQ ID NO: 127136 - DNA, 601 bp, Human; identical to SEQ ID NO: 31470

SEQ ID NO: 127137 - DNA, 601 bp, Human
tgacagagcaaggccctatctcaaaaacagaagaaaaaaaaaagaacatgagctcctgaggtggtggcctgggttacaaccctggcctgtccatttcagtagctgggtgactccatgcctttttaaacctcagtttcctgaaatgtaaagtggagataatcctactccctaccttgtagtcattgcaaggattacaggaggctggcacttaatcaggggccagtacaagtactgttgttagagttcagggagcaatccatttggatttcctcacccgctgcggcctgtggaggagtctgcratgcagtgactggagggagagtgagcctctaggctaggggttcacctaagccattgcttaggattttttttttttttttgagacaagagtctcactctatcgcccaagctggagtgcagtggtacgatctcggctcactgcaacctctgcctccctggttcaagtgattctcctacctcagcctcccgagtagctgggattacaggtgcgcaccaccatgcccagctaatttttgtatttttagtagagacggggtttcaccatgttggccagtctggtctcaagttcctgacctcaggt

SEQ ID NO: 127138 - DNA, 601 bp, Human
agctgagtgtggtggtgcatgcctatagtctgagctacttgcgaggctgaggtgcgaagattgcttgagcccaggaggtggaggttgcagtgagccaagatcatgccactgcattccagactggatgacagagcaaggccctatctcaaaaacagaagaaaaaaaaaagaacatgagctcctgaggtggtggcctgggttacaaccctggcctgtccatttcagtagctgggtgactccatgcctttttaaacctcagtttcctgaaatgtaaagtggagataatcctactccctaccttrtagtcattgcaaggattacaggaggctggcacttaatcaggggccagtacaagtactgttgttagagttcagggagcaatccatttggatttcctcacccgctgcggcctgtggaggagtctgcgatgcagtgactggagggagagtgagcctctaggctaggggttcacctaagccattgcttaggattttttttttttttttgagacaagagtctcactctatcgcccaagctggagtgcagtggtacgatctcggctcactgcaacctctgcctccctggttcaagtgattctccta

SEQ ID NO: 127139 - DNA, 601 bp, Human
gtcctcattgccagctctcctcctcaggcctccactgcactcctccatcctctttttggtccccctaaatattccagcttccttcccacttctgagcttttgtgctcactgtgccctccatgtggaatgccctttctccagccctctgtatggctgacttcttcaggtcacagcccaatgtcacctcctctgtcttgtccagtgccctcaacagagcctggtacatagtaggtactgaaaaaatatttgattcttgactccatcgagcattgcataacactgcatgttaaccactggctgsgcacagtggcttacacctgtaatcccagcactttgggaagccaaggcaggcagatggcttgagctcaggggttcaagaacagcctaggcaacatagcgagacctatctcgctatttaaaaattttaaaattagctgagtgtggtggtgcatgcctatagtctgagctacttgcgaggctgaggtgcgaagattgcttgagcccaggaggtggaggttgcagtgagccaagatcatgccactgcattccagactggatgacagagcaaggccctatctcaaaaacagaagaaaaaaaaaag

SEQ ID NO: 127140 - DNA, 601 bp, Human
tagtacacgaaagactcatttctcccagttgcccttcatggctaagagaaagctggtagactgttgtagaaagtaaaaaagtttcctcttcaaagtttcccttcttattaaagaataaatcataagtgttagaaataatagtttcctttaaagactaacttccttcaagcctccttgctttgtgctaataactctttgttaagctctatcctatgtagctgttagacatgctcacaggcacatagtacattctatgtccttgtaccttaaccaagatatttgtgctggacattccagctcrcaggcacattccagctcacagcctttgccccttccctatttggcataagcaacttcctcttttcctttgttctcccttgcctttacctatttaagaaaggtttaaattattagccagtcgggttagcttagattgtgtggtctggctccagccaatagagagacaggacacagtagcagggacaagctgagtaaaggataaaaattgcttccctcctttattcaggtgtgctctcgccattgttccatctgcaaggagcaccctttctgcagaaagtaaaattggcttgctgagaaaact

SEQ ID NO: 127141 - DNA, 601 bp, Human; identical to SEQ ID NO: 31471

SEQ ID NO: 127142 - DNA, 601 bp, Human; identical to SEQ ID NO: 31472

SEQ ID NO: 127143 - DNA, 601 bp, Human; identical to SEQ ID NO: 31473

SEQ ID NO: 127144 - DNA, 601 bp, Human
catttcactgctgccaaaattacgtcaaaaaacgtaaaaaatgaagttgaacttaggcaaataagttcacaatgctgaagtgacatgtactggtgtcatctactgatacgtgcaacttactctgaattgctccccaaaattaaatgaacttgataatcgattataataccgtaaaatgctaattgtagatgatggacatatgtgtatccacttcccaattctttcaactttccgcatgcttgaaaatacaaaaatggtaaggaaaatttttacaagcactgggagacaaaaacaaaagtgrtaattctgttggtggtaaaagtttctctcatttgatgttacacacctcactgcttcacaaaatacactacctttggaactcgttaaaccaataccccaatcacctactgtccctggggaaactgataggtacatttcaggaattgttgtttcctgtcacaaactgttcacgttgtttgcgatcttcagagattaagtcagtaattatggaaaacacgacgtattcaacaatacactaaaattatttgttaaattccaccaagaatcttaattaactgcaagatttgtattcctgaaccaa

SEQ ID NO: 127145 - DNA, 601 bp, Human
cagaaatatatataagccacaagtaatttaaaaattttaagcagccatactgaaaaaaaagtttttaataaaaggtcaaattaattttgatattttacttaactcacgatctgcaaaatactatttcaatacataatatatcaaaagtattaagatatttattttgttcataccaaattttcaaaatctggtataaattttacacttaacacatctcactttttaagtacttaaccacatgtgggtgatggtatcaaagtggacagtatagttctagatccacactatacagtataacgtkaaatcatgtgtgtgatgatgaccctaaggcaagttgccttatcaaagaaaggctcaatttgactcaatacgtttaaattatgtctaagtatattaatattttcccagaagtttgcactgacagaaggcactttctaaaaccagagtatatactgcctgaacatttcaagtaaatgtacttcaaaattttacacataacctaacagtctatgaaatcccagaataagctaattagaagttacacagaaactcccctccattatctgcactaatgtctcacatatataactctccattcttc

SEQ ID NO: 127146 - DNA, 601 bp, Human
gtgagccatgatcactgagccatggtgctcaagcaatcctgccaccttggccccgcaaagtgttgggattacaagcatgaaccactgagcccagctcacattgtatttctataaaaaataagtcatggtaaaaatttccaatgagaagtgttttgatgaacaagatatattaacaggaagccctaataccagggtaagcaaactttctgttacgggctagacagtaaatatttttggctctaccagccacacggtctattctgaaaggagctatagataacacataagcaaatgggcacartagatttcgactaccagtttgctggcctctgccctaaggcacccattataagcaatggctcttaaattttcataaattttgtgagccagtttaataacggtatcttgaaatctgccacagtgagaatatttacatcatggaaatccagcaaacactacaaatcagtgtttttcctgaagaacgggttgataaaccagcatttaccaacaaaccactcactatgtaatgaattaacttctctcctatacatctaaaattatattcattatgaaccatctttgaaaagaaatggatagctat

SEQ ID NO: 127147 - DNA, 601 bp, Human
atttttttgtagacaggctggtctcgaactccaggaggtgggggctgcagtgagccatgatcactgagccatggtgctcaagcaatcctgccaccttggccccgcaaagtgttgggattacaagcatgaaccactgagcccagctcacattgtatttctataaaaaataagtcatggtaaaaatttccaatgagaagtgttttgatgaacaagatatattaacaggaagccctaataccagggtaagcaaactttctgttacgggctagacagtaaatatttttggctctaccagccacayggtctattctgaaaggagctatagataacacataagcaaatgggcacagtagatttcgactaccagtttgctggcctctgccctaaggcacccattataagcaatggctcttaaattttcataaattttgtgagccagtttaataacggtatcttgaaatctgccacagtgagaatatttacatcatggaaatccagcaaacactacaaatcagtgtttttcctgaagaacgggttgataaaccagcatttaccaacaaaccactcactatgtaatgaattaacttctctcctatacatc

SEQ ID NO: 127148 - DNA, 601 bp, Human
tttgtttttaagagaccaagtctcattctgtcaccacagctggaatgctgcggtgcaatcatagctcagtgtaacctccaaactcctgggctcaaccttgctggactagctgggactacaggtgtgtgccaccacacctagctaaatttttatttttttgtagacaggctggtctcgaactccaggaggtgggggctgcagtgagccatgatcactgagccatggtgctcaagcaatcctgccaccttggccccgcaaagtgttgggattacaagcatgaaccactgagcccagctcacaytgtatttctataaaaaataagtcatggtaaaaatttccaatgagaagtgttttgatgaacaagatatattaacaggaagccctaataccagggtaagcaaactttctgttacgggctagacagtaaatatttttggctctaccagccacacggtctattctgaaaggagctatagataacacataagcaaatgggcacagtagatttcgactaccagtttgctggcctctgccctaaggcacccattataagcaatggctcttaaattttcataaattttgtgagccagtttaataacgg

SEQ ID NO: 127149 - DNA, 601 bp, Human
ctcactctgttgccaggatagagtgcagtcgcacgatctcagctcactgcaacctccacctcccggattcaagcgattctcctgcctcagcctctccagtagctgggactacaggtgcacaccaccacgcccagctaatttttgtattcttagtagagacagggtttcgccatgttggccaggacggtctcaaactcttgacctcataatccgcctgccatcatgattgtatacacttataaagtacaacatgatgtcttgatatatgtaaacaatgtggagtgactaaatcaagctaatrtatctatcacctctcttatcttttttgtagttgcagctgctggtacaggaaagtaactgtaataatgccatcagacacttaagttgactaagaataaacacactttttcaaaatcacattgttaaaatattcctaagaccagcctgtctgggcaacatggcaaaatcctgtctctataaaaacaaacaaaaaaattttaaaaaaaaacccaataagaaaaatagctgggcaaggtggtgcacgcctgcagtcccagtttcttcagaagctgaagtgggagaatcgcttgagcccaggaga

SEQ ID NO: 127150 - DNA, 601 bp, Human
tggcagctgcttaaccagtaaaccaggcagactgttgccatatctacaggacatcaaactaactcatagttgtataaatttacctggaaaaatcagagttcaggtctagcaacaatattctgcaaatacacacatatattttcatgcctataataaatagaatctgtgaagtatgctaatccaacagtctctgcaaacagcagatttaagtatcaacttcagtctctaaaaaaagctcctaatctcaatttaatggtatttgtatagtttcacttcacttttcaaattaatttttttttttgagtcggagtctcactctgttgccaggatagagtgcagtcgcacgatctcagctcactgcaacctccacctcccggattcaagcgattctcctgcctcagcctctccagtagctgggactacaggtgcacaccaccacgcccagctaatttttgtattcttagtagagacagggtttcgccatgttggccaggacggtctcaaactcttgacctcataatccgcctgccatcatgattgtatacacttataaagtacaacatgatgtcttgatatatgtaaacaatgtggagtgactaaa

SEQ ID NO: 127151 - DNA, 601 bp, Human
ttagacatctatatggcagctgcttaaccagtaaaccaggcagactgttgccatatctacaggacatcaaactaactcatagttgtataaatttacctggaaaaatcagagttcaggtctagcaacaatattctgcaaatacacacatatattttcatgcctataataaatagaatctgtgaagtatgctaatccaacagtctctgcaaacagcagatttaagtatcaacttcagtctctaaaaaaagctcctaatctcaatttaatggtatttgtatagtttcacttcacttttcaaattaatttttttttttgagtcggagtctcactctgttgccaggatagagtgcagtcgcacgatctcagctcactgcaacctccacctcccggattcaagcgattctcctgcctcagcctctccagtagctgggactacaggtgcacaccaccacgcccagctaatttttgtattcttagtagagacagggtttcgccatgttggccaggacggtctcaaactcttgacctcataatccgcctgccatcatgattgtatacacttataaagtacaacatgatgtcttgatatatgtaaacaatg

SEQ ID NO: 127152 - DNA, 601 bp, Human
ctgggactacaggtgctccccaccacactggctaatttttttatttttttagtagagatggggtttcactatattggccaggctggtcttgaactcctgaccttgtgatctgcccacctcagcctcccgaagtgctggacttaaaggcgtgaggcgccgtgcccagtccccttttttatacttttcaacatcatttgaatttcttaattttaaagcaaaaatatgtaaaaggtattttttaaatgtaaaagttatatcctttaagaaaactggagagagctttaaagagttaaaaaaaaaattacccccaagttttagacatctatatggcagctgcttaaccagtaaaccaggcagactgttgccatatctacaggacatcaaactaactcatagttgtataaatttacctggaaaaatcagagttcaggtctagcaacaatattctgcaaatacacacatatattttcatgcctataataaatagaatctgtgaagtatgctaatccaacagtctctgcaaacagcagatttaagtatcaacttcagtctctaaaaaaagctcctaatctcaatttaatggtatttgtatagtttcact

SEQ ID NO: 127153 - DNA, 601 bp, Human
gctcactgcaacctccacctcccgggttcaagtgattctcctgcctcagcctcccaggtggctgggactacaggtgctccccaccacactggctaatttttttatttttttagtagagatggggtttcactatattggccaggctggtcttgaactcctgaccttgtgatctgcccacctcagcctcccgaagtgctggacttaaaggcgtgaggcgccgtgcccagtccccttttttatacttttcaacatcatttgaatttcttaattttaaagcaaaaatatgtaaaaggtattttttaaatgtaaaagttatatcctttaagaaaactggagagagctttaaagagttaaaaaaaaaattacccccaagttttagacatctatatggcagctgcttaaccagtaaaccaggcagactgttgccatatctacaggacatcaaactaactcatagttgtataaatttacctggaaaaatcagagttcaggtctagcaacaatattctgcaaatacacacatatattttcatgcctataataaatagaatctgtgaagtatgctaatccaacagtctctgcaaacagcagatttaagtat

SEQ ID NO: 127154 - DNA, 601 bp, Human
atgggccctcccaccttttttttttttttgagactaagtctcactctgtcgcccaggctggagtacagtggcgccatcttggctcactgcaacctccacctcccgggttcaagtgattctcctgcctcagcctcccaggtggctgggactacaggtgctccccaccacactggctaatttttttatttttttagtagagatggggtttcactatattggccaggctggtcttgaactcctgaccttgtgatctgcccacctcagcctcccgaagtgctggacttaaaggcgtgaggcgccrtgcccagtccccttttttatacttttcaacatcatttgaatttcttaattttaaagcaaaaatatgtaaaaggtattttttaaatgtaaaagttatatcctttaagaaaactggagagagctttaaagagttaaaaaaaaaattacccccaagttttagacatctatatggcagctgcttaaccagtaaaccaggcagactgttgccatatctacaggacatcaaactaactcatagttgtataaatttacctggaaaaatcagagttcaggtctagcaacaatattctgcaaatacaca

SEQ ID NO: 127155 - DNA, 601 bp, Human
agataagcccttaaagagacaatttgcaacacaaccagcacagctcaaatccagatttcataatgtctacaaatcaccaagaaacacaacccaattgaaaaatggccaagaaattgaaacaggaatttcacaaaaatgaaatccttttcatttaaatggcaaacaacacaggtaactttaaattaaaaccagtaacaaatgcactgaatggttcagtttaagactgttaaagagtgttacagaggatgcagagcaactggaaaccacacacactgtgggtacaagtataaatcagtacatyttggaataacattttgcaacagaagttgaacatatgcttaccctatgacccaacaattccactatttaacaaactacatgtccacaaaaaatacaatcaacatttgaaccaatattacttgtattggccaaaaactgcaaacaatccaaatgtccctcaactgtaaaataaactatagtatagtcatttgatagattacccccaatgacaacaaatgaactactgccacatatcatcacggatacctcaacacgagcgaaaaagccagtcacaaatgaatataaattgtatgatttcatt

SEQ ID NO: 127156 - DNA, 601 bp, Human
agaggttgcagtgagccgagattgcaccattgcactccagcctgggcgatgagagcgaaactccgtttcaaaaaaaaaaaaagacatgcatctattcttacatcctttcaaatacctaccaaaaaatagtattttttaagctttatggagacataactcataccacgtaattcactcatttaaagtatacgattcaatggtttctggagtattcacagacatgtgttacaatccatttcagaacattttcattacctcaaaaaaatctataccctacagctatcacccacctatggctcakcacttccaaccataagaaaccagtaatttctactttctgtttccatacgagtatttcatataaatgcaatattataacatatggtctttgtgactagcttcttatacttggcatgttttcaagattcacccatgtcacagcatgtgtcaatacttcatccctttctatggccaaatagtatgccattgtatgaatataccacctattttgcttatccactcatcaggtgatgagcatttgggttgtttctgccttttggctattataaacaatgtgatacatttatctcagagaaactga

SEQ ID NO: 127157 - DNA, 601 bp, Human
acaaacctatccagattaactatttttcatatgcaaaatgagagggtaaaactagatttgtgtttcttaaccttaaactcagaaatgctttccaaaatttttgatatccctcgttattctgaaataagtgacttaattactgaacatacagttatatagcattttattgtattttaggatttgaaggtaagatactagattaaacacatgcatcgggcggggtgcagtggctcacacctgtaatcccagcactctgggaggccgaggcgggcagatgacaggtcaggagatagagaacatmttggccaacatggtgaaaccccgtctctactaaaaatacaaaacttagctgggcattgtggtgcatgtctgtaatcccagctactcaggaggctgaggcaggagaattgcttgaacctgggaggcagaggttgcagtgagccgagattgcaccattgcactccagcctgggcgatgagagcgaaactccgtttcaaaaaaaaaaaaagacatgcatctattcttacatcctttcaaatacctaccaaaaaatagtattttttaagctttatggagacataactcataccacgtaattcac

SEQ ID NO: 127158 - DNA, 601 bp, Human
tactaaagaaagtagccgataaaacctgaagaaaggctttccagggaccagacacataaaaccagacaagagaaaagagcatcatgctataaagaaacacttacttatactattctcagatctttaccaaaatcaccagtatgcttaggctttaccagactgtccaaataggaaagcttcagagtgggcccaggaatctacattaaaagactggctcaagaaatcagtccaaattcagaaaagaatcacatcttcaaaccactctacctcactgtcccacagcagtggatctcaacagatraggaaattgctgccaagaaggtgttttggaaatatataggggcattcttctggttgtcacgataaacggaaagacattaaatgacagaatgtctgagatttaaaaaatcttgtggggacaaggaagggaaggcatatataaaaaacatgataagctatatatcattgttgaaaatcagagataggtgcatgaaagttcctaacactctacatttgtgtatgaacaaaattttccataatcaatttacaacagccaatataaacaactgatttttaaaaaatctgttttacctttgtcaac

SEQ ID NO: 127159 - DNA, 601 bp, Human
ataatcccaatgttccaggaggctgaggcaggaggactgcctgagtccaggagttcgaggctgcagtgagctattatcacaccactgcactccagcctgggtgacagagtgatatcccgcctctaaaaacaaaacaaaacaaaaaatccccaattcaaaacaatacagagatgcatcctttttatgtcagtatcttgatgttagtaagaaatgattattacttcatctctaacacaaaggtcctactataggtgcacatatcctatattcgatcctctgctaaggcctaacaatgcattgyttcccaatatccttattctttttatgttaatgagaccaaatttagttcgagccacagttagctcttaccacgtccaaaataatccattcctcagacttctatcttcagtcctgttcctttctttctagttgaatacagtatacacagccaatctcatattcttggcctagcggtggagtatctctaatgcaaataccccaaatatgaaatgcaccaacatccaaaacttttgagtatccatgacactcaaaggaaatgctcattggagcattttccaactttggattttcaaattaggaa

SEQ ID NO: 127160 - DNA, 601 bp, Human
ctagtttctacaggtacctcatagaggcccctactacagacgctacaattcaaacaccataatcccaatgttccaggaggctgaggcaggaggactgcctgagtccaggagttcgaggctgcagtgagctattatcacaccactgcactccagcctgggtgacagagtgatatcccgcctctaaaaacaaaacaaaacaaaaaatccccaattcaaaacaatacagagatgcatcctttttatgtcagtatcttgatgttagtaagaaatgattattacttcatctctaacacaaaggtcstactataggtgcacatatcctatattcgatcctctgctaaggcctaacaatgcattgcttcccaatatccttattctttttatgttaatgagaccaaatttagttcgagccacagttagctcttaccacgtccaaaataatccattcctcagacttctatcttcagtcctgttcctttctttctagttgaatacagtatacacagccaatctcatattcttggcctagcggtggagtatctctaatgcaaataccccaaatatgaaatgcaccaacatccaaaacttttgagtatccatg

SEQ ID NO: 127161 - DNA, 601 bp, Human
tgtttgcacagcaccatacagtctagtttctacaggtacctcatagaggcccctactacagacgctacaattcaaacaccataatcccaatgttccaggaggctgaggcaggaggactgcctgagtccaggagttcgaggctgcagtgagctattatcacaccactgcactccagcctgggtgacagagtgatatcccgcctctaaaaacaaaacaaaacaaaaaatccccaattcaaaacaatacagagatgcatcctttttatgtcagtatcttgatgttagtaagaaatgattattamttcatctctaacacaaaggtcctactataggtgcacatatcctatattcgatcctctgctaaggcctaacaatgcattgcttcccaatatccttattctttttatgttaatgagaccaaatttagttcgagccacagttagctcttaccacgtccaaaataatccattcctcagacttctatcttcagtcctgttcctttctttctagttgaatacagtatacacagccaatctcatattcttggcctagcggtggagtatctctaatgcaaataccccaaatatgaaatgcaccaacat

SEQ ID NO: 127162 - DNA, 601 bp, Human
tgataccagataagagttttgaatgccactcattgcttctttccctgaatttagctaaggcacacatttttctattttaacatctccgaaatcaggatctgtcttacaattgctgacagccaggcatcaactacatgcctgcacatgtagtctacatgacttcaactgaatgcctgggtacactgttgtatcatatgtaacgggcttaattaccacattaagtgtcttcaaaataattacactattaattggcactgacagaagttaccatgtattcagaatagcaccaaaatagaaggaatatgttgaatgagtaaagcaagtatttgctgttggtaaacaacagcataaaaacttacaggagtgttaatggcttggaacaaaatcctggagaaaatactggagagctcttttaagcaatgctacaccaccaacactcttgacagaacagagtttgatactgtatgaaaaaatatggacactgacaactaagtctttgtatgttatgcaagagtgatatgataaaattccatacccatgtaagtctaaaggagctctttcactaagtataaaataaacattttaagtgacaagaaaacat

SEQ ID NO: 127163 - DNA, 601 bp, Human
cttccagatgataccagataagagttttgaatgccactcattgcttctttccctgaatttagctaaggcacacatttttctattttaacatctccgaaatcaggatctgtcttacaattgctgacagccaggcatcaactacatgcctgcacatgtagtctacatgacttcaactgaatgcctgggtacactgttgtatcatatgtaacgggcttaattaccacattaagtgtcttcaaaataattacactattaattggcactgacagaagttaccatgtattcagaatagcaccaaaayagaaggaatatgttgaatgagtaaagcaagtatttgctgttggtaaacaacagcataaaaacttacaggagtgttaatggcttggaacaaaatcctggagaaaatactggagagctcttttaagcaatgctacaccaccaacactcttgacagaacagagtttgatactgtatgaaaaaatatggacactgacaactaagtctttgtatgttatgcaagagtgatatgataaaattccatacccatgtaagtctaaaggagctctttcactaagtataaaataaacattttaagtgacaa

SEQ ID NO: 127164 - DNA, 601 bp, Human
gctgagctgaatgatcctgaggcctagggaaaataattaatcacagagtaagcagtagagctgattatttttaaaagaaccaccaaaggccaggcacagtggctcacgcctgtaatcccagcactttgggaggccgaagctggctgatcacgaggtcaagagatagagaacatcctggctaacacagtgaaaccccatctctactaaacatacaaaaaattagccgggcgtgatggtgagtgcctgtagtcccagctacttgggaggctgaggcaggagaatggcgtgaacccaggaggcrgagcttgcagtgagcgagatcgcgccactgcactccgtccagcctgggcaacagagcgagactccgtctcaaaaaaaaaaaaaaaaaaaaaagaaccactgaaatcctgacatctagaaataaagggtaaactctcagaccaaatcaaattatcatttagtaaaaagcctgagaaaactaagcattaggaacaaaaaatacaaaataaaataaaaccctacaaaatacaaaatatgctgcaattgcccctcctctttgagtataatgtacacaaatatttcattagtttcaatcatattg

SEQ ID NO: 127165 - DNA, 601 bp, Human
gagttactattaggagttgatgatgtagtaacattgcttccagctgtatttgtttgctgagctgaatgatcctgaggcctagggaaaataattaatcacagagtaagcagtagagctgattatttttaaaagaaccaccaaaggccaggcacagtggctcacgcctgtaatcccagcactttgggaggccgaagctggctgatcacgaggtcaagagatagagaacatcctggctaacacagtgaaaccccatctctactaaacatacaaaaaattagccgggcgtgatggtgagtgcctrtagtcccagctacttgggaggctgaggcaggagaatggcgtgaacccaggaggcagagcttgcagtgagcgagatcgcgccactgcactccgtccagcctgggcaacagagcgagactccgtctcaaaaaaaaaaaaaaaaaaaaaagaaccactgaaatcctgacatctagaaataaagggtaaactctcagaccaaatcaaattatcatttagtaaaaagcctgagaaaactaagcattaggaacaaaaaatacaaaataaaataaaaccctacaaaatacaaaatatgctgcaattg

SEQ ID NO: 127166 - DNA, 601 bp, Human
ccagatgtagagttactattaggagttgatgatgtagtaacattgcttccagctgtatttgtttgctgagctgaatgatcctgaggcctagggaaaataattaatcacagagtaagcagtagagctgattatttttaaaagaaccaccaaaggccaggcacagtggctcacgcctgtaatcccagcactttgggaggccgaagctggctgatcacgaggtcaagagatagagaacatcctggctaacacagtgaaaccccatctctactaaacatacaaaaaattagccgggcgtgatggygagtgcctgtagtcccagctacttgggaggctgaggcaggagaatggcgtgaacccaggaggcagagcttgcagtgagcgagatcgcgccactgcactccgtccagcctgggcaacagagcgagactccgtctcaaaaaaaaaaaaaaaaaaaaaagaaccactgaaatcctgacatctagaaataaagggtaaactctcagaccaaatcaaattatcatttagtaaaaagcctgagaaaactaagcattaggaacaaaaaatacaaaataaaataaaaccctacaaaatacaaaatatg

SEQ ID NO: 127167 - DNA, 601 bp, Human
aagccactgagtttggctatctattatcaaaagaaaatggataacagcactttggcagatcacaaattcaggagatctagaccatcctggctaatatggtgaaacccagtctctactaaaaatacaaaaaaattagccgggcgtagtggcacactcctataatcccagctactcgggaggctgaggcagaagaatcgcttgaacccaggaggcagaggttgcggtgagcctagatcgcgccactgcactccagcctgggcgacagagcaagactctgtctcaaaaaatatatatatatattttccacagaacctcaatatataaatctaatacaggccaggcacagtggctctcatctgtaacccagcattttgggacaccagcaggacaccgtaagccaggagtttgaggctgcagtgagctatggatggcatcactgcactctagcctccgtgactgagcaagatcctgcctctcttaaaaaaaaacaaacaaacaaacaaaaactaatataagaaaaacaaaagcagttttaggcgaggctggcttcccagacccccttccatgtgttcaggacagttacaaaataactaatgcagtc

SEQ ID NO: 127168 - DNA, 601 bp, Human
ttcctggcaagttccaacgtctacgaaaaatatttccaaaaaaagaaaaaaaaaaggcattgaaatacacatgaattacattaattactttattaactgccattaaacaaagtttatgggaggccactgttttgttttgtttttttaatttttttgagacagagtcttgctttgtcgcccaggctggagtgcagtggcatgatcttggttcactgcaagctccgcctcccgggttcacacccattctcctgcctcagcctcccgagtagctgggactacaggcgcccgccaccacgccccrctaatttttttttgtattttttagtagagacggggtttcaccgtgttagccaggatggtcttgatctcctgacctcgtgatccgcccacctcagcttcccaaagtgctgggattacaagcgtgagccaccgcgcccggccaggaggccactgttttggaccagcctcctgcactatgccccagcagaccacaacaaaccaaaatagagccacttgtgccaagtgccatgtaatcaaagtgaactatgaaaggggccagtttcccccccaaaaccatagtaagctgcagtcaacgtgagtc

SEQ ID NO: 127169 - DNA, 601 bp, Human
ttatatccccctgggatgctttctaggttgctcaaagctcggtcctggttcctcatcatctcctgcatcattgctggattcctggcaagttccaacgtctacgaaaaatatttccaaaaaaagaaaaaaaaaaggcattgaaatacacatgaattacattaattactttattaactgccattaaacaaagtttatgggaggccactgttttgttttgtttttttaatttttttgagacagagtcttgctttgtcgcccaggctggagtgcagtggcatgatcttggttcactgcaagctcygcctcccgggttcacacccattctcctgcctcagcctcccgagtagctgggactacaggcgcccgccaccacgccccgctaatttttttttgtattttttagtagagacggggtttcaccgtgttagccaggatggtcttgatctcctgacctcgtgatccgcccacctcagcttcccaaagtgctgggattacaagcgtgagccaccgcgcccggccaggaggccactgttttggaccagcctcctgcactatgccccagcagaccacaacaaaccaaaatagagccacttgtgccaag

SEQ ID NO: 127170 - DNA, 601 bp, Human
cctgctcttgtgcagcactcagcattggttcctgaatatctgtgtacatgcgccttaaagcattatatccccctgggatgctttctaggttgctcaaagctcggtcctggttcctcatcatctcctgcatcattgctggattcctggcaagttccaacgtctacgaaaaatatttccaaaaaaagaaaaaaaaaaggcattgaaatacacatgaattacattaattactttattaactgccattaaacaaagtttatgggaggccactgttttgttttgtttttttaatttttttgagacrgagtcttgctttgtcgcccaggctggagtgcagtggcatgatcttggttcactgcaagctccgcctcccgggttcacacccattctcctgcctcagcctcccgagtagctgggactacaggcgcccgccaccacgccccgctaatttttttttgtattttttagtagagacggggtttcaccgtgttagccaggatggtcttgatctcctgacctcgtgatccgcccacctcagcttcccaaagtgctgggattacaagcgtgagccaccgcgcccggccaggaggccactgttttggac

SEQ ID NO: 127171 - DNA, 601 bp, Human
agtaagaacattgcaaccctctcaaaagattgttagtatcaaagtaaggattaagtagaatatagaacagaatatttttattgatttaaaaatggtattacttcaggttttacaaaacctatattataaacataaatctcaagatatccactgtattctataaaagaatatatatcaactgtgatcattaattactcttctcattctgattcttctttcagcaatgaatttttaaaaattcttcatccagcacctcatctttccacttcctctgccaaagtacaggcatcttttaaaacaygcccagtctatctcatcttagagaagtgctcccatgtctccatttcttcctacttatacgccaagtattaggactaaaattgtcactatggctaatgatcttggacctaattcatggacaaaacatccgcatgtagtatctgaatagctgaaaggaagacatctgagttcagtctacagaaaagtggacaaaagtaaatttctaacctgttcacacatgagaatctgcttcacacaaacacagatcttaaccccactatgaaagatttggctccacaaagtctgagggtaagatctggga

SEQ ID NO: 127172 - DNA, 601 bp, Human
gagctactacctttcactttgaagtgattaatctgaatgtaatggcatgttaaaaacaacattatctaatggaattctataaatgccttccacactgataaatatgctattaaaatcaaatgcttttggaatgagtacgtattttgaataagtcagtcaagtctcactacatatcagtattaacagatgaactttgcaattttggtaaacagaacactgaaccccaattatgcaaaatgttattcccccaaagaagtcccattcctcttatcagtagatacaaggaaaatattgtaactamatattaccaatttttttattttttcaattaaaaaatttgtgggaatttgttttgtctcttgatgtaatacattctccattttgcctcttggccagtaatacctgaagtattatctgacccttcacatgaaaaatctgtcaactcctgctctaacacttccttacattctagagtaggtgcttacaggaccaaagaagagtcaagaatttcatctttacatgtgtatgtgtgcatatatgtatgcatcaaatgtcacagttgagtaagaatcataatactgtacaaatatgctgacaatct

SEQ ID NO: 127173 - DNA, 601 bp, Human
ttgcagatttacttttgagctcataccaccagcaacatttttcagacctcaatgcaaatgcaaaggcaactgacattcaaagttcacttaactgtgcaattgaggagctactacctttcactttgaagtgattaatctgaatgtaatggcatgttaaaaacaacattatctaatggaattctataaatgccttccacactgataaatatgctattaaaatcaaatgcttttggaatgagtacgtattttgaataagtcagtcaagtctcactacatatcagtattaacagatgaactttgmaattttggtaaacagaacactgaaccccaattatgcaaaatgttattcccccaaagaagtcccattcctcttatcagtagatacaaggaaaatattgtaactaaatattaccaatttttttattttttcaattaaaaaatttgtgggaatttgttttgtctcttgatgtaatacattctccattttgcctcttggccagtaatacctgaagtattatctgacccttcacatgaaaaatctgtcaactcctgctctaacacttccttacattctagagtaggtgcttacaggaccaaagaa

SEQ ID NO: 127174 - DNA, 601 bp, Human
ttgttagagagttggtaatgcttatgcatgaattcaacctaaaactacaaagcaaagcagcatttatgtgtgatcatactaaagtcattttgacaactaaaattgtttgaatcacaagcaatgtcaaggtgctttacagacttcctatgccgtcaaaaaaaaaaaaaaatcacaagaagcaagacctccattctcacaaatttgcagatttacttttgagctcataccaccagcaacatttttcagacctcaatgcaaatgcaaaggcaactgacattcaaagttcacttaactgtgcaaytgaggagctactacctttcactttgaagtgattaatctgaatgtaatggcatgttaaaaacaacattatctaatggaattctataaatgccttccacactgataaatatgctattaaaatcaaatgcttttggaatgagtacgtattttgaataagtcagtcaagtctcactacatatcagtattaacagatgaactttgcaattttggtaaacagaacactgaaccccaattatgcaaaatgttattcccccaaagaagtcccattcctcttatcagtagatacaaggaaaatattgta

SEQ ID NO: 127175 - DNA, 601 bp, Human
tagaaacaaattagaaaaaggaatacattaataagggacctgtatacgattttcagcaggggaatcaatagttgaaagaaggagaacattgttctgacaaattcccgtctttaataaatgctattttacaactgccattctgagcatgactattataatctgagtgatctactaaataaaagtatttcaaatgtattaacattgctcttaattgctttcaagatttacatttcattaagtagtttatcttcaaaagagtgggcattccagaactctgtacttgtctcctaactcaacataygtagaaacaaactaaacctgcacttctttctagtcaatgaatggcagagataaagttgttttaattacatatgaagtattaatttactgcaaagaaacacacggtctaaaaaattggagacacagtttacttatttttctagtgtattaagatatcatacacaacacaaatgtgccaaaatcacaattacaagattaggttattttaattcacactgcacagtctttttcaatacaattacaaactcacctgtgcagcaaggtcaggattctggcttagtgactgcatcatgcttctcat

SEQ ID NO: 127176 - DNA, 601 bp, Human
acaaatttggtgagggcataagttattactgagaattatacacaaagatacctgaatcaatatagttttagaatttagaaaataaaaaccattcatttgacttaaagcttttaaaatttaagggatgagattaactataaagtcttccaaattcctgacacactacagaagccatttttaacgaacagcaaatataaactacagattatcaaggtttatttcacattctccgtggtttttcaagccctgtggtatggaacctagatagtacctaggcaacttgagggagaaagggttatcrgacgcaattatctcaaaatctctaaggatgaggccccaaccatcggtactgtctataaagcttcccaagtgatcctgagtgttcagccagcattaagatccccaattttcttagctgtggtctctttagaaacaaattagaaaaaggaatacattaataagggacctgtatacgattttcagcaggggaatcaatagttgaaagaaggagaacattgttctgacaaattcccgtctttaataaatgctattttacaactgccattctgagcatgactattataatctgagtgatctacta

SEQ ID NO: 127177 - DNA, 601 bp, Human
acttaaaagggaggaaggtagaacataaataaaaaaaggaaaagggaagatactgtccacaagagggatctccagaagaacaaaaacaaaaaaatgaggcatattctctctcaatgagaatggtggttatgataatgacatgcaatatcctaaaaaataaaagcaatcattttcttaggcttttccttgaacaaacgtgaatatatgccattgaaagaaaaatgggagtaactggcattcatgaagatatattttctactacactggcagaataaacataaacatcaatacatgaactatrtaacatggcttgcttagaaacctcaacacacaagtggcaggcacagagaaaatctagatctgaaaaggaccactacatctacctgcctactacaaaacagctaatattaggtccaaaaaaataacaccgcaaaacagcaaccaacttgccagagaaatggagctgctaggtgaaaatcagtcaggcctagcaccaacagtcctctgggaaaagtattaaaatgatttaagacctaaaagatgtaaatccatttgagaacaccaagattagcatctggatttcacctcactactaccagag

SEQ ID NO: 127178 - DNA, 601 bp, Human
tttttccttctttttggaaatttctaaatttccaacattaaggaatacaaaacttgaatggaaaagaactgatacctgaggatttactccagcaagagcctgcagcatctgctgaataaactgctgatgtccaggttcagtggttcctgctgtgggacttgtgttttcactaggtgtggcgttagatccattagttcccgaagagcctccagtgcttcctaatgcccccaagccaggagtaaacctacagaaagcacaaataggaaatatcctaaggtcctgcaaaaccagaagccagtcygtaaatcagttacattttaatataagctaagccatcttcttaaaataagcccttttggcctggtgcagtggctcattctgggagaccgatgatcccagcagcccaggaatttgagatcagcttaggcaacattgttgagacttcatctctacaaaaaataaaaacaaaattagctgggtgtgctggtgcacacctgtagtatcagttacttggcaggctgaggtaagaggattgctttagcccaggaggtagaggctgaagtgagctgagatcgcgccactgcactccagtctgctcgat

SEQ ID NO: 127179 - DNA, 601 bp, Human
catttttaaaggcaatttctaaaaaataagactttaggttgtagcatgtcttctctacaaccgtaacaacgtttcctttagtgtctcagcaccaaagtcaacaatttttgtaatgcctgttttcttactcaatatccttaagactgtatttttcattaatctaaacacctaagaactactgctttccttttttctccctttttccttctttttggaaatttctaaatttccaacattaaggaatacaaaacttgaatggaaaagaactgatacctgaggatttactccagcaagagcctgmagcatctgctgaataaactgctgatgtccaggttcagtggttcctgctgtgggacttgtgttttcactaggtgtggcgttagatccattagttcccgaagagcctccagtgcttcctaatgcccccaagccaggagtaaacctacagaaagcacaaataggaaatatcctaaggtcctgcaaaaccagaagccagtctgtaaatcagttacattttaatataagctaagccatcttcttaaaataagcccttttggcctggtgcagtggctcattctgggagaccgatgatcccagcagc

SEQ ID NO: 127180 - DNA, 601 bp, Human
caaaatctatttcaaatgattttcaaataggaacaaaaaaaatgcatttttaaaggcaatttctaaaaaataagactttaggttgtagcatgtcttctctacaaccgtaacaacgtttcctttagtgtctcagcaccaaagtcaacaatttttgtaatgcctgttttcttactcaatatccttaagactgtatttttcattaatctaaacacctaagaactactgctttccttttttctccctttttccttctttttggaaatttctaaatttccaacattaaggaatacaaaacttgaayggaaaagaactgatacctgaggatttactccagcaagagcctgcagcatctgctgaataaactgctgatgtccaggttcagtggttcctgctgtgggacttgtgttttcactaggtgtggcgttagatccattagttcccgaagagcctccagtgcttcctaatgcccccaagccaggagtaaacctacagaaagcacaaataggaaatatcctaaggtcctgcaaaaccagaagccagtctgtaaatcagttacattttaatataagctaagccatcttcttaaaataagcccttttgg

SEQ ID NO: 127181 - DNA, 601 bp, Human
ctgtaatcccagcactttgggaggccaaggcgggtgagatcgcttgagctcaggagtttgagaccaacctgggcaacacggttgaaaccccagctctacaaaaaatacaaaaattagccaggtgtggtggtctgcgcctgtaatcccagctactccagaggctaaggtgggaggattgctgcagcccaggaggtgcaggtcgcagtgagctgtgattgcatccagcctgggcactttgtcaaaagggaaagggaaagaaaaaaaaaaaagggaaaggcaaagaggggaaagaggaaaaagrggaaagggggaaggggaagaggaaagggaaaagggaaaggggaagaggaaggaggaaaaggaaaggggaaaggagaaagggaaagaaaaaagaaacccagaaaagaaaacagaaagcacctaacagaccttgagacattaagaagtttggggacaacctaataaaacaggtttaaactggcgatcatctttatataatggcacattattagtaaaaccaatgtatgtttgtagatgcaaccacattattagggggtccatattctttagccatatttacgagatatatatatatgtaaca

SEQ ID NO: 127182 - DNA, 601 bp, Human; identical to SEQ ID NO: 23974

SEQ ID NO: 127183 - DNA, 601 bp, Human; identical to SEQ ID NO: 23975

SEQ ID NO: 127184 - DNA, 601 bp, Human; identical to SEQ ID NO: 23976

SEQ ID NO: 127185 - DNA, 601 bp, Human; identical to SEQ ID NO: 23977

SEQ ID NO: 127186 - DNA, 601 bp, Human; identical to SEQ ID NO: 23978

SEQ ID NO: 127187 - DNA, 601 bp, Human; identical to SEQ ID NO: 23979

SEQ ID NO: 127188 - DNA, 601 bp, Human; identical to SEQ ID NO: 23980

SEQ ID NO: 127189 - DNA, 601 bp, Human; identical to SEQ ID NO: 23981

SEQ ID NO: 127190 - DNA, 601 bp, Human; identical to SEQ ID NO: 23982

SEQ ID NO: 127191 - DNA, 601 bp, Human; identical to SEQ ID NO: 23983

SEQ ID NO: 127192 - DNA, 601 bp, Human; identical to SEQ ID NO: 23984

SEQ ID NO: 127193 - DNA, 601 bp, Human; identical to SEQ ID NO: 23985

SEQ ID NO: 127194 - DNA, 601 bp, Human; identical to SEQ ID NO: 26533

SEQ ID NO: 127195 - DNA, 601 bp, Human; identical to SEQ ID NO: 26534

SEQ ID NO: 127196 - DNA, 601 bp, Human; identical to SEQ ID NO: 26535

SEQ ID NO: 127197 - DNA, 601 bp, Human
agaaattccatacctgttaagcaataactcaccagttttccctcctgcagcccctgctaacctctattctaccttctttctctatgaatttgtctattctagatatctcatgtaagtggaatgcttttttgtccttttctgtatggcttttttttttttttttgaaacagagtctcgctgtgtcgcccaggctggagtgcagtggcgccatctcggctcactgcagtctccgcctcctgggttcaagcgattctcctgcctcagccttttaagcagctgggattataggtgcctgccaccrtgcctggctcatttttgtatttttagtagagacggtttcatcatgttggccaggctggtctcgaacccttgacctcaagcaatctgcctacttcggcctcccaaagtgctgggattacagtcgtgagccacagcacccagcctatggcatattttacgtagcataatgttttataggttcatccatattgtaacgtgtattagaacttccttcctttttatggctgaataatatctattgtatgtatacaccacgttttgttctatttatccgttgatagacatttgggttgttttatct

SEQ ID NO: 127198 - DNA, 601 bp, Human
gcctcctgggttcaagcgattctcctgcctcagccttttaagcagctgggattataggtgcctgccaccatgcctggctcatttttgtatttttagtagagacggtttcatcatgttggccaggctggtctcgaacccttgacctcaagcaatctgcctacttcggcctcccaaagtgctgggattacagtcgtgagccacagcacccagcctatggcatattttacgtagcataatgttttataggttcatccatattgtaacgtgtattagaacttccttcctttttatggctgaatamtatctattgtatgtatacaccacgttttgttctatttatccgttgatagacatttgggttgttttatcttttggctattgcgaataatgctgctatgaaaattggtgtacagatatctttttaagtcctttttcatttattttgcgtctgcccctaggaatggaattgatggattgtatggttaattctgagaaacctgtttttcatagcaatgataccgtattacattcccatcagtaatgcatgaaggttccaatttctccatgtacttgtgaacatgtgttttctagctttttttta

SEQ ID NO: 127199 - DNA, 601 bp, Human
ctgccaccatgcctggctcatttttgtatttttagtagagacggtttcatcatgttggccaggctggtctcgaacccttgacctcaagcaatctgcctacttcggcctcccaaagtgctgggattacagtcgtgagccacagcacccagcctatggcatattttacgtagcataatgttttataggttcatccatattgtaacgtgtattagaacttccttcctttttatggctgaataatatctattgtatgtatacaccacgttttgttctatttatccgttgatagacatttgggttsttttatcttttggctattgcgaataatgctgctatgaaaattggtgtacagatatctttttaagtcctttttcatttattttgcgtctgcccctaggaatggaattgatggattgtatggttaattctgagaaacctgtttttcatagcaatgataccgtattacattcccatcagtaatgcatgaaggttccaatttctccatgtacttgtgaacatgtgttttctagcttttttttaataatagccatccttgtgggtgtgaagtagtatctcattgtggtttcgatttgcatttccc

SEQ ID NO: 127200 - DNA, 601 bp, Human
ctttggctcggcatcagagggagactgtggagagagagggagagggagaccgtggggagagggggagagggagagagggagagggagctaacgtctttgtttagtggacttttatttatgtgcgaatgtaactattgcctgtaggaataattaattgacactttgactagtaattccaatgtctgggcttcctcagggttggttttgtcaaattcttattttcctaagagttgtccatactttcctctttttttgtgatttatatgtttttttgagaactagacattctaggtatattttytcttgtgcatggctggagctgcctgtgacttttccaaacgattattgtagcacgtgtattacttgttgtacgtggtcactgatgtttctgtttcattctctctgcggtcaatcagtgatctgacaaagatttccttaaatacctggctccaaaaagaaaaaaagcatcttgtctgtaagtcttccaatatagatcctgctgggggaagctgctgccaccaagagggtgaaaaccaatgcacgtacctggaccaggcactcggcatcaccagaccaaccaaaacataaaatcctcagttct

SEQ ID NO: 127201 - DNA, 601 bp, Human
agttgtccatactttcctctttttttgtgatttatatgtttttttgagaactagacattctaggtatattttttcttgtgcatggctggagctgcctgtgacttttccaaacgattattgtagcacgtgtattacttgttgtacgtggtcactgatgtttctgtttcattctctctgcggtcaatcagtgatctgacaaagatttccttaaatacctggctccaaaaagaaaaaaagcatcttgtctgtaagtcttccaatatagatcctgctgggggaagctgctgccaccaagagggtsaaaaccaatgcacgtacctggaccaggcactcggcatcaccagaccaaccaaaacataaaatcctcagttcttagagaacaggtccccactgcctgccttggcaccagccagcttctccaggaattccagctgcctgtctcatcggcgaggggcgaaggagtgagggtggtagttgatttgcacacagtgcttactaatgaaaagcagcaacttctctcgtcatcaaacactcccctgattgttgtaagtgtcccatcaggttccagagttcccaaatagtttattccagtctctcattc

SEQ ID NO: 127202 - DNA, 601 bp, Human; identical to SEQ ID NO: 26536

SEQ ID NO: 127203 - DNA, 601 bp, Human; identical to SEQ ID NO: 26537

SEQ ID NO: 127204 - DNA, 601 bp, Human; identical to SEQ ID NO: 26538

SEQ ID NO: 127205 - DNA, 601 bp, Human; identical to SEQ ID NO: 26539

SEQ ID NO: 127206 - DNA, 601 bp, Human; identical to SEQ ID NO: 26540

SEQ ID NO: 127207 - DNA, 601 bp, Human; identical to SEQ ID NO: 26541

SEQ ID NO: 127208 - DNA, 601 bp, Human; identical to SEQ ID NO: 26542

SEQ ID NO: 127209 - DNA, 601 bp, Human
tgggagaaactggtgttttcctagggcaagtcttgaaaactttgatctcttacaacattcacactcaaggttttcagtttaattgctagtaaaagaggcgtaaataaagtaacctgcttttaggttatatggtgtagggctttacagtatacatacacaattatttcgttaagtttatttaaaacttaacatttgggggatgaggatctctttgaaacctttaatgatttcaacaattcaaataatcgttcaacaaacgtttacaatctataaataggcttatttattaagtttgattttyttaagctggtgtttattacagttagctttactatagctgtgaattttgaggttattttagggcattagataagctttaaatttttcataacattttgcagtttctttttaggttgtcagctatcttgaatgacatgtttatacatctgtgcaaaaccttgtatctgaaaaaatatctaaggatatttaaggtttactcaagtctgcagttagtgtttcagtacttaagttcatactctgcagtgcaagaagctttcactcctttttgaggattctgactgaaagactgttgttgtgcttc

SEQ ID NO: 127210 - DNA, 601 bp, Human
cattattcagaaaagtggaaggaacttcttttaaaaattagaaatgagagttgtgaaatggaaataattttttccaaaagatgctgttaagttagtgaatctgaagttggagaaattgggcaggtcattgatactgttaccaacagtttttccatctgtaaaatagggataatcatatttgattatgacatattccccttgaaaggtattttgcatttcttagaggaaaagtgcaatatttgtcattgttgtgatagtgtagagatgaaacaaatatatcttcaacttatatataatttargtagtagagtgtttttatgtactgtaaagtttgtctcatgcatttagctcaggatgtaaattgagagagaatcagaagaatgctgaggatttagtaattttctctctttaaaaattatcttatgttgaatttactggcagagaaacaggagtccagtgaatataaaattctatttatattgctgtaacttctgattaattttcttagccttcatagatactgtgagtatgttttcatggcctcctttttttaacttattttacatgtgcgtgcatttggatattgaggaggtgcacattc

SEQ ID NO: 127211 - DNA, 601 bp, Human
ccatgacccttgtacagtcacatctcttcactgaaatttctttctcccttgaaaatccagttgtaagtgtggggtgggacagatgtgatgatagcagaataaggtgggaataaaagcagaaacgaactaggaaatgggaaaaagtgtagtcctgtggcatggcccgtgtgccttgttaaaacaaaaaaatagactagttgtgaccatagctgggatcaggtatggaactggcagattaggactagaaataaaattgtacatttaggagagaaatttaaaaggaagactgtagagttctaartaaaaccacttctataaaacatttcatagtacaggattgtaatcagtcttgctttctctaagtgacataggattctgcaacttccttaaaatgtttcatgttgtcaaaattttgcatgcttgaaataacctaggtggggacagtttgaaagtgggaatgtgaagcaagtaaaccttgaagttctttctagtcacatcagtgataatctagagtcgtctgtctctatttaaggcaaatttctgggaggagatggacttaactcttttggatggtgaataaagatgtttagagtgggaaaaa

SEQ ID NO: 127212 - DNA, 601 bp, Human
cttaacaccacatggaagccaccaagacttacggcttgcattctgtaaatggcagcccaagctgtacctcagcctctttgagccatggctggagctggagtggcctgaatgctgggatcccaaggctgcacagggcagtggggccctgggtctgacctataaacccattcagtcctcctgggcctctgggcctgtggtgggaggggctgctgcaaaggtctctgaaatacctttgaagccttttccccgtagtcttggatattagcacttggctcccttttagttatgcagatatctgtarcatgcggttgccccacagcctgcttgaatttctctccagaaaaaactttttttttctttgccacatggttaggctgcaaattttctgaatgtttgtgctctgcttcctgtttaaatataaattccagctttaaatcatttatttgacccttcagctaagataggctgttagaagcagccaggttacctcttgaatactttgctgcttaaaaatttcttctaccatatatactaggttgtcactctttagtgcagagttccacagatccctagggcatgaatagaatgcaagtcaagctct

SEQ ID NO: 127213 - DNA, 601 bp, Human
ctgggtctgacctataaacccattcagtcctcctgggcctctgggcctgtggtgggaggggctgctgcaaaggtctctgaaatacctttgaagccttttccccgtagtcttggatattagcacttggctcccttttagttatgcagatatctgtagcatgcggttgccccacagcctgcttgaatttctctccagaaaaaactttttttttctttgccacatggttaggctgcaaattttctgaatgtttgtgctctgcttcctgtttaaatataaattccagctttaaatcatttatttsacccttcagctaagataggctgttagaagcagccaggttacctcttgaatactttgctgcttaaaaatttcttctaccatatatactaggttgtcactctttagtgcagagttccacagatccctagggcatgaatagaatgcaagtcaagctctttgctgagacgtaacacgtgtgacctttgcacaagttcccagtaaccttctcatttccatctcagacctcagcagcctgactttactgtccatatcactatcaatgttttggtcacaaccatttaaacagtctcttaagaagttc

SEQ ID NO: 127214 - DNA, 601 bp, Human
cctttgaagccttttccccgtagtcttggatattagcacttggctcccttttagttatgcagatatctgtagcatgcggttgccccacagcctgcttgaatttctctccagaaaaaactttttttttctttgccacatggttaggctgcaaattttctgaatgtttgtgctctgcttcctgtttaaatataaattccagctttaaatcatttatttgacccttcagctaagataggctgttagaagcagccaggttacctcttgaatactttgctgcttaaaaatttcttctaccatatakactaggttgtcactctttagtgcagagttccacagatccctagggcatgaatagaatgcaagtcaagctctttgctgagacgtaacacgtgtgacctttgcacaagttcccagtaaccttctcatttccatctcagacctcagcagcctgactttactgtccatatcactatcaatgttttggtcacaaccatttaaacagtctcttaagaagttccaaactttgcctcatcttcctatcttcttctgagccctccaaactctgcctgtttcccagttccaaaaccagttccacattttc

SEQ ID NO: 127215 - DNA, 601 bp, Human
ataatagtgaaaaatacctggaaaacagtgctgaaggaagtactagaattctaatccagcttactgcttgtttttatagggccttcaggctaagaattatttttacatttttaagtggttggagaaaacaaatcaaaagaaggataatatttagggatgagtgaaaattacatgagaataaaatatcagtgccgtaagtgaaagttttattgggctacagccatgctcacttgtggatgtagtgtctacggctgcttttgcactacggcagtggcagagacccaatgtcctgtaaagcctaagacattactctctggccctttacaggaaaagtttgccagcctcttggatagactaataaaattagcgtcatttttccaggaaaagaaaagattgtagtggctagaggaaaaatgttaaatagatgaagaaacactgtatacagtcatgaaccgcataacgttttggtcaacgacagaccagtggccttataagatgataatggagctaaaaattcctattgcctagtgacatcatagccattgtaacatcacagtgtaattaccttatttttaaaaaatttagcatagcctaagtttac

SEQ ID NO: 127216 - DNA, 601 bp, Human
cctaataacacgtttctccaaacacatccctgtcgttaagtgacacatggccgtaaatggtgctgagcatcatgctgttctttcccgtgctgttctttctgtttctggtctaacacagaggccgttagcctcctgggactatttacatttaattaaatacaacttaaaattcagttcttcagctacattgactgcattccaagtgcccaatagccacatgtggctggtggccaccatatttgaagaacatttccatcattgcttaaaactctgctggacatggctatgtaatagtaaatayggtactttatgccaggtgctgctcttgaatcttctcaaaaacttcttgaagtagggattattatcacttctgttctacagatcagaacgttgaggaacagggaagtgaagaaacttgcctagaatcacacaactagtgtcagaggcaggatttaaacccacacagcctagcttcagagtcttgcttcttaatcatttcgtgctgagaaaggttgagagtgaggaatacgcttaattgtagcaagagggacatggcttatgtgttgacagtgctgtacagattttgaaaaacaaaacatag

SEQ ID NO: 127217 - DNA, 601 bp, Human
gactatttacatttaattaaatacaacttaaaattcagttcttcagctacattgactgcattccaagtgcccaatagccacatgtggctggtggccaccatatttgaagaacatttccatcattgcttaaaactctgctggacatggctatgtaatagtaaatacggtactttatgccaggtgctgctcttgaatcttctcaaaaacttcttgaagtagggattattatcacttctgttctacagatcagaacgttgaggaacagggaagtgaagaaacttgcctagaatcacacaactastgtcagaggcaggatttaaacccacacagcctagcttcagagtcttgcttcttaatcatttcgtgctgagaaaggttgagagtgaggaatacgcttaattgtagcaagagggacatggcttatgtgttgacagtgctgtacagattttgaaaaacaaaacatagaaaagttgtgtagagtataatagctgcattccttcctagaaggaaatcgagagataggaactggactagtattttggagacccttcagtcttctttatgttaaatggatcatttgaattctgacatatcttcatag

SEQ ID NO: 127218 - DNA, 601 bp, Human
attataatttcacttgagtagaggtgtaggggccacatatgatgctgttgtcggtattacatgcaaaggctaatgccctctgttgtatagcatgaatattgggtgagcattttagtggatgaacacttccctcttctgaatattactaaatttatttggttttattttaacaaatgcatagcatttcatgtgtcaggcactatttggagtactttgtaaacgttaacttatttaatctccctatccctatgagaaatactggtttttttttttttttttgaaacggagtctcgctctgttrcccaggctggagtgtagtggtgtgatcttggctcactgcaacctctgcctccagggttcaagcaattctcctgccccagcctccccagtagctgggattacaggtatgtgccaatacgcccggctaattttgtatttttagtagaaacggggtttcgccatgttgaccaggctggtctcaatctcctgacctcaggtgatccgcccgccttggcctcccaaagtgctggggttacaggcatgagccactgtgcccagccgagaaatactgttatcctcattttgcagttaaggaaactga

SEQ ID NO: 127219 - DNA, 601 bp, Human
ttttagtggatgaacacttccctcttctgaatattactaaatttatttggttttattttaacaaatgcatagcatttcatgtgtcaggcactatttggagtactttgtaaacgttaacttatttaatctccctatccctatgagaaatactggtttttttttttttttttgaaacggagtctcgctctgttgcccaggctggagtgtagtggtgtgatcttggctcactgcaacctctgcctccagggttcaagcaattctcctgccccagcctccccagtagctgggattacaggtatgkgccaatacgcccggctaattttgtatttttagtagaaacggggtttcgccatgttgaccaggctggtctcaatctcctgacctcaggtgatccgcccgccttggcctcccaaagtgctggggttacaggcatgagccactgtgcccagccgagaaatactgttatcctcattttgcagttaaggaaactgaagcacccatgaagcacatttgacccatgtggtcaaatgtttaataatttgaccacagtcacacagttagacaagtgatggcaccgggatttgaacccaggcagtttgac

SEQ ID NO: 127220 - DNA, 601 bp, Human
gatgaacacttccctcttctgaatattactaaatttatttggttttattttaacaaatgcatagcatttcatgtgtcaggcactatttggagtactttgtaaacgttaacttatttaatctccctatccctatgagaaatactggtttttttttttttttttgaaacggagtctcgctctgttgcccaggctggagtgtagtggtgtgatcttggctcactgcaacctctgcctccagggttcaagcaattctcctgccccagcctccccagtagctgggattacaggtatgtgccaataygcccggctaattttgtatttttagtagaaacggggtttcgccatgttgaccaggctggtctcaatctcctgacctcaggtgatccgcccgccttggcctcccaaagtgctggggttacaggcatgagccactgtgcccagccgagaaatactgttatcctcattttgcagttaaggaaactgaagcacccatgaagcacatttgacccatgtggtcaaatgtttaataatttgaccacagtcacacagttagacaagtgatggcaccgggatttgaacccaggcagtttgaccacagaac

SEQ ID NO: 127221 - DNA, 601 bp, Human
tccctcttctgaatattactaaatttatttggttttattttaacaaatgcatagcatttcatgtgtcaggcactatttggagtactttgtaaacgttaacttatttaatctccctatccctatgagaaatactggtttttttttttttttttgaaacggagtctcgctctgttgcccaggctggagtgtagtggtgtgatcttggctcactgcaacctctgcctccagggttcaagcaattctcctgccccagcctccccagtagctgggattacaggtatgtgccaatacgcccggctawttttgtatttttagtagaaacggggtttcgccatgttgaccaggctggtctcaatctcctgacctcaggtgatccgcccgccttggcctcccaaagtgctggggttacaggcatgagccactgtgcccagccgagaaatactgttatcctcattttgcagttaaggaaactgaagcacccatgaagcacatttgacccatgtggtcaaatgtttaataatttgaccacagtcacacagttagacaagtgatggcaccgggatttgaacccaggcagtttgaccacagaacctgtaatctt

SEQ ID NO: 127222 - DNA, 601 bp, Human
catctttccatgtcaatacatagctacctcactctttttagtagctgttattatttccattttagaaattgtatagattccatgtacacttactttcactagtttcctatttaccaacatttgattatttccaggttctttgtttgcttttgagacaaggtcttgctctgttgcccaggctggagtgcagtggcacgatcatggctcactgcagccacaacatcctgggcttaggtgatcctctcatctcagcctcctgaatagctgggactacaggcgtgtgcaaccatgcccagctaatttttttttttttttttttttaattttttgtggtgatggagtaccactctgttgtccaggctgtccttaaactcttgggttcaagtgatccttacaccttggcctcccaaggtgctgggattacaggcatgagccattgtgcctggcccagttttttgatattgtgaaaaacgctgcatgaatatcctttattcatttgaccattgtataccatattgggtctaaaactgttgctaaaatttagtttaatttctcagctgtttaagagttttaaaagaaaatagtttgctgtagagaaaag

SEQ ID NO: 127223 - DNA, 601 bp, Human
catgagccattgtgcctggcccagttttttgatattgtgaaaaacgctgcatgaatatcctttattcatttgaccattgtataccatattgggtctaaaactgttgctaaaatttagtttaatttctcagctgtttaagagttttaaaagaaaatagtttgctgtagagaaaagtatacacaaaaaagttacgactatcctaaagaattcatatatctaagtatgtctaagaaaagaatacagaagacatgaatgggtagactataattcatctaattattggatacttaaatttttttcyagtttttgttttgttaaacatctttaaatctttgtggatattcttaggaaaagtcagtggatctgtggagaatcttcatttgggaacttcccagccccagtttttttttttttttaatcaccagagacccaccttcctctttaggaatctcactaatctgttactattactgtactgatctcagatattccccatatcattccagagtgagcacagaactgccctttaattttctgtggcaaagctgaaattaagctgtaatgtttaaacagaactttattaaagttggttagtaataca

SEQ ID NO: 127224 - DNA, 601 bp, Human
tgcagtgtagtggtgagatctcagctcactgcaacctctgcctcccgggttcaagcaattctcgtgcctcagcttcccgagtagctgggactataggtgcatggcaccatgcccagccaactttttgtatttttagtagagatggggttccaacatattggtcaggctggtctcaaactcctgaactcaagtgatttgcccgcctcggcctcccaaagtgttgagattacagatttgagccagtatgcctagcctaacctttctattttgatgtatttggaacatctttggtacatttttygaacaccagttaaaccaaactaagcacaatataaggtattcttttcaacatatgtacttcatcatctctcagaattcttttgcctttaaatctgttatcttttaagcctattatccttccacattgcataatccctgtttgttttgtatctgttctcctactgtacaaagaacaatggtcttttgcttttagaaacattaaagtagtttattataataatgtatcaccatataaaaaaattaaatgatgcaaaagaataaataataataaatgtgcagttccacttcacagtttgttatt

SEQ ID NO: 127225 - DNA, 601 bp, Human
aagggatgggatgtggagtgtggagtttctattttctaagatggggcagtctgtgggaagagccaggttgggggatggggaagagttagttttggatgtggtaagtgagaggtgtttattaggtgtccaagcagagatgctgaataaacagccaaatatatgcttttggagtttggagaagggcttcatcctggatatacacagtatatatttgagaatcatcagtgtatagatggtatttacagccacagaattgaagagatccccaagggagtgggtatagatgaagaagacaagattmgaagaggcacaggactctccccatcctcctgacctataaaatcaggtgccccaagggctcctggtattgtatttttagtagaaacagggttttaccatgttggtcaggctggtctcgaactcctgaccttaagagatccgccccctctcagcctcccaaagtgctggaattacaggcgtgaggctcagacccttggggcacctggttttataggtcgggaggatggggagagtctagcaaaggacactgagaaggagccactgatgagaaagaagggtaacggagaatgtggtccccaga

SEQ ID NO: 127226 - DNA, 601 bp, Human
tttgtttagagacagtcttactctgttgtccaggcttgagtgcagtgttgtgatctcagctcactgcaacctccacctccgaggctccagtgcttctcttgccttagcctcccgagcagctgggattacaggtgcctgccaccacacctagttaatttttgtatttttagtagggacagggctttgccatgttggccaggctggtctcaaactcccgaccttaggtgatctgcccaccttggcctcccaaagtgctgggaataagccaaggcacccgccccaaagaggacttatgatagattttttttttttttttttttgagacagagtcttgctctgtagcccaggctggagtgcagtggcgtgatctcggcttactgcaagctccacctcccgagttcacaccattctcctgcctcagcctcccaagtagctgggactataggcgcccaccactatgcccagcttattttttgtatttttagtagagatggggtttcactgtgttagccaggatgatctcgatctccggacctcgtgatctgcctgcctcggcctcccaaagtgctgggattacaggcgtgagccaccgcgcccggcc

SEQ ID NO: 127227 - DNA, 601 bp, Human
ctgggaggtaaatgtggcaattgctcctgattcctcagtgaagtaggcagcatggccaccccacctgtgagtgaggagggaggcagcagccaagtaggatccaggagagctaatagagcaggagtgtggagcggctgctaggctgcatcagggaccctctggccagctggtggtttgaagtaacagcagccagcgtgcttaattgtgtatctccagctatttccagctgtgctgctgagttggatttaaccaggtttgtggttttaacaagtgaataccaaaaaagtgagagaagaacacrggatgtgaggacatctttggatgttatgaaagatggagatactgttgagcttggagtttgagcttgcacagggggcatgtgaggccacaaaaggagtaagagacagtgaaaagactgtaggatctgtcgatttaagtggagtccagggcttgttggaggtgatgaacatttgagccagtgagttggaacaacgggaggaggtggtttgacactgggaagcttgaaatggagataatggctgggactgctgtcattgataaaggcagggtggaatgcgaccagaggagggagtgctttgaa

SEQ ID NO: 127228 - DNA, 601 bp, Human
cacttaagtaatttaatgggaccagcacttttactctatttgtgatattggtatgaaaaacctggatattttttctgaatttgctttccacttccttttaatacagtttacgtttaataagaaggagacctgtaagcttgtttgtacaaaaacataccatacagagaaagctgaagacaaacaaaagttagaattcttgaaaaaaagcatgttattgaattatcaacatcactggtaaggcatgaatattttcgattttggggtttatcctttccatatgaaatctttgttgctttgactrtataaattacttgattgtgtaaaatatagcaaattaattgatttccttttttttgttactagtggtcgtagcttgaagtagtgactcttagttaaagatgacaacatcatttaaagtatcatcttttaactgtgtttagattactgtaatatctggtacttcttttgatacatagatctggtacatagagtagttatttttattcacatacaggcataccttggggatactgaggttcagttccatgccactgcaataaagcaaataacacaataaagtgagtcacataaagtttttctt

SEQ ID NO: 127229 - DNA, 601 bp, Human
acgcttacattttgcttagcctttcattttgtaaacatgacataacattaacaaattctgtaccagtttgtatcagaatcaaaaagtatttaaaactgtcctgtttttccttccaaagtagtatatacttattatacaatattcaaacatagaattttttttttttttctgagatggagtctctcactgttccccagactggagtgctgtggcgtgatctcggctcactgcaacctccgtctcctggggtcaagtgattcttgcattttagccgcctgagtagctgggattacatgtgccygccaccacacctggctaatttttatagttttagtagacacggggttttaccatgttggccaggctggtctcgaactcctgaccttaagagatccgcccctctcagcctcccaaagtgctggaattataggtgtgagccactgcgcccggtcaaacatagaatatttttaaagactttcaaaatccaacatttgaagtataaccattgctattcttctgagtaattttgcttggaaatgcctatattctgtggggatcatagtttacatatgttttgccttttctagaaagtgtaagatgc

SEQ ID NO: 127230 - DNA, 601 bp, Human
atcaatgcatatcaattgcatatcaacctgggatatgtttacttattgttaagtaattgaaatttccttgttgtttttctttgtaatcttcaaaataatatttaagcctcagttcttatcttctcatattagccctatccacctgcgtttactgcaatagctatcagtttgttgactgactgaaagaatgactgttaaggtctgtggatgattttttttttttctttttttttgagacggaatctcgttctgtcacccaggctggagtgcagtggcgcaatctcggctcactgcaagctcygcctcccgggtccacgccattctcctgcctcagcctcccgagtagctgggactacaggcgcccgccaccacgccggctaattttttgtatttttagtagagacggggtttcactgtgttagccaggatggtctcgatctcctgacctcgtgatccgcccgcctctgcctcccaaagtgctgggattacaagtgtgagccaccgcgcccggccttgtgggtgattttttagctctttcttctaccctctgtgcttagaatactgtttagtcagcccggcaccgtggctcatgcctataatc

SEQ ID NO: 127231 - DNA, 601 bp, Human
ttagctctttcttctaccctctgtgcttagaatactgtttagtcagcccggcaccgtggctcatgcctataatcccagtattttgggaggccaaggcaggcagatcacctgaggccaggagttcgagaccagcctggccaacatggcgaaaccccatctctactaaaaatacaaaaattagccaggtgtggtggcaggcgcctgtaatcccagctactcgggaggctgaggcaggagaattgcttgaaccaaagaatactgtttagtcttgctcctgaaggtagtagaagcagttcttcastagcctcctgacaggaaagtacttagagatatttttaactaatttatgatgcagttaacaaagatttcattataatgccaagatgcttaataacaagaaagaataaatacagtagtgtacaaactaagcaagcatcagacagtaaaatttactgaatgatttgtaatcagcatatcaattgcaaacttcaactattctgctttaaaaaaattacctgagaaagtgctggtaaataatgattttgcagttgaatcagaaaagttgatgattttaagtgtaacccttaaatcagttcagtat

SEQ ID NO: 127232 - DNA, 601 bp, Human
tattctgacatttcaggattgatttcactaaaactccctttggcatgatttgttattgttatgggttgtccagaaaaccataccaatagttattttcctgtcatgataagcggtcaagccaaggtgccttagtgttttgtttttcagtcaggaggttttgacagcttttccacgtgtcagtggggagggagaagttgagtggttgggacagtggtccccttcgtggtggaaagaacactgcctcagataatgtgtggctttcctctggtcagaggcccaaatgagtggacaagtactgtgrtttctcaagcccctatgcagtgttagatgccactatgaaatacgagccattgaaagagatctcttcaacttattattttttatcacgaacgtacatatcagttatttatgagattttttttttaaatatttcattttttttcacgactttttctgccattgaattagcctttttctcatgcactggtggtcaagaaatacatgccataataagatggcagttaaacttcatcagtattttttttttttaaataagattatttagccaggcacagtggctcgcacctgtaatctgaacact

SEQ ID NO: 127233 - DNA, 601 bp, Human
tgggtgacaaagcaagaccttgtctcaaaaacaaaacaaaaaacaaaaaaggccaggcatggtggctcatgttgtaatcccagcactttgagaggctgaggcagtaggattgcttgagcccaggagttcaagaccagcctgggcaacatagcaagaccttgtttctacaaaaaatgaaaaattagctgggcgtggggtgtggtggcacacacctgtagtcccatctacttgggagactgaggtgggaggatcacttgagcccaggagtttgaggctgcattgaactgtgatggcaccaccrcactcaggcctgggtaagagagcaagaccctgtcccaaaaaaaaaaaagaaaaaaaaaaagattatttaaatgctcttcaagtatagtgttttcaaaagtatgtttataattttgtacacatatgatgtaaatatttatgctattaagtgtgacatgaataatttcacctttgtcagcagcattttaaaatacgtacaaaatctgtaacctttacctcatttttaaaaagttgtactttatcagcatcttgccaaaatgtttcttcccacagcttcaaacatacccatatagataaacca

SEQ ID NO: 127234 - DNA, 601 bp, Human
tctgaaattgattttaaatttgtactacttaaactaattaaaatgttactgattatgcttgtcaaataaagaagctattaatgagctgatttttaggatagtttgtcggtgtaccaagcaacataatcactcttgtaactgagtcttagtttaaatgagaatatagaggaagttgaagacttgagcctgatttagtgttaagcataagagatacatataagacaaaagtagaaaacaggcctagaggacgggatggaaatgccagagatatattcagaaaccatttgggaaatcaacaccrtactttaaaggatttaagtgtgaactttaaatggagagcttccaattggtagattgtcttagaaaattgaagggagtgttttcattaacgaagtttcttaaaatgcaaattcattgttatgagaatcttagtattctacctttattttttcaccatttttaaaatcaagatttaattatgaactttaaatgaagagtttccgattgggagattgtcttagaaaattgaagggagtatttttattagcgaagtttcttaaaatgcaagtttatcattaaaatgcaagaatcttaggcagtg

SEQ ID NO: 127235 - DNA, 601 bp, Human
tactcctgagagtaggaatttttctgttacactcactgtggtatctggtgttttaaacagagccgagcttatagttggtgctcaatgaatgtttacatccatgcttactgtattagcaaagtagctagaatatgagagctaatgccatttgcttattgtggagatcattaagagtaggatgaagaggatagaatgtgactaaaaatcgtcatcaagtcagatcacaaagcttgacttagagtagaattaggtagcaatcacattgtctttgtaaagtttctcaataagtatatttgtagascttaatgtcataaatttaagaaactgacatataagacagttcagcaaagccatattaagctccatgagtcaagctgtattcttcaaaattgaaataggtactaacatttttaagtttaaaaaaaacctgttttctgtaacagcatattcaacagtgaacaaactgtctatagttgtcttgttgataccatgagacaatcgaactgatttcattccccttttaggaagatgcccaggaagaatttggctggaaacttgttcatggtgatatattccgtcctccaagaaaagggatgctgct

SEQ ID NO: 127236 - DNA, 601 bp, Human
tgtacttgaatctcagaagagtcaaatgcactcttgagcatccagtcagcctcccctgatcacaggaaggatgtgatctctcattctggactctgagaagaaacttccaaagtgaagtttgcctcatgtatgatcagattggtgcagtacagtaaatattactaagattgtgtagagctgcatggtaggagagcacatggttttgcgtgaagttgtatttttttcttgtttgaaaaatgagagggtttctctatcatttcacagcaaaggaaacagagtaataacatgtacagcctttcaygatttgtgttttagttttcgcttgcctgggatttttgtcacctgccaaccgaggagcgctgatgacgtgtgctgtggtcctgtgggtgctgctgggcacccctgcaggctatgttgctgccagattctataagtgtaagtcaaagccactgtgactggcgtctgatcaggaagggactctgctgcggctgtggatctgacctgggtatcagatggtgatgctttgtaaatagtgtgcctcataggggtctgttcttagttaaaaggagcctgcttggtgattccttttgtgtcatgagtt

SEQ ID NO: 127237 - DNA, 601 bp, Human
atatcattagtcacaatctcttgtgttcttgcattctagaagtaaaataaagttcagtgaaacaaaaggctcacggccacagagtaaggctgagatgggactggatggcttagaaagcagctggcagggtcagcagggaccagagctggcctcctcgggaatgccacagtctcgtctgggatatacagtgattccccacggtctagcaatgtgaaaaagttttgaggtgaagcacagtagagttacgtggacaaccttaatgtggggttgggtagtctcagcccccagtaaaagattaacytagaccttgtcagacacagttctctcttgagtatgtgaagccctgtatgtatgtgtgttttaagtgtgttttaatttctgtgaattttgtcaagttctttcttcccctttactaaaggaggtaggattagggccatcatacggattttaatgcatacaaaatacagtcagccctttgcctgccacaccagccttacttcatgccacactccccctttctcaccatttcagccacacaggctttctgtcggttcctcggacaggctgcctgctttcccacaccctgctcccatctgcactc

SEQ ID NO: 127238 - DNA, 601 bp, Human
gttctgagatctcagccagtttcatttctgacttaaactgggagcagacgtgtactttcatttttcactctagctacttcagtatttgaattctttaaactggaaaaaaaagcaagttggagaggggcaaaggagagtaaaacatatattagcaaacatggtctgtcaaatggtcataacccttctactcttcttagttgcctcatctgacacacgcacctcctaggaaccacagttcctcctagaaaccacagtgctagaggaagagttggcctactgtggaagtgtaaatgtgttgcayatcaggcttgacggttcccagttttataacaaattctgaaactgactgcaagataagtgagaatcccgtgtgcccttcctgtgcctaggcccattgattgatactggctcaggatttaaggattcttttggttgtgaggggaaaagaagaactgatcttgatgacttgcctctgattctctagagcaggacttacctagggaatcccatcctgtatgtctcagatttggattatttaataaaggaatatcatattatatttgctagtaccattttctaggaatgagtactcattgctgtc

SEQ ID NO: 127239 - DNA, 601 bp, Human
aatatcagacttgtaatatggatatttggtttgctttaaagaaaatctgtatttatacaacttttgttttcttctatagcctttggaggtgagaagtggaaaacaaatgttttattaacatcatttctttgtcctgggtaagtgaatttttcaagaattactttcttaacatagttacatgttagtccccaaattttcagtcgttgagtctttaatcctccgtgtctctaaatcatgtacctaagaaagtaaatttaatttttgaaaaggggtaaaataaatattttataaacgtttgccraatgattaccacatgtcttatctggggaaagtacctttagacatgagaaatgttttaattccttctcttcaaagtctttctgtttcttggtttttagtggtcagtctgacatgttgttctgtaggctgcatttaaagcttttgagccaggcacaggaaggaatcctgaagatagttcaggcaagcatatgttttcccatttttatccaaagcattgccattttttagagtttattccattaagtaaagtaatatacaccaaaaataaaaaataagcagccaccacaaatccaaaacaaaa

SEQ ID NO: 127240 - DNA, 601 bp, Human
aaaaaataagcagccaccacaaatccaaaacaaaacaaaaatccttcactctctggaactgcttctcctctcgattatctgatgcggttctggtcctagaagcaaaacccacttcctcccaaacctgcacatttctggtgggcaagaactgacacgtgaacaggctacagcaataaagaaagccaaggatgatgaagtctagaaaccagaactgttccatttgcaggctagaaatgcaagcgtgatggcagcagcattttaatacacatttgggataaatattctctctatcacctccacygaagattcacattcttctcagttatcggttctattcaaatttctatgcttttctcaagccatgtcctttgttttctttccctctgtcaactcacaaaggtgtccgtccttaccaagactgtgatttcctgcagaatctccgaatcttgcttttcaggcacctatccctctagtctcacacatcttccattgctcccttctcacatgttctgcttatgtggttcttttattcctccaaataggctcatgtctcccctaaaaagggatcataaacatcttcccttcttatttccatctcatt

SEQ ID NO: 127241 - DNA, 601 bp, Human
ctagaagcaaaacccacttcctcccaaacctgcacatttctggtgggcaagaactgacacgtgaacaggctacagcaataaagaaagccaaggatgatgaagtctagaaaccagaactgttccatttgcaggctagaaatgcaagcgtgatggcagcagcattttaatacacatttgggataaatattctctctatcacctccactgaagattcacattcttctcagttatcggttctattcaaatttctatgcttttctcaagccatgtcctttgttttctttccctctgtcaactcacraaggtgtccgtccttaccaagactgtgatttcctgcagaatctccgaatcttgcttttcaggcacctatccctctagtctcacacatcttccattgctcccttctcacatgttctgcttatgtggttcttttattcctccaaataggctcatgtctcccctaaaaagggatcataaacatcttcccttcttatttccatctcatttcttttctattcccaacaaaatgccttgaaaaaaatagtctctactcctttcttctcattttctcagtaaacatttgcagtgtaaagccacgtca

SEQ ID NO: 127242 - DNA, 601 bp, Human
ctagtctcacacatcttccattgctcccttctcacatgttctgcttatgtggttcttttattcctccaaataggctcatgtctcccctaaaaagggatcataaacatcttcccttcttatttccatctcatttcttttctattcccaacaaaatgccttgaaaaaaatagtctctactcctttcttctcattttctcagtaaacatttgcagtgtaaagccacgtcattcgtatttttctccatcattttactgaaacttttaagtttgccaataatgttcccattttcaaatccagaaaygattttctctgtattgtctaacattggaataccttcttgaaactccttccttttttggcttcataaaaattatcctgtgctggttcttcttttatgtctctgatcaacccttctctgattgatgttcttcatcctactcttaacagtgggtgtttaccagcaggtaaatagagcgtgctaagaactcaagtattcaggggcagggggacttggtgttcacctaggaatagaaggatcatttaataacaggaaatctagtcatacaattctacataaataaacacctgcatataattactg

SEQ ID NO: 127243 - DNA, 601 bp, Human
taataaaaagagtttggcaaaatggctaggtatcaactaatattccaagatcctaaacagcaccattaaccagttaaatgttttaatggtagtggtagttgtgctggaagagggctctattcacagaaaacccatacagtgcctgaaataacctctcaaagtatgcacaatccatatgacaagcctacaagattattaactcgaaagagatggaaatttgccatgtttcttaatgaaaagatcaagcattgtgaaggtgtttggaaagtccaggggctgctgggatggagaatacagaagyaggccctgtatccatggcagcgtgctagatgtggcaccatgagccagaggaactgttagataagtgatgctgggacagctgattctcttcatgaagggagaaagttgtcagtcctaggtggagtcaaacctaaatgcaccaggcgtaactactgtgtgaaaatatggaagagcatcttcatggtcccaggttagggaaggctttcttctcttaagcagagtgcacaaaggataaaagggaaagtggttgcgcttaaaaactgtgtgggggaagtacagtgattattgtatgattacaacc

SEQ ID NO: 127244 - DNA, 601 bp, Human
cgtttattggtgcatactttggttttaagaagaatgtaagtttataggtgttaacttattcaggtgaattttagctgcagaaattagcatatgccatctcaaaagataccataaaagtgtgtaaagatgtaaacttgtcctttaggatctggatttcatagaatatttttaaaatagtagtattatttaggagcgtggtagagaggttacagatctaaacttaggtttcaaagttttttaagtgaatagaagctaatatagattaattgggaaagaaatgctgatataaactaatgaaaatattcattcattcattcattcattcatttagagatggagtctcattctgtcacccaggctggagtgcagtggcgccatctcggctcactgcaacctccaccttcagggttaaagcgattttcctgcctcagcctcccgagtagctgggattacaggcatgtgccaccacacccagctaatttttgtatttttagtggagacaaggtttcatcacgttggtcaggctggtcttgaactcctgacctcaggtgatccacctgcctgggcctcccaaagtgcacaaagcttagctaagtaagca

SEQ ID NO: 127245 - DNA, 601 bp, Human
atttttagtggagacaaggtttcatcacgttggtcaggctggtcttgaactcctgacctcaggtgatccacctgcctgggcctcccaaagtgcacaaagcttagctaagtaagcagagaagaagtcactgtaagaaaagtagctgcagagtaagagtagcaaatgtttgtggttgatatgtagctttgaaataaattgtatctgctggaaataaattgtatctgcttccctgctaatattggattttaaggaagattataatcaggtttcagtccttcctccagtttccctctcaccctcyagtcggccttctctcactttgctgcccactcctgccctcaggctaaaagaaaaacaaaaacgagatcttattcttctgtctcatcagtatccttctctaaccgcacttcagtatccctgtcctctgaaaatatcaagtccacagggtaaaagaaagactgtgtggttagtacactttgtgagcaggacccggaaggccctggcagaagctggcactgttccacagcctccactgcactttcatgcctggctgctgaaggatttttttaaacttcttcggcattttgtttaatttatgact

SEQ ID NO: 127246 - DNA, 601 bp, Human
gctgatttcttacagtacatgtgtaatgaaaatgaaaagcctaactctacctttttattaactattattttccaagtattctcttatctcctgtgtactttttcctgtgtctaaagccattagtcagtagatcactgctggagacagtattaacttgttccagtagacagactgagtattgtacctgatggtacctggatgatggcttccaaagacaaatttcagtttgatgtcttaagtagactttattgccattagtgacaacatagaagctgaaaaaaagcaggcaaataatctcgtktagagaagaatatttgagacagatacgtaattatgaattcttccttcctttttttactgaaggccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtaagctaaggataaagtcctctcattctcattaccattatatgtaatatttcctttttgtttgtttatatgggttactatttgta

SEQ ID NO: 127247 - DNA, 601 bp, Human
ttctctgtgaggtgagtgttatccccattttacagagctgtaaatgaggctttgtaagttgagtaatttgcttgtgttacacagcaaccctgtgacagaaaattcaccgaagtttctccaaacctatgttcctaactaatctgcactgttcagagaagatcctctgagcacttgtcggaggggattggtgaagggattggtctaggtgacctgcagagtcctttgcaattctcagatgccttcattctccgattgcttgttcacatgtaaaaactcataatagtcattttgagccattctstgtgtgtgtatatctatatatagtgttatatcatgattgttattggatcacattgacgtatgttacaggaagtaccaaggttggaggttacagaaagttagaactaaatttgagctttttaatgattagaacatatctttgcttcttaatcgttatactaattttccaaattcaactggttttattatatgtgataagaaacggttacctattcttagttggctctgccttttcagtcactttttatcaaatatctctggctcaccaggagacgagtagtctagccatatgtaaataagt

SEQ ID NO: 127248 - DNA, 601 bp, Human
tattaaaaaatacaaaaaaaattttagactgaaaatttaataaaagtaaactagtaagaaaattcattaaaaagtttctataatcacattgtaatgagttctattcatggcagcaccaaaatgatagtatccttatgtaataggtagaattgaattttaaagatttaggttgtgttaaatctactatttaatatttattgtctatattggagaaaaagctaactttattaaacttagtgtgttattcaaaaaatggaggttaaatttacataacagaaaatgaaccattttgaagtggacrgtttaatggcacttactgcatttacagtgttgcgccaccaccacctctgtttagttccaaaatatttttatcacccctaattaaagccctatacttgctgagcagttgctcctcattcctcacttcccccaggccttagcagccaacggtctgctttctgtctgttttgcctgttcagacatttcttacaaattgaatcatataatatgtgaccttttgtgtgtggcttctttgacttagcatgttttcagggttcatcatatcgtggcatgtatagtagtacttcattccttttttttt

SEQ ID NO: 127249 - DNA, 601 bp, Human
gaattattatcaaattagggctgagtgtggtggttcacgcctatctctaatcccaacactttggaaggctgaggcgggaggatcgcttgagcccaggattttgagaccagcctgggcaacatagtgagatcttgtctttataaaaaataacaaaattagctgggtgtgatggcttacttgggaagctgaggtggaaggatcacttgagcccaggagggcttcagtaagccatgattacaccactgcactccagaacctgggcaacagagtgagaccctgtctcctaccccacccccgaccaaaaaaaagaattattgccaaattcaaggttatgaagatttacccccatgttttcttctaagtgttatagctttacctcatgtatttaagtcattgatctattttgagttagcttttgtattttgtgtgatgtagtgtccagctacattatttgacgtgtggatatccagttatccagcaccatttgttgaagaggctgttctttcctcatttaatggtcttggcaatcttgtcaaaaatcaattgaccatagatgtatgggtttatttctggactctcaatactattccagtggtctata

SEQ ID NO: 127250 - DNA, 601 bp, Human
acagaaaatgatagcttaaccatcacctaaattttatttatttttatttattttatttttatttttttgagacggagtctcactcttttgcccaggctggagtgcagtggcgcgatctcagctcactgcaaactctgcctcccaggttcacgccattctcctgcctcagcctcccgagtagctgggactacaggcgcccgccactgcgcccggctaattttttttatttttagtagagatggggtttcaccatgttagccaggatggtctcgaacccctgacctcagacgatctgcccgcsttggcctcccgaagtgctcggattgggcgtgagccactgcgcccagctgattttgttttttaaagtgttatattttcattcattcagagttgaattttgtaatctgaattatggagtcatatcaaatggaaccaaccagttaaaccagtaacttatagtgtatttcactttcttcaattgtatttttcctttagtgaacaggtggaagcattctggataagggagtagtgagccctttaaatgccttacctttctctaaaatagggtatggtctgtatttgcttcagtactccagagcaa

SEQ ID NO: 127251 - DNA, 601 bp, Human
ctattccatgccattcctcaaaggacttgtcaagtgcctatctttatcctaacatacaactccttaactaactcatgaacacacaaatatgtctgtgtattatctgtaaaacaaaataaaaaccactattctgttgattctgctttcccttcttgagacagggtctggctgtcatccaggaagcagtggcttgaacacggctcactgtagccttgacctcccggactcaagcaatcctccttttgtagcctcccaagtagctgggactacagatatgagccaccatgcctggctaattttyctatttttgtagacagggttttgccatgttgcccgaactggtcttaaactgagctcaaacaatctgcccaccctggcttccaactggcctcccgaagtgctgggattacaggaatgggctactgcatccagccttccttcttatggcactctctatctccttctttacactgccactttccttaaatgaagcatcagcatcctttctgttaccaccaaacccaaggtgccctgtaatttctactatcctattgaattactgcaatcaccaaaagtgatttttcttttttgagacggagtc

SEQ ID NO: 127252 - DNA, 601 bp, Human
ccccttcacagaggaccactccagaagtcataagaagttctgcaaagtactgggtttcaattccttcctcctcatgttttttaaactggataccagatgttgttagtagctctatagagtcctgggcatacatgtcctccctggcagaagaaagagaaagacaacattcaaacatgccattacttcaaacaagctgttcttctgcttacatctataactacagtgccagaaaagagacagaggaatggcttgagtccacctgtttcaatgctttatatatatgcaagaaaaatgcaatttwaatacaaaggtcattatttcagaaaagtgtttcgaataaaaaatcattcagagagtccaaaggtgcaattttaatcttttttctattaactctattagcctttcatacttaaatacatttaactgggtttggaaaagggtctcctattcaccaggggctaccgtcgcaaagtgacagacaagttttttcagagactctcagtctcagcagccactgtaatgctcccagatggagctgcagccatagctgtggggcatatgcccatctcccgtgctctcagcagcaccagtaaggagaccc

SEQ ID NO: 127253 - DNA, 601 bp, Human
ttttgcaccttcatatctagggaagaaaaatgactaaaaaaaaggtatttgtatcaagagtcttaagttatgtttcctaaggtacaagttcaagtgcagaagagacaaaaaagatgataggtaagaatgagtgtgttcagtacctacaactcaaccatttctggttagtacacatcaaagttgcccacatgaacagtccttcactataaacatcccacagatcagagacagaaactaaacatgcaggagactcagatttaagatacatgtgtgaagtggaccaagtatgagagtattaacrtctatgtaacacaatgctttttcaaaacctaacaaaagccaatatcattctgaaggttacttttagtccctggaacgtcagtttagtttacttagatgggaaaactctttttcatacgtggaagtctatttcacaaaatcggaatagtttccttaccagaaacactcttaaataatctagtttcataacaataaagaatttagaaccaccacttattgagaatttactgtttataaagtattttggtgaccattaaaacaagtcttcaagctatttcttctaagggatgccttatcactt

SEQ ID NO: 127254 - DNA, 601 bp, Human
ctttaaaatatggtttaaaacaacatcccagcctaggctctcatgacagtcacttggtctgaacagtgtgctgctgtagataatgccatccgaagccttactttgagatttttgcagctcttcatgaggtacttcacatcataaatgacaggaaaaaacaatcgaaggatctcaaagaagtcaagttcttcttcaggcaagttagagttggttaggattttgattaagtagccaaagtcgtaaccgctataaaagggttaaaagaatagagaagagggacatataaatactataaagattaaaaaaaaaagtttttctgattcaaatttaagcaagtcacactagagccctcccaaaaacattaaagagaagtgcacacaagaacagagaaaacaaacatattgagaactatgagaaaatgtcgtcatcttacagtattaagaactttatcactttattattcagagatatcaacacagacctacactaccaaaccagcctatggtcaataaaatactattttgttgatatctgaatagagaacaccaagaagagtatcaagctgcccacagatgtctcaaaatattttttaaagtaacta

SEQ ID NO: 127255 - DNA, 601 bp, Human
agtaacagaaggaaagaaagtgggaggacaggcaaggagagtaaagggaggggagaataagtagagcgtgaaggaaagaaacaccaacaacaaaacaaaaattcttctctaacttgttaaggcctccaccagcaaaatggcccttctgtgcatcacagcttgaaacaaggctttgcacagcagttgcttctgcgctaaaaatagcacgaggattaggtatcgttagcagctgcttaggagaacagaactagaactgaatagaacagcatggctgactataggtcaaaaagcacctttgtcrttaacctgaattttaacacagcagcttactcaggacacattcagaatatctgtacttagaaacttcccagtaacaaccacatgatgagcaataatttggttccctgttcctgaaaactatcattatacagacatgtcaattaaaaaaaaagtcagatgaaaacatgtaggcctcagcatgcagtgctttcacagggtgggctgaatttctcaagcaagggataccctactgcaagttcacttcctggaagtcccctcaaattacacagaagtctactgctacaaacataaaataatcttt

SEQ ID NO: 127256 - DNA, 601 bp, Human
gaataatcattaagagtatgctaaatgcttcactatggttttcttagttaagacgagtatatgcacacaactccttagagtggtctgctataatccacctatgttaatactcctaagattaaaaaagaaagatgagagtggaaagagtggaaagaaagaaagagaaagacagtaacagaaggaaagaaagtgggaggacaggcaaggagagtaaagggaggggagaataagtagagcgtgaaggaaagaaacaccaacaacaaaacaaaaattcttctctaacttgttaaggcctccaccrgcaaaatggcccttctgtgcatcacagcttgaaacaaggctttgcacagcagttgcttctgcgctaaaaatagcacgaggattaggtatcgttagcagctgcttaggagaacagaactagaactgaatagaacagcatggctgactataggtcaaaaagcacctttgtcgttaacctgaattttaacacagcagcttactcaggacacattcagaatatctgtacttagaaacttcccagtaacaaccacatgatgagcaataatttggttccctgttcctgaaaactatcattatacag

SEQ ID NO: 127257 - DNA, 601 bp, Human
aatccaccctagaaaaaataaaaaattgcttgtcaagaagaaaaatcttacaaggcctaaattcacaaattataaacttagacgctgaccaaaataaaaataaactttagtatgtaaaggtgaatcttataaagattggggggaagaaacagagaatgtgaattactaatgtatttgttgaatgcggaaaaagtatcatttaatagaaaacaagatcctaattgggaaaatgtattttcatcatgttttagggcatatgacaggtaaatactctcctagatatgggaaggaagcagaccayatatagggtaatatttatcaagtacactcatagtctatcaatccagtaataattataaaactgaaaagctagtataacaccatttttttcatattttcttaaacttcccaccatccatttgtagttttcacttaatttttacaaaacaaagccattatgaataatcattaagagtatgctaaatgcttcactatggttttcttagttaagacgagtatatgcacacaactccttagagtggtctgctataatccacctatgttaatactcctaagattaaaaaagaaagatgagagtgga

SEQ ID NO: 127258 - DNA, 601 bp, Human
tcatttagtttcattcttccatccctaacactttatactcaaggaactgatctctgccttttgccgtttaaggagggttttcctaatatggtttctgatgcaactactacgttggatttatttgatcccttcggaattcaaccccccttttaagactcaatgcagtaaaagagcctgagttcttctctataaaatcttcaaagcactgaagaatgacatgagcaaataatatatttatcaccagtttaaaccttaaaaggggtcatgctagaataaacctaatataaagattccttgcctygtagaaggagcaccaatgggagtcagaaaagaactctggagttctcccactagtaatgtgtttaatcatggaagttattagcctgttttctcacctgagaaataatatggttggacctacatgacttctcaggtagtttatgttttaaaattgttggttctatgatgaacatgttctcccagttccttctgaactacatttcaagatgacttatttttgaatacttttaagtgtggtggatgtgactcatatggtatctctaattatatctttacttagtaggtacttgttgcccaaaat

SEQ ID NO: 127259 - DNA, 601 bp, Human
cggtcatacttagtactgaaaggcagacaataaaatgggccatgaaaggggggggaaaggtactgtctattgttcgagggattcaaccagagataaaacctatatacaagcatgtgtgtagctcgaaataaaaataaaaggactatttcatgtcatgactgcttgttggcttcctcttcatatgcattccctgtgccattctgtacataggatgaaccagaaccaaggccatacaaatgaccacaatatttggcatcatcaatatgatcttcaaagaacatctaaaaaggaattttgaagaaaaaaaaaagataattttaaccaaaaggaaccacttgtaatttatatttcagcaatgtaagtactgactgttcactgacaataatgatggctcttttctatggtgttcctttgaggctacgcatttcagttcaatgagtaagactaatgtcctcaaaagtacagagctcagaaaccaaagaaagagactacaaaaaaagtgtataaatgcatgtcttttccatttagaccatttttataagaatttttcatcatggaaaaataactattccattaatttaacaatactcaagaatgaaga

SEQ ID NO: 127260 - DNA, 601 bp, Human
gcaatcgctgattcggttgcagagttccaggtgacctccccctcccctcgcagttctgggcgtgttttcgtctaccaccttttgcttgaatcctgcaagatctgcctagatcttcgaacaaaaatgtcagtgtatgaaacttcaaaacgaatcaaaagcccacggcttattatatttatctaattggatgggaaatggtgaagaaaatgcatttttttggtacagcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagtacatgtttcatctgggtgcctcctggtgtcctcaaccctctcttgaaattcctgggctacaacacaatttttgcttagatttagtggaaaagtagcttttgctgttatgcaacttcatgctggagccagctcgacctggctcacatttttatccactcgttcatcctgaccag

SEQ ID NO: 127261 - DNA, 601 bp, Human
aatcgctgattcggttgcagagttccaggtgacctccccctcccctcgcagttctgggcgtgttttcgtctaccaccttttgcttgaatcctgcaagatctgcctagatcttcgaacaaaaatgtcagtgtatgaaacttcaaaacgaatcaaaagcccacggcttattatatttatctaattggatgggaaatggtgaagaaaatgcatttttttggtacagcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagtacatgtttcatctgggtgcctcctggtgtcctcaaccctctcttgaaattcctgggctacaacacaatttttgcttagatttagtggaaaagtagcttttgctgttatgcaacttcatgctggagccagctcgacctggctcacatttttatccactcgttcatcctgaccagtt

SEQ ID NO: 127262 - DNA, 601 bp, Human
ccaggtgacctccccctcccctcgcagttctgggcgtgttttcgtctaccaccttttgcttgaatcctgcaagatctgcctagatcttcgaacaaaaatgtcagtgtatgaaacttcaaaacgaatcaaaagcccacggcttattatatttatctaattggatgggaaatggtgaagaaaatgcatttttttggtacagcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagtacatgtttcatctgggtgcctcctggtgtcctcaaccctctcttgaaattcctgggctacaacacaatttttgcttagatttagtggaaaagtagcttttgctgttatgcaacttcatgctggagccagctcgacctggctcacatttttatccactcgttcatcctgaccagttcctttctttcctaggaaactacat

SEQ ID NO: 127263 - DNA, 601 bp, Human
aggtgacctccccctcccctcgcagttctgggcgtgttttcgtctaccaccttttgcttgaatcctgcaagatctgcctagatcttcgaacaaaaatgtcagtgtatgaaacttcaaaacgaatcaaaagcccacggcttattatatttatctaattggatgggaaatggtgaagaaaatgcatttttttggtacagcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagtacatgtttcatctgggtgcctcctggtgtcctcaaccctctcttgaaattcctgggctacaacacaatttttgcttagatttagtggaaaagtagcttttgctgttatgcaacttcatgctggagccagctcgacctggctcacatttttatccactcgttcatcctgaccagttcctttctttcctaggaaactacattt

SEQ ID NO: 127264 - DNA, 601 bp, Human
cagtgtatgaaacttcaaaacgaatcaaaagcccacggcttattatatttatctaattggatgggaaatggtgaagaaaatgcatttttttggtacagcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagyacatgtttcatctgggtgcctcctggtgtcctcaaccctctcttgaaattcctgggctacaacacaatttttgcttagatttagtggaaaagtagcttttgctgttatgcaacttcatgctggagccagctcgacctggctcacatttttatccactcgttcatcctgaccagttcctttctttcctaggaaactacatttgccaaaaaaataccgcattgtagtttgcaaaatccaagatagtcgtggtacttgaagttgagcatgagggtccttcagcctagagctttgcttaataaa

SEQ ID NO: 127265 - DNA, 601 bp, Human
aatcaaaagcccacggcttattatatttatctaattggatgggaaatggtgaagaaaatgcatttttttggtacagcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagtacatgtttcatctgggtgcctmctggtgtcctcaaccctctcttgaaattcctgggctacaacacaatttttgcttagatttagtggaaaagtagcttttgctgttatgcaacttcatgctggagccagctcgacctggctcacatttttatccactcgttcatcctgaccagttcctttctttcctaggaaactacatttgccaaaaaaataccgcattgtagtttgcaaaatccaagatagtcgtggtacttgaagttgagcatgagggtccttcagcctagagctttgcttaataaaacgtaggcagagcttctactgg

SEQ ID NO: 127266 - DNA, 601 bp, Human
ggcttattatatttatctaattggatgggaaatggtgaagaaaatgcatttttttggtacagcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagtacatgtttcatctgggtgcctcctggtgtcctcaascctctcttgaaattcctgggctacaacacaatttttgcttagatttagtggaaaagtagcttttgctgttatgcaacttcatgctggagccagctcgacctggctcacatttttatccactcgttcatcctgaccagttcctttctttcctaggaaactacatttgccaaaaaaataccgcattgtagtttgcaaaatccaagatagtcgtggtacttgaagttgagcatgagggtccttcagcctagagctttgcttaataaaacgtaggcagagcttctactgggagagtaacactta

SEQ ID NO: 127267 - DNA, 601 bp, Human
agcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagtacatgtttcatctgggtgcctcctggtgtcctcaaccctctcttgaaattcctgggctacaacacaatttttgcttagatttagtggaaaagtagyttttgctgttatgcaacttcatgctggagccagctcgacctggctcacatttttatccactcgttcatcctgaccagttcctttctttcctaggaaactacatttgccaaaaaaataccgcattgtagtttgcaaaatccaagatagtcgtggtacttgaagttgagcatgagggtccttcagcctagagctttgcttaataaaacgtaggcagagcttctactgggagagtaacacttaactctgcccagagagaagttgccatgagttcagtttgtaaaatgcaatattaaaatgctc

SEQ ID NO: 127268 - DNA, 601 bp, Human
ttagcatttaaatgttttgtttgctctattcactccatgggtgttatttgtacagtacatgtttcatctgggtgcctcctggtgtcctcaaccctctcttgaaattcctgggctacaacacaatttttgcttagatttagtggaaaagtagcttttgctgttatgcaacttcatgctggagccagctcgacctggctcacatttttatccactcgttcatcctgaccagttcctttctttcctaggaaactacatttgccaaaaaaataccgcattgtagtttgcaaaatccaagatagtygtggtacttgaagttgagcatgagggtccttcagcctagagctttgcttaataaaacgtaggcagagcttctactgggagagtaacacttaactctgcccagagagaagttgccatgagttcagtttgtaaaatgcaatattaaaatgctcctggcaggcccttgtatgcaactgctgaaaaggcagaaatgtaatttgtagtatcattttttgaatagggcaggagatggccaggcaaaataatttcaaatcagccattcctttgtttatacccaacttgcgagtcttagaggctcaga

SEQ ID NO: 127269 - DNA, 601 bp, Human
acttcatgctggagccagctcgacctggctcacatttttatccactcgttcatcctgaccagttcctttctttcctaggaaactacatttgccaaaaaaataccgcattgtagtttgcaaaatccaagatagtcgtggtacttgaagttgagcatgagggtccttcagcctagagctttgcttaataaaacgtaggcagagcttctactgggagagtaacacttaactctgcccagagagaagttgccatgagttcagtttgtaaaatgcaatattaaaatgctcctggcaggcccttgtrtgcaactgctgaaaaggcagaaatgtaatttgtagtatcattttttgaatagggcaggagatggccaggcaaaataatttcaaatcagccattcctttgtttatacccaacttgcgagtcttagaggctcagaaattgacttccattctgcctcctggatctcacccagcccatgtgagtttattacaaacatctgactaaatttaccctttctttaagtgtaatccatacaaacaataagcatttatgagacaattggagaaagtggaatacagactgaatgtaagaaatagttcataa

SEQ ID NO: 127270 - DNA, 601 bp, Human
gctggagccagctcgacctggctcacatttttatccactcgttcatcctgaccagttcctttctttcctaggaaactacatttgccaaaaaaataccgcattgtagtttgcaaaatccaagatagtcgtggtacttgaagttgagcatgagggtccttcagcctagagctttgcttaataaaacgtaggcagagcttctactgggagagtaacacttaactctgcccagagagaagttgccatgagttcagtttgtaaaatgcaatattaaaatgctcctggcaggcccttgtatgcaacygctgaaaaggcagaaatgtaatttgtagtatcattttttgaatagggcaggagatggccaggcaaaataatttcaaatcagccattcctttgtttatacccaacttgcgagtcttagaggctcagaaattgacttccattctgcctcctggatctcacccagcccatgtgagtttattacaaacatctgactaaatttaccctttctttaagtgtaatccatacaaacaataagcatttatgagacaattggagaaagtggaatacagactgaatgtaagaaatagttcataaattttag

SEQ ID NO: 127271 - DNA, 601 bp, Human
ttcctttctttcctaggaaactacatttgccaaaaaaataccgcattgtagtttgcaaaatccaagatagtcgtggtacttgaagttgagcatgagggtccttcagcctagagctttgcttaataaaacgtaggcagagcttctactgggagagtaacacttaactctgcccagagagaagttgccatgagttcagtttgtaaaatgcaatattaaaatgctcctggcaggcccttgtatgcaactgctgaaaaggcagaaatgtaatttgtagtatcattttttgaatagggcaggagayggccaggcaaaataatttcaaatcagccattcctttgtttatacccaacttgcgagtcttagaggctcagaaattgacttccattctgcctcctggatctcacccagcccatgtgagtttattacaaacatctgactaaatttaccctttctttaagtgtaatccatacaaacaataagcatttatgagacaattggagaaagtggaatacagactgaatgtaagaaatagttcataaattttaggtgataatagcacgaagattttgtttataaaagtacacacatctggccgggcaca

SEQ ID NO: 127272 - DNA, 601 bp, Human
gcaaaatccaagatagtcgtggtacttgaagttgagcatgagggtccttcagcctagagctttgcttaataaaacgtaggcagagcttctactgggagagtaacacttaactctgcccagagagaagttgccatgagttcagtttgtaaaatgcaatattaaaatgctcctggcaggcccttgtatgcaactgctgaaaaggcagaaatgtaatttgtagtatcattttttgaatagggcaggagatggccaggcaaaataatttcaaatcagccattcctttgtttatacccaacttgcsagtcttagaggctcagaaattgacttccattctgcctcctggatctcacccagcccatgtgagtttattacaaacatctgactaaatttaccctttctttaagtgtaatccatacaaacaataagcatttatgagacaattggagaaagtggaatacagactgaatgtaagaaatagttcataaattttaggtgataatagcacgaagattttgtttataaaagtacacacatctggccgggcacagtggctcatgtctgtaatcccagcactttgggaggccaaggcaggtggatcaca

SEQ ID NO: 127273 - DNA, 601 bp, Human
aataatttcaaatcagccattcctttgtttatacccaacttgcgagtcttagaggctcagaaattgacttccattctgcctcctggatctcacccagcccatgtgagtttattacaaacatctgactaaatttaccctttctttaagtgtaatccatacaaacaataagcatttatgagacaattggagaaagtggaatacagactgaatgtaagaaatagttcataaattttaggtgataatagcacgaagattttgtttataaaagtacacacatctggccgggcacagtggctcatgyctgtaatcccagcactttgggaggccaaggcaggtggatcacaaggtcaggagttcaagaccagcctggccaagatggtgaaaccccgtctctactaaaaatataaaaattagccgggcgtggtggtgggcacgtgtaatcccagctacttgggagggtgaggcagagaactgcttgaacctgggaggcagaggttgcagtgagccgagatcgcaccactgcactccagctgggcgacaaagtgagactccatctcaagaaaataaagataaaaataaaagcacacatatctataatgta

SEQ ID NO: 127274 - DNA, 601 bp, Human
tggaatacagactgaatgtaagaaatagttcataaattttaggtgataatagcacgaagattttgtttataaaagtacacacatctggccgggcacagtggctcatgtctgtaatcccagcactttgggaggccaaggcaggtggatcacaaggtcaggagttcaagaccagcctggccaagatggtgaaaccccgtctctactaaaaatataaaaattagccgggcgtggtggtgggcacgtgtaatcccagctacttgggagggtgaggcagagaactgcttgaacctgggaggcagargttgcagtgagccgagatcgcaccactgcactccagctgggcgacaaagtgagactccatctcaagaaaataaagataaaaataaaagcacacatatctataatgtatggactatttatggatacaatagtgaacacacagtgcttcattaagttatgtaaccgtttggctaaacctattaagaatggtttttggttttgagttgtgttgtgagttgtggccaggagctactaaggagagtggattacacaggaggcccttccagtgctggtctcagattggcaggttgggaatatcctg

SEQ ID NO: 127275 - DNA, 601 bp, Human
gaatgtaagaaatagttcataaattttaggtgataatagcacgaagattttgtttataaaagtacacacatctggccgggcacagtggctcatgtctgtaatcccagcactttgggaggccaaggcaggtggatcacaaggtcaggagttcaagaccagcctggccaagatggtgaaaccccgtctctactaaaaatataaaaattagccgggcgtggtggtgggcacgtgtaatcccagctacttgggagggtgaggcagagaactgcttgaacctgggaggcagaggttgcagtgagcygagatcgcaccactgcactccagctgggcgacaaagtgagactccatctcaagaaaataaagataaaaataaaagcacacatatctataatgtatggactatttatggatacaatagtgaacacacagtgcttcattaagttatgtaaccgtttggctaaacctattaagaatggtttttggttttgagttgtgttgtgagttgtggccaggagctactaaggagagtggattacacaggaggcccttccagtgctggtctcagattggcaggttgggaatatcctgccttcaaggccat

SEQ ID NO: 127276 - DNA, 601 bp, Human
gtgataatagcacgaagattttgtttataaaagtacacacatctggccgggcacagtggctcatgtctgtaatcccagcactttgggaggccaaggcaggtggatcacaaggtcaggagttcaagaccagcctggccaagatggtgaaaccccgtctctactaaaaatataaaaattagccgggcgtggtggtgggcacgtgtaatcccagctacttgggagggtgaggcagagaactgcttgaacctgggaggcagaggttgcagtgagccgagatcgcaccactgcactccagctgggygacaaagtgagactccatctcaagaaaataaagataaaaataaaagcacacatatctataatgtatggactatttatggatacaatagtgaacacacagtgcttcattaagttatgtaaccgtttggctaaacctattaagaatggtttttggttttgagttgtgttgtgagttgtggccaggagctactaaggagagtggattacacaggaggcccttccagtgctggtctcagattggcaggttgggaatatcctgccttcaaggccatcccaaagcacaaattacagacacaaggtc

SEQ ID NO: 127277 - DNA, 601 bp, Human
aagaccagcctggccaagatggtgaaaccccgtctctactaaaaatataaaaattagccgggcgtggtggtgggcacgtgtaatcccagctacttgggagggtgaggcagagaactgcttgaacctgggaggcagaggttgcagtgagccgagatcgcaccactgcactccagctgggcgacaaagtgagactccatctcaagaaaataaagataaaaataaaagcacacatatctataatgtatggactatttatggatacaatagtgaacacacagtgcttcattaagttatgtaaccrtttggctaaacctattaagaatggtttttggttttgagttgtgttgtgagttgtggccaggagctactaaggagagtggattacacaggaggcccttccagtgctggtctcagattggcaggttgggaatatcctgccttcaaggccatcccaaagcacaaattacagacacaaggtccatgactcaacttgtttcactgccttttagtttttctgatcacatctaaaagacagtctttattattattttattattattgttattattattattattattattattattgagatggagtc

SEQ ID NO: 127278 - DNA, 601 bp, Human
accacggaatgggaggctttaaaaccgcagaagtttgtttgctcacagtccagaggcttgtagtccaaagtcagtgtcagcagcaccacacagcttctaagatgcgggtagaatccttccctgcctccactagcttctggttgtggtcagcaaccccttggcattttttttagcttgtggccacatcactccaatctctgcctctgttgccatgtgaccatcttctccccgtgtctgtctttacatggcattttcatacgtgtgtgtgtgtgtctcctcataagaacatcagtcctattgsaggagagcctaccctaatgacctcatgctaacttgattacatttgcaaagactccattcctcaatgaggttacattcacagatacctgggagttaggacttcagcatatctttttaggggacacaattcaaccagtaagacagggtgagacatggagaggactgaggcggggtgtgaggatgccgtttgaatggatagccataaacctgcctgaaacgaggaagcaaaccccggaggtagctgacagcaaagctgtgcactccaggggcaccacaaaggcaatagcttcaagatgggctt

SEQ ID NO: 127279 - DNA, 601 bp, Human
ctggaggcttctgaacgaagaagtacccataatttgatttatgttttcaaaggtaggtgctatggtttgcccccaccacatcttatgttgaattttgatcccccatgtggtggtggtggtgggaggtagggcctcatgggaggtgtttgggccttgggggtagatccttcatgaagagattaatgccttcccttggggatgtgtggattctgtattatttccagcaagaactgcttgttaaagagagtctggtccctcctcctcccatcgcaccatgtgatctctgcactgctagttatcsttgccctctgccctgagtggaagcagcctgaggccttcattggaagcagatgttggttccatgcttcttgtacagcctgcagaacgatgagccaaataaacctcttttctttataaacaacccagccctacgtattcctctatagcaatgtgaaatgaactaacacagaaaattggtaccaaggagtgggatattgctataaagatacctgaaagtgtggaagcagctttggaactgggtactgggcagagaatcggaagagtttggagggctcagaagaaaacagcaagaggagggaaa

SEQ ID NO: 127280 - DNA, 601 bp, Human
ccttgggggtagatccttcatgaagagattaatgccttcccttggggatgtgtggattctgtattatttccagcaagaactgcttgttaaagagagtctggtccctcctcctcccatcgcaccatgtgatctctgcactgctagttatccttgccctctgccctgagtggaagcagcctgaggccttcattggaagcagatgttggttccatgcttcttgtacagcctgcagaacgatgagccaaataaacctcttttctttataaacaacccagccctacgtattcctctatagcaatgygaaatgaactaacacagaaaattggtaccaaggagtgggatattgctataaagatacctgaaagtgtggaagcagctttggaactgggtactgggcagagaatcggaagagtttggagggctcagaagaaaacagcaagaggagggaaagtttggaatttcttagagattggttatatagttgtgactgaactgttgatagaaatatagacagtaaagttcatgctgacaaggtctgaaatggaaacagataacttattgggagctggagaaaagtcacccttgttaggccttagcaaag

SEQ ID NO: 127281 - DNA, 601 bp, Human
cccttggggatgtgtggattctgtattatttccagcaagaactgcttgttaaagagagtctggtccctcctcctcccatcgcaccatgtgatctctgcactgctagttatccttgccctctgccctgagtggaagcagcctgaggccttcattggaagcagatgttggttccatgcttcttgtacagcctgcagaacgatgagccaaataaacctcttttctttataaacaacccagccctacgtattcctctatagcaatgtgaaatgaactaacacagaaaattggtaccaaggagtgsgatattgctataaagatacctgaaagtgtggaagcagctttggaactgggtactgggcagagaatcggaagagtttggagggctcagaagaaaacagcaagaggagggaaagtttggaatttcttagagattggttatatagttgtgactgaactgttgatagaaatatagacagtaaagttcatgctgacaaggtctgaaatggaaacagataacttattgggagctggagaaaagtcacccttgttaggccttagcaaagaacttggctgcattgtgtccatgccctagggattttgg

SEQ ID NO: 127282 - DNA, 601 bp, Human
ttggaagcagatgttggttccatgcttcttgtacagcctgcagaacgatgagccaaataaacctcttttctttataaacaacccagccctacgtattcctctatagcaatgtgaaatgaactaacacagaaaattggtaccaaggagtgggatattgctataaagatacctgaaagtgtggaagcagctttggaactgggtactgggcagagaatcggaagagtttggagggctcagaagaaaacagcaagaggagggaaagtttggaatttcttagagattggttatatagttgtgactraactgttgatagaaatatagacagtaaagttcatgctgacaaggtctgaaatggaaacagataacttattgggagctggagaaaagtcacccttgttaggccttagcaaagaacttggctgcattgtgtccatgccctagggattttggaaggccacacttaagagtgatgtcctagggtatcctaaagaagaaatttttaatcagcaaagtgctcaagtagtggtgggtgtggctgggtttaaaatcttaggatcagccgggcagggtggctcacgcctgtaatcccagcactttggga

SEQ ID NO: 127283 - DNA, 601 bp, Human
caagaggagggaaagtttggaatttcttagagattggttatatagttgtgactgaactgttgatagaaatatagacagtaaagttcatgctgacaaggtctgaaatggaaacagataacttattgggagctggagaaaagtcacccttgttaggccttagcaaagaacttggctgcattgtgtccatgccctagggattttggaaggccacacttaagagtgatgtcctagggtatcctaaagaagaaatttttaatcagcaaagtgctcaagtagtggtgggtgtggctgggtttaaaakcttaggatcagccgggcagggtggctcacgcctgtaatcccagcactttgggaggcaggcggatcatgaggtcaggagatcgagaccagcctgggcaacatggtgaaaccctgtctctattacaatacaagaagttagcctgatgtcgtggtgcgcacctgtagtcccagctacttgggaggctgaggcaggggagtcgcttgaactcgggaagaggagattgcagtgagctgagatcaggccactgtactgcagcctggtgacagagtgagactctgtctcaaaaaaaaaaaaaaaaaa

SEQ ID NO: 127284 - DNA, 601 bp, Human
cctcaccttggaaaacaaacagacattcaactccaacctgtcagatcagccatgtgggcttcacccagccaagttagaggggtggggagggcgaaggcttgtttttgattttccaggctcacagctgtaaggaacttgcctcaagctcagatgagactttggacttttgagttgatgctggaacaagttaagatttcggggactattgggaaaggatgcttgtaatttgcagtatttgaaagacatgagttttggggggccagaggtgcaatgctatgatttggatatttgacctcctccwaacctcatgttgaaatttgatcaccagtgttggtggtggggcctaatgggaggtgtttgagtcatgggggtggacccctcatgaatggcttgttgccctcctggaggtaatagaactaatagcgtgagttcttgctccactaattcatgtaagagctggttaaaaggaggcttgcacctcccctctctctctctctcgcttcttctctctccatgtgatctctgcatatacctattctccttcacctgtgccaccagtggaagcagcctgaggccctcaccagatgcccagtcttgaatc

SEQ ID NO: 127285 - DNA, 601 bp, Human
ggggactattgggaaaggatgcttgtaatttgcagtatttgaaagacatgagttttggggggccagaggtgcaatgctatgatttggatatttgacctcctccaaacctcatgttgaaatttgatcaccagtgttggtggtggggcctaatgggaggtgtttgagtcatgggggtggacccctcatgaatggcttgttgccctcctggaggtaatagaactaatagcgtgagttcttgctccactaattcatgtaagagctggttaaaaggaggcttgcacctcccctctctctctctctygcttcttctctctccatgtgatctctgcatatacctattctccttcacctgtgccaccagtggaagcagcctgaggccctcaccagatgcccagtcttgaatcttctggccagcagaactgtgagctgagtaaacctctttcctgcataaatgattcagcctcagctatccctttatagccacatagacggccgaaggagtgatacagtggaagccaggggctgcttaggagatagtataaatgtctggatggtaagtggcttggcccaggctggtatcagtggatggaaggaaaagagg

SEQ ID NO: 127286 - DNA, 601 bp, Human
gacatgcctactagtctttcaagtggcggtgctgaataagcaacaggatatttagatctggagtgtagaggcggggtcaggacaggagctagggcagctttcagcatataaatgctgcaggggtcacgggattgtgtgaggtcacttagagagtgaagagtagttagagaggagtgatcaggcaggtcaggaaaatgaggaagagctgccacagactgaagagttgtcagtgacacaggaggaaaaccaaggcagcacagggtcctgcgagccatgtgaatcgagtttttcaagaagagcktcatcaactgtattctaacaggtgttctggaaaatacttcagattgaggcctttatcctggtattgaaggatctaattttcagaaactgcttttttttttttttaaagatactttaaacagtggtagtgttaccggaaaggggtcctgatccagaccgcaagaaaaagttcttggatctcgtgtaagaaagaattcggagtgagtccatagaagtaaagtgaaagcaaatctattaagaaagtaaaggaataaaagaatggcttcttcataggcagagcagcggcatggactgctcagct

SEQ ID NO: 127287 - DNA, 601 bp, Human
gtgtagaggcggggtcaggacaggagctagggcagctttcagcatataaatgctgcaggggtcacgggattgtgtgaggtcacttagagagtgaagagtagttagagaggagtgatcaggcaggtcaggaaaatgaggaagagctgccacagactgaagagttgtcagtgacacaggaggaaaaccaaggcagcacagggtcctgcgagccatgtgaatcgagtttttcaagaagagcttcatcaactgtattctaacaggtgttctggaaaatacttcagattgaggcctttatcctggyattgaaggatctaattttcagaaactgcttttttttttttttaaagatactttaaacagtggtagtgttaccggaaaggggtcctgatccagaccgcaagaaaaagttcttggatctcgtgtaagaaagaattcggagtgagtccatagaagtaaagtgaaagcaaatctattaagaaagtaaaggaataaaagaatggcttcttcataggcagagcagcggcatggactgctcagctgcttatacttacggttacttcttgattatatgctaaacaaggggtggattattcatgagttt

SEQ ID NO: 127288 - DNA, 601 bp, Human
ggacaggagctagggcagctttcagcatataaatgctgcaggggtcacgggattgtgtgaggtcacttagagagtgaagagtagttagagaggagtgatcaggcaggtcaggaaaatgaggaagagctgccacagactgaagagttgtcagtgacacaggaggaaaaccaaggcagcacagggtcctgcgagccatgtgaatcgagtttttcaagaagagcttcatcaactgtattctaacaggtgttctggaaaatacttcagattgaggcctttatcctggtattgaaggatctaattytcagaaactgcttttttttttttttaaagatactttaaacagtggtagtgttaccggaaaggggtcctgatccagaccgcaagaaaaagttcttggatctcgtgtaagaaagaattcggagtgagtccatagaagtaaagtgaaagcaaatctattaagaaagtaaaggaataaaagaatggcttcttcataggcagagcagcggcatggactgctcagctgcttatacttacggttacttcttgattatatgctaaacaaggggtggattattcatgagttttccgggaaagggacggg

SEQ ID NO: 127289 - DNA, 601 bp, Human
gggcagctttcagcatataaatgctgcaggggtcacgggattgtgtgaggtcacttagagagtgaagagtagttagagaggagtgatcaggcaggtcaggaaaatgaggaagagctgccacagactgaagagttgtcagtgacacaggaggaaaaccaaggcagcacagggtcctgcgagccatgtgaatcgagtttttcaagaagagcttcatcaactgtattctaacaggtgttctggaaaatacttcagattgaggcctttatcctggtattgaaggatctaattttcagaaactgcttttttttttttttaaagatactttaaacagtggtagtgttaccggaaaggggtcctgatccagaccgcaagaaaaagttcttggatctcgtgtaagaaagaattcggagtgagtccatagaagtaaagtgaaagcaaatctattaagaaagtaaaggaataaaagaatggcttcttcataggcagagcagcggcatggactgctcagctgcttatacttacggttacttcttgattatatgctaaacaaggggtggattattcatgagttttccgggaaagggacgggaaattcctggaa

SEQ ID NO: 127290 - DNA, 601 bp, Human
aaggaataaaagaatggcttcttcataggcagagcagcggcatggactgctcagctgcttatacttacggttacttcttgattatatgctaaacaaggggtggattattcatgagttttccgggaaagggacgggaaattcctggaactgagggttcctctcctttttagaccatataggatgacttcctgatgttaccatggcatttgtaaacactcatggcgcttgtgggagtgtcttctagcatgctaatgcattataattagcatataatgatcagtgaggatgactagaggtcacrttcgtggccatcttggttttggtgggatttggccagattctttaccacaacctgttttatcagcaaggtgtctgtgacctgtatcttgagccaacctcctgtctcatcctgtgacgaatgcctttacctcctgggaatgctgcccagtggttctcagccttattttacccagcccctattcaagatggagtctctctggttcgaatctctgacagtaggtgggttttttggagtggggttctcgaaaggaagagagaaagaaagggcttgctacatcttgctacattttcctctccatag

SEQ ID NO: 127291 - DNA, 601 bp, Human
attagcatataatgatcagtgaggatgactagaggtcacgttcgtggccatcttggttttggtgggatttggccagattctttaccacaacctgttttatcagcaaggtgtctgtgacctgtatcttgagccaacctcctgtctcatcctgtgacgaatgcctttacctcctgggaatgctgcccagtggttctcagccttattttacccagcccctattcaagatggagtctctctggttcgaatctctgacagtaggtgggttttttggagtggggttctcgaaaggaagagagaaagraagggcttgctacatcttgctacattttcctctccatagtatcgctttcccaccttctcagctttgttcttggaaaagtgtgtgtgttcctgtggggtgtttcatgaaaaatggaaaaatgagagtggcatctctcagtgtatataactaattgggaagcaactgagtggctcagaagaatgtatggtgtggttaactgaggagctacttttagggatggcctttcccctttactgcccatcagggaggagaaaacccaacagctctagcgctttgatattaatgactgtgcttaacaag

SEQ ID NO: 127292 - DNA, 601 bp, Human
ctgtttggcttggaactccatgtcacatcaaacaaagaatctcatggtgcatgagatttgtgcaaataaagtgaaaaagcaacaatatgctaatctctaagtggatggagaggcaatggcatgagccagagaaagctctagacttggagtcagagggtctgttttttcactaccttcttgatgacctggagtgaactacttggcatctatacattaaaaagactaatatctgctttgtttccaccacaagttcatcatagagatctcatgtgacaaccataaaaaaacaaatagcacttatctagcaatcacttactgtaggtcagatgctaatttcagcagttctgacatattaactcatttaactcccacagtaattattacagttattatgaggtagttattaccatatcattctcaatttatagatgagaaaactgaaacagaagagggcaagtagcttcccaaggtcacacagccagtaagtggcaggcctggacctgaagctagtaatgatatttaatggttcttgaattttgccacctatttctctataaattatacgatgcaatagtctcaaaaattcaatggtaatggacgt

SEQ ID NO: 127293 - DNA, 601 bp, Human
tggtgcatgagatttgtgcaaataaagtgaaaaagcaacaatatgctaatctctaagtggatggagaggcaatggcatgagccagagaaagctctagacttggagtcagagggtctgttttttcactaccttcttgatgacctggagtgaactacttggcatctatacattaaaaagactaatatctgctttgtttccaccacaagttcatcatagagatctcatgtgacaaccataaaaaaacaaatagcacttagctagcaatcacttactgtaggtcagatgctaatttcagcagttytgacatattaactcatttaactcccacagtaattattacagttattatgaggtagttattaccatatcattctcaatttatagatgagaaaactgaaacagaagagggcaagtagcttcccaaggtcacacagccagtaagtggcaggcctggacctgaagctagtaatgatatttaatggttcttgaattttgccacctatttctctataaattatacgatgcaatagtctcaaaaattcaatggtaatggacgttcacttatagtatgaattcttgtattttttaagtctttgaaaaa

SEQ ID NO: 127294 - DNA, 601 bp, Human
caaatagcacttagctagcaatcacttactgtaggtcagatgctaatttcagcagttctgacatattaactcatttaactcccacagtaattattacagttattatgaggtagttattaccatatcattctcaatttatagatgagaaaactgaaacagaagagggcaagtagcttcccaaggtcacacagccagtaagtggcaggcctggacctgaagctagtaatgatatttaatggttcttgaattttgccacctatttctctataaattatacgatgcaatagtctcaaaaattcartggtaatggacgttcacttatagtatgaattcttgtattttttaagtctttgaaaaataaccaattgacatagttaggctgaagagtcatattcttttaaacagttagacatgggatttgggagtcactcaattccaataccgtctgggtatctgtggggacactaggctggctcctttagctttgcatcattgccatcaaaccacaggccaattctgtggtcaggcagctggaccagctatacagttagatcagctggtggggctatttggtcaaaaggtcaaattattttgcatagat

SEQ ID NO: 127295 - DNA, 601 bp, Human
ggtcacacagccagtaagtggcaggcctggacctgaagctagtaatgatatttaatggttcttgaattttgccacctatttctctataaattatacgatgcaatagtctcaaaaattcaatggtaatggacgttcacttatagtatgaattcttgtattttttaagtctttgaaaaataaccaattgacatagttaggctgaagagtcatattcttttaaacagttagacatgggatttgggagtcactcaattccaataccgtctgggtatctgtggggacactaggctggctcctttarctttgcatcattgccatcaaaccacaggccaattctgtggtcaggcagctggaccagctatacagttagatcagctggtggggctatttggtcaaaaggtcaaattattttgcatagataatagcaaatatttggatgcataatctccaaaatcagataatctcatgttcctgagtaacatagatacacaagatgtgatagcttagaaggatcagacaagtagctctgtttgtctaaattccataggatttacagatggttattgtcatttctggtagcttgaattcctgttacatgata

SEQ ID NO: 127296 - DNA, 601 bp, Human
aggcctggacctgaagctagtaatgatatttaatggttcttgaattttgccacctatttctctataaattatacgatgcaatagtctcaaaaattcaatggtaatggacgttcacttatagtatgaattcttgtattttttaagtctttgaaaaataaccaattgacatagttaggctgaagagtcatattcttttaaacagttagacatgggatttgggagtcactcaattccaataccgtctgggtatctgtggggacactaggctggctcctttagctttgcatcattgccatcaaaycacaggccaattctgtggtcaggcagctggaccagctatacagttagatcagctggtggggctatttggtcaaaaggtcaaattattttgcatagataatagcaaatatttggatgcataatctccaaaatcagataatctcatgttcctgagtaacatagatacacaagatgtgatagcttagaaggatcagacaagtagctctgtttgtctaaattccataggatttacagatggttattgtcatttctggtagcttgaattcctgttacatgatacacagaataccaaattagacct

SEQ ID NO: 127297 - DNA, 601 bp, Human
cctccgcctcccgggttcaagcagttcttgtgcctcagcctcccgagtggtagctgggattacaggcatgcgccaccatgcctggctaattttgtatttttagtagagatggggtttcgccatgttgcccaggctggtctcaaacttctgacctcaactgatccacctgcgttggcctcccaaaatgctgggattacaggcatgagccaccacacctggcctacagtcccctattcattcttgttgagtggacacaactgtgtggctgcaaggggcttagctgagatttttagagtccggwggcccaccacaggcagaacagtgggggcactcttccctggatgcaggcaataagggtgccttacttatagagaaggcaaaaatgacaacaaaagcaacttaaagtcagttagctttttattatcactatttgccagcaactctcaatgttggtgataaaatactccttccccagagacattttgttggtgaaattctaaatcgttgctacagttacagttgagttttgataatttatatgtaagcttcagattagtatacacataatatttactctttaataataagcattttattctac

SEQ ID NO: 127298 - DNA, 601 bp, Human
atatttttgttttctaagggcaaattttagctcatacatgaactgttgtgctgaatttgaataatatctttggagctgaaatattttttaatgttttaaaattaatcaaaagatgataattacatgacttttactgaaaacaatattgacatatgaggaggggaggattaaaaagttatcttctctagagttacctaaaagctatgagggctgggcatggtggctcactcctgtaatcccagcactttgggaggccaaggcaggtggatcacctgaggtcaggacttcgagaccagcctgrccaacgtgctgagaccctgtctccatgtctctactaaaaatacaaaaatgagttgggtgtggcggcgggcacctgtaatctcagctactcagggtgctcaggcaagagaatcacttgaacctgggaggtggaggttgcagtgagctgagattatgccactgccctccaacctgggcaatagagtaagaatctgtctcaaaaaaaaaaaaagttattggcctcaaatattccaaaaatgtcattactacagcgcatttctctctccttacgttttgcagttactggccaacaccttcccaa

SEQ ID NO: 127299 - DNA, 601 bp, Human
tcttaccgtgaaaagtaatgatgaaaaaccaccattgcttttgcgccaacctaatacatgactcagttccctcttcatagcacttgagccttcttccaggaatgggaatctgtccatttgcattcctggagtcactgtcccctgtctgaggcgctcttctctcccatctctgatactgcggtgaccacacctgggctagggcttctcactgccgctggagcaacacttaaaagtcagagttcagcgtgtggcttccctgctcaccactcggtggatgcccttggggataaagtccagcatsctcatatggtagtgaggccctcgctgacctctgccgtcctctggagtcacctctaatctcgatcagacactctgctttcgctgccctgggctcctgtgagattctcaaaagcgccaggctcctggggacttcgagtttgctctttcatagccaggaacactcttgggcccctgagcaccgggctaacctcaggcatcactgtctctgggaaacccatggcaggcccccccagctatgtgttcccacagcacttgctgtttcctcttcccagctctcttcacactgaaaactactattatt

SEQ ID NO: 127300 - DNA, 601 bp, Human
gagactgtttcaaaaaaaaaaaaaaaattcttggcatagtgactcatgcctgtaatcccagcactttgggagggtgaggcgggcggatcaccggaggtcaggagttcgagaccagcctgaccaacacggcgaaaccccatctctactaaaaatacaaaattagctgggcatggtacatgactgtaattccagctagggaggctgaggcaggagaatcgcttgaacctgggaggcggaggttgtggtgagccgagatcgtgcctttgcactccagcctgggcaacaagagtgaaactccatstcaaaaaaaaaaaaagtaaaaaaaagaaaaaataattttgaagtgtacagtattgttaactataggcacatggttgtataatagacctctagaccgttttcatcttgcatggccgaaactatgtgcccactgaacccctctcctagcattctttcctggcagtcaccttgctactggctgtttctatgagtttgacaactctaggtaccccatataaatggaacatgcagcgtattttttttttttgttactgacgtatttcccacagcatgatgtcctcaaagttctttgatgttgcag

SEQ ID NO: 127301 - DNA, 601 bp, Human
atataaataacttgatctcatggttcatatgtgtaacacagagaaagcattcaatttactcaataaggataaatgtcttatcctatatgtttcctgcagtgagaataaagacaaagaatgttgtggaacagagaagccagaggctgaggcacagctagatttgaatcttccgtttatcactaaccagcaaagtggtgtgtgatcagtagtttccctagaacccagttgccttatctggaatgtgaatatattattgcttatttgtttatttaattgattacttctttataatctgggatcygtgtccttcttccctcctgaaagaataaaccccttgagggcaaataacacatctgtggtttatcatcagattcctagcacctagaacaatgtctgacacataccagagctcaggaagtatgttttggcttccacaggggtttaggccgcatgtcagaagtcagttcttagtcattcattcattcagtatttaaagataattactgagtactgatgtgtacactgcatgtattgggaggtaggtcagctaggcaaacaacaaagtattaatgtatttcatatctatggtgctgtgtcacct

SEQ ID NO: 127302 - DNA, 601 bp, Human
atatattattgcttatttgtttatttaattgattacttctttataatctgggatctgtgtccttcttccctcctgaaagaataaaccccttgagggcaaataacacatctgtggtttatcatcagattcctagcacctagaacaatgtctgacacataccagagctcaggaagtatgttttggcttccacaggggtttaggccgcatgtcagaagtcagttcttagtcattcattcattcagtatttaaagataattactgagtactgatgtgtacactgcatgtattgggaggtaggtcwgctaggcaaacaacaaagtattaatgtatttcatatctatggtgctgtgtcacctggatccatccccattgtctcagagcctgatatggtttggctgtttcccctccaaaatctcatcttgaattatagctcctgtaattcccacatgttgtgggaggggcccagtgggagataattgaatcataagggcagttcccccatactgttctcatggtagttaatacgtctcacgagatcacatggttttctaaggggaaacccgtttctcttggtgctcattctgtcttgccagctaccacg

SEQ ID NO: 127303 - DNA, 601 bp, Human
gtactgatgtgtacactgcatgtattgggaggtaggtcagctaggcaaacaacaaagtattaatgtatttcatatctatggtgctgtgtcacctggatccatccccattgtctcagagcctgatatggtttggctgtttcccctccaaaatctcatcttgaattatagctcctgtaattcccacatgttgtgggaggggcccagtgggagataattgaatcataagggcagttcccccatactgttctcatggtagttaatacgtctcacgagatcacatggttttctaaggggaaacccrtttctcttggtgctcattctgtcttgccagctaccacgtaagacatcccttgctcttccaccaggattgtgagacctccccagccacgtggaactgtgaatccattcaacttctttcctttatacattactcagtctcaggtatgtctttattagcaatgtgagaacagactaatacagaacctattgttacttgacctcatagagccgttagtccattgactctcccttctccctctttatccacattgcacctttatgtctttacttctctctctcttttaaaattttatttttccat

SEQ ID NO: 127304 - DNA, 601 bp, Human
gttctcatggtagttaatacgtctcacgagatcacatggttttctaaggggaaacccgtttctcttggtgctcattctgtcttgccagctaccacgtaagacatcccttgctcttccaccaggattgtgagacctccccagccacgtggaactgtgaatccattcaacttctttcctttatacattactcagtctcaggtatgtctttattagcaatgtgagaacagactaatacagaacctattgttacttgacctcatagagccgttagtccattgactctcccttctccctctttatscacattgcacctttatgtctttacttctctctctcttttaaaattttatttttccataaattattgaggtacaggtggcatttggttacatacgttctttagtgtgagccatcagatcctggtgcacccgtcgtcacccaagcagtatacactgcaccatatttgcatatttgttatcttttatccctcactgccccaaactcttccccccaagtccctaaagtccattgtatcattcttacgcctttgtgtcctcacagcttagctcccacatatcggtgagaacttatgatgttttct

SEQ ID NO: 127305 - DNA, 601 bp, Human
agacctccccagccacgtggaactgtgaatccattcaacttctttcctttatacattactcagtctcaggtatgtctttattagcaatgtgagaacagactaatacagaacctattgttacttgacctcatagagccgttagtccattgactctcccttctccctctttatccacattgcacctttatgtctttacttctctctctcttttaaaattttatttttccataaattattgaggtacaggtggcatttggttacatacgttctttagtgtgagccatcagatcctggtgcaccygtcgtcacccaagcagtatacactgcaccatatttgcatatttgttatcttttatccctcactgccccaaactcttccccccaagtccctaaagtccattgtatcattcttacgcctttgtgtcctcacagcttagctcccacatatcggtgagaacttatgatgttttctattcctgagttactttacttagaataatagtctccaattctgggctctgtcatttctactgaactcttgaatatgtcctaagttcctttgctctctgttcttccttcatttccacttggaaacttgcga

SEQ ID NO: 127306 - DNA, 601 bp, Human
tttcctttatacattactcagtctcaggtatgtctttattagcaatgtgagaacagactaatacagaacctattgttacttgacctcatagagccgttagtccattgactctcccttctccctctttatccacattgcacctttatgtctttacttctctctctcttttaaaattttatttttccataaattattgaggtacaggtggcatttggttacatacgttctttagtgtgagccatcagatcctggtgcacccgtcgtcacccaagcagtatacactgcaccatatttgcatatwtgttatcttttatccctcactgccccaaactcttccccccaagtccctaaagtccattgtatcattcttacgcctttgtgtcctcacagcttagctcccacatatcggtgagaacttatgatgttttctattcctgagttactttacttagaataatagtctccaattctgggctctgtcatttctactgaactcttgaatatgtcctaagttcctttgctctctgttcttccttcatttccacttggaaacttgcgaccctaaatgaccctgttcatctactttctcttgtctgcacat

SEQ ID NO: 127307 - DNA, 601 bp, Human
tctcaggtatgtctttattagcaatgtgagaacagactaatacagaacctattgttacttgacctcatagagccgttagtccattgactctcccttctccctctttatccacattgcacctttatgtctttacttctctctctcttttaaaattttatttttccataaattattgaggtacaggtggcatttggttacatacgttctttagtgtgagccatcagatcctggtgcacccgtcgtcacccaagcagtatacactgcaccatatttgcatatttgttatcttttatccctcacygccccaaactcttccccccaagtccctaaagtccattgtatcattcttacgcctttgtgtcctcacagcttagctcccacatatcggtgagaacttatgatgttttctattcctgagttactttacttagaataatagtctccaattctgggctctgtcatttctactgaactcttgaatatgtcctaagttcctttgctctctgttcttccttcatttccacttggaaacttgcgaccctaaatgaccctgttcatctactttctcttgtctgcacatggaccctgaggactgctggaa

SEQ ID NO: 127308 - DNA, 601 bp, Human
cacgtggccgtggctgccagtagatgtggccacctcacgtttgcttggcaaaatcaatacatttctctagaaaggtcactttttctctcttcttaaacctctcatcttcatctctctgactttcagctaatgaaattatcccctaacttattaagaaattggagctctaatcaccttaagtttctctgatcatatgtcctccttccctgatctaccagtgacgggaagaaggatgaggattttccctcctaaggccaaagcactatccgtgccctggatctcatctctacctactttcccrggaacttcgatacatcacttactgcctcttcattctggatcatcaacatctccttgaaaaggatttatgggtccttttcatcaatattcaccaaattaagaaattctgccttgacccccatgcaccctgcagccatcttcctctctgataaccttcacacccagttccctgggaggagtctctgtcctcattgtattcactttttttctttttcctattcattcttcaataactctacctgactcctggccccattactccacatgcattttttcaccaaggtcaacaagggcactaaat

SEQ ID NO: 127309 - DNA, 601 bp, Human
ctctctacttgctggcgaatgccctcgatttgtcctatattacattaaacgtttcttctgagctccagactgagctacctagctgcctgctcacaatatctgcttggatctttcatgagcttttatttacgctgaaccatctatcctagcaacaggggaggccaagatgggaggatcacttgaggccaggactttgagaccagcctgagcaacacagcaagacccccatctctaaaaaaaaaattgttttaaattacaggtgtggtggtacatgcctgtagttgcagctactcaggatgcygtggtgagaagatcacttgggcccaggagtttgaggctgtagtgaactatgatctgtgactgcgctccagcctgggcaacagagcaagaccccatctctaaaaaaaaaaaacaaaaaaacccctaaaaattagccaggcatagtagtgcacccctgtagtcccagctacttgggaggctcggatggtaagatagtttgggcccaggagctcaagactgcagtgagctatgattgtgccagtgctctccagcctgggagacagagcaaggcccatctctaaagaaataataaacaaactga

SEQ ID NO: 127310 - DNA, 601 bp, Human
tccagactgagctacctagctgcctgctcacaatatctgcttggatctttcatgagcttttatttacgctgaaccatctatcctagcaacaggggaggccaagatgggaggatcacttgaggccaggactttgagaccagcctgagcaacacagcaagacccccatctctaaaaaaaaaattgttttaaattacaggtgtggtggtacatgcctgtagttgcagctactcaggatgccgtggtgagaagatcacttgggcccaggagtttgaggctgtagtgaactatgatctgtgactgygctccagcctgggcaacagagcaagaccccatctctaaaaaaaaaaaacaaaaaaacccctaaaaattagccaggcatagtagtgcacccctgtagtcccagctacttgggaggctcggatggtaagatagtttgggcccaggagctcaagactgcagtgagctatgattgtgccagtgctctccagcctgggagacagagcaaggcccatctctaaagaaataataaacaaactgagctcatgatctttctccacacctggtcatcctcctgtgtccttcagttcagagaatggcacta

SEQ ID NO: 127311 - DNA, 601 bp, Human
tctctaaaaaaaaaaaacaaaaaaacccctaaaaattagccaggcatagtagtgcacccctgtagtcccagctacttgggaggctcggatggtaagatagtttgggcccaggagctcaagactgcagtgagctatgattgtgccagtgctctccagcctgggagacagagcaaggcccatctctaaagaaataataaacaaactgagctcatgatctttctccacacctggtcatcctcctgtgtccttcagttcagagaatggcactaattccatccagttgctcttgaccagaggcccrggaatcacttgaaaaccactttcgttattcactcccgcatccaaccaatgatgctactatctaagcatttcttgaattgtcccacttcttcctatcacaacagcagtgactgtagtctctaaccttagagggtgtctgtttattccctgatgttttcctcacacccagcacagtctccagcatgccccaggtcctccatatgtatttctatgaatgaatggtgccagaggcactgagcctgcaggggatctaaagtcaggcccctgagatcatgtgacctgagactctgggagcaagctc

SEQ ID NO: 127312 - DNA, 601 bp, Human
ccctccaccttcaagtgggcccctgtgtctataattcctgtctttgtgtcgaggtgtactgaatggttagctcccctttaaaagtgagagcatgtggtatttagtcttcagttcctgtgttggtttacttaggataatggcctccagctgcatccatgttgctgcaaaggacatgatttcattcttttttatggttgtgtagtattccatggtgtgtatgtaccacattttctttatgcagtctactattgatgggcatctaggttgattccttgtctttgctcttgtgactagtgctgcwtgaacataggaattcttgtgcctttgtggtagaactatctatattcctttggatacatacttggtaatgggattgctggcccacatggtagctctaagttcttcgagaaatatccaaactgctttgcacagtggctgaatgaatccacattcccacctgcagtatgtaaacttcccctttcctccatgaccttgacggcatctgttatttttggctttggttactagcagttctgaccggtgtgagagggtatctcattgtggatttggtttggatttctttaatgattagtatgttggg

SEQ ID NO: 127313 - DNA, 601 bp, Human
ctctcggtctgatggaggtagcttcaggcaagagagagtaatcatcgaatttttttttaaagctgtagactaaactaacctgatttctaaagattcaaaacagaaatgaaaagcagatacccagaatgaggcattgatttttcttggtggaatagctttgcgtggaaagtggttgaaattccacattgatttagggtagctctttggatgccagagtgtgaaaacctgatactgggctatttggaaaggagagctctgttggaagagcgtaactgcaggatgctcttggagttctggtctrctctgcgatgcttgtttgcaaaaccctgtcatgagaaggtccactagatggcaggtttcagctgtgctacaactggcttcctatcaccagtaaatgaagaaacattccaaatgagaactgagtggatacaatatgtgcccacttatacctatggtcctttcagcctttcaggctacgtagtggtcacagtttcaagttgtattttaaacagtatagaattcattttacaaacaaattttattttatttttatttatttatttttggagacagagtcttgtttcttgcccagcctggagtg

SEQ ID NO: 127314 - DNA, 601 bp, Human
acagtatagaattcattttacaaacaaattttattttatttttatttatttatttttggagacagagtcttgtttcttgcccagcctggagtgcagtggcacgatctcagcttactgcaacctctgcctcctgggttcaggcgactctcatgcctcagcctctcaagtagctgaggttacgggcgtgcgccaccaagcctggctaattttttgtgttttcagtagagacggggttttgcgatgttggccaggcttgtgttgaactgttgacctcaagtgatccacccaccacctgggcctygctaagtgctgggattacaagcatgagccaccacgcccagcccaacaaacacattttttaaaaagggagcagacatttgtaagtgtatgtacccacacagggacaaatttattcatgcccctgtcccctgctgggtctttcaggagcagtggcccccttgaacagtgtagttgatcccttcgaggctaatataaacttgctgatgactgtattttcaggtgctgaaattgattcaggttttacctccagactcagtccatcccagatcccataaacatctcctgtctttgagatcggaaa

SEQ ID NO: 127315 - DNA, 601 bp, Human
gagtgcagtggcacgatctcagcttactgcaacctctgcctcctgggttcaggcgactctcatgcctcagcctctcaagtagctgaggttacgggcgtgcgccaccaagcctggctaattttttgtgttttcagtagagacggggttttgcgatgttggccaggcttgtgttgaactgttgacctcaagtgatccacccaccacctgggcctcgctaagtgctgggattacaagcatgagccaccacgcccagcccaacaaacacattttttaaaaagggagcagacatttgtaagtgtakgtacccacacagggacaaatttattcatgcccctgtcccctgctgggtctttcaggagcagtggcccccttgaacagtgtagttgatcccttcgaggctaatataaacttgctgatgactgtattttcaggtgctgaaattgattcaggttttacctccagactcagtccatcccagatcccataaacatctcctgtctttgagatcggaaatagcaaaggtactgtttctgacaacagtaattatcatttgtcgaacactctgtttcttgactcctctgccctgttcctttcttcccac

SEQ ID NO: 127316 - DNA, 601 bp, Human
tcatgcctcagcctctcaagtagctgaggttacgggcgtgcgccaccaagcctggctaattttttgtgttttcagtagagacggggttttgcgatgttggccaggcttgtgttgaactgttgacctcaagtgatccacccaccacctgggcctcgctaagtgctgggattacaagcatgagccaccacgcccagcccaacaaacacattttttaaaaagggagcagacatttgtaagtgtatgtacccacacagggacaaatttattcatgcccctgtcccctgctgggtctttcaggagmagtggcccccttgaacagtgtagttgatcccttcgaggctaatataaacttgctgatgactgtattttcaggtgctgaaattgattcaggttttacctccagactcagtccatcccagatcccataaacatctcctgtctttgagatcggaaatagcaaaggtactgtttctgacaacagtaattatcatttgtcgaacactctgtttcttgactcctctgccctgttcctttcttcccactgttttgtcataagcatctactatgtttatggtccctgctaggcagatgatggagataa

SEQ ID NO: 127317 - DNA, 601 bp, Human
acatctcctgtctttgagatcggaaatagcaaaggtactgtttctgacaacagtaattatcatttgtcgaacactctgtttcttgactcctctgccctgttcctttcttcccactgttttgtcataagcatctactatgtttatggtccctgctaggcagatgatggagataagatggtgagcaaaatagataaaatctctatatcccatagatcttttaatcttagggaagacaattaaataagcaattttaataaaatattaaagtctgttagcaagtgccttgctaaccgaagtatgstgtcaaggaggaggaaactcaagctcatatttgaaagttccctgggtaaggaagggcatagcaggatataaggaaattccagaaagagagaagtgtttgaaggaagtacctagaagtgggaaagagcataaaacttggagcatggagggcaggtgggtaagatgtggcggtcagaggcgagggagtgggaaggaggttaggaggagagatgatgatgggaggtgaggcagaccatggagggccttgttggccacattaagaaatttagagtgctggagaggatgtggagtaataggaaca

SEQ ID NO: 127318 - DNA, 601 bp, Human
gccctgttcctttcttcccactgttttgtcataagcatctactatgtttatggtccctgctaggcagatgatggagataagatggtgagcaaaatagataaaatctctatatcccatagatcttttaatcttagggaagacaattaaataagcaattttaataaaatattaaagtctgttagcaagtgccttgctaaccgaagtatggtgtcaaggaggaggaaactcaagctcatatttgaaagttccctgggtaaggaagggcatagcaggatataaggaaattccagaaagagagaaktgtttgaaggaagtacctagaagtgggaaagagcataaaacttggagcatggagggcaggtgggtaagatgtggcggtcagaggcgagggagtgggaaggaggttaggaggagagatgatgatgggaggtgaggcagaccatggagggccttgttggccacattaagaaatttagagtgctggagaggatgtggagtaataggaacacttttacactgttggtgggactgtaaactagttcaaccattgtggaagtcagtgtggcgattcctcagggatctagaactagaaataccattt

SEQ ID NO: 127319 - DNA, 601 bp, Human
ggaacacttttacactgttggtgggactgtaaactagttcaaccattgtggaagtcagtgtggcgattcctcagggatctagaactagaaataccatttgacccagccatcccattactgggtatatacccaaagagttataaatcatgctgctataaagacacatgcacacgtatgtttatagcggcactattcacaatagcaaagacttggaaccaacctaaatatccaacagcgatagactggattaagaaaatgtggcacatatacaccatggaatactacgcagccatgaaaaatsatgagttcatgtcctttgtagggacatggatgaagctggaaaccatcattctcagcaaactgtcgtaaggacaaaaaaccaaacactgcatgttctcactcataggtaggaattgaacaacgagaatgcatggacacaggaaggggaacttcacacaccggggactgttgtggggtggggggatgggagagggatagcattaggagatatacctaatgctaaatgacgagttaatgggtgcagcataccagcatggcacatgtatacatatgtaacaaacctgcacgtcatgcacatgta

SEQ ID NO: 127320 - DNA, 601 bp, Human
catcccattactgggtatatacccaaagagttataaatcatgctgctataaagacacatgcacacgtatgtttatagcggcactattcacaatagcaaagacttggaaccaacctaaatatccaacagcgatagactggattaagaaaatgtggcacatatacaccatggaatactacgcagccatgaaaaatcatgagttcatgtcctttgtagggacatggatgaagctggaaaccatcattctcagcaaactgtcgtaaggacaaaaaaccaaacactgcatgttctcactcataggkaggaattgaacaacgagaatgcatggacacaggaaggggaacttcacacaccggggactgttgtggggtggggggatgggagagggatagcattaggagatatacctaatgctaaatgacgagttaatgggtgcagcataccagcatggcacatgtatacatatgtaacaaacctgcacgtcatgcacatgtactctaaaacttaaagtataataataataaaatttaaaaaaaatttagagcaaaatttagggcaattatgagtcgaggatttaaagcctttctaaatatgtatacaaa

SEQ ID NO: 127321 - DNA, 601 bp, Human
cattactgggtatatacccaaagagttataaatcatgctgctataaagacacatgcacacgtatgtttatagcggcactattcacaatagcaaagacttggaaccaacctaaatatccaacagcgatagactggattaagaaaatgtggcacatatacaccatggaatactacgcagccatgaaaaatcatgagttcatgtcctttgtagggacatggatgaagctggaaaccatcattctcagcaaactgtcgtaaggacaaaaaaccaaacactgcatgttctcactcataggtaggarttgaacaacgagaatgcatggacacaggaaggggaacttcacacaccggggactgttgtggggtggggggatgggagagggatagcattaggagatatacctaatgctaaatgacgagttaatgggtgcagcataccagcatggcacatgtatacatatgtaacaaacctgcacgtcatgcacatgtactctaaaacttaaagtataataataataaaatttaaaaaaaatttagagcaaaatttagggcaattatgagtcgaggatttaaagcctttctaaatatgtatacaaagaaaa

SEQ ID NO: 127322 - DNA, 601 bp, Human
gtatatacccaaagagttataaatcatgctgctataaagacacatgcacacgtatgtttatagcggcactattcacaatagcaaagacttggaaccaacctaaatatccaacagcgatagactggattaagaaaatgtggcacatatacaccatggaatactacgcagccatgaaaaatcatgagttcatgtcctttgtagggacatggatgaagctggaaaccatcattctcagcaaactgtcgtaaggacaaaaaaccaaacactgcatgttctcactcataggtaggaattgaacaaygagaatgcatggacacaggaaggggaacttcacacaccggggactgttgtggggtggggggatgggagagggatagcattaggagatatacctaatgctaaatgacgagttaatgggtgcagcataccagcatggcacatgtatacatatgtaacaaacctgcacgtcatgcacatgtactctaaaacttaaagtataataataataaaatttaaaaaaaatttagagcaaaatttagggcaattatgagtcgaggatttaaagcctttctaaatatgtatacaaagaaaatgcatggct

SEQ ID NO: 127323 - DNA, 601 bp, Human
tcatgagttcatgtcctttgtagggacatggatgaagctggaaaccatcattctcagcaaactgtcgtaaggacaaaaaaccaaacactgcatgttctcactcataggtaggaattgaacaacgagaatgcatggacacaggaaggggaacttcacacaccggggactgttgtggggtggggggatgggagagggatagcattaggagatatacctaatgctaaatgacgagttaatgggtgcagcataccagcatggcacatgtatacatatgtaacaaacctgcacgtcatgcacatgkactctaaaacttaaagtataataataataaaatttaaaaaaaatttagagcaaaatttagggcaattatgagtcgaggatttaaagcctttctaaatatgtatacaaagaaaatgcatggctgggcatggtggctcacgcctgtaattccagccctttgggaggctgaggcgggtggatcacttgagctcaggagtttgagaccagcttgggcaacatggcaagaccccatctctacgaaaaaaggtacacaaattagcagagcatggtggcgtgtgcctatagtcctagctacctggga

SEQ ID NO: 127324 - DNA, 601 bp, Human
atactaatggtcccaaggttctctagatcacccattgctcgtcgatctagtcattagagtaggggaaattggttgaagcacgttctatagttttggggaaaacgtcttctgctaactcttacttaaaaataatgtttctacctacaccaaatatgtatttaaaaaaacaacaaaaaaagtttctttcaacaaaacatttcatttcttgagcatttctggtaagtctaggattgattatcccagatgtgttgcacagaattaaaatacagtaagaaaatgacaatacagtcaagctagtgcrttaaaccaaagacactgtaggaatatcaccaactatgttagatgataattttggggcatcttgcaagatggagcattgtttatagtaccagtgattgcatgtattttatgagtgaaatgttgctttaacaagtaagtatacatgtgggtgacgtctgggatttaatgctcaaacgtaaaaactggtgtgttagtagcatgatttttgaccaagtatttgaatatagaagatgtaaataaaacagctttgaaagatatgtcaaaggagggtgcaagaaaagaggaataaaggataagatgt

SEQ ID NO: 127325 - DNA, 601 bp, Human
cccgtcctgcattcccaacttgtccactctgtcctggggcctcaggggcctgtctcctgcctcgcttggtgccttcctgctcaaagactttgcttggattgcctttgggagttcatcctgatttgcccctggtctctgcctttcagaccacatcctactgtccaaagcactcctctctctccatcccactgcctagaaaccagatgagatctggtgtctcagttacattggagcagaggtcagaaagcaccagctcaccctttcctgtaacagcactgttgtttgtgaacttgacttcatrgctgggaaaaggtagggggttgggggccctgtgagtcaaccaacattgatacaagtgaatcaatgttgaacgtgccctcaagcgtttatttactcaggtggctcgtgcattggcacaatatatcacatcagctggtaggcatcctggggaaggaggcagagggaggcactgtcccatacaagagccggaggggtgaccagagcgagtgtgtcacagccttcagttcattgttggtctgctgaggagaatgcacgctaaatagcattaacgtttgcttaatgtatatataaaggcagtcta

SEQ ID NO: 127326 - DNA, 601 bp, Human
gcttggtgccttcctgctcaaagactttgcttggattgcctttgggagttcatcctgatttgcccctggtctctgcctttcagaccacatcctactgtccaaagcactcctctctctccatcccactgcctagaaaccagatgagatctggtgtctcagttacattggagcagaggtcagaaagcaccagctcaccctttcctgtaacagcactgttgtttgtgaacttgacttcatggctgggaaaaggtagggggttgggggccctgtgagtcaaccaacattgatacaagtgaatcartgttgaacgtgccctcaagcgtttatttactcaggtggctcgtgcattggcacaatatatcacatcagctggtaggcatcctggggaaggaggcagagggaggcactgtcccatacaagagccggaggggtgaccagagcgagtgtgtcacagccttcagttcattgttggtctgctgaggagaatgcacgctaaatagcattaacgtttgcttaatgtatatataaaggcagtctactaagccagaatgcttatgagggggggaaaaagacagaaatagtcccaatgacaagcagctta

SEQ ID NO: 127327 - DNA, 601 bp, Human
caaagactttgcttggattgcctttgggagttcatcctgatttgcccctggtctctgcctttcagaccacatcctactgtccaaagcactcctctctctccatcccactgcctagaaaccagatgagatctggtgtctcagttacattggagcagaggtcagaaagcaccagctcaccctttcctgtaacagcactgttgtttgtgaacttgacttcatggctgggaaaaggtagggggttgggggccctgtgagtcaaccaacattgatacaagtgaatcaatgttgaacgtgccctcawgcgtttatttactcaggtggctcgtgcattggcacaatatatcacatcagctggtaggcatcctggggaaggaggcagagggaggcactgtcccatacaagagccggaggggtgaccagagcgagtgtgtcacagccttcagttcattgttggtctgctgaggagaatgcacgctaaatagcattaacgtttgcttaatgtatatataaaggcagtctactaagccagaatgcttatgagggggggaaaaagacagaaatagtcccaatgacaagcagcttaagaactagtgagataaaa

SEQ ID NO: 127328 - DNA, 601 bp, Human
tggattgcctttgggagttcatcctgatttgcccctggtctctgcctttcagaccacatcctactgtccaaagcactcctctctctccatcccactgcctagaaaccagatgagatctggtgtctcagttacattggagcagaggtcagaaagcaccagctcaccctttcctgtaacagcactgttgtttgtgaacttgacttcatggctgggaaaaggtagggggttgggggccctgtgagtcaaccaacattgatacaagtgaatcaatgttgaacgtgccctcaagcgtttatttacycaggtggctcgtgcattggcacaatatatcacatcagctggtaggcatcctggggaaggaggcagagggaggcactgtcccatacaagagccggaggggtgaccagagcgagtgtgtcacagccttcagttcattgttggtctgctgaggagaatgcacgctaaatagcattaacgtttgcttaatgtatatataaaggcagtctactaagccagaatgcttatgagggggggaaaaagacagaaatagtcccaatgacaagcagcttaagaactagtgagataaaagacaaaccagata

SEQ ID NO: 127329 - DNA, 601 bp, Human
tggagcagaggtcagaaagcaccagctcaccctttcctgtaacagcactgttgtttgtgaacttgacttcatggctgggaaaaggtagggggttgggggccctgtgagtcaaccaacattgatacaagtgaatcaatgttgaacgtgccctcaagcgtttatttactcaggtggctcgtgcattggcacaatatatcacatcagctggtaggcatcctggggaaggaggcagagggaggcactgtcccatacaagagccggaggggtgaccagagcgagtgtgtcacagccttcagttcaktgttggtctgctgaggagaatgcacgctaaatagcattaacgtttgcttaatgtatatataaaggcagtctactaagccagaatgcttatgagggggggaaaaagacagaaatagtcccaatgacaagcagcttaagaactagtgagataaaagacaaaccagatacaaggacagagcaacagaagacagtgtgtggtcaagtgtgagtgtggagcggctgataggaaggagagaaggcagctgtgagcaggcgttggtgaggcaaatggaatcattgagtaagtgatgacctgattgta

SEQ ID NO: 127330 - DNA, 601 bp, Human
aggaggcagagggaggcactgtcccatacaagagccggaggggtgaccagagcgagtgtgtcacagccttcagttcattgttggtctgctgaggagaatgcacgctaaatagcattaacgtttgcttaatgtatatataaaggcagtctactaagccagaatgcttatgagggggggaaaaagacagaaatagtcccaatgacaagcagcttaagaactagtgagataaaagacaaaccagatacaaggacagagcaacagaagacagtgtgtggtcaagtgtgagtgtggagcggctgayaggaaggagagaaggcagctgtgagcaggcgttggtgaggcaaatggaatcattgagtaagtgatgacctgattgtaggagaccaggccttgaagataagatagagacttgtacaaagcagagccaaggaggggccaggcaaggcagctcatgcctgtaatcccagcactttggcaggctgaggcaggaggatcacttgagcccgggagtttgagaccagcctgagcaaaatagtgagaccccatctcttaaaaacaaacaaaaagttttagctggatatagtgctacaccctgtggtcc

SEQ ID NO: 127331 - DNA, 601 bp, Human
agttcattgttggtctgctgaggagaatgcacgctaaatagcattaacgtttgcttaatgtatatataaaggcagtctactaagccagaatgcttatgagggggggaaaaagacagaaatagtcccaatgacaagcagcttaagaactagtgagataaaagacaaaccagatacaaggacagagcaacagaagacagtgtgtggtcaagtgtgagtgtggagcggctgataggaaggagagaaggcagctgtgagcaggcgttggtgaggcaaatggaatcattgagtaagtgatgacctrattgtaggagaccaggccttgaagataagatagagacttgtacaaagcagagccaaggaggggccaggcaaggcagctcatgcctgtaatcccagcactttggcaggctgaggcaggaggatcacttgagcccgggagtttgagaccagcctgagcaaaatagtgagaccccatctcttaaaaacaaacaaaaagttttagctggatatagtgctacaccctgtggtcctggctacttgggaggctggggtgggtggttgaggctacagtgagccatggtcacactgctgcactccagcc

SEQ ID NO: 127332 - DNA, 601 bp, Human
taagccagaatgcttatgagggggggaaaaagacagaaatagtcccaatgacaagcagcttaagaactagtgagataaaagacaaaccagatacaaggacagagcaacagaagacagtgtgtggtcaagtgtgagtgtggagcggctgataggaaggagagaaggcagctgtgagcaggcgttggtgaggcaaatggaatcattgagtaagtgatgacctgattgtaggagaccaggccttgaagataagatagagacttgtacaaagcagagccaaggaggggccaggcaaggcagctcrtgcctgtaatcccagcactttggcaggctgaggcaggaggatcacttgagcccgggagtttgagaccagcctgagcaaaatagtgagaccccatctcttaaaaacaaacaaaaagttttagctggatatagtgctacaccctgtggtcctggctacttgggaggctggggtgggtggttgaggctacagtgagccatggtcacactgctgcactccagcctgggtgacagagcaagactgtctcaaatagtgataataaaataggagccagctgggcacagtggctcattcctgtaatgc

SEQ ID NO: 127333 - DNA, 601 bp, Human
ccctgtggtcctggctacttgggaggctggggtgggtggttgaggctacagtgagccatggtcacactgctgcactccagcctgggtgacagagcaagactgtctcaaatagtgataataaaataggagccagctgggcacagtggctcattcctgtaatgccaccactttgggtggctgaggctggtggatcacctgagtttgggaattcaagaccagcctggccaacatgatgaaaccctatgtctactaaaaatacaaaatttagccaggtgtggtagtgggcacctgtagtcccagytacttgggaggcgcaggttgcagtgagctgagattgcaccactgcactccgacctgggcgacagagcgagactctgtctggaaaaaaaaaaaaattacctgggtgtggtggcgtgcacctgtaatcctagctactcaggaggctaaagcaggagaatcgcttgaacctgggatgtggaggttgcagtgagccgagatcacgccactgcactccagcctgggtgacagagtgagactctgtaaaaaaaaaaaaaaaaaaagagccaaagagaacagcatcaaacctcccccaaaagattgt

SEQ ID NO: 127334 - DNA, 601 bp, Human
gagccatggtcacactgctgcactccagcctgggtgacagagcaagactgtctcaaatagtgataataaaataggagccagctgggcacagtggctcattcctgtaatgccaccactttgggtggctgaggctggtggatcacctgagtttgggaattcaagaccagcctggccaacatgatgaaaccctatgtctactaaaaatacaaaatttagccaggtgtggtagtgggcacctgtagtcccagttacttgggaggcgcaggttgcagtgagctgagattgcaccactgcactccgrcctgggcgacagagcgagactctgtctggaaaaaaaaaaaaattacctgggtgtggtggcgtgcacctgtaatcctagctactcaggaggctaaagcaggagaatcgcttgaacctgggatgtggaggttgcagtgagccgagatcacgccactgcactccagcctgggtgacagagtgagactctgtaaaaaaaaaaaaaaaaaaagagccaaagagaacagcatcaaacctcccccaaaagattgtgatatgcagccaggttggagaaccactgatgtggcttgaaccctacatttta

SEQ ID NO: 127335 - DNA, 601 bp, Human
tattcccaagatctctgtagtctctacaccaagaaaacagtttgtttatttaggtttctgatgttactcagaagatttaccatcaaagtggcattgttatgagcgattaccttgaaaacgttggcagaagggagatttggtggatttccccgcagtgaattcactgtgctgggtgcaaatgggtccaggccccatggctgttgcattcactattctgacttggccataatacactcactgtgcctgcacgcctgcccattagtaattcacagcttgttctcctagcaagggtggcagaggmttgctcctttgtcctctgtcctcactcatcttccagggccgattcttcccaagtatgtggctgtgagcgttcagctgagcagagctggggcatgtttttctgatgttacccacagagaagtgctgatgagcttctgctacatggtaagattagaattgccagatttatagtaagggttgggcatcctaatccataaatccagaatccgaaatgctacaaaatctgaaactttttgagcactatgacattcaaaggaaatgcttactggagcatttcagatttcagattttcaaattaggg

SEQ ID NO: 127336 - DNA, 601 bp, Human
aattcacagcttgttctcctagcaagggtggcagaggcttgctcctttgtcctctgtcctcactcatcttccagggccgattcttcccaagtatgtggctgtgagcgttcagctgagcagagctggggcatgtttttctgatgttacccacagagaagtgctgatgagcttctgctacatggtaagattagaattgccagatttatagtaagggttgggcatcctaatccataaatccagaatccgaaatgctacaaaatctgaaactttttgagcactatgacattcaaaggaaatgctyactggagcatttcagatttcagattttcaaattagggatgcttaactagtaagtatgatgcagatactccaaaatctgagaaaaatctgaagtccaaacccctctggttccaagcattttggataagggattctcaacctgtagtgtgagtaacccatatacatctgagttatatggtcacaaagtttgaaagatgaccttgtcaaatttacatgagaagggccaggcgcggtggctcacacctgtaatccgagcactttgggaggccaaggtggcaggatcccttgagctcgggagcta

SEQ ID NO: 127337 - DNA, 601 bp, Human
ctacaaaatctgaaactttttgagcactatgacattcaaaggaaatgcttactggagcatttcagatttcagattttcaaattagggatgcttaactagtaagtatgatgcagatactccaaaatctgagaaaaatctgaagtccaaacccctctggttccaagcattttggataagggattctcaacctgtagtgtgagtaacccatatacatctgagttatatggtcacaaagtttgaaagatgaccttgtcaaatttacatgagaagggccaggcgcggtggctcacacctgtaatcygagcactttgggaggccaaggtggcaggatcccttgagctcgggagctaaagagcagcctggccagtatggtgaaaccccgtcactactaaacacacaaaaattagccgggcctggtggcgcatgcctgtagtcccaggtactcaggaggctgaggcgggagattcccttgaacccaggaggcagaggttgcagtgagccgagatcacaccactgcactccagcctgggggacagtgagattccgtctcaaaaaaaattacacgagaattgatgatttcgttgttatttccatgcatttc

SEQ ID NO: 127338 - DNA, 601 bp, Human
actatgacattcaaaggaaatgcttactggagcatttcagatttcagattttcaaattagggatgcttaactagtaagtatgatgcagatactccaaaatctgagaaaaatctgaagtccaaacccctctggttccaagcattttggataagggattctcaacctgtagtgtgagtaacccatatacatctgagttatatggtcacaaagtttgaaagatgaccttgtcaaatttacatgagaagggccaggcgcggtggctcacacctgtaatccgagcactttgggaggccaaggtggyaggatcccttgagctcgggagctaaagagcagcctggccagtatggtgaaaccccgtcactactaaacacacaaaaattagccgggcctggtggcgcatgcctgtagtcccaggtactcaggaggctgaggcgggagattcccttgaacccaggaggcagaggttgcagtgagccgagatcacaccactgcactccagcctgggggacagtgagattccgtctcaaaaaaaattacacgagaattgatgatttcgttgttatttccatgcatttctctacatggtgagtgcctatctgga

SEQ ID NO: 127339 - DNA, 601 bp, Human
ctatgacattcaaaggaaatgcttactggagcatttcagatttcagattttcaaattagggatgcttaactagtaagtatgatgcagatactccaaaatctgagaaaaatctgaagtccaaacccctctggttccaagcattttggataagggattctcaacctgtagtgtgagtaacccatatacatctgagttatatggtcacaaagtttgaaagatgaccttgtcaaatttacatgagaagggccaggcgcggtggctcacacctgtaatccgagcactttgggaggccaaggtggcrggatcccttgagctcgggagctaaagagcagcctggccagtatggtgaaaccccgtcactactaaacacacaaaaattagccgggcctggtggcgcatgcctgtagtcccaggtactcaggaggctgaggcgggagattcccttgaacccaggaggcagaggttgcagtgagccgagatcacaccactgcactccagcctgggggacagtgagattccgtctcaaaaaaaattacacgagaattgatgatttcgttgttatttccatgcatttctctacatggtgagtgcctatctggaa

SEQ ID NO: 127340 - DNA, 601 bp, Human
ggccaaggtggcaggatcccttgagctcgggagctaaagagcagcctggccagtatggtgaaaccccgtcactactaaacacacaaaaattagccgggcctggtggcgcatgcctgtagtcccaggtactcaggaggctgaggcgggagattcccttgaacccaggaggcagaggttgcagtgagccgagatcacaccactgcactccagcctgggggacagtgagattccgtctcaaaaaaaattacacgagaattgatgatttcgttgttatttccatgcatttctctacatggtgagygcctatctggaaagtaatcatctgtaaatttcctccaagtcattcatttggttaggacttacttacgtatttaaaacagtcaactcatgtttcttttgcggtacgcagtgggaggcatgccaaactctcttttctcaggagtccccagggatttcattcccagctctgcctctagctggccttgtaaccttggatgagtcagttcatctctgtaaagtgagacatccaaccagatgatctttaaggtccctctcagttctgaaagtactcttggcacttgtacttaactcacattggata

SEQ ID NO: 127341 - DNA, 601 bp, Human
cctggtggcgcatgcctgtagtcccaggtactcaggaggctgaggcgggagattcccttgaacccaggaggcagaggttgcagtgagccgagatcacaccactgcactccagcctgggggacagtgagattccgtctcaaaaaaaattacacgagaattgatgatttcgttgttatttccatgcatttctctacatggtgagtgcctatctggaaagtaatcatctgtaaatttcctccaagtcattcatttggttaggacttacttacgtatttaaaacagtcaactcatgtttcttttscggtacgcagtgggaggcatgccaaactctcttttctcaggagtccccagggatttcattcccagctctgcctctagctggccttgtaaccttggatgagtcagttcatctctgtaaagtgagacatccaaccagatgatctttaaggtccctctcagttctgaaagtactcttggcacttgtacttaactcacattggataaaaaagggaggcaaaaagtaaggactcttagataagttattcaacccactttcactcactgaattctcttctattctgtacactgtcacctttaaccg

SEQ ID NO: 127342 - DNA, 601 bp, Human
aggtactcaggaggctgaggcgggagattcccttgaacccaggaggcagaggttgcagtgagccgagatcacaccactgcactccagcctgggggacagtgagattccgtctcaaaaaaaattacacgagaattgatgatttcgttgttatttccatgcatttctctacatggtgagtgcctatctggaaagtaatcatctgtaaatttcctccaagtcattcatttggttaggacttacttacgtatttaaaacagtcaactcatgtttcttttgcggtacgcagtgggaggcatgccaractctcttttctcaggagtccccagggatttcattcccagctctgcctctagctggccttgtaaccttggatgagtcagttcatctctgtaaagtgagacatccaaccagatgatctttaaggtccctctcagttctgaaagtactcttggcacttgtacttaactcacattggataaaaaagggaggcaaaaagtaaggactcttagataagttattcaacccactttcactcactgaattctcttctattctgtacactgtcacctttaaccgtagttcaaggtcacatagccagtaa

SEQ ID NO: 127343 - DNA, 601 bp, Human
cactccagcctgggggacagtgagattccgtctcaaaaaaaattacacgagaattgatgatttcgttgttatttccatgcatttctctacatggtgagtgcctatctggaaagtaatcatctgtaaatttcctccaagtcattcatttggttaggacttacttacgtatttaaaacagtcaactcatgtttcttttgcggtacgcagtgggaggcatgccaaactctcttttctcaggagtccccagggatttcattcccagctctgcctctagctggccttgtaaccttggatgagtcasttcatctctgtaaagtgagacatccaaccagatgatctttaaggtccctctcagttctgaaagtactcttggcacttgtacttaactcacattggataaaaaagggaggcaaaaagtaaggactcttagataagttattcaacccactttcactcactgaattctcttctattctgtacactgtcacctttaaccgtagttcaaggtcacatagccagtaactggtagaggcaggatttgaaccaaggaaagctgactcctgagtgcatgctcttaaccgcccttttacaaaggccactg

SEQ ID NO: 127344 - DNA, 601 bp, Human
ctctggcagctccaacacttcctgtgtagccttgggaaagttacctaacctctccagcctgtttgttcacctgccacgtggggttaataatagcacttatctctcagggcttcatgaggatcaaatgagtcaaaatgggtaaagggcttacagcattgcttagcacatattaaacactgcttaagtttcagttattgttataagtctcatcattgccatctcacgggattgagaaaaagtaaagtgtctcttccgtattgccagttatgaagtcgatgcttaataactgatgggtgtcccrttcttgtttcctttaattaattaccggatggtttagtgttgacttaatagaaaacagtgtaccgtttctactatggaatttaaaattctgagctcatttaactggatctctcatatttttgtttgtgatttgggagtgtgtgtgtgtgcatagctatacttagcagattttacaagctgttagaggtgccatcactcagtcaaaattgcttcatttcatttcatttctgtaggatgaaaatccatgccctcttaatttataagtgtttgtaacctgagtctgtgtgacactagattagat

SEQ ID NO: 127345 - DNA, 601 bp, Human
gggtaaagggcttacagcattgcttagcacatattaaacactgcttaagtttcagttattgttataagtctcatcattgccatctcacgggattgagaaaaagtaaagtgtctcttccgtattgccagttatgaagtcgatgcttaataactgatgggtgtcccattcttgtttcctttaattaattaccggatggtttagtgttgacttaatagaaaacagtgtaccgtttctactatggaatttaaaattctgagctcatttaactggatctctcatatttttgtttgtgatttgggattgtgtgtgtgtgcatagctatacttagcagattttacaagctgttagaggtgccatcactcagtcaaaattgcttcatttcatttcatttctgtaggatgaaaatccatgccctcttaatttataagtgtttgtaacctgagtctgtgtgacactagattagatgctctgccactcaatagctgagtaacttggacaagttgcttctctatgtttcggtgccctcaagcagtaaaaggggaaaaatagtacctccaacttaatgtagctgtgagaaccagggggaccataataatgacaa

SEQ ID NO: 127346 - DNA, 601 bp, Human
actcaaagcctgggcaagagagcgagaccctatctctaaatgaataaacaagatgtattgagcacttctctgtggcagatgctgttctaagtcctgaacttgtttacggagcttggcagcgtgcctgcactcaacaagcattagctatcattattgttactacaagtctgaagagtaggtgaagccagactgtggaagacgagctgtagctaaggactctgaaggtcatggtggagctgggatttgaatctggtcagtagggttccaaagtccatgattttattttattattgttattatttatttatttatttatttatttatttatttatttctgagagggagccttgctctgtcaccaggccggagtgcagtgccgcaatctcagctcactgcaacctccgcctcccgggttcaagcgattgtcctgcgtcagcctccccagtagctgggactacaggcatgcaccaccgcgcccagctaatttttgtattttcaatagagatgcggtttcaccatgttggccaggatggtctcgatctcttgacgtcgtgatccacccacctcggcctcccaaaatgctgggattacaggcatgaac

SEQ ID NO: 127347 - DNA, 601 bp, Human
gttattatttatttatttatttatttatttatttatttatttctgagagggagccttgctctgtcaccaggccggagtgcagtgccgcaatctcagctcactgcaacctccgcctcccgggttcaagcgattgtcctgcgtcagcctccccagtagctgggactacaggcatgcaccaccgcgcccagctaatttttgtattttcaatagagatgcggtttcaccatgttggccaggatggtctcgatctcttgacgtcgtgatccacccacctcggcctcccaaaatgctgggattacaggcatgaaccacttgcgcctggcccaagttcatgattttatgcctttcaccacagtcttcagccaacttgtcgtccagaataacatcgctttgttctgcacaaacttgccttttttcttctctctggagacctccttccctgggactgcatgccctcgatttgcgcatgttgacatccttcctttgtaccaagaccctcttggcctagaggctcttgctggttactctcctcggagttctcatggcatgttgtgtaggagaactcgggagcagggacttctctagacatcattgcatccct

SEQ ID NO: 127348 - DNA, 601 bp, Human
ttttcttctctctggagacctccttccctgggactgcatgccctcgatttgcgcatgttgacatccttcctttgtaccaagaccctcttggcctagaggctcttgctggttactctcctcggagttctcatggcatgttgtgtaggagaactcgggagcagggacttctctagacatcattgcatccctcctgtcctctccagcacctcccatttattttgtacttactaagtatgtgtgggtataataccaatgaatcattatcttgtaacccaaggctcacccttgcccttggcttgcrgagtcttcaccggggcagacaggaaatggaccccactactattaactggccactgccccaagtaagatgcaccggtccctatatctgaggactgtcagctccctcctctgtgccatctcatgacttaggccacccccaggagagagcagcctgggctaaatacaggaagcttcagtcctccactgatgggagcaagactctgtgtgtgttaaggccaggggagcgtgttggaagccatgcacacacatacacatacacggggtcttaaaatttgaacactttcactttgaaacatggact

SEQ ID NO: 127349 - DNA, 601 bp, Human
cgtgttggaagccatgcacacacatacacatacacggggtcttaaaatttgaacactttcactttgaaacatggacttggccatcactgagatctctgtgggtcagggctagaactcctagtttagaaagaaaaggccagaggcaagctgatgtgttggcgtgttcagagctgcttcctgttaatgtgaattctgcttctcttaggacgctttttcctggcatttggtcatgacaccttctttttgctccacttaaactccccattcgccactttctccatccctggggatggtgttcagyggttacacagaaaggaagggtctttgatgaagcatctctgtacagacactggctctgaagggctcagggaatccttgtctcccttgcgtgacacggactcagcctccagaggccctcggtcacttccaaccccttgcgtagtctgctgcctagacgatgagataccattggtagaaatggacattctaaatccaggccctgaaactgtaatcccactaaataatttgtttcctgttttatattgtttgcgtagaagagggggtggaaaaatgcagaactgttttccagtgcgtttccttc

SEQ ID NO: 127350 - DNA, 601 bp, Human
cggggtcttaaaatttgaacactttcactttgaaacatggacttggccatcactgagatctctgtgggtcagggctagaactcctagtttagaaagaaaaggccagaggcaagctgatgtgttggcgtgttcagagctgcttcctgttaatgtgaattctgcttctcttaggacgctttttcctggcatttggtcatgacaccttctttttgctccacttaaactccccattcgccactttctccatccctggggatggtgttcagcggttacacagaaaggaagggtctttgatgaagcrtctctgtacagacactggctctgaagggctcagggaatccttgtctcccttgcgtgacacggactcagcctccagaggccctcggtcacttccaaccccttgcgtagtctgctgcctagacgatgagataccattggtagaaatggacattctaaatccaggccctgaaactgtaatcccactaaataatttgtttcctgttttatattgtttgcgtagaagagggggtggaaaaatgcagaactgttttccagtgcgtttccttccttccgcccccaaacctactaaagatacagcatg

SEQ ID NO: 127351 - DNA, 601 bp, Human
gcaagctgatgtgttggcgtgttcagagctgcttcctgttaatgtgaattctgcttctcttaggacgctttttcctggcatttggtcatgacaccttctttttgctccacttaaactccccattcgccactttctccatccctggggatggtgttcagcggttacacagaaaggaagggtctttgatgaagcatctctgtacagacactggctctgaagggctcagggaatccttgtctcccttgcgtgacacggactcagcctccagaggccctcggtcacttccaaccccttgcgtagyctgctgcctagacgatgagataccattggtagaaatggacattctaaatccaggccctgaaactgtaatcccactaaataatttgtttcctgttttatattgtttgcgtagaagagggggtggaaaaatgcagaactgttttccagtgcgtttccttccttccgcccccaaacctactaaagatacagcatgcagattgcacactggtggtagggttattcccaagtgttaatttcttacgtgcctaattactttcccagtaggaatggcatcttatactttctatcactacagtgctag

SEQ ID NO: 127352 - DNA, 601 bp, Human
accttctttttgctccacttaaactccccattcgccactttctccatccctggggatggtgttcagcggttacacagaaaggaagggtctttgatgaagcatctctgtacagacactggctctgaagggctcagggaatccttgtctcccttgcgtgacacggactcagcctccagaggccctcggtcacttccaaccccttgcgtagtctgctgcctagacgatgagataccattggtagaaatggacattctaaatccaggccctgaaactgtaatcccactaaataatttgtttcctsttttatattgtttgcgtagaagagggggtggaaaaatgcagaactgttttccagtgcgtttccttccttccgcccccaaacctactaaagatacagcatgcagattgcacactggtggtagggttattcccaagtgttaatttcttacgtgcctaattactttcccagtaggaatggcatcttatactttctatcactacagtgctagcaaatgctcggcccagagaagatgcgcagtgaatttactgattgcctgctgatttggtaccctggttctgagctctacgggaatgtggccag

SEQ ID NO: 127353 - DNA, 601 bp, Human
tttttgctccacttaaactccccattcgccactttctccatccctggggatggtgttcagcggttacacagaaaggaagggtctttgatgaagcatctctgtacagacactggctctgaagggctcagggaatccttgtctcccttgcgtgacacggactcagcctccagaggccctcggtcacttccaaccccttgcgtagtctgctgcctagacgatgagataccattggtagaaatggacattctaaatccaggccctgaaactgtaatcccactaaataatttgtttcctgttttayattgtttgcgtagaagagggggtggaaaaatgcagaactgttttccagtgcgtttccttccttccgcccccaaacctactaaagatacagcatgcagattgcacactggtggtagggttattcccaagtgttaatttcttacgtgcctaattactttcccagtaggaatggcatcttatactttctatcactacagtgctagcaaatgctcggcccagagaagatgcgcagtgaatttactgattgcctgctgatttggtaccctggttctgagctctacgggaatgtggccagaaatta

SEQ ID NO: 127354 - DNA, 601 bp, Human
gtcgcctccattttcccttcccttttcttttcttttttttttaatttgctgaaatctagcttcatccttaaaactagcattgatctttccatttttattttttattttttaagtcagggttttgctctgtcgcctaggctggagtacagtggtgggaatcatagctcattgcagcctcgacctcctggactcaagagatcctcccacatcagcctcctgaatagctaggactacatgcacactaccatgcctggctaatgtttaattttttgtagatatggggttttgctatgttgcccartctggtcatgaactcctgagctcaagcgatcctcctgcctcagcctcccaaagtgttgggattataggcatgaaccaccgcacctggcctgggtcgaccattttttatttgctgtgctaactatccccagtgctgcatgtgtactatttgtcatggctatagtaatcttcatgattactactattcatctgtaattaagatataattgggataacacaatgaatcaggcattgcacaaggggctttgtatgtattttcttatctaatgagtggtattcagaacatacttaattgacttaa

SEQ ID NO: 127355 - DNA, 601 bp, Human
gttcctgcctcaaagcttgtaccatctagtgtaatgacaggaagccaggggtatccgaggggtagagaacaaggaagtcaattatgtcaggcaaaagtggggagattcctgagagtcgatcctaattagaagcttcctgaaggaggagagatttccgttcagggtaagggaggcagttgatggcgtgggagtacagaagcaccacttggcagaactggtggacaaaacaagctattccgcagtgaaccagaacagggctgcgttcaggaccaactcacctgacattttccctatgctaaaygtaaactggtcacggtattgattctgctgcaagataaactgcagaatctcagctacatcataaaagtatgtggatctcagaagagcgaagcatttggatgttcgagatgagtccccagattaaaactgcttattttggcgcccccatgtgctgaggctctcagcctcaggggaacctccagtgtgaggatgataaatctgatacatctggatttgtgccacaatataatagaattaattaccattgaaattggctaatgctagtgtttaataataaatatgtatgcccctcttcatttca

SEQ ID NO: 127356 - DNA, 601 bp, Human
ggagattcctgagagtcgatcctaattagaagcttcctgaaggaggagagatttccgttcagggtaagggaggcagttgatggcgtgggagtacagaagcaccacttggcagaactggtggacaaaacaagctattccgcagtgaaccagaacagggctgcgttcaggaccaactcacctgacattttccctatgctaaatgtaaactggtcacggtattgattctgctgcaagataaactgcagaatctcagctacatcataaaagtatgtggatctcagaagagcgaagcatttggatrttcgagatgagtccccagattaaaactgcttattttggcgcccccatgtgctgaggctctcagcctcaggggaacctccagtgtgaggatgataaatctgatacatctggatttgtgccacaatataatagaattaattaccattgaaattggctaatgctagtgtttaataataaatatgtatgcccctcttcatttcagaaagaaactgaaggggtttgcaaatatatttgccatgcaacaagttacaaaatacaaaagataaggaagaaaaataaaagaagaaataatagagtaagg

SEQ ID NO: 127357 - DNA, 601 bp, Human
agtgaaccagaacagggctgcgttcaggaccaactcacctgacattttccctatgctaaatgtaaactggtcacggtattgattctgctgcaagataaactgcagaatctcagctacatcataaaagtatgtggatctcagaagagcgaagcatttggatgttcgagatgagtccccagattaaaactgcttattttggcgcccccatgtgctgaggctctcagcctcaggggaacctccagtgtgaggatgataaatctgatacatctggatttgtgccacaatataatagaattaattrccattgaaattggctaatgctagtgtttaataataaatatgtatgcccctcttcatttcagaaagaaactgaaggggtttgcaaatatatttgccatgcaacaagttacaaaatacaaaagataaggaagaaaaataaaagaagaaataatagagtaaggtcagaggaaaagtcgaaatgcccaaaccctttaaatactttattagaagtgggctgtatgcatactttgggctcaggaccttatcagccaatgcgttttcttcctaaaagaaagtttttggttttaacatgataatgtag

SEQ ID NO: 127358 - DNA, 601 bp, Human
gatacatctggatttgtgccacaatataatagaattaattaccattgaaattggctaatgctagtgtttaataataaatatgtatgcccctcttcatttcagaaagaaactgaaggggtttgcaaatatatttgccatgcaacaagttacaaaatacaaaagataaggaagaaaaataaaagaagaaataatagagtaaggtcagaggaaaagtcgaaatgcccaaaccctttaaatactttattagaagtgggctgtatgcatactttgggctcaggaccttatcagccaatgcgttttyttcctaaaagaaagtttttggttttaacatgataatgtagcatgtgtaagattctaagagttaatgcagagacttatctttattgatgaaagggattttggatattgcataatgctgtgtgctttcatttatgttgactgcttacaaacgattcatgagacacaggctgaaagcaaaacaccaggccaaggctttctggctgaacttctgaggctgcatagctattgcaccaatggttttacttaaggaaaccgcaggtctgaggacaattacattctccaagaagaggaattctctttg

SEQ ID NO: 127359 - DNA, 601 bp, Human
gctgaaggttcccccactgcatgctgaatagcaaataatgacaatcagagcacttcctgtttgccaggctctgggctaaatgctttacatcagttatttcatgtaagtcttaccgtaacccttcagggcaaatactaatattattcctgtttttttttttttcagatgggaaagttgaggtttagagtgattaaataagtccttaaggtcacacagaaagtaagtggtggtaacaggatttcaacacaaaccatttggttccagggtctgtccctgcactccccaatacggtgaccactaracatgtgtggctacttaaatgaaaattaaaatgaaataaaattaagaacaagttctcagtgcacttgccacatttcaagtgctcaactgtagcatgtggctaatggctattgtactagacagcacagagagagaacattccctttatcacagaaagttctattggacagtgctgctgttgactttcatcactgtcttctcagaacctatgaccatcttctttttggaaactccataggatgcttcactaaagacctcccatttgtcctttttattattttgttttttgatttttcggtag

SEQ ID NO: 127360 - DNA, 601 bp, Human
gagagagaacattccctttatcacagaaagttctattggacagtgctgctgttgactttcatcactgtcttctcagaacctatgaccatcttctttttggaaactccataggatgcttcactaaagacctcccatttgtcctttttattattttgttttttgatttttcggtagaagtgaggtctcactgtgttgcccaggctggtctcgaactcctgaactcaagctatcctcctgcttcggtctcccaaattgctgtagttacaggcatgagccattctgctcagccctgtttgttctkgtgaatactatgagctgagatttcgggggcaagattcccaaagattgtggctgttgtgtctccagtccctgtccctaagcctcagtggactgcctcaaaatgttcaggtcagagtggagaactcttctctgcagtgcaaagtatgtttctggaagatggagcttgcattttgagaaacacgtgtgcagaataactgctcagcctctttcttctgtaatgttctctaagttctgaagtttaggggatgaagttctccagcaaggttcagaagtcagtaagagctttcaggaatcttacaaa

SEQ ID NO: 127361 - DNA, 601 bp, Human
tgaaccttttgtaggacaaggtgaaggatggactgatagccagattctagctagcataactggtgttgtcaggagaattgctaataattgttcataggcaatctctttggatcttcattttggaactcgctacacaagattgtaaatgtgccctttgtattataccatgctgtgaagcaacagtggaaaaagcaatcaactaagatgaataaaagtctgttattcaagtcaatgactgatgccacatttcaagttgcagaaggaagattctttgccaagattagcactgttgtgtcttccsaaagtattggtcgaggttttgaactgcaggcttagcttgggcagaatatcctattaatattatgggctcttggccaggcatggtagctcatacctgtaatccagcactttgggaggccacggcgggcggatcacctgaggtcaggagttcgagaacagcctggccaacatggagaaatcccatctctacaaaaatacaaaagttagctgggcgtggtggtgcacacttgtgctcccagctactcaggaggctgaagcaggaggatcgcctgaatctcggagtttgtggttgcagtgagtc

SEQ ID NO: 127362 - DNA, 601 bp, Human
atgctgtaacacatttgacctaatgtgttatacatcatttattttttcttatttgtcaacactaagctaggagtccagttggatttttactatagggtttggcaatttgtcttttcaagcatggatggctttgagaaaccaagatgggctgttacagaagctgaggttctcactgctggctcaggattctttcagaacatgtgtttcctggctacccatgtggagaaatgtttgtcattcattatgtttgtatgtttcctagagtttgattaaaaacactgaagcttcttttgggggactsactgttgttagtgtgcaatttgtgattaaataattgccgtatgtatttcctctttcatcttgatccaggaggatcttggaaggttttccctgcttctctttcacttcttattgtagtataacatatgtaaagaaaaacattcaaattctcagaatacagctcaataaattatccttaagcaaacaggcacatgtaactcccacccagatcaaggatgagaacattaccagcagcagggctttctcatagtaaaaggctgaggctctaatttttatacgtaggaaaaccacattaataagt

SEQ ID NO: 127363 - DNA, 601 bp, Human
acattcaaattctcagaatacagctcaataaattatccttaagcaaacaggcacatgtaactcccacccagatcaaggatgagaacattaccagcagcagggctttctcatagtaaaaggctgaggctctaatttttatacgtaggaaaaccacattaataagtactttcctggctgggtgcagtggctcatgcctataatcccctagcactttgggaagccgaggcaggcggatcacttgaggtcaggagttcaagaccagcctaaccaacatggcgaaactccctctgtactaaaatgyaaaaattaggtgggcatggtggcacacgcctgtaattccagctactcgggaggctgaggcacaagaattgcttacacccaggaggcagcgagtcaaagttgcagtgagccgagatggcaccactgcattccagcctgggtgacggagtgagactgtctcaaaatactgaatttgttgtaatttggatttagtttatagcttgttaacttgcatttatttatttttttatttttatttttatttattattattatactttaagttttagggtacatgtgcacaatgtgcaggttagttaca

SEQ ID NO: 127364 - DNA, 601 bp, Human
cccaacgaatctttgtatttttagcagagatggggtttcaccatgttgtccaggagggtctcggtctcctgacctcatgatccgcctgccttggcctcccaaagtgccgggattacaggcgtgagccactgcacctggtcgagttttttttttttaatctaaaatcccatgtgtttagttttctttaagtaaaacatttgtcttctagatgagtggatataaatacatttgcaggggacatgtgtaatctataattattaaaacaaacttcaacactttgttattgttgatggaagctacrgattgcaaatatatttttaaagcaactggtttggtcacatttcaaagtatgtattatagtataagaagtaaagtatatattatagtataagaagtaaggctgggaacattggctcatgcctgtaatctcagcactttgggaggccaaggcaggaggactgcttgagtccaggagtttgagaccagcctgggcaacatagtgagaccctgactctagaaaaactaaaaaataaaaaattagacaggcatggtggcacgtgcctgtagtcccagctactcaggaggctgaggtgggaggatc

SEQ ID NO: 127365 - DNA, 601 bp, Human
gcctgccttggcctcccaaagtgccgggattacaggcgtgagccactgcacctggtcgagttttttttttttaatctaaaatcccatgtgtttagttttctttaagtaaaacatttgtcttctagatgagtggatataaatacatttgcaggggacatgtgtaatctataattattaaaacaaacttcaacactttgttattgttgatggaagctacggattgcaaatatatttttaaagcaactggtttggtcacatttcaaagtatgtattatagtataagaagtaaagtatatattayagtataagaagtaaggctgggaacattggctcatgcctgtaatctcagcactttgggaggccaaggcaggaggactgcttgagtccaggagtttgagaccagcctgggcaacatagtgagaccctgactctagaaaaactaaaaaataaaaaattagacaggcatggtggcacgtgcctgtagtcccagctactcaggaggctgaggtgggaggatcatttgagccctggaggttgaaactgcagtaagtcatgatggtgccactgcactccagcctgggcaacagcgtgagaccctgtc

SEQ ID NO: 127366 - DNA, 601 bp, Human
ctgccttggcctcccaaagtgccgggattacaggcgtgagccactgcacctggtcgagttttttttttttaatctaaaatcccatgtgtttagttttctttaagtaaaacatttgtcttctagatgagtggatataaatacatttgcaggggacatgtgtaatctataattattaaaacaaacttcaacactttgttattgttgatggaagctacggattgcaaatatatttttaaagcaactggtttggtcacatttcaaagtatgtattatagtataagaagtaaagtatatattatastataagaagtaaggctgggaacattggctcatgcctgtaatctcagcactttgggaggccaaggcaggaggactgcttgagtccaggagtttgagaccagcctgggcaacatagtgagaccctgactctagaaaaactaaaaaataaaaaattagacaggcatggtggcacgtgcctgtagtcccagctactcaggaggctgaggtgggaggatcatttgagccctggaggttgaaactgcagtaagtcatgatggtgccactgcactccagcctgggcaacagcgtgagaccctgtctc

SEQ ID NO: 127367 - DNA, 601 bp, Human
aaagtatatattatagtataagaagtaaggctgggaacattggctcatgcctgtaatctcagcactttgggaggccaaggcaggaggactgcttgagtccaggagtttgagaccagcctgggcaacatagtgagaccctgactctagaaaaactaaaaaataaaaaattagacaggcatggtggcacgtgcctgtagtcccagctactcaggaggctgaggtgggaggatcatttgagccctggaggttgaaactgcagtaagtcatgatggtgccactgcactccagcctgggcaacagmgtgagaccctgtctcaaaaaataaaaatacaagaagatatttttgtgttcttaaattcacacggttcacttattcgactaatggctctgcttatcgcttcagattattctacacacttttaaaacaaaagttgcctctaaatcttgcaatcataaaatcctaaagtgttgttgctaagaaaacatcttcaatattatccactccagattcttctcttgacaaatgtggacattgaagcatgaggaaataaaataatgcctttgaggccatgtagatggactctgtgtgaactcatgaaca

SEQ ID NO: 127368 - DNA, 601 bp, Human
acgttgacaaaggtaccccttacctaagcctgaaagccaatttcttatgaagttgcacagacctcccagcctgatggaaacccatgtaaaagacggagactctctgagccatgatatactcttccctcgtcttagagtcaggaggaaggatctccgtgttagtgaacttggtacttacagcccaagaactcttggctcatgaaccatttgatgatgtgtccaggaattctgcccccaacctaaaacaccatctaactgtgacacaaagaaggcaagtggggaagaaagccaagaaaaattrtttatttcaggaacactgtggggaaaacacaagaaagcatgtaatacgtattggggtatcactagctctgaagatttctctttgcaaatactgtaatattccctcacagaatgatccagaaaaacaaaggattcaatgtaccatgccaaaaaagaaaagccaccagcaccaacaaaaatacccccaaaagcccagtccagagtttcttgcctgtcctaaggacagaattggtaggccagtcctcgtttctcccatttcagtaagataaaaatgccatcatctgagcttaaagaaccaggc

SEQ ID NO: 127369 - DNA, 601 bp, Human
atttcttatgaagttgcacagacctcccagcctgatggaaacccatgtaaaagacggagactctctgagccatgatatactcttccctcgtcttagagtcaggaggaaggatctccgtgttagtgaacttggtacttacagcccaagaactcttggctcatgaaccatttgatgatgtgtccaggaattctgcccccaacctaaaacaccatctaactgtgacacaaagaaggcaagtggggaagaaagccaagaaaaattatttatttcaggaacactgtggggaaaacacaagaaagcmtgtaatacgtattggggtatcactagctctgaagatttctctttgcaaatactgtaatattccctcacagaatgatccagaaaaacaaaggattcaatgtaccatgccaaaaaagaaaagccaccagcaccaacaaaaatacccccaaaagcccagtccagagtttcttgcctgtcctaaggacagaattggtaggccagtcctcgtttctcccatttcagtaagataaaaatgccatcatctgagcttaaagaaccaggcagagtaatttcagaggaaatggggggagataagagactg

SEQ ID NO: 127370 - DNA, 601 bp, Human
agtgaacttggtacttacagcccaagaactcttggctcatgaaccatttgatgatgtgtccaggaattctgcccccaacctaaaacaccatctaactgtgacacaaagaaggcaagtggggaagaaagccaagaaaaattatttatttcaggaacactgtggggaaaacacaagaaagcatgtaatacgtattggggtatcactagctctgaagatttctctttgcaaatactgtaatattccctcacagaatgatccagaaaaacaaaggattcaatgtaccatgccaaaaaagaaaagycaccagcaccaacaaaaatacccccaaaagcccagtccagagtttcttgcctgtcctaaggacagaattggtaggccagtcctcgtttctcccatttcagtaagataaaaatgccatcatctgagcttaaagaaccaggcagagtaatttcagaggaaatggggggagataagagactggctgaggattcccagccaggtgctggccaagccgagagcagacctgagactgatgggttcctccttcaagccgacgccattcccctccgctaaccttggcaggcgccagatcctctgggct

SEQ ID NO: 127371 - DNA, 601 bp, Human
gaaccatttgatgatgtgtccaggaattctgcccccaacctaaaacaccatctaactgtgacacaaagaaggcaagtggggaagaaagccaagaaaaattatttatttcaggaacactgtggggaaaacacaagaaagcatgtaatacgtattggggtatcactagctctgaagatttctctttgcaaatactgtaatattccctcacagaatgatccagaaaaacaaaggattcaatgtaccatgccaaaaaagaaaagccaccagcaccaacaaaaatacccccaaaagcccagtccasagtttcttgcctgtcctaaggacagaattggtaggccagtcctcgtttctcccatttcagtaagataaaaatgccatcatctgagcttaaagaaccaggcagagtaatttcagaggaaatggggggagataagagactggctgaggattcccagccaggtgctggccaagccgagagcagacctgagactgatgggttcctccttcaagccgacgccattcccctccgctaaccttggcaggcgccagatcctctgggctgtgtgaggacaggctgaggacactgtcaccgtgctggggc

SEQ ID NO: 127372 - DNA, 601 bp, Human
acaagcagcagatggtttcaaggttttacaactgctaagggtttaaaacttacaatcataaaatcacattagtaagtgctttcctaaatattgagtttgctgtaatttggatgtagtttacagcttattagcttgattttttgtggaaatctaaaatccaatgtgcttgtctactttaagtaatacgtgtgtcatctacatgagtggatgtaaatacattttcaggggacatatgtaatctataattattcaaatgagctttaacacatttttttgttgatggaagctaccgattgcaattttttttttttttgagacgcaatcttgctctgttgcccaggctggagtgcagtggcatgatctcagctcacagcaacctctgctgcctcctgggttcaagcaattctcatgcttcagcctcccatgtagctgggactacaggcgcgcaccaccacactcagctaatttttttttttttatttttagttgagacggggtttcaccatgttgcccaggctggtcttgaactcctgagctcaggagatccacccgcctcggcctcccaaagtgctaggattacaggcatgagccaccacgcctg

SEQ ID NO: 127373 - DNA, 601 bp, Human
cagggtcccgttttgttgcccaggctggaatgcagtggcacaaccattttctcactgcagcattaaagccctgggctcaagcaaccctccctccttagcctcctgagtagctggaaccacaggtatgagccaccatgccctgctaacttttttttttttttttttttgtctcatagagaagaggtctccctaccttgcctgggctggtctcgacctcctgggcttaaacaatcctttgatcttagcttcccagagtgccgagattacaagtgtgagccaccatgctcggcccacttatgcygttcttaaaggcttcccttctgccccaccacttctaggatggatgttctccttccttgttatgaccctgaccgaaaacccctcttctccattccagccaaatccttccatcgttcactctggtgctgcctctgtgttggatcaggtcttctatgtccccaaactcctttagagcatcctcccagcctcttggtctaaacccaaatctgctgtctcctaaggacatcattcattcccacgtcaaggctggcatccttcttgtacccattgccacctgccaaccctcattctctgcccttct

SEQ ID NO: 127374 - DNA, 601 bp, Human
ttggatcaggtcttctatgtccccaaactcctttagagcatcctcccagcctcttggtctaaacccaaatctgctgtctcctaaggacatcattcattcccacgtcaaggctggcatccttcttgtacccattgccacctgccaaccctcattctctgcccttctgttgggaacctctgctctttgggggctctaccagcattctcatttcctttcctgtcactcccatgcattcatcgaacattttggcacttggttcatggccctgcttgtcactccatttttagggtgactttgataycgacttggtacccactggccaggttcatggacccctcatccgttccacctcagatattcccaccctcatcacaatgtgaacatgtcaaccacaaccactgtgacagcaaccaccggggctgaccccagctccagtgacacaggcttgtactttcccaggattctgtgttcaatgactccctcagccacagtcctcacctgcacccaccctgttcttgagggctttctgccctccccacccatgaggcttagatcctgggtcccaccacatcagtactcactacccacacccggcacgccc

SEQ ID NO: 127375 - DNA, 601 bp, Human
ggatcaggtcttctatgtccccaaactcctttagagcatcctcccagcctcttggtctaaacccaaatctgctgtctcctaaggacatcattcattcccacgtcaaggctggcatccttcttgtacccattgccacctgccaaccctcattctctgcccttctgttgggaacctctgctctttgggggctctaccagcattctcatttcctttcctgtcactcccatgcattcatcgaacattttggcacttggttcatggccctgcttgtcactccatttttagggtgactttgatatcracttggtacccactggccaggttcatggacccctcatccgttccacctcagatattcccaccctcatcacaatgtgaacatgtcaaccacaaccactgtgacagcaaccaccggggctgaccccagctccagtgacacaggcttgtactttcccaggattctgtgttcaatgactccctcagccacagtcctcacctgcacccaccctgttcttgagggctttctgccctccccacccatgaggcttagatcctgggtcccaccacatcagtactcactacccacacccggcacgccctc

SEQ ID NO: 127376 - DNA, 601 bp, Human
gctctaccagcattctcatttcctttcctgtcactcccatgcattcatcgaacattttggcacttggttcatggccctgcttgtcactccatttttagggtgactttgatatcgacttggtacccactggccaggttcatggacccctcatccgttccacctcagatattcccaccctcatcacaatgtgaacatgtcaaccacaaccactgtgacagcaaccaccggggctgaccccagctccagtgacacaggcttgtactttcccaggattctgtgttcaatgactccctcagccacrgtcctcacctgcacccaccctgttcttgagggctttctgccctccccacccatgaggcttagatcctgggtcccaccacatcagtactcactacccacacccggcacgccctcctctctgtactcccctctcctgtccaggaaagaaccaccccggatgaacacaactaaccttctccccatgcctgtactcagagagttaagagctgttgggacactcccatgggagggtagagggcatggccatgaatcccccatctctcgtctaccctgcctggtgtcctctgcattttgtcccgtc

SEQ ID NO: 127377 - DNA, 601 bp, Human
tcagaggaagtaagtgagagctggcagtccctggtaataaatgctgacctggcttgttgtctgttagcctgatgggaacagatagtgactccagtggtttgtcacaggtgatagggactcacctgtcacaagcccccttggtgtcctaggccctgtcccatgcagcctcgccttctcctggaccctcagctggaggctgcctctgcttgtatgaacttctttgctctgagctgcagcatggctgaaagagcctggagtcctgacatctctgtgtctacctgatcacctgactccagagcaygtggccaccagaacatacagtggagacacagtctgggccctctttacttctcgaagtcccccaccctgccatcttgtccagagctcttttgccccgggctgatggcataggggcaggctaggagcagttgcgttgcagaacgctgcaacaccccccacattccttggcaagcagttctctgaggccgctccctcgcctttctggagtgaagcaccctcttgccagccttgcaagggaggaggggaaatagtttctcttctggcactgtagtccctcaaaggtgactttagtctctccgag

SEQ ID NO: 127378 - DNA, 601 bp, Human
ttctacttttttcattaaatcactttcaaatcctactgtttctctccatcctcactgcaaaaaagggatcaagctagcattgtctctgccctagacttatgtgaataccttctcatttcccctatgtccaccttttctttctccactccattttccacactgtagctgattttttttttttttaatacagagtcttggctctgttgcccaggctggagtgcagtggtgtgatctcggctcactgcaacctccacctcctgggctcgagggattctcctgtctcaggctcagtatctgggawtacaggcatgcgccaccatgcccagctaattttgtacttttagtagagatggggttttaccatgttggccaggctggcctcgaactcctgacctcaggtgatctgcccacctcagcctcccaaagtgctgggattacaggagtgagccactgtgcccgttccctgattttaattaaaccaatcagtaggttcccacttctcccagaaacaaagtccaaatcctttgcgtggcctgaatggcctcacatggactcacctctgtcctcctccccatccaggtctcactcctccctcccctcc

SEQ ID NO: 127379 - DNA, 601 bp, Human
cactccgccactgcctctcacccagggccatgaacatgggcattcccagcctgctggtgtctccctgcttctcctgttcctgtctctgaagctcggccttgagattttagttcaaacagcgcttcctcaaggaagcccttcctggctctcagactgttctattctggccttttggagtactctgggcttctgcttcatagcttttaacacagcattttaaattaaccatacgatgactcactcagtgtcccgcccctttgctagaatacagattccaagggctcagagatcaggtccatcwccctccctgctctaggcccacctgctagcacatagcatttctcaaggctgccatcaaaattgctcattaacacacctgtaatcccagcactatgggaggtcaaggcatgagaattgcttgaggccatgagttgcagatcagcctgggcaacatagaccaaaaaaactgaaaaactagccaggtgcagtggctcataccttaatcctagctactcagaaggcacaggtgggaggatggcttgagctttcctccaggatgcaggagtttgaggctgcagagagttaagattgcaccactgtt

SEQ ID NO: 127380 - DNA, 601 bp, Human
ggctctcagactgttctattctggccttttggagtactctgggcttctgcttcatagcttttaacacagcattttaaattaaccatacgatgactcactcagtgtcccgcccctttgctagaatacagattccaagggctcagagatcaggtccatctccctccctgctctaggcccacctgctagcacatagcatttctcaaggctgccatcaaaattgctcattaacacacctgtaatcccagcactatgggaggtcaaggcatgagaattgcttgaggccatgagttgcagatcagcytgggcaacatagaccaaaaaaactgaaaaactagccaggtgcagtggctcataccttaatcctagctactcagaaggcacaggtgggaggatggcttgagctttcctccaggatgcaggagtttgaggctgcagagagttaagattgcaccactgttggcaggcgcctgtagtcccagctactctggaggctgaggcaggagaatggtgtgaacccgggaggcagaacttgcagtgagccgagatcgcgcagctgcactccagcctgggtgacagagaccccatttctaaataaatagac

SEQ ID NO: 127381 - DNA, 601 bp, Human
ctcaaggctgccatcaaaattgctcattaacacacctgtaatcccagcactatgggaggtcaaggcatgagaattgcttgaggccatgagttgcagatcagcctgggcaacatagaccaaaaaaactgaaaaactagccaggtgcagtggctcataccttaatcctagctactcagaaggcacaggtgggaggatggcttgagctttcctccaggatgcaggagtttgaggctgcagagagttaagattgcaccactgttggcaggcgcctgtagtcccagctactctggaggctgaggcaggagaatggtgtgaacccgggaggcagaacttgcagtgagccgagatcgcgcagctgcactccagcctgggtgacagagaccccatttctaaataaatagacagcttgttgagtgaattccccataatgaagaaatttgtttctgaaacatgatgaggcaaaggcactgcagacccaggtagcactcatgcccaaacatctttcacatctgtacatttagattttctgttcgtcttctgcggatggtcagccacacacctatctgctccctgccacccctgtggacaccaccacccagta

SEQ ID NO: 127382 - DNA, 601 bp, Human
agctttcctccaggatgcaggagtttgaggctgcagagagttaagattgcaccactgttggcaggcgcctgtagtcccagctactctggaggctgaggcaggagaatggtgtgaacccgggaggcagaacttgcagtgagccgagatcgcgcagctgcactccagcctgggtgacagagaccccatttctaaataaatagacagcttgttgagtgaattccccataatgaagaaatttgtttctgaaacatgatgaggcaaaggcactgcagacccaggtagcactcatgcccaaacatcyttcacatctgtacatttagattttctgttcgtcttctgcggatggtcagccacacacctatctgctccctgccacccctgtggacaccaccacccagtacttcctccctgcttcttccctagggacttcttccccctcacctcttcattctcttcacatgaccactgatggacctctgagcttcctctcctaatcacagtcttggaggctgtcctgggagtcctggtgcctaccccattccagaccaccaaggtcaacagataaaggtggcttcaaaggaagccccaagttgtgggctca

SEQ ID NO: 127383 - DNA, 601 bp, Human
gcttgcttccagttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggtaagtgttgtacctgcatctcagcccctgcgtctcagcctctgcatctcagccagccattttaattcacagcttcgtccccacccagtgctatatgccataacttcagaagtgcaagaaacatgtggggctatgttgggggccaggtmttgtttgttttttttgaagatgtttcggtatatttaaaaatgaatttcttttaaggacaggaaataagagattgagtttcattagtcagtttgctcaatgtaccctcttcatatgcaggtttttttttttttaaacccttaagtaagaaaggacagtaatgctcattgcagcgccattcacaataccaaagacatggaatcaacctaaatgcccttcaatggtagactggataaagaaaacatagtacatatacaccaaagaatactatgcagccatgaaaaagaatgagatcatgtcct

SEQ ID NO: 127384 - DNA, 601 bp, Human
acaaatggagctggaggccattatccttagcaaactaacacagaaacagaaaaccaaatacctcatgttctcacttttaagtgggagctaaatgattagactacatggacatatagaggggaacacacactggggcctacctgggggtggagggtgggaggagggagaagatcgggcaaaataactaatgggtactaggctgaatattaatacctgggtgaggaaatgatctgtcatttcatgacacgagtttacctatataacagacttgcacatatacccctgaacctaaaataaaagktttttttttaaaaaaaaggacattgggaggaaagggaaatgaaggatctccctctttcctcctgcccccacctcagtctttcaatcccatcttctgggccaactagagtctaatctaacctcctcctggggtccttcagagtgttctctttgtttttaatatattttgtcatttttgatttcaatcggtttttaagaacagtaggtgtgtgttacgtgaataagttccttagatgatttctgagattttggtgtatccatcacttgagcagtgtacactatacccaatgtataggctttt

SEQ ID NO: 127385 - DNA, 601 bp, Human
gttttccatttgtgaattacttcaattagaataatggtctccatccaggttgctgcaaatgccattatttaattcctttttatggctgagtagtattccatggtatatatactacatttctttatccactcattgattgatgggcatttgagctggttccctatttttgcacttgtgaattgtactgctgtaaacatgtgttcaaatatctttttcatattatgacttcttttcctctgggtagatacccagtaatgggattgctggatcaaatggtggttctacttttagttctttaagsaatctccacagttttccatagtggttgtactagtttacattcccaccagcagtgtaacagtgttgccttttcaccacatccatgccaacatcgattattttttaatttttaaattatggccattcttgcaggagtaaggtggtatcacattgtggttttgatttgcatttccctaatcattagtgatgttgagtacgttttcatatgtttgttggactttggtatatcttttgagaattgtctattcatgtcctaagcccaatttttgatgggattgttattttcttgctgatttgtttg

SEQ ID NO: 127386 - DNA, 601 bp, Human
aatgctttcaactttttcccattcagtatagacagttttcattaccttaaggtatgtcccttctatgccaattttgctgagggttttaatcataaagggatgctggattttgtcaaatgttttttgtgtgtctgttgagatgatcatgcgattttttgtttttaattctatgtggtgtatctcattaatgtcttgtgtatgttaaaccaccccagtatgaaacccatttgatcatggtggactatctatttgatatgctgttggatttggttagctagtattttgttaaggatttttgcayctatattcatcaaacatgttggtctatagttttctcttttttgttatgtcctttcctggttttggtattagggtgatactggcttcacagaatgatttagggaggattccttctttctgtgtcttgtgaaataatgttgataggattgataccagttcttagaatgtctgatagaattcatttgtgaatccatctgattctgggcttatttttgttggcagttttttaaattaccatttcaatctcactgcttgttattggtctgttcagagtttctctttcttcctggtttaatctagg

SEQ ID NO: 127387 - DNA, 601 bp, Human
aataatgttgataggattgataccagttcttagaatgtctgatagaattcatttgtgaatccatctgattctgggcttatttttgttggcagttttttaaattaccatttcaatctcactgcttgttattggtctgttcagagtttctctttcttcctggtttaatctaggagggtggtataattccaggaatttatccatctcttctaggttttctagcttgagtatgtaaagctgttcacagtagccttgaattatcttttgtatttctgtggtattggttgtaatatcttgtttcatwtctaactgagcttatttggatcttcttggttaattttgttaatagtctatcagttttatttatcttttcaaagaatcagctttttgtttatcttttgtatttttttggttcaatttcattcagttctgctcagatctttatttcttttgttctgctatgtttgggtttggtttgttctggtttttccagtccttgaggtgtgaccttagattgtctatttgtgctctttcagactttttgatgtagtcatttaatgctatgaactttcctcttagcactgcctttgctgtataccagagg

SEQ ID NO: 127388 - DNA, 601 bp, Human
agacactctccttgggcgggtcttgctatggctgctgttgggattgggggtgtggttctcaggccaatggggttatgttcctcaggggattatggctgctctgctgtgtcatgcaggtcaccagggaagtgggggaaagccagcagttacaggcctcacccagctcccacgtagcccaaagggccggtctcactccctctgtccctgccaacagcaccgagtttgtttctaggcagtggatgagcagggttgagaacttgtcccaggctaccagcctcttggctaagaaagcaaacagggytttcagatttcacatctcctacctgccatggtttctgtgctgtgtctgcactcctgcttcaccccctcacccgagttctgtccaggaaactgtgtttggtcaaaattgttacaaagttcagctagaagtttccttctccctgtggtcttttcccagtttctctggtagccctctccagggatctctgtgagacaaagtcagaaatggcttctttggggactgagagagcccatagggctctttctgctgctcctttctattcctgtgtttcacttggctagagtgttctctatacaagct

SEQ ID NO: 127389 - DNA, 601 bp, Human
ggcttctttggggactgagagagcccatagggctctttctgctgctcctttctattcctgtgtttcacttggctagagtgttctctatacaagctgtgcccatggcaagctgctgtgagcagacatccaccaagtggacatagaccacgccaaaaaggtgctgtgaggccagagataattttaaagtagacttctcataaaagcaattgcagcgtatttagcccttgtgcatgttctgcttgctaaaataacagctctgctcccagcacggaataatccctttgttgccagaagagatttrgcctccacaagacacattaagtagctgacatccttctggcctatgggctgtgattggtagaaaataactgtctctggggaatagtgttttccggcatcctggtaccaggcacttgattatcaaacgtgttggtcatacttacaggacattgatgattttcaatagaggtccccgccccccccccaccccccgccacattgctatttggtattttatgagaaaaggtattcacttagtgatatattagttctgttacatgaattcagaaaatactatgttcttatcactggagttgggtgg

SEQ ID NO: 127390 - DNA, 601 bp, Human
taattttaaagtagacttctcataaaagcaattgcagcgtatttagcccttgtgcatgttctgcttgctaaaataacagctctgctcccagcacggaataatccctttgttgccagaagagatttggcctccacaagacacattaagtagctgacatccttctggcctatgggctgtgattggtagaaaataactgtctctggggaatagtgttttccggcatcctggtaccaggcacttgattatcaaacgtgttggtcatacttacaggacattgatgattttcaatagaggtccccgccccccccccaccccccgccacattgctatttggtattttatgagaaaaggtattcacttagtgatatattagttctgttacatgaattcagaaaatactatgttcttatcactggagttgggtggacatctcaaaagtgaccatcgcactttgtagaaataggggtcctgtcatgtagtacattatcttacccatccttggtacaacttttctcccactagagtcctaaggcacactggcctaatcatacttctccctctctcaaatctgagcaattgggagctcttagtcatttataca

SEQ ID NO: 127391 - DNA, 601 bp, Human
gtagacttctcataaaagcaattgcagcgtatttagcccttgtgcatgttctgcttgctaaaataacagctctgctcccagcacggaataatccctttgttgccagaagagatttggcctccacaagacacattaagtagctgacatccttctggcctatgggctgtgattggtagaaaataactgtctctggggaatagtgttttccggcatcctggtaccaggcacttgattatcaaacgtgttggtcatacttacaggacattgatgattttcaatagaggtccccgccccccccccaccccccgccacattgctatttggtattttatgagaaaaggtattcacttagtgatatattagttctgttacatgaattcagaaaatactatgttcttatcactggagttgggtggacatctcaaaagtgaccatcgcactttgtagaaataggggtcctgtcatgtagtacattatcttacccatccttggtacaacttttctcccactagagtcctaaggcacactggcctaatcatacttctccctctctcaaatctgagcaattgggagctcttagtcatttatacagtgggtgctt

SEQ ID NO: 127392 - DNA, 601 bp, Human
agggctgtttggaaaaaatgcaacctaaaatgattccagtgtagaagcttccacagcttatgagctacgcatactaaacagtcttttataagcatgtgctttgctctctgaaaggaacgctcaacagtgttgggtgagtgggagctctttatagcagcttgtccctcttgcttcagtctttgtgggtgtcgttaaacaggatgaaaggcctgtgacgatccaagacacttggaggttgatccacagaggactgggacacaccacgagaatctcccagagtgtcattacagtggaagacttygagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattt

SEQ ID NO: 127393 - DNA, 601 bp, Human
agaatattcttcaagcatcttcccagtcactcttaagataataacttaactgttgctgcttaaatgtatatttatttactgcttaaacatatatacacacatatatatactgcttatatatacacacacacacacacacacacatatacacacacacacacttggactaaaattctagctgccattaaagtggtaactttgagttcctatttttccagaattcaaacctgaacagtgaaatccagttttctttttacggtttcaaaaaaagaagggagagggatgatctcactggaagagrcgagcagaccccagaggcagtcccaggtctgggctctgtgcttctcagccctcaagacacagggaaggagcctgttggtacctgtaaatcaaccagtaatctacttggatgcttttggttttcttcaaacacttaacgttcactcagctaaactggcagagcaaactttcatgacatatcctaactgcatcctaagatttccatcctaagcattttgccaccatttctgcgcctacaaagtttacaagagttagccaaggacggtagctttgtttttcaaagggctaaaagcaacgacaa

SEQ ID NO: 127394 - DNA, 601 bp, Human
aaaataccaagaaaccacatctgattgttacccagcagtcagcagaagtttaggttttgaatgcatgctaaattcaacgctccttaaatgagagtcgacaaaagaatattcttcaagcatcttcccagtcactcttaagataataacttaactgttgctgcttaaatgtatatttatttactgcttaaacatatatacacacatatatatactgcttatatatacacacacacacacacacacacatatacacacacacacacttggactaaaattctagctgccattaaagtggtaactytgagttcctatttttccagaattcaaacctgaacagtgaaatccagttttctttttacggtttcaaaaaaagaagggagagggatgatctcactggaagaggcgagcagaccccagaggcagtcccaggtctgggctctgtgcttctcagccctcaagacacagggaaggagcctgttggtacctgtaaatcaaccagtaatctacttggatgcttttggttttcttcaaacacttaacgttcactcagctaaactggcagagcaaactttcatgacatatcctaactgcatcctaagat

SEQ ID NO: 127395 - DNA, 601 bp, Human
actgagaaacacttaagatctttcatactgagaaaacaaaataaaaacagttcccatgtaacacaacctaacagatacataatagttgagaggcaaagttattaaggaaatgtatcttcttttcccaaggtttaagaattctgacccactcaaaaaaaaaagtgaggataaaaatgaaaaggtgagatactagatatcacctggtaaccatctgatactgacttcacggcaccagccaaaggggctttagtaccttttcaaactgattcgctatccacaaaggccaattaacctagtaagkgaggcatttgtgctagattccaacctgatgaacacggtataaatatcaacctaaaggaaatattgataaaactttttttttaaatcattacaagagtcctttcttgctcgactggtaagaaattacttttttcacccagttcactctgacctacacacctctaaattcataccaaagcggctttagaaaataccaagaaaccacatctgattgttacccagcagtcagcagaagtttaggttttgaatgcatgctaaattcaacgctccttaaatgagagtcgacaaaagaatattcttc

SEQ ID NO: 127396 - DNA, 601 bp, Human
ggaggagaaaagaatgttcttccccaaatgatacactgttaccatacagtctgtagatgtacttaggtacaggaatgactggcagaagccaacttacctacctctaaaactgtaaaactgtaacagctgaaaatctgatcatcttttccactgagaaacacttaagatctttcatactgagaaaacaaaataaaaacagttcccatgtaacacaacctaacagatacataatagttgagaggcaaagttattaaggaaatgtatcttcttttcccaaggtttaagaattctgacccactcaaaaaaaaaagtgaggataaaaatgaaaaggtgagatactagatatcacctggtaaccatctgatactgacttcacggcaccagccaaaggggctttagtaccttttcaaactgattcgctatccacaaaggccaattaacctagtaagtgaggcatttgtgctagattccaacctgatgaacacggtataaatatcaacctaaaggaaatattgataaaactttttttttaaatcattacaagagtcctttcttgctcgactggtaagaaattacttttttcacccagttcactctgacc

SEQ ID NO: 127397 - DNA, 601 bp, Human
aatcacaaatttgccacataatatatgatctcaccttggtcagttaagtcttccttggtctccacatctacaaaatggtataatatcatctacatctcaaacggtaccggtaagaatcaagaggcataaaaatgatttgcaaaacattgaaaaatggtgtttatactaacatggttgttatttttcaagcatccttgcctaggccacctgaattcactctgctttatttttttattttatttttttttttgagacggagtctgcctctgtcgcccaggctggggtgcaacggcacaatctsagctcaacgcaacctccgcctcccgggttcaagtgattctcctgcctcagcctcccgagtagctgggattacaggcgtgtgccaccacgcccagctaattttttggatttttagtagaaacagggtttcaccatgttagccaggatggtctcgatctcctgacctcatgatccgcccacttcggcctctcaaactgctgagattacagactctgctgtctttctaagccaactccttataagccctggtcaggagacaagaaaaagggagggctatgaggcctatcagagcaagccatag

SEQ ID NO: 127398 - DNA, 601 bp, Human
gtttttgatcctgatgtaaaatatatttcttacatgggtcacggttcagaaaagttgaaaagtgactgataaaattttgtaacagaaatgtgcaaaccaaaatctcatttttaaatcacatttctgcaaactcaaagccgattggtgttcctgcctccatctgaagcttttcttttaatctcaattgagtgaaacaacaaatgctcaatgaaagacggagtacttatagccacagatcagcctgatttctttatgtttattcgtcactatattcattcagtttctgatgtctatttttttyccctactgaaatataaaactggggtttaagagaaaaaaagcaaaggcttcagcaactttcattaaacatttactttaaatggtaacctcattcagatctaccactttcaacccctcccctaggacctggcacatgaaagttcaataagggttgctgattgaataaattaaaaaatcagcctcctatttctaatttctttagccaatctaactagcaatgagataaactttaatgtttgcaaaagtaaccataaaacagtaacactgcatgatgagtgggagtaggaggagtagtagtttc

SEQ ID NO: 127399 - DNA, 601 bp, Human
ggtgtggtccacttcctgcaggtaaggagcttccacaagggcagctctgaatcatcgggagtaatcgcccaaataaagagctaaggggcccgtttctcaggagaccatcggacgcctggactgcggctttagagtgtgtgtaaccgcacaagcacagcagaaagtagcagtgaccatcgacaggctcctcccttcagtaactgctcaccctgcatcttgcaccagggtcctggaaaaatactgaactgaaaatgaaactcaacctgcaccacattaggcagctcagctctacgcatcagamcgtagctccaagaagagcatcaaagtcagaaagagggtgggaaagcaatgatgccagccgccacctgcccataactgctcagcacagttagcaagctagaaaatctcatctgaccaattcctacttgaaggtcacttgcttttatgtgacatgctatcaagaatactcccagatctgagactggactcctccaaaagtttgggtttttctaatttaaaaaaaccttgtgaccatcctccccctcaaaaaagaacactttcaagcaaaacaaattcttaccattgttacattttggaacac

SEQ ID NO: 127400 - DNA, 601 bp, Human
caaaggcatatctcagtttatttcccctaatttaaaccttgcaaaccagggagccatttaggattaagaaactccatagtcaccctcaggaggcaggttatttttcccaaagcatttggcacttatattttttataatttccactgcaaaaacatgaattatgggaaatgactgctacaaactactccgacgacagtggctgattctacgcgatgagacatggataatagagtgcaacttctatttcctgcactcacaccacccacaagattccattaatgataatcagctgagctaaggyattaaaaggcacagaaaggtggcttgggtgtggtccacttcctgcaggtaaggagcttccacaagggcagctctgaatcatcgggagtaatcgcccaaataaagagctaaggggcccgtttctcaggagaccatcggacgcctggactgcggctttagagtgtgtgtaaccgcacaagcacagcagaaagtagcagtgaccatcgacaggctcctcccttcagtaactgctcaccctgcatcttgcaccagggtcctggaaaaatactgaactgaaaatgaaactcaacctgcaccacat

SEQ ID NO: 127401 - DNA, 601 bp, Human
tctctctgctgggggagagcggggagcccatgtgaggaaaagaggcaagcggaagagaagtaaatcctcatccgcagggtccaaagtctatagacaatgcctgaaaccaggaaaaaaaaaaaaacacaggcagaaatttttttttttttttttgagatggagtttcactctgtcacctaggctggagtgcagtggcaccatctcagctcactgcaacctccgcctcccaggttcaaagaattctcctgcctcagcctcccaagtagctgggaatacatgcgcccaccaccacgcccagctrttttttttgtatttttagtagagacagagtttcaccatgttggccaggctggtcttgaactcctgacttcaagtgatccacctgcctcagcctcccaacgtgctgggattacaggcgtgagccaccgcccccggtcaattttttaatgttcctcataaactaaggagtaacaaaaacaaaaatcaaccaggagagatcaaaggggctgccctcggggaataagaaatggcgggaggtggaagcagctgctatctttcccaaccaaccttacaaaactacccattagacatttctaaatag

SEQ ID NO: 127402 - DNA, 601 bp, Human
ccaggaagaacagcacagcctgcacacacagaagccggtgctggcagggcctccatcttcaacagcaacactggaagctaaaacacagtggagaaacacctttaaaattctggaggaaatgaatgtccaccctgcaattttacaccatgctaaaatatcaactgagggagaagaaaaaaaatttttgaaaagcctgtctcccacgctgcctattcacagaaaatggcgcactatatgcccaaccaacatcatggcataaaccaagaaagaaaatgacagcagagacaaaaaaaaaaaaacaaaaaaaaacaaaacagatattcaacacaagagagcagcagaaggaacccagaggatgagagcaaaggaagaccagaggatgggggtggcacaagaagcatagaagatacgcaggtgacgaaaggcacaggtgccacccgaacttcctaagacaaggttgcaacaactacagagtgctgggatgaatgagaagcattaccaaaagaaaagaaatctgatcagtaactatggttgagtaataatggctgggctgcagatccgtctgcagtccattaatgtacacaccgcattctgacctcac

SEQ ID NO: 127403 - DNA, 601 bp, Human
taggtccaggaagaacagcacagcctgcacacacagaagccggtgctggcagggcctccatcttcaacagcaacactggaagctaaaacacagtggagaaacacctttaaaattctggaggaaatgaatgtccaccctgcaattttacaccatgctaaaatatcaactgagggagaagaaaaaaaatttttgaaaagcctgtctcccacgctgcctattcacagaaaatggcgcactatatgcccaaccaacatcatggcataaaccaagaaagaaaatgacagcagagacaaaaaaaaacaaacaaaaaaaaacaaaacagatattcaacacaagagagcagcagaaggaacccagaggatgagagcaaaggaagaccagaggatgggggtggcacaagaagcatagaagatacgcaggtgacgaaaggcacaggtgccacccgaacttcctaagacaaggttgcaacaactacagagtgctgggatgaatgagaagcattaccaaaagaaaagaaatctgatcagtaactatggttgagtaataatggctgggctgcagatccgtctgcagtccattaatgtacacaccgcattctgac

SEQ ID NO: 127404 - DNA, 601 bp, Human
aaagttcagatcccattaggtccaggaagaacagcacagcctgcacacacagaagccggtgctggcagggcctccatcttcaacagcaacactggaagctaaaacacagtggagaaacacctttaaaattctggaggaaatgaatgtccaccctgcaattttacaccatgctaaaatatcaactgagggagaagaaaaaaaatttttgaaaagcctgtctcccacgctgcctattcacagaaaatggcgcactatatgcccaaccaacatcatggcataaaccaagaaagaaaatgacagsagagacaaaaaaaaaaaaacaaaaaaaaacaaaacagatattcaacacaagagagcagcagaaggaacccagaggatgagagcaaaggaagaccagaggatgggggtggcacaagaagcatagaagatacgcaggtgacgaaaggcacaggtgccacccgaacttcctaagacaaggttgcaacaactacagagtgctgggatgaatgagaagcattaccaaaagaaaagaaatctgatcagtaactatggttgagtaataatggctgggctgcagatccgtctgcagtccattaatgta

SEQ ID NO: 127405 - DNA, 601 bp, Human
gcccaggctggagtgcaatggcgcgatctcggctccctgcaacttccgtctcctgggttcaagcaattctgcctcagcctgccaagtagctgggattacaggcgtgtatcatcacgcctggctaatttttgtgtttttggtagagaaggggtttcaccatgttggtcaggctggtctcgaaatcctgacctcaaatgatccacccgcttcggcctcccaaagtgctgagattacaggcatgagccatcgcgccgggccagcagagaactaacttaactcacagtgctggacccccagctcycaggaactgacggcaccagtccctctgccgggggaatgagtgaaccaggcagagcctcaaagtcagccacagaagtgggtagacagccagacagcttgccccacatctcacagccaggctcccaaagtcaaggaaatgatgaaaatatattatctgcaaaggaaggaaaaattgaggatatatggaccaggctgcagcagacacagccggaagcagaggcagcatacttaaaaatggggaatgaaggccggggatggtggctcacacctgtaatcccaccactttgggaggccgaggcat

SEQ ID NO: 127406 - DNA, 601 bp, Human
cagtcagtcctagctcttggaatttcctcacctgcctggccctgtctttattcacctataaactgaagaatagcaacttggaggtagaggggtcacacagacagcagcatctaattgggtcaatcctgaaatcccactaaaatcataaatctaaaaaccaccacatacctgaaacagagagaagacaactgcaatgaaatctcagaagctggaaagtaggtagtggtttaaaaaaaaaaagggggggggtggggagtagaggaagacaacgctaaaccggaggtgcagaaaacagagaactttttttttttttggaggcacagtctcgctctgtcgcccaggctggagtgcaatggcgcgatctcggctccctgcaacttccgtctcctgggttcaagcaattctgcctcagcctgccaagtagctgggattacaggcgtgtatcatcacgcctggctaatttttgtgtttttggtagagaaggggtttcaccatgttggtcaggctggtctcgaaatcctgacctcaaatgatccacccgcttcggcctcccaaagtgctgagattacaggcatgagccatcgcgccgggccagcagaga

SEQ ID NO: 127407 - DNA, 601 bp, Human
tgccctcaatgaaatggagatttttcttttcctcaaaaaaaatgaataacaatgaaacatgaacacactcttctttaaaggttaaaaacaaggaaataaaaacgcccaaaacaccctctgttcacagccctgaactcagctgtttcatggaggctggagggacaatgtgacggtcaggagggcagagctgtgttggggatgtggtgcagggaatctgacacgccagggagcaggcagtcgggaggaaggaaaagaacacacatgctggcctcccagtcagggcttccgccccagtgatgcygttttctagccgaggccttgggcaggtttcataagcctcggttttctcatctgtaaaattagtctgacagccattccctcagcagagaccctgagggttcaccaagaggcctggccctcactgaagaaaactcaatcaaagcagtccccttccgacaaggcttcccatgaagggcaacaaattccaaagatgtttattttctagactgacataaatccagccatgccacaggctcagtccttccacctacccacagcaagcaacagggaagcaggtgggagaagaaagctctgctgcaga

SEQ ID NO: 127408 - DNA, 601 bp, Human
caaatttgagaattatcaggttcagagcatttgttctagttcggggttttccaaaaagactactgcaccctagatcttgagagatgcactccttatgaaataaggttccaagtggcacgcagtagcataagcctgtaatctcagctacttaagaggcagaagcaggaggactgcttgaggccaagagttcaagtccagccttggcaacatagcgagattcccatttctaaaaataaaaataaggttccaaggtcaaaaagacatggaacacacatcctctgcccccaacaggtttataaayacatgctaaaatcgcaaaggctctaatgagtcttataattacaggcctattcaattcccaaagttaggtcagcggttccaaagtcagtctttggaaatacaagccataggctgcaagcactgattgtagcttgctctgcttttcaaatgggcaaggctactgtgtgcttcactagagtggggagcaatgaggattcaggattcttttttgattctccagcgcagtggttctcaaagtgtcatcctcgaggcggcaatacaccaggacacttgctcagaacacaaactccctccgagacgc

SEQ ID NO: 127409 - DNA, 601 bp, Human
accgagaaaagaaaatcaattctaaccaaagacggtcatttcatcagtgggaaaaacaccggcgggtatgcccttctctcccctgcggcatcccagcacctggagctaagaggagctggacagatgatacagagcttgctcgggggcttccccttacgagggctccctaggcagaggaaggcaagcggtactgagtctgagaatcctgcagtggctgagcatggggaggggtaggttcaaaggcccaggaacaggcactgagctttggaggagcacagggagctgagcccacccagggcakaggagctgaagagcagagaggaggaagctgggtactaaaaaaggccctgagttttaggctggcgtctacatctgatcaggaagtcaggagcagcaggcaataccacagttaagaaaagttatcctgacaaatttgagaattatcaggttcagagcatttgttctagttcggggttttccaaaaagactactgcaccctagatcttgagagatgcactccttatgaaataaggttccaagtggcacgcagtagcataagcctgtaatctcagctacttaagaggcagaagcaggaggactg

SEQ ID NO: 127410 - DNA, 601 bp, Human
acttaaaaccaaaagcaaagccaacaaccccaaaaccctcaaataagaaagcctggtaaaatcaaagtgtaactaaatccagtacaccctaataacagacgacattattaaaataaatgggggggagagataacagagaaatagagatcacttctgaatcaaaagtcaaatcaactatacataaaagccaacatcccaaacattgaaaactctactgatatgaaatactttttcccattctgaaatatatgtatagtattacatttagttaagtgttaaatacaacagctaccgagaaaasaaaatcaattctaaccaaagacggtcatttcatcagtgggaaaaacaccggcgggtatgcccttctctcccctgcggcatcccagcacctggagctaagaggagctggacagatgatacagagcttgctcgggggcttccccttacgagggctccctaggcagaggaaggcaagcggtactgagtctgagaatcctgcagtggctgagcatggggaggggtaggttcaaaggcccaggaacaggcactgagctttggaggagcacagggagctgagcccacccagggcagaggagctgaa

SEQ ID NO: 127411 - DNA, 601 bp, Human
aaggaaccagggatgccacttggagaactagttttcaactgaagttgtttaaactatgtgatcactttatgcctccagggaaatgaaatcccatcccacaacatccaaggctagcaccgatggccccaggtcaattttgggagtgtgtacccagaataccgatgctattagatggcacacttcaatcgcatcctctgcctttattcttcagagataaacacaggcagttgggggaccgaggccaggaaatgcaagtagtttcacttcacagaagctcgtcttttcttgcagaagacaaagyaggggaaggcattctgaatgacacaagttgttttagaaagacttcagattcttcgataacaaagggaaaaaagagcgcaaatctctgtaactcctcttcctgatgtggtcaatcccctaagtctgtataatgtgctgtttacccttgtattttaaaatgccgtataaaacacatttccaggctgggcgtggtggctcacgcctgtaatcccaacattttgggaggctgaggtgggcggatcacgaggtcaggagatcgagaccatcctggctaacatggtgaaaccccatctctactaaa

SEQ ID NO: 127412 - DNA, 601 bp, Human
aaaattagccggacgtggtggcgggcgcctgcagtcccagctactcgggaggctgaggcaggagaaccacatgaacccaggaggcagaagttgcagtgagccaagatcacaccactacactccagtctgggcaacagagtgagactccctctcttaaaaaaaaaaaaaaaaaaaggtaaaaaaaattaaaaatagaaaataacatattttatatgaacgtacctgcatgcacagaaacgtctgtatatttgggggttgggaagcttctcaagccttctcaggcctcccaagaaacgatttrctccacaacatacacagtaatgcatcccagaggaaggaaccagggatgccacttggagaactagttttcaactgaagttgtttaaactatgtgatcactttatgcctccagggaaatgaaatcccatcccacaacatccaaggctagcaccgatggccccaggtcaattttgggagtgtgtacccagaataccgatgctattagatggcacacttcaatcgcatcctctgcctttattcttcagagataaacacaggcagttgggggaccgaggccaggaaatgcaagtagtttcacttc

SEQ ID NO: 127413 - DNA, 601 bp, Human
tgtaaaaagtactgaggtgtttatcactttaaaagggttccaggctgggtgcagtggctcacgcctgtagtcccagcactttgggaggccaaggtgggcagatcacgaggtcaagagatccagaccatcctggctagcgcggtgaaaccccgtctctactaaaaatacaaaaaaattagccggacgtggtggcgggcgcctgcagtcccagctactcgggaggctgaggcaggagaaccacatgaacccaggaggcagaagttgcagtgagccaagatcacaccactacactccagtctgrgcaacagagtgagactccctctcttaaaaaaaaaaaaaaaaaaaggtaaaaaaaattaaaaatagaaaataacatattttatatgaacgtacctgcatgcacagaaacgtctgtatatttgggggttgggaagcttctcaagccttctcaggcctcccaagaaacgatttgctccacaacatacacagtaatgcatcccagaggaaggaaccagggatgccacttggagaactagttttcaactgaagttgtttaaactatgtgatcactttatgcctccagggaaatgaaatcccatcc

SEQ ID NO: 127414 - DNA, 601 bp, Human
ggaacagtccacatattttaaactttatttcttacaattgaaaaactgtgcttctttttgcatcaaacaatggtgaccacagaagtaaattacaataaaaatattaatatatccctaggctgggcacggtggctcacgcctgtaatcccagcactttaggaggctgaggcaggcggatcacctgaggttgggggttcgagaccagcctgaccaacgtggagaaaccctgtctctactaaaaaaaaaaaaaaaaaaaaaaaaaaaaaatccaaaattagccaggcatggaggcacatgcctrtaatcccagctattcaggaggctgagggcagaacaatctcttgaactcaggaggtggaggttgcaccattgcactccagcctgggcaacaagagcgaactccgtctcaaaaaaaaagaaaaaagtgtattaatatatccctgatatggtttggctgtgtccccacccaaacctcatcctgaattgtagctcccataatccctatgcattgtgggagggacccagtgggaggtaaccgaatcacaggagggtttttcccatcctcttcgcatgacactaagtctcacaagatctgatggtt

SEQ ID NO: 127415 - DNA, 601 bp, Human
acacacatctttcttcccataattaagaaggcctaccggttttatgaactattaggaatactttcccagcatccagctgagcaattttgacaggaggaatcctgttttcatgggaactactgaacccactagagggggtgcagcaaagaggaatgcagtaaacaccagagcggtacaacaccaggagggcactacaatggagaagggggtactgcagggcacagccaggcctggcacagccccaaagaccaacctaaactaactcagaaacctgcacccagaaacataaagaaaactcctyctcctcctccaactctcttatgccaactagcttcctgccttcagaaccaggaacttaactcttaagattatagtttacatagactttggagtaaaaggcttttctagcctagcctcacaacttaactgctatttccaaactcctttctatacgaaaatatgcaggcgactaaccaacaaagttacaagtgaaatcgggaatgtatttgggaacagtccacatattttaaactttatttcttacaattgaaaaactgtgcttctttttgcatcaaacaatggtgaccacagaagtaaatta

SEQ ID NO: 127416 - DNA, 601 bp, Human
cccttaagtccggcagaattggattccttgtatttttccaaacactctgtgccatttaaagacaccatgcttttgaacattctaatctgtctggatgccctctgcctttaaaagaaattcttctagaacagagctcagccattgtttcctttattaatcttcagccggctaggtctagatacttaattaccccctcctctgcgctacttctgagccttatacttccataaatgcattttttcccattgaaatgtatgcgacacatgtgcctctgctactgggccataagctccttgaagayggagctgttagtcatctaatcccaatgccagcactgcaccagacgtatgacagatccctcttcaactctaaacaccatctcctatgccttacacattggctgatataccacctattagatatctattcagatcaacacacatctttcttcccataattaagaaggcctaccggttttatgaactattaggaatactttcccagcatccagctgagcaattttgacaggaggaatcctgttttcatgggaactactgaacccactagagggggtgcagcaaagaggaatgcagtaaacacc

SEQ ID NO: 127417 - DNA, 601 bp, Human
ggtctcaatctcctgaccttgtgatccacccgcctcggcctctcaaagtgctgggattacacgcgtgagccaccgtgcgggctaccagcctccctgtcttatgtaaatgtcttcctttctctagataaggtcttttatcagcatatacctgacgaaatgcccggataagaaattcggtcccatactcaggacccacttcaggaagaactctatctttcctgacttctcctccttccccggggaattgtcagtcgcatggcctggattccccaacagggctggcagggggcatggattggcyagagccccactcctcttgccacagggatcagtccagggttaaggactatgctaggacgctcagcattgcctaagaacttgtgctagagctactgaaaaagaggtgctctttgtcccccaggatcacatcattaaggctgggtgctgcgggcagccgcctttatcatcggctggggcacacctgcctaagaagtaagccctcacgttccactgtactggaagtcaagcccactgcagccctttcagtgctgtgagcagatgaatctccccttcttctttttgcttaaactagttgaggttg

SEQ ID NO: 127418 - DNA, 601 bp, Human
tttttgtatttttagtaaagatggggtttcaccatgttagccaggatggtctcaatctcctgaccttgtgatccacccgcctcggcctctcaaagtgctgggattacacgcgtgagccaccgtgcgggctaccagcctccctgtcttatgtaaatgtcttcctttctctagataaggtcttttatcagcatatacctgacgaaatgcccggataagaaattcggtcccatactcaggacccacttcaggaagaactctatctttcctgacttctcctccttccccggggaattgtcagtcrcatggcctggattccccaacagggctggcagggggcatggattggccagagccccactcctcttgccacagggatcagtccagggttaaggactatgctaggacgctcagcattgcctaagaacttgtgctagagctactgaaaaagaggtgctctttgtcccccaggatcacatcattaaggctgggtgctgcgggcagccgcctttatcatcggctggggcacacctgcctaagaagtaagccctcacgttccactgtactggaagtcaagcccactgcagccctttcagtgctgtga

SEQ ID NO: 127419 - DNA, 601 bp, Human
acacctataatcccagcactttgggaggccaaggcaggcagatcacctgaggtcaggagttcgagactagcttgaccaacatggtgaaacccagtctgtactaaaaatgcaaaaattagccaggcatggtggcacacacctgtaatctcagctactcaggaggctgaggcacgagaatcacttgaaccagggagatggaggttgcagtgagctgagatagtgctactgcactccagcctgggaggcagagcgagactccaactcaaaaaaaaaaaaaaaaaaaagaaagaaaaaatagttyaagaacatgatcacccaaaatatcctaacactgcttttatcttttcttattacacttgattggtctagtgtgtatcttataacctagccaccatcatagctgactataatcatgacctgctctttacagagtgaacgctgagctcatgccatcccttttcccctcatgtataactggcacaatatgccctgccttccaggcagcacacacaaccctattgttggataaccatgtttaaactcactctcggccaggcacagtggctcacgcctgtaatcccagctctttgggaggccgagg

SEQ ID NO: 127420 - DNA, 601 bp, Human
tgtcaggaagagaaatgaaacctacatccctccaccaaggaacgaaaaagtagctcaaggattccaggcacccaagaggcctcctttggcctttttccagttctgttctgagcatcacccaaaattcaaagaaaacatcccggcctatccgtgggtgatgctgcacagagactgggagggatgggagagacaacactgctgcagatgcccagtagcctaggaaaaggaggcgcagcatgagaaggatcctgctgcaggctgggctgaaggaatgcccgatgaagtacaaagagagttgctyaggctgaaaaaaagcaagaaaaaggaggaacaggaggcttggcgcagtggctcacacctgtaatcccagcactttaggaggccaaagtggggggatcgtctgaggtcaggaattcgagaccaacctggccaacatggtaaaacctcacctctactaaaaatacaaaaattagccaggtgtggtggcaggtgcctgttatctcagctactccagaggctgaggcaggagaactgcttgaacccaggaggtggaggctgcagtgagccgagatcacgccactgcactccagcctgggtgatg

SEQ ID NO: 127421 - DNA, 601 bp, Human
gagggcgccttgagaaccccaagggcaggcagctttctgagtggcagaccagccacggggacccaggatctgccactccagagaaactgccttcggtctagtcagaaaccgaagacgccaacaaggggaagatggcatctgcagaaaaccacttgagtagggccaaaaggacacgttttcaggataccctcactgatttccaggcagtggaactatcctgtaggacgctccagtggtggatgcatgtcactatacgtttgtcaaaacccactgaacatacaccaccaagagtgagctccascgtcagcgatggattcaggtgatgacaacatgtcaacgcaggctcatcagctgtgacaaacgtaccactctggcacaggatgctgacaccaggggagaccccgtgggtgtgggagccaaggggatgggaaatctctgcaccttacactcaattttgttgtgctccaaaactgctctaaaaaaaaatttatttaaaaaataatgacagccaccacggtaggctaagctccagagtccctgtggggtgcgtgagagccggacgggcactcagcaactctgggccttgctgaggaaagggtga

SEQ ID NO: 127422 - DNA, 601 bp, Human
tctttacatcagtagggagaggcactatggggtattttcccctccctacaacgaccacccacaggaacaaggatgatgggaagggacgcagaccctggacgctgggtaccaaattgatcagaaacatgggagaaggtgtggtcagcaaggtggggacaggccagctggggacacaagtggctacgggacagcagagaggcaaaccatctgcagctaagccggcggaggtcttcttccactcaacccagctgggaaaagactaagggaaatttgaggcagagaaaacaaagcaggaggtccyccttagagaaggacatgcactcagcttttaaacctggcctcgaagtgaattggggagcagagcaccaaaaagagctatgagaactgcccattagaatctgaccttgtggaggtccagggtggctaccgagggcgccttgagaaccccaagggcaggcagctttctgagtggcagaccagccacggggacccaggatctgccactccagagaaactgccttcggtctagtcagaaaccgaagacgccaacaaggggaagatggcatctgcagaaaaccacttgagtagggccaaaaggaca

SEQ ID NO: 127423 - DNA, 601 bp, Human
tctgggctcaaaggtaaaaaaatactcatttgcatgtaattttgcataaactctcttgtttagttccagatgcccaattctaagtatgcaaaataaaatgaaatcatttatacagcttactgcttccagtgttttcaattcaatgctttaacaataaaagcaaaaagaaaaccttctgaatcaatttctgaattaagttccttaatcaacttctgaattaagttgaagattaagttcaacttaaaaaaaaaaatacatgcatatatattgtgaccagcctataaaaatcaacacttggccrggcgtggtggctcacgcctgtaatcccagcactttgggaggccgaggtgggtggatcacaaggtcaggagatcgagaccatcctggctaacatggtgaaaccccgtctttactaaaaatacaaaaaattagccgggcatggtggcgggcgcctgtagtcccagctactcgggaggctgaggcaggagaatggcgtgaacccgggaggcggagcttgcagtgagccgagatcttgccactgcactctagcctgggcgacagagtgagactctgtctcaaaaaaaaaaaaaaatcaagactt

SEQ ID NO: 127424 - DNA, 601 bp, Human
acaggtgggtcgtctgcagcatactactagctcattaatacactttatttatagtggctagggttgtaacactgcaggcttccctttgatgactcaattcaatactccacaaagattttcatcctagttcatgaaacgtcattaacactgttagtcatttacaactgagggaattctctagaagcagtaaaagctttcttgtttcttctttttcattttacataggaacaggccaagcacagtggctcatgcccataatcccagcactttgggaggtcaaggggggaagatcgcgtgagcycaggagtttgagaccagcctgagcaacatagggggaacctgtccctacaaaaaatagttgggcatggtggtgcacacctgtagtccctgctacttcgaaggtgaggcaggaggatcgcctgcgcctgggaggtagaggctacagtgagccatgatcacaccactgcactccagcctgggtgaggaagcgagaccctctctccaaaaacaacaacaacaaaaaggaatggcctctttcttgtagttttgtcttctctctctaaagacaaaccatcagtatttatcactcaagtccagttgt

SEQ ID NO: 127425 - DNA, 601 bp, Human
tgtgtggcaccttccatctctctccactgctcccactctcgccatgtgactgcctgttcccacttcaccttcggccatgagtcaaagctccctgaggcctccccagcagccaaagagaagcctgtaccatgcttcctgtacagcctgcagaaccataagccaactaaacctctttcctttataaattgctttatagcaacagaagaacagcctgagacaggcactaattccattcatgaaggcagaaccctcatcagctaatcacctaatcacctcctaaaggccccacctcgaaacacarttgcactaagattcacaacatgactgtggagagccataagcattcagaccacagtagctacctatttccttgcctcctgactatgcctggtgtaacctcacagttaggtggtctcacatctcttcaatgatcttgacttttccacaagaatctcacttccacaggtgggtcgtctgcagcatactactagctcattaatacactttatttatagtggctagggttgtaacactgcaggcttccctttgatgactcaattcaatactccacaaagattttcatcctagttcatgaaacgtc

SEQ ID NO: 127426 - DNA, 601 bp, Human
aactgcatgatgaaatgcaatccccagtgttggaggtggggcctgctgggaggtgtttggatcatgggggtggatccctcgcggcttggtgctgtcctcataatagtgagttccagcaagatctggttgtttaaaagtgtgtggcaccttccatctctctccactgctcccactctcgccatgtgactgcctgttcccacttcaccttcggccatgagtcaaagctccctgaggcctccccagcagccaaagagaagcctgtaccatgcttcctgtacagcctgcagaaccataagccaamtaaacctctttcctttataaattgctttatagcaacagaagaacagcctgagacaggcactaattccattcatgaaggcagaaccctcatcagctaatcacctaatcacctcctaaaggccccacctcgaaacacaattgcactaagattcacaacatgactgtggagagccataagcattcagaccacagtagctacctatttccttgcctcctgactatgcctggtgtaacctcacagttaggtggtctcacatctcttcaatgatcttgacttttccacaagaatctcacttccaca

SEQ ID NO: 127427 - DNA, 601 bp, Human
tcctcatggatggcacctcctagctctgtcctcacatagcagaagggacaaagaagctccctcggacctcttttgtgagggcactgatatggttggaggtccccttcaaactgcatgatgaaatgcaatccccagtgttggaggtggggcctgctgggaggtgtttggatcatgggggtggatccctcgcggcttggtgctgtcctcataatagtgagttccagcaagatctggttgtttaaaagtgtgtggcaccttccatctctctccactgctcccactctcgccatgtgactgcctrttcccacttcaccttcggccatgagtcaaagctccctgaggcctccccagcagccaaagagaagcctgtaccatgcttcctgtacagcctgcagaaccataagccaactaaacctctttcctttataaattgctttatagcaacagaagaacagcctgagacaggcactaattccattcatgaaggcagaaccctcatcagctaatcacctaatcacctcctaaaggccccacctcgaaacacaattgcactaagattcacaacatgactgtggagagccataagcattcagaccacagt

SEQ ID NO: 127428 - DNA, 601 bp, Human
aatttaaacaatgagccgggcacggtggcacacgcctatagtcccagctactcgggaggctgtggcgtgaggactgcttgagcccaccagttcgaggctatagttagccattaccacatcgctgcactccagcctaagcgacagaatgagaccctatttctttaaaacaaaattaatgatcaactatgataaaaagtcaataggttgtttgcagtcagctggttttccagtatttgtactgagacacctcttgtccaggattcctgtaatgacacgccatgggctggggaggcaagattargagtaaaatcaatagctgtgaaatggttttctctgcaaggctcccagttgtattcagccatcaatttagtaaacttcgccttattaccaactctttgtgaccaaaggagcaaactgagaaaatacatgatgtgcaagcacctttcctatacttcaatatcacagcctcattcaccttctcatctccagtaaactgatcccacactgtagttcttatccacacagagcaaactactgctaaaccctcatggtagatgaggctatttatgcagctgggccaccaagccctcccctctctccc

SEQ ID NO: 127429 - DNA, 601 bp, Human
caggcccagtggctcacacctgtcaacctaagcactttgggaggccaaggtgggagaatcgtttgaggccaggagttagagaccagtctgggaaacataatgagaccccatctccaccaaaaatttaaacaatgagccgggcacggtggcacacgcctatagtcccagctactcgggaggctgtggcgtgaggactgcttgagcccaccagttcgaggctatagttagccattaccacatcgctgcactccagcctaagcgacagaatgagaccctatttctttaaaacaaaattaatgaycaactatgataaaaagtcaataggttgtttgcagtcagctggttttccagtatttgtactgagacacctcttgtccaggattcctgtaatgacacgccatgggctggggaggcaagattaggagtaaaatcaatagctgtgaaatggttttctctgcaaggctcccagttgtattcagccatcaatttagtaaacttcgccttattaccaactctttgtgaccaaaggagcaaactgagaaaatacatgatgtgcaagcacctttcctatacttcaatatcacagcctcattcaccttct

SEQ ID NO: 127430 - DNA, 601 bp, Human
gccaggatggtctcgatctcctgacctcgtgatccacccgcctcggcctcccaaagtgctgggattacaggcgtgagccaccgcgcccagctatctaattgttttaaggggtaacttttatgttaaaatttatattaaaattgtggccaggcccagtggctcacacctgtcaacctaagcactttgggaggccaaggtgggagaatcgtttgaggccaggagttagagaccagtctgggaaacataatgagaccccatctccaccaaaaatttaaacaatgagccgggcacggtggcacaygcctatagtcccagctactcgggaggctgtggcgtgaggactgcttgagcccaccagttcgaggctatagttagccattaccacatcgctgcactccagcctaagcgacagaatgagaccctatttctttaaaacaaaattaatgatcaactatgataaaaagtcaataggttgtttgcagtcagctggttttccagtatttgtactgagacacctcttgtccaggattcctgtaatgacacgccatgggctggggaggcaagattaggagtaaaatcaatagctgtgaaatggttttct

SEQ ID NO: 127431 - DNA, 601 bp, Human
gtgccaccacactcagctaatttttttgtatttttagtagagacagggtttcaccatgttagccaggatggtctcgatctcctgacctcgtgatccacccgcctcggcctcccaaagtgctgggattacaggcgtgagccaccgcgcccagctatctaattgttttaaggggtaacttttatgttaaaatttatattaaaattgtggccaggcccagtggctcacacctgtcaacctaagcactttgggaggccaaggtgggagaatcgtttgaggccaggagttagagaccagtctgggmaacataatgagaccccatctccaccaaaaatttaaacaatgagccgggcacggtggcacacgcctatagtcccagctactcgggaggctgtggcgtgaggactgcttgagcccaccagttcgaggctatagttagccattaccacatcgctgcactccagcctaagcgacagaatgagaccctatttctttaaaacaaaattaatgatcaactatgataaaaagtcaataggttgtttgcagtcagctggttttccagtatttgtactgagacacctcttgtccaggattcctgtaatga

SEQ ID NO: 127432 - DNA, 601 bp, Human
aaacatcgcccacaacaggcctgagcttcaaccctacaaacgcaggtggggcagcccctatcacggaaagtcaaattcccattttcagtttccaatgagatgtcaagaaccaagcaacaggctcaggaagagccaagaaaattgactttctcaactaaaaaaaggccagaacacatgaactccttgtgtttgtcatgtggactccagttactcacacctgaatctctgaggccctgaacatctgtgttcccccttccttccatatctaattgttgtttttttttgtttgtttgtttgtttktgagatggagtttcactcttgttgcccaggatggagtgcaatggcaccatctcggctcaccgcaacctccgcttcccaggttcaagcaattctcctgcctcagcctcccgagtagctgggattacaggcatgtgccaccacactcagctaatttttttgtatttttagtagagacagggtttcaccatgttagccaggatggtctcgatctcctgacctcgtgatccacccgcctcggcctcccaaagtgctgggattacaggcgtgagccaccgcgcccagctatctaattgttttaag

SEQ ID NO: 127433 - DNA, 601 bp, Human
cagagataagcaggccagcttatcctccaaacatcgcccacaacaggcctgagcttcaaccctacaaacgcaggtggggcagcccctatcacggaaagtcaaattcccattttcagtttccaatgagatgtcaagaaccaagcaacaggctcaggaagagccaagaaaattgactttctcaactaaaaaaaggccagaacacatgaactccttgtgtttgtcatgtggactccagttactcacacctgaatctctgaggccctgaacatctgtgttcccccttccttccatatctaattgctgtttttttttgtttgtttgtttgtttttgagatggagtttcactcttgttgcccaggatggagtgcaatggcaccatctcggctcaccgcaacctccgcttcccaggttcaagcaattctcctgcctcagcctcccgagtagctgggattacaggcatgtgccaccacactcagctaatttttttgtatttttagtagagacagggtttcaccatgttagccaggatggtctcgatctcctgacctcgtgatccacccgcctcggcctcccaaagtgctgggattacaggcgtgagcca

SEQ ID NO: 127434 - DNA, 601 bp, Human
cttcttctgaagctaaaaaaaacatgaaagtttaaagaaattgggagatcacaggaattgcttaagatctgaatataattcaacaccagtcttaaagtccttgtcattctgggtttcactgatgaaggctaagagtacaggattaacttctgatacatgaaattgttcagtttaaaagacaatgcacagatgaccgctgcggcaaaggctgggcagggtgctggggtccacctgatgcctagtgccacccccactgtcccccaacccctgttcacaagagacagctgtgaaagggccactrgcacacagcatggcaccttatcccaaaggcagtgctatcccagatgatctggtgagcagttcaggcagatctcaaatggcctggtccatctgagaaagcccttactttcaaaagccttctatctaccaactcttacaaaaacacacacgagtaaatcactttaaaagccttttttataattttgctttaaaaaaaaaatgaaatccccagacctgtcaaaagctgaatctatgccagaaggagaccagattttgccaagaatatggtgaacagggacttccttcagtcccctggccacaa

SEQ ID NO: 127435 - DNA, 601 bp, Human
ccctaaatcaatatggataataataaagaagctaaaagcggcaaatgtctttctatattagatgaaacatcctgaattatattacaccaaacactgtaattactgcatgacttttaaacaattctttccatagggaaaaccgacaaaatgaaaatacaaaaaaagagaaatcattcaagaaaaaaatgttaccttaaaactcttcttctgaagctaaaaaaaacatgaaagtttaaagaaattgggagatcacaggaattgcttaagatctgaatataattcaacaccagtcttaaagtcyttgtcattctgggtttcactgatgaaggctaagagtacaggattaacttctgatacatgaaattgttcagtttaaaagacaatgcacagatgaccgctgcggcaaaggctgggcagggtgctggggtccacctgatgcctagtgccacccccactgtcccccaacccctgttcacaagagacagctgtgaaagggccactagcacacagcatggcaccttatcccaaaggcagtgctatcccagatgatctggtgagcagttcaggcagatctcaaatggcctggtccatctgagaaagc

SEQ ID NO: 127436 - DNA, 601 bp, Human
acgaggtcaggagatccagatcacggtgaaaccccgtctccactaaaaatacaaaaaattagccaggcttggtggcgggcgcctgtagttccagctactcgggaggctgaggcaggagaatggcgtgaacccgggaggcagagcttgcagtgagccgagattacgccactgcactccagcctgggtgacagagcaaaactccatctcaaaaaaaaaaaaaaaaaaagtgccagacttggcttcaggaagaagattttaagtttattcctggctgctcagtcagtgattagacaactcaaayccattaccctaaatcaatatggataataataaagaagctaaaagcggcaaatgtctttctatattagatgaaacatcctgaattatattacaccaaacactgtaattactgcatgacttttaaacaattctttccatagggaaaaccgacaaaatgaaaatacaaaaaaagagaaatcattcaagaaaaaaatgttaccttaaaactcttcttctgaagctaaaaaaaacatgaaagtttaaagaaattgggagatcacaggaattgcttaagatctgaatataattcaacaccagtctt

SEQ ID NO: 127437 - DNA, 601 bp, Human
agctatgaagaggcttctagtaaaagccattaaatgaaaggtgcatttacgttaggctgctgtggcccacgctgaagttaataaaggaaggagagtgagaagaaaagtccatctgcaataaaactaggaactactctcacctgaacccacagatgacaaagactacctgccgggcacaatgacctctgccccaggctgaggcgacaactgagaacacagcaggaccttaggccagcacaggggcaggaggctctgaaactgaggtggcaggtacgttcccgtggcccaactgcagacacakaagtccccagcaggcctggcccacgagggcatctccacttccctaaccaggaaggtttcctggaagagaggccagctttgcactgtgggccccaggcaactgggccctgaccctgcatctgggaagcaagggccctactgggagtggcgcagcccccctggagtatctcatcccgccgggtagagcaggcagaggcacagccagccggcagaaggcagggcaggccggagaggagaggacagagccgcccgccccaggaggcaatgctccccaccctccaagccgacctgaggccagggt

SEQ ID NO: 127438 - DNA, 601 bp, Human
cccttgttcctggagtgaaagtgacgggaagcaaagcagcccacagccctagaaaggctgatggtgcaatctactttctatgcgtttgtcttttactctactttctccatctacacgtccaagtaccaacgcttaccctgtatgtccgtaagaggtcagttgaaatctagaccccctcatttccaaacaacaccagaacacgcggcctgacaggaacgggtgtatttgtggagacgatgggacggagtaccaagtctcagatccaccacttcctgtagcagaaaacagcagccagctagcktggacctggaaggcccaaagactgaagcctccgggggcttacaggtgccagcaaaggccaagggaggggggagaggccgcagctccgctccggctgggaggagaccagtcatgccatcctccaaagtttacagcttcgggaaaatcctctctatccaagtgtccccacagagttgtttttttccccaaaaaaagagaactaaacacttgaagggcaaaccaaatgaataattcaaccaatgtgctcccgcggctggacctgacaggaagtctgcatacatttacttaactgcggctctct

SEQ ID NO: 127439 - DNA, 601 bp, Human
tctgtgtttttcaggaaaccagcatataaatataaatggcttcctagacccaagaaacagcctacaaggtagttcatgcacttcagataaagaaacacacattaaaaatcatacagctgagcctaataaatgctcgggtttcccggttcctaggttcctttccatattagtcccttgttcctggagtgaaagtgacgggaagcaaagcagcccacagccctagaaaggctgatggtgcaatctactttctatgcgtttgtcttttactctactttctccatctacacgtccaagtaccaaygcttaccctgtatgtccgtaagaggtcagttgaaatctagaccccctcatttccaaacaacaccagaacacgcggcctgacaggaacgggtgtatttgtggagacgatgggacggagtaccaagtctcagatccaccacttcctgtagcagaaaacagcagccagctagcgtggacctggaaggcccaaagactgaagcctccgggggcttacaggtgccagcaaaggccaagggaggggggagaggccgcagctccgctccggctgggaggagaccagtcatgccatcctccaaagttt

SEQ ID NO: 127440 - DNA, 601 bp, Human
acacagtaacccctcatactcacagagcactctgtgtttttcaggaaaccagcatataaatataaatggcttcctagacccaagaaacagcctacaaggtagttcatgcacttcagataaagaaacacacattaaaaatcatacagctgagcctaataaatgctcgggtttcccggttcctaggttcctttccatattagtcccttgttcctggagtgaaagtgacgggaagcaaagcagcccacagccctagaaaggctgatggtgcaatctactttctatgcgtttgtcttttactctmctttctccatctacacgtccaagtaccaacgcttaccctgtatgtccgtaagaggtcagttgaaatctagaccccctcatttccaaacaacaccagaacacgcggcctgacaggaacgggtgtatttgtggagacgatgggacggagtaccaagtctcagatccaccacttcctgtagcagaaaacagcagccagctagcgtggacctggaaggcccaaagactgaagcctccgggggcttacaggtgccagcaaaggccaagggaggggggagaggccgcagctccgctccggctggga

SEQ ID NO: 127441 - DNA, 601 bp, Human
taaaatcgtgcatttcaaagcaatctcttccttggcacagatcaaaggacacagaacacaagtgagtcaaagctcgttccatctccacccgctgttctccaagggtccactaggactttaaccatgggccgtttataactcatttcttatcccgacctgaagacaaaggttatttacaagactgcgttattttctggacatggtaatcagctctcatgatttaatactttcttgacatcacactccaccgaccctagcgctgactgatatgtcagccattttaaagcattgtaaatgggacttaaataagcaacgttttggaaggtgtgcaaacctaaataaatattgctgagtagggaccattccagccaactctctcgtctgttaaggtaaaaaggactgacaaaaacaatacattcatcctatgcacaaacaacaacaacaacaacaaaaaaaacggccaattggtaggttccaacttcctcccagctctgccttttactgatggtaaccagaacagggccagcctcaaactccagggtcaactcaagtgacaacacagtaacccctcatactcacagagcactctgtgtttttcagg

SEQ ID NO: 127442 - DNA, 601 bp, Human
agaaaataaaatcgtgcatttcaaagcaatctcttccttggcacagatcaaaggacacagaacacaagtgagtcaaagctcgttccatctccacccgctgttctccaagggtccactaggactttaaccatgggccgtttataactcatttcttatcccgacctgaagacaaaggttatttacaagactgcgttattttctggacatggtaatcagctctcatgatttaatactttcttgacatcacactccaccgaccctagcgctgactgatatgtcagccattttaaagcattgtaartgggacttaaataagcaacgttttggaaggtgtgcaaacctaaataaatattgctgagtagggaccattccagccaactctctcgtctgttaaggtaaaaaggactgacaaaaacaatacattcatcctatgcacaaacaacaacaacaacaacaaaaaaaacggccaattggtaggttccaacttcctcccagctctgccttttactgatggtaaccagaacagggccagcctcaaactccagggtcaactcaagtgacaacacagtaacccctcatactcacagagcactctgtgttt

SEQ ID NO: 127443 - DNA, 601 bp, Human
aatatttagttgagaaaataaaatcgtgcatttcaaagcaatctcttccttggcacagatcaaaggacacagaacacaagtgagtcaaagctcgttccatctccacccgctgttctccaagggtccactaggactttaaccatgggccgtttataactcatttcttatcccgacctgaagacaaaggttatttacaagactgcgttattttctggacatggtaatcagctctcatgatttaatactttcttgacatcacactccaccgaccctagcgctgactgatatgtcagccattttaaagcattgtaaatgggacttaaataagcaacgttttggaaggtgtgcaaacctaaataaatattgctgagtagggaccattccagccaactctctcgtctgttaaggtaaaaaggactgacaaaaacaatacattcatcctatgcacaaacaacaacaacaacaacaaaaaaaacggccaattggtaggttccaacttcctcccagctctgccttttactgatggtaaccagaacagggccagcctcaaactccagggtcaactcaagtgacaacacagtaacccctcatactcacagag

SEQ ID NO: 127444 - DNA, 601 bp, Human
ttccactcactactccattactgctgctacaatatttagttgagaaaataaaatcgtgcatttcaaagcaatctcttccttggcacagatcaaaggacacagaacacaagtgagtcaaagctcgttccatctccacccgctgttctccaagggtccactaggactttaaccatgggccgtttataactcatttcttatcccgacctgaagacaaaggttatttacaagactgcgttattttctggacatggtaatcagctctcatgatttaatactttcttgacatcacactccaccgacyctagcgctgactgatatgtcagccattttaaagcattgtaaatgggacttaaataagcaacgttttggaaggtgtgcaaacctaaataaatattgctgagtagggaccattccagccaactctctcgtctgttaaggtaaaaaggactgacaaaaacaatacattcatcctatgcacaaacaacaacaacaacaacaaaaaaaacggccaattggtaggttccaacttcctcccagctctgccttttactgatggtaaccagaacagggccagcctcaaactccagggtcaactcaagtg

SEQ ID NO: 127445 - DNA, 601 bp, Human
ttctttcaagagatatttcttatttttgacttagaagctgccaatgtaataaatgtaccagatgctgtccctacagaattaaatcatgtaatccccatctcttcaaagataaggaaaccagaacacaaaggtgagatgaactgtaggaaagatttgaaccagtttgtctcaacagcctgtgccctcatccatgacactttacccttttaccatgaggaagtgtattttatctgcacatctaaacagcacgcactggtattactgaagcccgggggttagcagggtgtatcacataaattcygggaaatgtggaatagagtgagcaatacttttccactcactactccattactgctgctacaatatttagttgagaaaataaaatcgtgcatttcaaagcaatctcttccttggcacagatcaaaggacacagaacacaagtgagtcaaagctcgttccatctccacccgctgttctccaagggtccactaggactttaaccatgggccgtttataactcatttcttatcccgacctgaagacaaaggttatttacaagactgcgttattttctggacatggtaatcagctctcatgattt

SEQ ID NO: 127446 - DNA, 601 bp, Human
tgggcatctgaaggaactccccaaacctctgtgatttagcaggagacaaaataagggttatctaccccagcacctggacgcatttagattaagtaaatctactgaggctccagaggaaggtcttcaggactcagaccttagttatagactaagagaagttgctcactaatgtctttagctgcacacttacatacaagaatatatagcttagaaggtatataagctctggaaaactttgtaattttgagttggtccggggataatttccaggccttctccctgtaaccggctgcaggaaatraaaacgctcttcctctccagttcatctgcatctcattattgggcccgagaaatagcagcctgaccctcagtttggtctgggaacagcttcaagctgatcaaaatcaggacccaacactttcagctgcatcccgaccaactatgaagggcagtttgttcagatgttcaaaggaaacagtgttttcctaatggcagtattatgaaaacttttgaggttgtgagcaaagagaccatgatgtcagcatcagagccagaaagtgggagggttcaggaaaattataacctaatttacaataaactt

SEQ ID NO: 127447 - DNA, 601 bp, Human
ctaggagtctgaagaagctccccaggcctccacagacaaggttattgggcatctgaaggaactccccaaacctctgtgatttagcaggagacaaaataagggttatctaccccagcacctggacgcatttagattaagtaaatctactgaggctccagaggaaggtcttcaggactcagaccttagttatagactaagagaagttgctcactaatgtctttagctgcacacttacatacaagaatatatagcttagaaggtatataagctctggaaaactttgtaattttgagttggtccrgggataatttccaggccttctccctgtaaccggctgcaggaaataaaaacgctcttcctctccagttcatctgcatctcattattgggcccgagaaatagcagcctgaccctcagtttggtctgggaacagcttcaagctgatcaaaatcaggacccaacactttcagctgcatcccgaccaactatgaagggcagtttgttcagatgttcaaaggaaacagtgttttcctaatggcagtattatgaaaacttttgaggttgtgagcaaagagaccatgatgtcagcatcagagccagaa

SEQ ID NO: 127448 - DNA, 601 bp, Human
tttgccatatttatataacaatattaatgttgcaatggaagtaggagtacatctattggcaccataatctgtcgtccccttcctatattaaaatgattcttgatgatgaaccatccttggatgcctgaaaaaaagaatcaaatcctttatcttcagtgctctcacagcatttgaaaataatgctagattttaaaacatcacaagtcagcaaagcaaagtgcttaagagagtaggctttggagtcaggctggcccagtgttcttctctcgacttgatctctgcaaagctccatttaaaaacaaaaaaaaaaggaaacttacattaccagcacagtaatgacggctgcatcattatttctctcttatgttacctcagaatttactaggtccataatggcaactttttactgctttgtattaaaattacacataggagaaatgggaacattacaaacggctggagggagcaaaatgacgtggccacttcagaaagccatttggcaatttctcaaaaggttaagcataaaactaccatatgtggaaaccagagagtctccaaggggaaacaaaaaacctaccctctaacccagcaactccattcc

SEQ ID NO: 127449 - DNA, 601 bp, Human
aagaggaggtggcgatctttatagtcttcacctgggttcctttctgctgccccctcagtgtagtgcaggggctgagggctcagctcctggagccaggctgcctgaatcgaatccccagctctgatgagggattcgatttaagtgactgacaaagtcacttaaacgccctgtgcctcagctgcctcttctatagatggggataacaagagtacccacaacacagggctgtgggatgaacctgctgaggggctcagggctccgctgcatggcccaaccacttccatgatgccccagctgctcygctcggggtgcagctggaggtcagagtgggcagggcctaccttgtagatgtcacttgtagcttccaccctggttttctgtcacaacagacacctgctttctggtgcccatcaatgtcactaatccacagggatgtcaacaaatcctcatcacttccagaacttccttcccaagaaccatgctaagcttcaggttttagtgaaggaaagggtattctccatcggctaggtcaatcactgctttggtgcttgctttttttttttttttttttttgagatggagtctcgctctgttgaccagg

SEQ ID NO: 127450 - DNA, 601 bp, Human
tagagacggggtctatgttgcccaggatggtctctaactccagggctcaaatgatcctctcaccccgacctcccaaagtgctgggattatagggatgagccaccacacctgcccttctctccatttttaaaagctcatgagctgataaaagccggcctcctagtcccctgcaggagcccagtgctctggggtcccgggagctgccctgacctctcagaacgatcttccaagcatcactcaacagaaccagaaacacataccctgccagccaccacactcctccgcctgtcctccagctgtycggctgccacactcctccgcctgtcctccagccgcccagccacactcctccgcctgtcctccagtcgcccagtgaaagggagggggaagcaggcccttgtgtgcccccgacactggccggagcccgcccctcccggctcatctccttacctcccccaaaccccttgaagcagccgcctccaaagatgagaaggggaggcttggcaagtaagtcactcacccagggagagagccaggatggtggccttcagctccttgagtcctcaagccagcgttcttcagcctacactgtgaccccctc

SEQ ID NO: 127451 - DNA, 601 bp, Human
aggctttggggactaaattgtctctgttgcatattcttcttctatctttttttttttttctcttccaagagaagggatctctccctgtcacccagacaggagtgcagtggcacaatcatggctcattgcagcctcaaactcctgggttcaagtgatcctctcacctcagcctcccaagtagctgagactacagatgtgtgccaccatgcctggctgactgttattttactttttgtagagacggggtctatgttgcccaggatggtctctaactccagggctcaaatgatcctctcacccygacctcccaaagtgctgggattatagggatgagccaccacacctgcccttctctccatttttaaaagctcatgagctgataaaagccggcctcctagtcccctgcaggagcccagtgctctggggtcccgggagctgccctgacctctcagaacgatcttccaagcatcactcaacagaaccagaaacacataccctgccagccaccacactcctccgcctgtcctccagctgtccggctgccacactcctccgcctgtcctccagccgcccagccacactcctccgcctgtcctccagt

SEQ ID NO: 127452 - DNA, 601 bp, Human
gaaaccctgcaagctccaggccaacacacttcagtaggggccagaaaacaaatgccttaggctttggggactaaattgtctctgttgcatattcttcttctatctttttttttttttctcttccaagagaagggatctctccctgtcacccagacaggagtgcagtggcacaatcatggctcattgcagcctcaaactcctgggttcaagtgatcctctcacctcagcctcccaagtagctgagactacagatgtgtgccaccatgcctggctgactgttattttactttttgtagagacrgggtctatgttgcccaggatggtctctaactccagggctcaaatgatcctctcaccccgacctcccaaagtgctgggattatagggatgagccaccacacctgcccttctctccatttttaaaagctcatgagctgataaaagccggcctcctagtcccctgcaggagcccagtgctctggggtcccgggagctgccctgacctctcagaacgatcttccaagcatcactcaacagaaccagaaacacataccctgccagccaccacactcctccgcctgtcctccagctgtccggctgc

SEQ ID NO: 127453 - DNA, 601 bp, Human
cgaaggggaaattcctggaatggaggtgcgaaggtcatagacaaggttgatttgtcacaaataggaacacacgtatcctgcccaccggggggaaaaatgtcactgagtgttcttttctccctaggtggggcagcaagggcaagagggaacgtgagcaatcaagatacaatctgtgagccaaatcctacatctcacagaaaccctgcaagctccaggccaacacacttcagtaggggccagaaaacaaatgccttaggctttggggactaaattgtctctgttgcatattcttcttctatctttttttttttttctcttccaagagaagggatctctccctgtcacccagacaggagtgcagtggcacaatcatggctcattgcagcctcaaactcctgggttcaagtgatcctctcacctcagcctcccaagtagctgagactacagatgtgtgccaccatgcctggctgactgttattttactttttgtagagacggggtctatgttgcccaggatggtctctaactccagggctcaaatgatcctctcaccccgacctcccaaagtgctgggattatagggatgagccaccacacctgc

SEQ ID NO: 127454 - DNA, 601 bp, Human
aatattttgcagacccagtgttctgatgcaccagctagtgccacccagaccggtaatctggctcaaccagttctgggatcccacccaggaaccgaaaacagcaaaaaacccacttcaatctcctatgattccatctccgacccaaccaatcagcattccccacttcctgaacccctacccaccaaattatccttaaaaatcccaatctccaaattttcagagaggctgatttgagtaacaataaaactctggtctcctgtatagccagcactatgtgaattaaactctttgtctattgcarttcccctgtcttgataaatcagctgtttgggcagcaggcaaggagaacccactgggcagtcccaacaaacaggccctgacagcataaccaggagtttcatcaggcaagaatttgataaaaaatatgcaacgggccaggcgtggtggctcacgcctgtaatcccaacattttgagaggctggggcaggcggatcacctgaggtcaggagttcaagaccagcctgaccagcgtgtatttactaaaaatacaaaattagctgggcgtggtggcacgtgtctgtaatcccaactacctgggagg

SEQ ID NO: 127455 - DNA, 601 bp, Human
ctagtctgtgtccatgaacagataatttacttctgtaagtggcactactcagtttatctacctgagctgtattaatgcgttacaaatgcccccaccatctggtttagtaaactcatttctcccatagtatacactttattttatccctacaataatcacatcatctagaggacaagctgaataaatatcctacagtatttgacaaaacagaaaattggcacaaagagaaattaaattctatgaattgcaaagtctaggtctacacaatcaattagttttcaggccgggtgtggtggctcaygcctataatcccagcactttgggaggctgaggtgggtggatcacttgaggccaggagttcaagactaacctagccaacatggtgaaaccccatctctacaaaaaatataaaaattagccaggctaccagctactcaggagactaaagcatgagaatcacttgaacctgggaggtggaggttgcagtgagctgaaattgcaccactgcactccagcctgggtgacagagcgagactatctcagttttcctaaattccttaatatttcctaaatctcctaaagattaaggaatacttaatat

SEQ ID NO: 127456 - DNA, 601 bp, Human
ctgtctggcgctaccacccacagacccatgctggtggctaccattccagctcacccttccatacccgccgtctccctctccccaggccccccaccacgtgtttcatcgttaacagtgttgctacctaccatttctaaagctggaaacctctgcacccccattcctctctcaccccaacatgcaaaccgcgtcatggttcttccgaagcgtctctccatccagccccttccaggtcactgcctggccctccctcccccacagcagcagcctccaactgatccacttcaagacctgcctgtgmcctgctgtcagagttgatcttcctaaaagctcacggtttccttcactgcttaaaacaactggggacgacccactgcccttcacactgaggtcacactcagcttgtgaatctaaaccccaaagctcctttctaatcccctcacttaccctcttgtcatccaacttcttaatactgtctacaagcgccaaaggtcatatacagtatgagtccctttatagaaaattctcaaggtgacaaaatttgactggtggagaatagatccttggttgctgaggctggggtgaggaaaagacaaacaaa

SEQ ID NO: 127457 - DNA, 601 bp, Human
tgagccctggggcttgctcctctgaggaaagggttcagggataaaaagacaatgataaataatagtatctatctctgcattaagggcaactgagagtgaggatccagcacctgtggaggtgtctgacacatcccatgcagggtctgaatagaaggcactcgaatactgatttctctactcacaactttccaattccctaaaatccccccaagaattttaacagcccaacttccccttctgggggacctcggggttaagagccaccacgcccgcccgacctgaaggacaggctttggttggrtaagtcagggttggtcagctggaaagctgagcgggtgagggatggtggctggagtgcggtggagggaggagcattggcagtatgctggggtgaaaggggctttcgaaacaggtccgtctttgctttttctggtttttaaacaatttttgtcctgttttctctcagtcttctttctgtgaacagatgctttgtcctttgtcaagctgtatgtataatttttttcgtggatgcaaaattgttgtctcagtgtcccaatatgactcaggcattttccccctgcagtgcacacagcgtgtagcc

SEQ ID NO: 127458 - DNA, 601 bp, Human
gcagtgggaggtcaggacacatggacaacccccgctccccaacattcccctccaaagtcacctcccctagggcaagaagactaggggatgggggcggggatgggagcagcctgcacacagcaccccctccccaggccctggactcagcactcaaaaatatcaattagatgccttgtccctacagtggagccgggctcgccaccccggtataggcaggaggatcggcttctctatgaccaagggaagcacaagggagtgacttccccttcccgagctcaccgagcctcgagccccacaagcygcctcacactgatgagccctggggcttgctcctctgaggaaagggttcagggataaaaagacaatgataaataatagtatctatctctgcattaagggcaactgagagtgaggatccagcacctgtggaggtgtctgacacatcccatgcagggtctgaatagaaggcactcgaatactgatttctctactcacaactttccaattccctaaaatccccccaagaattttaacagcccaacttccccttctgggggacctcggggttaagagccaccacgcccgcccgacctgaaggaca

SEQ ID NO: 127459 - DNA, 601 bp, Human
ccctcaaccccacagcccgtgcctgaaaggaagcaaagcctaagccagggcaaggcaggagaatcaggacgcccaagggctccgccttttctgaagcagtgggaggtcaggacacatggacaacccccgctccccaacattcccctccaaagtcacctcccctagggcaagaagactaggggatgggggcggggatgggagcagcctgcacacagcaccccctccccaggccctggactcagcactcaaaaatatcaattagatgccttgtccctacagtggagccgggctcgccaccccrgtataggcaggaggatcggcttctctatgaccaagggaagcacaagggagtgacttccccttcccgagctcaccgagcctcgagccccacaagctgcctcacactgatgagccctggggcttgctcctctgaggaaagggttcagggataaaaagacaatgataaataatagtatctatctctgcattaagggcaactgagagtgaggatccagcacctgtggaggtgtctgacacatcccatgcagggtctgaatagaaggcactcgaatactgatttctctactcacaactttccaat

SEQ ID NO: 127460 - DNA, 601 bp, Human
aaagcagggttccctgcgcgggcagccctgccctttggcaattcttgcacgggttcattaccatactgtgtcccccatggccagaagaaaaatcaatgccaaagaggccctctttcaaataagaaccttgagattctgctgccagaatttgctcaccgaggaaagtagatttccttggcaaaaaaggcacaattctgccagccttcttgataatttcctttttagaagggtttgggctgaactaagcaccggctatggcctcagattggaaaggcctggggcccctcaaccccacagcccstgcctgaaaggaagcaaagcctaagccagggcaaggcaggagaatcaggacgcccaagggctccgccttttctgaagcagtgggaggtcaggacacatggacaacccccgctccccaacattcccctccaaagtcacctcccctagggcaagaagactaggggatgggggcggggatgggagcagcctgcacacagcaccccctccccaggccctggactcagcactcaaaaatatcaattagatgccttgtccctacagtggagccgggctcgccaccccggtataggcaggaggatcg

SEQ ID NO: 127461 - DNA, 601 bp, Human
ttactattgtcccaaaagacgtttccaggcgtacggcacctgtacaataaagggtcactgcattgtctcaatctgctcaagcacggcgactttcagaacccctggcctctgtgtcagcagctgtaggccaggctaaaaattacccctggcaagaaggcagccatctgctgaggccggggcaatggggcactcaataaagcagggttccctgcgcgggcagccctgccctttggcaattcttgcacgggttcattaccatactgtgtcccccatggccagaagaaaaatcaatgccaaagargccctctttcaaataagaaccttgagattctgctgccagaatttgctcaccgaggaaagtagatttccttggcaaaaaaggcacaattctgccagccttcttgataatttcctttttagaagggtttgggctgaactaagcaccggctatggcctcagattggaaaggcctggggcccctcaaccccacagcccgtgcctgaaaggaagcaaagcctaagccagggcaaggcaggagaatcaggacgcccaagggctccgccttttctgaagcagtgggaggtcaggacacatggacaac

SEQ ID NO: 127462 - DNA, 601 bp, Human
ttctagacactggagaggccacgtggaagagagcacggcaccggataaacatgcagccaactgctagacctggggcgagacacgcagccttcctcgctgcctctgctgaacccaggccccagacactctccagctggccacagccacacgaatgcacctcagccaggcgggtggaaaaaccacccattcaccccaaggaatggtgagaaatgctaaatcgttattgttttaggttgctaagtgatatagcggtttcttggtttcttatacaacaacagataatagaattcaacagaaaccwctgcgggagaaaagtgtctatggggtgtcaggggtagacagatgttccagattctggaatgttttagtaacctgcctgttttccttttgcctggaccaagacggcttagaaaacagcaattttcactcttttactattgtcccaaaagacgtttccaggcgtacggcacctgtacaataaagggtcactgcattgtctcaatctgctcaagcacggcgactttcagaacccctggcctctgtgtcagcagctgtaggccaggctaaaaattacccctggcaagaaggcagccatctgctg

SEQ ID NO: 127463 - DNA, 601 bp, Human
tcaattgccaccttgaaggaaaggctgtgttaaagactcacgtacatgacagctttcaaagcgctagctcaggccttccttctgaacaggaaccccccagaccagctgcttcccaagcattctctctttctacccagacatctctagctcaacatgtgtgcacggaatttgccacttcccctgctggactgtcctcccacagtagccctctgctctgcgctgtctcctttgctcagctgcaagctgaagagtcaggggctgtgtctcacgcacctctacacccctgtgcccaggtatgatragtggcatgggactgtggtcagtaaacatcccctgagcaataagaaaaccccagactcaccctggctcgaacaggacccaggtcagacacctcaaagcctatcctacacacagacagggggtcctggagggaaggggaaagcccttcctgctgacaagggcgagaggggtgctaacagcctgccttcctgaggtcaggagagccggttagcactgtcattcccgggagcagtgattctcagacctgggtgagcctcacactcccctggaaggcttgttaggccacagagccccatcctac

SEQ ID NO: 127464 - DNA, 601 bp, Human
agacacactgagttccgagcagctgctctccaagagaactgttgaaagccagtcagcccatttctggtttgcaggccttacagtgctacagcgtgtccaccatggcaacaacgcacatatcgccacaatgacacacgagcagatagccacagtgacctcctgcacacaggggcgcagagcccctgccccatgtttgtttgaggctgcacatcaaacaatgcaaaagctcacaaaacccaccaaccatcttagtacaaaatgaaccaaggcttgcgtggtggacatatacccaacgggaaaygcgtcctggggttaccaagagagcaggacaggccagaggccagacactgagtgctcagcccacaccggaaggtcatggccagcgtaatccgaggtctaacgagcggccagggattacaaggactacagttttagccatgatcccccttggctcctaaaacgctacacaaacatccactgtgttaaaaatcaacctatctatccaacttccacttaaagtactgcactaaacatatcaattgggtgattaatcgagaggcatttaatttttttcctgaacaattgctcaattgttttcagt

SEQ ID NO: 127465 - DNA, 601 bp, Human
acatatgatatataccataattttccattttgcaaatgagaaagtggagaagttataaaaaataatgaaaactcactcaaggccacacatcaaagtaaatgacaagattcaagtcctgtgacacctgactccaaaactcactctttccatttcaaaatgctacatttgacctatgacacactgctgtcctttacacaagggataaaaaagggatcactgctcaattttgatttcctttaaatatccattttagttaatcaatggttctcaaaatgtccatcctctgacttacaccttactrtatttctacaaaagcaaaacctacacgctcccttctcacatcagagcagcttacaagttgtaacttagagactttagagggtaaggccaggggaggaagaggcctggcccaaattatccaggtttatcgctgcctcccctggaaaatcatcatttctttcttcatagttctgtattccacaataattatttcagagcgtttttttccccaccaattcttatgatttctaaaaccccattttaaaggttacaacatttttaagttcagtgaaacaggtatattttgaggaacttgaaacac

SEQ ID NO: 127466 - DNA, 601 bp, Human
catctctactaaaaatacaaaaattagccgggcacggtggttggtgagcgactgtaatcccagctactcaggaggctgaggcaggaaaatcgcttgaacccgggaggcggagggggcagtgaactgagatcgccccactacactccagtctgggttacacagcacgactccatctcattaaaaaaaagaaatttaacatcaagatgctggcattcccccacggaagtcacatgtgtagtgctttcgtttttgctgtgtcaagacccaaactgggtgcaccacacagcaacatttgctcttyttgttggcattcttcctccattctttaaccctggtttccttggtttgacctcaatggataccttaactgcaaactaccttcattgcatattcattgcagggtaatttaagagatgaggtatgaataaatgctaccaaggaaggaaaatacgcattaagtacctactacatgtcaagtactttcacatacttaattccatttaatctttgtaacatatgatatataccataattttccattttgcaaatgagaaagtggagaagttataaaaaataatgaaaactcactcaaggccacaca

SEQ ID NO: 127467 - DNA, 601 bp, Human
tctggtaatctcttctttgtcctggcctgctatataaaagtcccttaacacagggtgaaatcctaaggccctctctccaatcacccttaaagaactaagaacagtagctctgaacgctacagggagtgttttaaaatgacagtgaaaaccacatagagcactatttccagctctgtgccaaagacccatttgtcttacaaatccatttaatctgtatcctccttgacattaggaccacactttctaaacctaccaagatgatggaagaatggcctctgactcaggagggtccccttctggrccaaagaatttcatgacactccattacacaagaatgggcagacagaattacaggtctggattcttctcctgctcaattataatagttaattattgttttagaagagcagttcatgatgtatgtagccaaataagacaattgtccttcacatggctttaaaatccgggccaactttccacaatggccacgttcttccaggcattcttgtggcagatactccctaaaggacaatctgcttagtaaaatacagagagcgcactggataaagtatcaacacttttcaacctgcctggaggccat

SEQ ID NO: 127468 - DNA, 601 bp, Human
ctcctcaaaacaaaccccctgaaaaaaaaaaaaaaaagatttgtaagtgctgaagggaatgcacatttgcaaatggtgcacagagaaaaaacaggtcagcatcccgtactacaccatcctgttctcgttacaattatatgtcttcactgcctaattaaaatacaaaaccaaaaaattctctctcccctcctgcacactaccccatatcccctacccaaccccacacacaggcagtttcattttgacttcgtggatggtacctcagtggcagaaaactccaggggtataatggctgggacayggaggattctggttaagtatcctagctggtttaatttcccaaaaagtaaacactgaaactacaacgggtgaagttttttccatggtctgtgatcatcctcaagacctttccaggcctcagatccataaatattgggggggtggggggattcactgttgtattgttccttctcctccctaaattctagcccttgttttcaatctttaggggaaaaaaaatgctacaaagcaattttgtgacttcatcactgctactgtcaaaattaacaccactcaccagatccttagtaacattcagaat

SEQ ID NO: 127469 - DNA, 601 bp, Human
tttactaaaaatctactacatgccagcactttacatacatgatctcatctttatagtaatcatggaagtatatctgcgtttcctcaagaaaatcagcagcccaaacagcgaccagttgagtacctgtactagaatctgagactaaaatcttggctataactaaaagtgaatctcaatatggacactctgatagaatagcaagctcctcaaaacaaaccccctgaaaaaaaaaaaaaaaagatttgtaagtgctgaagggaatgcacatttgcaaatggtgcacagagaaaaaacaggtcascatcccgtactacaccatcctgttctcgttacaattatatgtcttcactgcctaattaaaatacaaaaccaaaaaattctctctcccctcctgcacactaccccatatcccctacccaaccccacacacaggcagtttcattttgacttcgtggatggtacctcagtggcagaaaactccaggggtataatggctgggacatggaggattctggttaagtatcctagctggtttaatttcccaaaaagtaaacactgaaactacaacgggtgaagttttttccatggtctgtgatcatcc

SEQ ID NO: 127470 - DNA, 601 bp, Human
tctattttaagacttgtgaattttgagtctgtttggcgcagataacttaaaatttttttaataagggaaaatcatcatttactaaaaatctactacatgccagcactttacatacatgatctcatctttatagtaatcatggaagtatatctgcgtttcctcaagaaaatcagcagcccaaacagcgaccagttgagtacctgtactagaatctgagactaaaatcttggctataactaaaagtgaatctcaatatggacactctgatagaatagcaagctcctcaaaacaaaccccctgaaaaaaaaaaaaaaaagatttgtaagtgctgaagggaatgcacatttgcaaatggtgcacagagaaaaaacaggtcagcatcccgtactacaccatcctgttctcgttacaattatatgtcttcactgcctaattaaaatacaaaaccaaaaaattctctctcccctcctgcacactaccccatatcccctacccaaccccacacacaggcagtttcattttgacttcgtggatggtacctcagtggcagaaaactccaggggtataatggctgggacatggaggattctggttaagtatc

SEQ ID NO: 127471 - DNA, 601 bp, Human
taggaactgatgaaaacttgtaagtcagggatctgaatccgcaatgagacaacagggcatgtttctttaataatgacactacaacaaaaactactatggcaaggaagaaatttgaaaagcacagcttttaagacctcgcacctgatttgctttggttaaactggcttgatgtttgagaggaataaataatttatcataaaagaaaatgataaaccttatttttagcatgctaacaatctattttaagacttgtgaattttgagtctgtttggcgcagataacttaaaatttttttaataasggaaaatcatcatttactaaaaatctactacatgccagcactttacatacatgatctcatctttatagtaatcatggaagtatatctgcgtttcctcaagaaaatcagcagcccaaacagcgaccagttgagtacctgtactagaatctgagactaaaatcttggctataactaaaagtgaatctcaatatggacactctgatagaatagcaagctcctcaaaacaaaccccctgaaaaaaaaaaaaaaaagatttgtaagtgctgaagggaatgcacatttgcaaatggtgcacagaga

SEQ ID NO: 127472 - DNA, 601 bp, Human
tttttttaaaaagggaaagcaaggtaccagcccctaacttgctttctccttcattaacactactctaatgaacaaggtcaaaatataaagccagataattctgacattggtcattatcagtttgctacaaaacatgcaaaaaacatgggcaggtgaggacctccagtcacacagccccattccggatgtaaataatgtctcagggaatattaacttttgtagaaagagtacaagtgtccaagggagagtcacaaacgtcccattaagactccactcagtgagggaggggctccctctcatytgtggtgtcttctgctcaactgtggaaagcagggtttataaggaacaccagacttaccggggtcactgccaacacttatgtaatcagtccctgctgcgaaccggcttctgcagcccatcggggtccacttgctgccctctcttacctcagaacaaaagtaacccagaaaagcatctctgagttatccgccttcccaggcgctgtgtgagcattcacagcctcgagaacagaggctggccagcccacgcagggtggacacactgccccgagtatggacacgcccttctcatgatgctggca

SEQ ID NO: 127473 - DNA, 601 bp, Human
agacacacagattaaaacagaaaaggatcttacataggtcgatgatgatggtgccatgaactgcaaaatatgaaaaactcaactcttacctgaggtccataaatagaacagagagaaagaaatgcaaccagaaaatgagcagcaattgacttagagcgaaacaggtcattttattggctagaaaggagtccaaagctcaaagaggctactgggaagagccctgctttagcactaaaaatacacatcatgtctaccgagaaacaaaaacaaaacaaaaaccctaaacacacacaaagtaagttttttttttttttttttaaaaagggaaagcaaggtaccagcccctaacttgctttctccttcattaacactactctaatgaacaaggtcaaaatataaagccagataattctgacattggtcattatcagtttgctacaaaacatgcaaaaaacatgggcaggtgaggacctccagtcacacagccccattccggatgtaaataatgtctcagggaatattaacttttgtagaaagagtacaagtgtccaagggagagtcacaaacgtcccattaagactccactcagtgagggaggggc

SEQ ID NO: 127474 - DNA, 601 bp, Human
agatgtgtgattccatctacggtgctccggaaaagccaaaatgctaaggactgatcagtgactgccatgggcgggggatggttcaggaattctttggaacgttggcattgttctggtcccatgtgtggtggtacttataagaatctatacatatgttacaacacataggactatacatccaagagtgagttttacagtaatttttttttttttttttgagacagagtctcgctgtgtcacccaggctggagtgcagtggtgtgatctcagcctcccaggttcaagcgattctcgtgcctcsgcctcccaattagctgtgactacaggtgcgtgccaccatgcctggctaattatttttgtatttttagtagagacagggtttccccatgttggccaggctggtttcgaacttctgacctcaagtgatccaatcgcctcagcctcacaaagtgctgggattacaggcgtgagccactgtgcccagcctacagtacataaatttttaaaaatgttatggggaaaaacaaacccatacatacaccatacacaaaaccatgttttctctattgaagacacacagattaaaacagaaaaggatctt

SEQ ID NO: 127475 - DNA, 601 bp, Human
cagtaaaaaggaacaaacaagtgacacatgcatgaacacggaaggattcctcaggcatgacaataactgaaaaacgccactaacaaaagccactaacaacagatgtgtgattccatctacggtgctccggaaaagccaaaatgctaaggactgatcagtgactgccatgggcgggggatggttcaggaattctttggaacgttggcattgttctggtcccatgtgtggtggtacttataagaatctatacatatgttacaacacataggactatacatccaagagtgagttttacagtaatttttttttttttttttgagacagagtctcgctgtgtcacccaggctggagtgcagtggtgtgatctcagcctcccaggttcaagcgattctcgtgcctcggcctcccaattagctgtgactacaggtgcgtgccaccatgcctggctaattatttttgtatttttagtagagacagggtttccccatgttggccaggctggtttcgaacttctgacctcaagtgatccaatcgcctcagcctcacaaagtgctgggattacaggcgtgagccactgtgcccagcctacagtacataaatt

SEQ ID NO: 127476 - DNA, 601 bp, Human
ttcatagcaacactgttcataatcaccaaattctggaaacacccacatgtccttcgataggtaaacctggttatacacaccctggtgccctacttaacagtaaaaaggaacaaacaagtgacacatgcatgaacacggaaggattcctcaggcatgacaataactgaaaaacgccactaacaaaagccactaacaacagatgtgtgattccatctacggtgctccggaaaagccaaaatgctaaggactgatcagtgactgccatgggcgggggatggttcaggaattctttggaacgttggcattgttctggtcccatgtgtggtggtacttataagaatctatacatatgttacaacacataggactatacatccaagagtgagttttacagtaatttttttttttttttttgagacagagtctcgctgtgtcacccaggctggagtgcagtggtgtgatctcagcctcccaggttcaagcgattctcgtgcctcggcctcccaattagctgtgactacaggtgcgtgccaccatgcctggctaattatttttgtatttttagtagagacagggtttccccatgttggccaggctggtt

SEQ ID NO: 127477 - DNA, 601 bp, Human
cttatataatgtatactgccagttgtgcacactctctctgtcgctctctctctctgcctgactcttcattcttgccttgtgtaacccaggacagaggactgcctcctgcccaggatatgtaagtaataagtctttgaacttggatttgaccacgacatattatatgtaatatcaaaatatcacatgtacctcagatatctgtacaatcattatgtagccatttttcaaaagcatcttctaaaatatatgtttgaacttgcttcctgttgtgatggtgtacggactctgtaccctccatccraagaaccaaccacattaccccaggacgtgtgggagcaaacaaggttggactcccagcaccagaatgatggccaggtagtcagacaagacccacaggggtgtccgtcagtataaacaagtttcccgagtcggggctcagaccattatgcgtgagcccatccaccaggtaaaagaagcatcctgtgaaaggcacacggtcatcacccacatccagctgcctttcagttccccttagggaagggtcgctagctactctgatactggaacccaattcagatgggggctcccaaaacacatttga

SEQ ID NO: 127478 - DNA, 601 bp, Human
cccaaaaggcccagctcgctggccaagataagaacttagaggcatctcctacacccagcagactgagctccccatgttccatctgcttcctttaaacagaacactcaggcctgcccgagaacttacagagccccacgccctgttccctcttatataatgtatactgccagttgtgcacactctctctgtcgctctctctctctgcctgactcttcattcttgccttgtgtaacccaggacagaggactgcctcctgcccaggatatgtaagtaataagtctttgaacttggatttgaccaygacatattatatgtaatatcaaaatatcacatgtacctcagatatctgtacaatcattatgtagccatttttcaaaagcatcttctaaaatatatgtttgaacttgcttcctgttgtgatggtgtacggactctgtaccctccatccgaagaaccaaccacattaccccaggacgtgtgggagcaaacaaggttggactcccagcaccagaatgatggccaggtagtcagacaagacccacaggggtgtccgtcagtataaacaagtttcccgagtcggggctcagaccattatgcgtga

SEQ ID NO: 127479 - DNA, 601 bp, Human
cacgtagcctgcaatgacggtcccagctacccagaattcttcctgctccccaccgcttcttgctacttcaaatactaaaatatgaaaggctaattataaagctaatagaagaaaaaaaataaatatatttgtaacctatgagaagctgatgtatttcgtatacaggatcccaaaagcagaaatcatataaggtgaaaaactgatggattaactacattaaaatcaaggatttttttccccaacagaggacgcttcaaagttaaaactagtgtgataaagtcagagaacacacctgtggtaycaaaaaccaacactaagagacaagaaacatagtaggaaatttcacagaagaatgtatgttaataaacagcaagagtatttgcctacaagtaaaccactagcctttcagggtcagcagaaaagaatgccaatttaaatgcaacttacaccacaagccccactggagagcagaaatgctacttagaatttctgttgggacagaagatgagatctttcttggtaaacttattgctattgtccgggaaagtgagggtgggaggaacagggggtattttaaaggggccaggggcatgtctgtgta

SEQ ID NO: 127480 - DNA, 601 bp, Human
gtcaggaaggcgggagacaaacagaaatgtgatggtaaaggcagcctcccctctaactaggtcttgtctctagcttcttttatgacacttcccaaaagcccattgcagatctcttcccccaaccctaaaacctctattccaccaagtcaagctcaagtggtgttatcccataaacccacatggcccaaaatgcaacagggaaagtaccaaaggagaattcaaacaccaatgcataacaagtgtttgacattacaataaactcaaaaatataaagaaacacgtagcctgcaatgacggtccsagctacccagaattcttcctgctccccaccgcttcttgctacttcaaatactaaaatatgaaaggctaattataaagctaatagaagaaaaaaaataaatatatttgtaacctatgagaagctgatgtatttcgtatacaggatcccaaaagcagaaatcatataaggtgaaaaactgatggattaactacattaaaatcaaggatttttttccccaacagaggacgcttcaaagttaaaactagtgtgataaagtcagagaacacacctgtggtatcaaaaaccaacactaagagacaa

SEQ ID NO: 127481 - DNA, 601 bp, Human
cagagcccaaaattagactaccacactccctggcttcattcccagccaggacgggatatcctgaggcaggtctccaggtctccagatctccagagcacagagtcaggaaggcgggagacaaacagaaatgtgatggtaaaggcagcctcccctctaactaggtcttgtctctagcttcttttatgacacttcccaaaagcccattgcagatctcttcccccaaccctaaaacctctattccaccaagtcaagctcaagtggtgttatcccataaacccacatggcccaaaatgcaacaggsaaagtaccaaaggagaattcaaacaccaatgcataacaagtgtttgacattacaataaactcaaaaatataaagaaacacgtagcctgcaatgacggtcccagctacccagaattcttcctgctccccaccgcttcttgctacttcaaatactaaaatatgaaaggctaattataaagctaatagaagaaaaaaaataaatatatttgtaacctatgagaagctgatgtatttcgtatacaggatcccaaaagcagaaatcatataaggtgaaaaactgatggattaactacattaaaat

SEQ ID NO: 127482 - DNA, 601 bp, Human
taaaaccacggacacgtgttaggcaagaatttctcctgctgaactacccaataaatacggtggccgtgagtaagaattcaatgctaggacaaatacagtcttttgaagatgtgacctaatactctcagattccaggcaagtgtgaaacggtgaccctgggccaggagcccgcaggcccgtcttgctaatttgctcaggctttcaggggaacctcactggacacatgcaaagggcgtgctgacctgtgagcagaggcctgagtgcaaaggacggtgctggccgacactaggcctctgtaaaygtgcagctgggcgggagagccagcgaggatgcctccagcaaggcagtgccactgtgtctgctccacccgattctccctcctcaactttgtaaaatggctgaactattgaataaatatctgaaataccctctgtagaaggagaacacaccactggagagagggaatccggtaagaaaatgggggagaagtacttaagaggacaaccgtcaggtgcagggaagctaacggtagaccaggaatgaggaaactctggccctaaatcccagctcaacagccaaagggctgcaaaagctttgaaag

SEQ ID NO: 127483 - DNA, 601 bp, Human
aaaaccaaaacgaggctcctggcagcagctgatgcgagcacaggaggggaggacaaggactgccctgccgagctcacagggcaatgtctcccgtagccgaagcagctcctccgttatcaatcacacagtgcaatttcccactcaaacacaaaggacagacttgtggaccctggctaagcttccggatctatgtcaaagtggggcacagctaccggcaccaattcaaattcaatcatttaatacatatgagtacagaggtgagcatcggcgaagcactaaaaatgcactaaaaccacggacrcgtgttaggcaagaatttctcctgctgaactacccaataaatacggtggccgtgagtaagaattcaatgctaggacaaatacagtcttttgaagatgtgacctaatactctcagattccaggcaagtgtgaaacggtgaccctgggccaggagcccgcaggcccgtcttgctaatttgctcaggctttcaggggaacctcactggacacatgcaaagggcgtgctgacctgtgagcagaggcctgagtgcaaaggacggtgctggccgacactaggcctctgtaaatgtgcagctgggcg

SEQ ID NO: 127484 - DNA, 601 bp, Human
agaacaaatggaatcaccgcccagattcataggcaaccgtgaacatccacaggtgaggaacacagcagtgctaacgaaggaaggtgcaggaccacaaaaccaaaacgaggctcctggcagcagctgatgcgagcacaggaggggaggacaaggactgccctgccgagctcacagggcaatgtctcccgtagccgaagcagctcctccgttatcaatcacacagtgcaatttcccactcaaacacaaaggacagacttgtggaccctggctaagcttccggatctatgtcaaagtggggcayagctaccggcaccaattcaaattcaatcatttaatacatatgagtacagaggtgagcatcggcgaagcactaaaaatgcactaaaaccacggacacgtgttaggcaagaatttctcctgctgaactacccaataaatacggtggccgtgagtaagaattcaatgctaggacaaatacagtcttttgaagatgtgacctaatactctcagattccaggcaagtgtgaaacggtgaccctgggccaggagcccgcaggcccgtcttgctaatttgctcaggctttcaggggaacctcactgg

SEQ ID NO: 127485 - DNA, 601 bp, Human
gactcaggtcgtggtgaccaccacagtggttaacagcaatcccgctgacagtttctcctttaatgcaagaagggaaatagactctttcaacttgtccccaaatgacaacagtggttcatggtgagaatgaagcctactgtgtggtgaggggcagacacaaagctgtggagtcgtcggtgactatctacacagcactatctcaggggaactccctgtcctcaaccaggaggaagctgctagagcttgctttctctccattcatttctaagcccaggagaggaagggctatttttcacctgargtcgctgatccctacccttggctggaagcagagaaacaacagcctccagtactccatccacatgtgcacaaggtgtggatggaggcaggttcgggctgatgaggaaggtgcacgtctgtctgggcgacgctgacagagcagcttacctccgtgggagtctgtcgatgtcagggtcatgtgcccactgtccactgggctgccatccctttgaggagagggagacactgatgggaaccaaaggatcttctaaaggcaagttcttaccgcaagctggccccaaggtccctgtaatcaaagaaa

SEQ ID NO: 127486 - DNA, 601 bp, Human
acattcagtagactgttacccaacacttatatgcactcaaagatggctgcagaaagtcagagactaagaatgtgcctgccgctcagtcaccagccatgccaacagaccagttttaatttcccaaatagaagatgagggcagaaacctgattaaaacaaacaaaaagtaataccaaacttggtacattactaaaccaagagctgaagctagaattcatttggtgaccttgagtttatgacctcctggcagcaagtgaaagttcattgtttatatggctgcctcacattaaagtggctgctgmtcattcacacagtctccaaaagaaagggcaagggcaaggactgcggacagcttcacgttccccttggaaagtcagcacgccagtgggagacgtggaaaggagaagcacatgtaagaaccaggaatgacctttctaatacagccacactaggcagagccttacaagggcactgcttccaagtgtgactgtgagcttaaaatatccttagaagtcataaagataatcttaaagggtagaaataagagacagaaaaaaggttaacattgaagatttttccttttttaaaactgcactaactgt

SEQ ID NO: 127487 - DNA, 601 bp, Human
tataagaggtacttgggtcataaggacggagccctcatgaatgtattaatgtggtgacttcaggaacaggtttgttatcgtgagagtgggtcgttatacagcaagtcctgtccctggtgcctttctccttcgcacgagcttgcttgctcttcccaccacgtcatgacacagcaagaaagccctcgccagatgccagtaccatgttcttggccttttcagcctccagaactgtgaaaaatacatttccttataaatcacccagtctatggtaactacccagtctttctgttataacaacagraagctaagacacaaaatatgctactagagggagaagacagcactgggaatcctaatttctttggatatgtgaaattccatttacaattttaaaaaggaaacacctgagaggactactacctgtgaggaaagacaattcagattttcaggtaattaagggctcacacatcccataatgaatatattagaaatactttccatgtgtttttttttttttttttcagtatggtacaactgaccaccaaccagttaaatgtgctctaggggctccaggcataaactcaactgccaaacaaataca

SEQ ID NO: 127488 - DNA, 601 bp, Human
tctgtctccagattttctgtctccaagaaaccattcatgattccatcctcaacggttcctttgaaaacagcttcaggcaggcacggtggctcatgcctataatcagcactttgggaggctgaagcgggtggatcacttgaggtcaggcgcttgagaccagcctggccaacatggcgaatccctgtctttactaaaaatacaaaaattagccagcatagtggtgcaatcccagctactcgggaggctggggcagcagaatcacttgaacccaggaggcggacgttgcagggagccgagattktaccactgcactccaacctgggcaacaaagcaagactctatctcaaaaaaaaaaaccagcttcaagtaagggcctaatgttctccacacattcacacttgcaaggcatgaacacatttcccagacgcacggcagagggaatcccgcaccttgggaatttaaatcaggtcagtcgggtggggatgcggcacctgcattttcacaccctcctggtgtgttcccacttggagtgattgcgtatggaaagaagcaccctctcatcaatcccttggaaaaggtaacttctgactaattcactgag

SEQ ID NO: 127489 - DNA, 601 bp, Human
gaaccaccaccaacgcctcggtgaagatgaccctgtggcagcacataaaacccaggcaacaggatggcgggctccaagaaacagcctcccagctccgtctagcacccagcaaaccaggtccgatgtcagcaacaaccacgacaacttgttactaccagacaagattcaagaaaggggcctggttcccgcagcccactttccttattttgaagcaggtgtctttacttactcaaatgcctggaagtcatgctgtcctacaagaactgctgaaggagaattgatttgcctccctggaaataartctccttttattacttacctgcagtcctttattccataatctaattaacatttgtgatctcttgtatcatgccacattgtagaaatttactcaggaatatagaagttttagaaaagaaagcatatggcataattattttattgaaatatatcagatgtgtttagataccccagacaagaggtttaaatttgcagaatgtgcatattgagacaaaaagaactaaaaatgccattaatacttattttaaattataggtaacattagccagaaaacagagctgaatttctttttggagaagta

SEQ ID NO: 127490 - DNA, 601 bp, Human
tttatgtcacagaccatctcttttggaaagggttgcgtgtgtgcgtgtgctcgcgtccaatatgtacagagatgttcctcttttccataaacacaaacttgacacattaaatctgctaatgggaagtttctgtgcttaaattctagcagatactaagaggaataaaaacattctgcttaaacttaaggatgcttacaaagcaatcagggaaatacaactacaaataacctaaatctgagggaaaagaaaagaaacaacaaagagaagcaggaaaaagtaccctgggaggcaagagagagattttttctttcctccccatccatcttcattaaagagcaaacatcacagtaaatgatcatcaactgccaagtcagataagttccatgccatcatcttgctatgaagctagtaacacgtgttctttctgcaaaagtggagtatttctaataattacaatattgttctgctagatgacaatcttaatgtcaatatgtaacatgttacaaatatcaatgaaaaccaaaaaaagtgattttttatgacttagcattaattctttcaagacccagccgaaagagaccaaacaagaccaagtcagaaa

SEQ ID NO: 127491 - DNA, 601 bp, Human
ctatacaatccagccaaagatttatttcaaggaaacccacagcattacaaacattcattactaagccaaaaaaaaaaaaaaaatactaagtgttcaatccaaaagtctaagaaggaaagcaaagaatagaataaagatacatgcataaataatcaaaaatattgggatgagaaatgaatccaatcatttttaaaatagataacttccagttactataaccaaggaaaaaatagatcacatatccatttgcaatagagcaataaaaggacaggaaaaaatttttaatgcaaataaaacacayggcaaaattttacaatagtaaatttgaacatacagaattagacaatttcaataatttattaataaaatttactcaagaaagaataaaaactataggcagaaaagggtgggtgaagaaatagatcaattcacctcctttaaagtgcgtgcgcgtgtgtgtgtgtgtgtgtgtgtgtgtgtgtgtgtgtgtaaacaaatcaacagatcgcaagaggctcaaatggttttgcccttgaataattccaaaacgtgaaggaactggtaattttagcaactccttcagggcacagtattttttaag

SEQ ID NO: 127492 - DNA, 601 bp, Human
cagctgcttcctttgctggctcctgtgtgcacagatataaacctttttctctcattaatatgtcacttatcagtttaatctgcaggccccaaatgctgaacctaacctagagaaaaagagtttttccttcctgacaagtgaactattgccaaatttttaactcaaagggcatgttgatcatatgcaagccaccctaggtaaataaagtccagccctatcacttattatctttagttaataagaggaccctatattcaccggaaaacattacatcctgtgggtcactcttcccatgtactaycctagttccaaactgcattttgaactcttacattatctcagcaacacaattaaaggggtgggggcaggacatacaatactaagttggactaacgtccagggtcaaagcttccacgtgatgaatgtggagtaaaggcgccggccttccattctcccaggtgatcattattagaaaagaaccagccagcagtgacagcttccagtgttggagaaaacccggattggacaatgtggaaggaaggcctcatcctcccttgtgttcgcaaacaaaaacgtccaacttaggcacacagcagctcaa

SEQ ID NO: 127493 - DNA, 601 bp, Human
gaacccggaatcattgaccggaaccagggcccccacattaacaactctcacaggagcttggcagaggtcacacgaacccaccaaggttaaaaaaaaagacaaacgagaaagggcagatgctacacagctaacagtgaagattttaaaacaggaattcgaaactgcaactctgctctgcacctgaaatgcccttggcagcctccacatttcaccagctgtaaccaaaggccaagaccgagaggtataaacaatgcagcgggctttattaaaatcacacggggtcacagacttccttaagagygtgagtttttgtaaaaggtacctttccgcgcagatgacgcatgtggcctcaaagccttaaggcctggtttgcatccaggctcaggccagctctgatggcaactacaacaaggcctcgcctatgagcctccacttcccattgcccccgggactaatgtgcatgctcctcagaggggcttcgatgatgatgaagtgaggccgtgtacacagcaagactcatcaacttgaaccactattactgtgttaactccacagtgtcctctgtctgaactgcaggcttgcgaacccggaagaaatccaa

SEQ ID NO: 127494 - DNA, 601 bp, Human
tactatcaataaccatagcacttccaggcaaacttgccccaaagtatttggaagtgcctcctaagaacccggaatcattgaccggaaccagggcccccacattaacaactctcacaggagcttggcagaggtcacacgaacccaccaaggttaaaaaaaaagacaaacgagaaagggcagatgctacacagctaacagtgaagattttaaaacaggaattcgaaactgcaactctgctctgcacctgaaatgcccttggcagcctccacatttcaccagctgtaaccaaaggccaagaccragaggtataaacaatgcagcgggctttattaaaatcacacggggtcacagacttccttaagagtgtgagtttttgtaaaaggtacctttccgcgcagatgacgcatgtggcctcaaagccttaaggcctggtttgcatccaggctcaggccagctctgatggcaactacaacaaggcctcgcctatgagcctccacttcccattgcccccgggactaatgtgcatgctcctcagaggggcttcgatgatgatgaagtgaggccgtgtacacagcaagactcatcaacttgaaccactatt

SEQ ID NO: 127495 - DNA, 601 bp, Human
ggaggaagcggaagaggagcagggacaggaacacatggactcggggaggggaacatcacacactggggcctgtcggagggtggtgggctaggggagggacagcattaggagaaatacccaatgtagatgacggtttgatgggtgcggcaaaccaccatggcacatctatacctatgtaataaacctgcacgttctgcacatgtaccccagaacttaaaagtattaaaaaaaaaaaaaagaaagaaaaaggggacagagtgaaggccgggtctcagtcttctggtgcccatacatgtgggcygcactcgcgccacacccctgcagcactgcactgggaaggtaggacaacagacagtcaacatgggcgccagaagagggccctgaaatgtgcctccaatgagatcccaaagaatcgtttctaccactaccaatcctaaggaagaaaccttcaaaggtgaacacacggataagcttgggaaagcaagagacaagctttgggggctgcaggcaaggctctccttcacagccacaccagggatcctccaccccagcactgacttttggagctgctcagctctgctgcaggcctcccccatgcact

SEQ ID NO: 127496 - DNA, 601 bp, Human
cgctgaaggtcggcccgggggaccggatggagcccgctagacacaggcagcagctgcaccaccgcctggcacttctggggctctcttcctgtgctctatgcaccagccattaatggaggaggaccctaacacccaacgccagccactaagacagcagctttcccctccttcccacagaaatgggaggaagcggaagaggagcagggacaggaacacatggactcggggaggggaacatcacacactggggcctgtcggagggtggtgggctaggggagggacagcattaggagaaataccyaatgtagatgacggtttgatgggtgcggcaaaccaccatggcacatctatacctatgtaataaacctgcacgttctgcacatgtaccccagaacttaaaagtattaaaaaaaaaaaaaagaaagaaaaaggggacagagtgaaggccgggtctcagtcttctggtgcccatacatgtgggccgcactcgcgccacacccctgcagcactgcactgggaaggtaggacaacagacagtcaacatgggcgccagaagagggccctgaaatgtgcctccaatgagatcccaaagaatcgtttc

SEQ ID NO: 127497 - DNA, 601 bp, Human
caccagcaccaacaaccagggggtgggatattgcatcaggaaaagctccactctgggtggaacctgcttttcaacctcattgggtgtgtcaccgcccagtgggttcaccttgcccgctgcctagacagagccgactcatcaagacaggggaactgcagttgagaaagagtaattcacgcagagccagctgtgcaggagaccagagttttattattactgaaatcagtctctccgagcattcggggagaatttttaaggataagctggtggggtaggggaagccagtgagccagaagtgctrattggtaagagatgaaatcacggggaatcaaagctgtcttcttgtgctcagtcagttcctgggtgggggccacaagatcagatgaaccagtttattgatctgagtggggccagctgatccatcaagtgcagggcctgcaaaatatctcaggcactgatcttaggagcagtttagagaggctcagaatcttgtagccccaagctgcctgactcctaagccataatttctaatcttgtggctaatgttagtcctacaaaagcaatctagtccccaggcaagaaggaggtctgctttggcaaa

SEQ ID NO: 127498 - DNA, 601 bp, Human
gtggaggggccgcctagcgtggcctccgactcacttgcctgtttggcagaagggcagccaattctagcacctcccaaagctgccacagtctcccctcagggagctttccagaaaagcaggtctgtcctaacatgcatgtctgtgtcctctcaaggccccggctctcacagtccccagctctgcgcctgccttccctgtggtctctcttcaagctactcagccctcatgacttgcagagttctctttttaaaaccacaaatcccaaagtgctactccctggaaaacaagcccgcaaacctgyccgccctccttggggagccaggcagtgcagggcacggggcagcctgggcagggtctggatcccgactcccacttcacgacctaggggcccgggcagctgtctcctgagcttctgcacgaggccttggccaagagcctggccacggcgagcagccaagaacccatggctggcacgggacgccaccgccagagtttgggttcacagtgggttcacggggttcagacgtcagcctgctccgctgctgactcaggactcggtggtggcttttgcacacatggaggaaaaaaaaagaagaaacct

SEQ ID NO: 127499 - DNA, 601 bp, Human
caccaagatattccattattatccataattttgtatcctataaaacaaaaaaaagaagagaatcattttcaaaatgaatccaggaaaattttttttaataatcaaagggtatttttcacaattatattggaactagaaagttttacaaacatgtaccagcacgggaagtgtgtcaaagtgagagctgtgcagggacctccagagtgcagggacacccccatcatgctctgggagggagctgtggggtgtgctcgggggcccgcacctgactccccagggctccagggcatgcgttccaccsactgccccaggatctcagaaagcagactgggtgtttccatttttaggccacttcactgggggatcctcaggcacagtgagagctgagaacttgcagccacttgaggcagtggtgtcacacacatcgggagagcagtgccaaggcaagaccctctcctcttcctccctcctgcagcactgagcctcccctgcgccccccaccccctaccgtgtgtctccaggtccctgtgagtggaggggccgcctagcgtggcctccgactcacttgcctgtttggcagaagggcagccaattctagcac

SEQ ID NO: 127500 - DNA, 601 bp, Human
aaaaaaaaaaggtaaaccaataatttttagtgatatataagaagcaaaaaaacacgtaaggaatagtttggttccttttttaatgcaacttgaaagaaagaaaaagaaatggatacatgcaatggattctttaaaacccaggtttcctgagaaaaagctttgatacgtattctgcatccaacataatacttactagatctagtgcggagcctccaccaagatattccattattatccataattttgtatcctataaaacaaaaaaaagaagagaatcattttcaaaatgaatccaggaaawttttttttaataatcaaagggtatttttcacaattatattggaactagaaagttttacaaacatgtaccagcacgggaagtgtgtcaaagtgagagctgtgcagggacctccagagtgcagggacacccccatcatgctctgggagggagctgtggggtgtgctcgggggcccgcacctgactccccagggctccagggcatgcgttccaccgactgccccaggatctcagaaagcagactgggtgtttccatttttaggccacttcactgggggatcctcaggcacagtgagagctgag

SEQ ID NO: 127501 - DNA, 601 bp, Human; identical to SEQ ID NO: 27881

SEQ ID NO: 127502 - DNA, 601 bp, Human; identical to SEQ ID NO: 27882

SEQ ID NO: 127503 - DNA, 601 bp, Human; identical to SEQ ID NO: 27883

SEQ ID NO: 127504 - DNA, 601 bp, Human; identical to SEQ ID NO: 27884

SEQ ID NO: 127505 - DNA, 601 bp, Human; identical to SEQ ID NO: 27885

SEQ ID NO: 127506 - DNA, 601 bp, Human; identical to SEQ ID NO: 27886

SEQ ID NO: 127507 - DNA, 601 bp, Human; identical to SEQ ID NO: 27887

SEQ ID NO: 127508 - DNA, 601 bp, Human; identical to SEQ ID NO: 27888

SEQ ID NO: 127509 - DNA, 601 bp, Human; identical to SEQ ID NO: 27889

SEQ ID NO: 127510 - DNA, 601 bp, Human; identical to SEQ ID NO: 27890

SEQ ID NO: 127511 - DNA, 601 bp, Human; identical to SEQ ID NO: 27891

SEQ ID NO: 127512 - DNA, 601 bp, Human
gcctccacccctcaccaccatggccttcagttcctcccacccccctccaaacccgctccatcctgtgtccccgctgccaccaaacaaacatagcctgagttaaaaacctcgatcatggtgggctggatcagcacagggtattaaatgatacagcaggagacagaggagaaaactgttcataaccaaggttgaagaattacctttatgacctacctcaaggtaccagcttcgttccaacttagaaaagctaccaggctaaagaacaaaaggcgggagccctccaggcctcgtgaggcacggygccgccctcaccctcccctcaccttcgagtcataggccgactgtttgatgacctcgggtgccatccagaatggggtgcccacgaaggtgttccttttgatctgggtgtctgtcagctggccagccacgccaaagtccgccagcttcacctcgccatgctcagacagcaggacgttggccgctgcaaaagaaagccaaggcggccctgggcggtgcggacttacaactccgtgcactgccacaagcgcgtcttctccctggctgggtggcgaacccaccgagcacaggcaccggggctaca

SEQ ID NO: 127513 - DNA, 364 bp, Human
ctctgcaccgcacacgcctccacccctcaccaccatggccttcagttcctcccacccccctccraacccgctccatcctgtgtccccgctgccaccaaacaaacatagcctgagttaaaaacctcgatcatggtgggctggatcagcacagggtattaaatgatacagcaggagacagaggagaaaactgttcataaccaaggttgaagaattacctttatgacctacctcaaggtaccagcttcgttccaacttagaaaagctaccaggctaaagaacaaaaggcgggagccctccaggcctcgtgaggcacggcgccgccctcaccctcccctcaccttcgagtcataggccgactgtttga

SEQ ID NO: 127514 - DNA, 601 bp, Human
ggaactctgaagggaggacttgcccttcaaggaaggtgggtgcggatggctcaggcagacaggacagctctcgaataaaggttctcatgtgagcagtgatggtgcaaccaagagcggaagatcttcacatggccctgtctccttttttccacggcactttgcatgatctgaaactgcttatttattgtttcttctacttcaggagaggagggagtgtgctgtcgtgatcacagttgtattcacagtgcagttgctcagtacaaatttgtgaatgaatggcaccagcttgattttcttcctytgaaggcacttaattttttaataagtttgtaatacaacttttttcctctggaaaaggttctgacatatgtaatcatctctattcattcattttgcttggtaccaggcaacctctttgacttatgggttcacatcattcttgaccttgggtaagttttaaatctttaaacattcttctatttattctggagttttctttcaaaacaccaattaaagctgtgcactgatgctttcaaaactcttttaaacctctctcagcttgcatctcaactagaacgccatcctgccagggcccaaccct

SEQ ID NO: 127515 - DNA, 601 bp, Human
ctcccaacccacccttcctttgacaatctgcgtgtgaacctaggtgtgacttgggcacgtgccttcataactaccatacagaaccctgtccccaatagctggaaggtctttccttacctgcagtgcacagactaggaggggaaatgtctacaagtcatgcaagagagaatggagggaaagctgggaagcagctgagtgagccatgagaccagagcggcctccagtgtaccctgaagagcactggctgcctggcaggcaagccagccactggagggacacacacagggcagccaggaagagygcccttatcaggccctgcttgcgacaagagctgccagtccagagccacgcccagtgggaaacaaaggaaatctcagccctaaggccccagcgtgaaaccccacttctgagaactttgagacgcagacacagacgtgaccctcatcggccctcaccacacgcctcccgggtccacaaacctggaaagtcaatttcacatcaacataagagtttgctcatgatttccagttcagagttggaactggaactctgaagggaggacttgcccttcaaggaaggtgggtgcggatggctcaggcag

SEQ ID NO: 127516 - DNA, 601 bp, Human
catcttccaaagcaattaaaatgaggtggaaggagagacccatttgggaaagatatgaaattagacattaagacactgctcacagagaaaacaaacagtggtttctaatataagctccagtcaaaagctgcaaatgcacacattaactgcgaacgaatcttctcctggggcatgctcctgagtgaccaccctgagttctctgttactgatggttctggactctcctcaacattgggagatgtggggatctatgcaacagcatcctacatcttcacaatatcatgtcaaataaagtacgctrgctacacatctgaagatacaatttaagtgattttaattatatagagaaaataattctagaagaaaccaactctataatcaagaagaaaaccagggataaccctaaatcacagctgtaatcaatcaaaacaaaatctcatttgatataagcttattacttaagcagatgcgatcattaggaacacacttgtaactggcatctagaggcgtatgtgatgtttatgaccattaagagcaacacaaggttgaccaaagtggcccaacattactcatgcaaaaataaagcctgctgtctcctggt

SEQ ID NO: 127517 - DNA, 601 bp, Human
ctgggatccccctcacctcaaacacggctcattcctttgtgctgggatattccaaatcttctcttctggctatttgaaacacaacaaattattaactacggtcaccctattgtgctactgaacatgatctctgacggatgcacctccagacctccaagcacctctcaaccagctaaacacactcggtgactggcaggcaggccctggcagaagccgatctctgctgagagtacgtcggtgatgcgcttgccttgattttactcagaggcccgaggacttgctttcaggttcagggacagayaataagcaggcggccgaacgcctgcttgcgaacgcctgcttctgcacgcagtgtgcaccacgggaagttcactgagaaaacccctgctggccccatctgaacgcaacccacgtatcagtctcctggcttccaaggagggcagccagtacagcaccatcaagaacaaacatgggggccaggcgcggtggctcacgcctgtaatcccaccactttgggaggccgacgcaggcagatcacttgaagccaggagttcgagaccagcccggccaacatggcgaaaccccatctctactaaaaata

SEQ ID NO: 127518 - DNA, 601 bp, Human
agagaacacgcctgagtctggtacagctttcctgctgttctcactgtgcactggaatccatcattattccaagaacttcagtgagaattgaatacatctctcacactcactctacagcaaggaaatgcataggcggaagcatcgttgtggctgcagggtgctttaactatccagaggatacacttaccatgttcctgcagccttagtgagtaccagaaatccctactggaagcccccaagcccagcagtccatgggaatgatgcctacggcatattctatttccttattctcagtgaagaygaaaagctgccagcaagtcttgttctaaattctttctactaaatcttgtactgaaggggtcagtctagaagagctgacgttggaagtaatactattttccttccctctacaacttggactctgctttatcttgcattgcattatcttaaaaatcagcagaaatgcaactgatcccagtctcttgcccctaggagcagggaagcaggtgcatgggagcacagggtgggcaagcacccagaactgtggcagcgacaggaggacaggagtgagcaggcacaaggagggaggaccgaggagggg

SEQ ID NO: 127519 - DNA, 601 bp, Human
tgggctggcgaaagacgaatggggactggggtagagaacacgcctgagtctggtacagctttcctgctgttctcactgtgcactggaatccatcattattccaagaacttcagtgagaattgaatacatctctcacactcactctacagcaaggaaatgcataggcggaagcatcgttgtggctgcagggtgctttaactatccagaggatacacttaccatgttcctgcagccttagtgagtaccagaaatccctactggaagcccccaagcccagcagtccatgggaatgatgcctacrgcatattctatttccttattctcagtgaagatgaaaagctgccagcaagtcttgttctaaattctttctactaaatcttgtactgaaggggtcagtctagaagagctgacgttggaagtaatactattttccttccctctacaacttggactctgctttatcttgcattgcattatcttaaaaatcagcagaaatgcaactgatcccagtctcttgcccctaggagcagggaagcaggtgcatgggagcacagggtgggcaagcacccagaactgtggcagcgacaggaggacaggagtg

SEQ ID NO: 127520 - DNA, 601 bp, Human
acaggcctgtggcacaaccaagcagttaggcaaaggaatgaattccttgaatgtgtcatgtcaatgagaagagccaggccatcctaagaggaacttgacagctgatgagacattgacagcatgtgacaccaatccccaaacaggacagaggccgacaatgaggcaggacatagtcctatatgggctggcgaaagacgaatggggactggggtagagaacacgcctgagtctggtacagctttcctgctgttctcactgtgcactggaatccatcattattccaagaacttcagtgagaatygaatacatctctcacactcactctacagcaaggaaatgcataggcggaagcatcgttgtggctgcagggtgctttaactatccagaggatacacttaccatgttcctgcagccttagtgagtaccagaaatccctactggaagcccccaagcccagcagtccatgggaatgatgcctacggcatattctatttccttattctcagtgaagatgaaaagctgccagcaagtcttgttctaaattctttctactaaatcttgtactgaaggggtcagtctagaagagctgacgttggaagta

SEQ ID NO: 127521 - DNA, 601 bp, Human
ctgtttctctcatctgtagaatggaggtggaagaggaggaggtggccatgtaaggtgccttaccaggggcccagaacttaaaaaagtttattatgaaaatgttcaaacatacaaagaactgagaaatattaatataatgcatcctcatctacctattgcatgaatttactaattaacattttgccatacgagctttgtccatgtgttccccgagtatattttaaaatcaatcagtcatcatgacattttcccccgagtatttccgtgtgccaatatacagactttttactacctatcagtrcctgaaattaacacgaattccttaatgtcatgtataattaaatgttctcagctgttcaaaaactgtcattccatggttggtttatctgaatcaggatccaaagtccacggggtacaactgactgccaggtcgctaaggctctttcaacctacaacagtcctgtccccagtctccccagggacatcaacttaaagaaacaggtcccaaattcgggatttgtctggtggtttcttgctgatgtcatttactgtgtctctctagtgtctgcattttctgccgaatgtcccagaggagacatct

SEQ ID NO: 127522 - DNA, 601 bp, Human
tgttttctgcctctacatggagatggcttatcaattcactcctactacgcctcctgctggatgcattcggcattccccgtggagtcccgggggccagcaggaccagtaagagaggtgagcagagaggaggagtccggagtgggtgtacgctcgcgagtcaccccctccagcagtgcttagaacttagggcacagctctgaggtcgagagtgggcaccttggtctcaagatacctgggttgaaatgccagttctacagtcaaagtcctgtgacgttagatgaaagagctaacctctgagccstgtttctctcatctgtagaatggaggtggaagaggaggaggtggccatgtaaggtgccttaccaggggcccagaacttaaaaaagtttattatgaaaatgttcaaacatacaaagaactgagaaatattaatataatgcatcctcatctacctattgcatgaatttactaattaacattttgccatacgagctttgtccatgtgttccccgagtatattttaaaatcaatcagtcatcatgacattttcccccgagtatttccgtgtgccaatatacagactttttactacctatcagtg

SEQ ID NO: 127523 - DNA, 601 bp, Human
acaacaggagaaactgtaataggccaaatgttttctgcctctacatggagatggcttatcaattcactcctactacgcctcctgctggatgcattcggcattccccgtggagtcccgggggccagcaggaccagtaagagaggtgagcagagaggaggagtccggagtgggtgtacgctcgcgagtcaccccctccagcagtgcttagaacttagggcacagctctgaggtcgagagtgggcaccttggtctcaagatacctgggttgaaatgccagttctacagtcaaagtcctgtgacrttagatgaaagagctaacctctgagccctgtttctctcatctgtagaatggaggtggaagaggaggaggtggccatgtaaggtgccttaccaggggcccagaacttaaaaaagtttattatgaaaatgttcaaacatacaaagaactgagaaatattaatataatgcatcctcatctacctattgcatgaatttactaattaacattttgccatacgagctttgtccatgtgttccccgagtatattttaaaatcaatcagtcatcatgacattttcccccgagtatttccgtgtgccaa

SEQ ID NO: 127524 - DNA, 601 bp, Human; identical to SEQ ID NO: 27892

SEQ ID NO: 127525 - DNA, 601 bp, Human; identical to SEQ ID NO: 27893

SEQ ID NO: 127526 - DNA, 601 bp, Human; identical to SEQ ID NO: 27894

SEQ ID NO: 127527 - DNA, 601 bp, Human; identical to SEQ ID NO: 27895

SEQ ID NO: 127528 - DNA, 601 bp, Human; identical to SEQ ID NO: 27896

SEQ ID NO: 127529 - DNA, 601 bp, Human; identical to SEQ ID NO: 27897

SEQ ID NO: 127530 - DNA, 601 bp, Human; identical to SEQ ID NO: 27898

SEQ ID NO: 127531 - DNA, 601 bp, Human; identical to SEQ ID NO: 27899

SEQ ID NO: 127532 - DNA, 601 bp, Human; identical to SEQ ID NO: 27900

SEQ ID NO: 127533 - DNA, 601 bp, Human; identical to SEQ ID NO: 27901

SEQ ID NO: 127534 - DNA, 601 bp, Human; identical to SEQ ID NO: 27902

SEQ ID NO: 127535 - DNA, 601 bp, Human; identical to SEQ ID NO: 27903

SEQ ID NO: 127536 - DNA, 601 bp, Human; identical to SEQ ID NO: 27904

SEQ ID NO: 127537 - DNA, 601 bp, Human; identical to SEQ ID NO: 27905

SEQ ID NO: 127538 - DNA, 601 bp, Human; identical to SEQ ID NO: 27906

SEQ ID NO: 127539 - DNA, 601 bp, Human; identical to SEQ ID NO: 27907

SEQ ID NO: 127540 - DNA, 601 bp, Human
cagaccaggcatggcttgcttcctccttgagctggcaagaaataaaaacatttcttgctttgctagaaaatgtcttctgtggctgagccaccaaagagcatcgatctgtgggcaccactttctccatgcccatgcctgccaggcacactcagcagagctgccacttgctccttccttccaggatgataaactggggacaggggccgggatggcacaggctcagacaagagctgctttggactctgaaataagtgtttttccttttcttaagacagggctgaagagccagatctgggctgakctgggggtcctgggtttcatgacagtaacggtgatgtggtggtaaatgtgggggtgtggctttgctcccaggtgccattgtcacccatggccttcctgagcccttgttatgtcccagatgaagcttcaagagatgacatgttcgagagggaataaaggacgtgtgtttggcgttgaaactccactcccagaatactgggtccaaatacagaatactaggtccaaaaggctgccatgcggctggccttcctgctgggaaggagtctgtctgtgtgtctgtctgtgtttaggaagggaggtt

SEQ ID NO: 127541 - DNA, 601 bp, Human
gcgtggatggggaggaagggcccaagggtctacatgcaaggtcctgcctgctgtgccaaaggggactctgtggggaacagtgctggctccgaacacaaaggccattgctccatggagcaataatcctcaggatattgccagcccaaaagatatggccaagagagaggcctctgccctgaggacaatggccagatttctctcacttatttatggtatcgtggtttacaaagtgggcccagcacacaaatctctgggcatagtttcaaatacatgcatttcttttaaattaaacacccccccmcacacacacacatacacgtgtgtgtgtgtgtgtagggtctgttcaagccctgctgctgcccaggagtgttcccagccacgtgggacagtaactgaggatgatggtactgaagccactgtctaatattagattttgtaactcagagattcattaatataattactcagatgccagcctggcttggcaaggcctcttgaattgtgttcctcttcaacaaagtgctccggctgcagaaatgcccctggtgagcctgagctctgctaccttgcctgtgaatggggcagaaggcatgtgttggcc

SEQ ID NO: 127542 - DNA, 601 bp, Human
gcaacagagccagactccgtctcaaaaaaaaaatcagtaccattgtgtattctactatgtcgctatttttcaaaatctaatttttagtggtttagcatcttttctttttcttgtttgtttgtttgtttgttagtttttgagatggagtctcgctctgtcgcccaggctggagtgcagtggcgcaatctcaggtcgctgcaagttccgcctcccagattcacgccattctgctgcctcagcctcccgagtagctgggactacaggcgcctgccaccacacctggctaattttttttttttttgtatttttagtagagacagggtttcaccatgttagccaggatggtcttgatctcctgacctcgtgatccgcctgccttggcctcccaaagtgctgggattacaggcatgagccactgcgcctggccttagcatcttttcttgttagctgcattacccctaaattgtcaacttttctaatgacttctgtcccctattcccttttgaaaatgagaaattacctcttattataagtgtaataggtgcttactgaaaaataaaaacatgcttttacatgctttttttttttttttttttttgga

SEQ ID NO: 127543 - DNA, 601 bp, Human
tggagtctcgctctgtcgcccaggctggagtgcagtggcgcaatctcaggtcgctgcaagttccgcctcccagattcacgccattctgctgcctcagcctcccgagtagctgggactacaggcgcctgccaccacacctggctaattttttttttttttgtatttttagtagagacagggtttcaccatgttagccaggatggtcttgatctcctgacctcgtgatccgcctgccttggcctcccaaagtgctgggattacaggcatgagccactgcgcctggccttagcatcttttcttrttagctgcattacccctaaattgtcaacttttctaatgacttctgtcccctattcccttttgaaaatgagaaattacctcttattataagtgtaataggtgcttactgaaaaataaaaacatgcttttacatgctttttttttttttttttttttggagacagagtcgctgtcacccaagctggagtgcagtggcactatctcagctcactgcaacctctacctccagggttcaagcaattctcatgcctcagcttcaggagaagctgggtttacaggtgtgcgccaccacacctggcta

SEQ ID NO: 127544 - DNA, 601 bp, Human
cctattcccttttgaaaatgagaaattacctcttattataagtgtaataggtgcttactgaaaaataaaaacatgcttttacatgctttttttttttttttttttttggagacagagtcgctgtcacccaagctggagtgcagtggcactatctcagctcactgcaacctctacctccagggttcaagcaattctcatgcctcagcttcaggagaagctgggtttacaggtgtgcgccaccacacctggctatttttttgtgtgtttttagtagagacgggatttcgccatgttggccagsctggtcttgaactcctggctgcaagtgatctttccgcctcagccttccaagtgctgatattacaggagtgagccaccatgcctggcctgaaaaagaaaaacatgcttttaaacagcttcatgagatttcatcatgccagagctgatgtaaaccccacccccacccccactgaggcctttgagttgtgttgcgttcatccccattgtaaattctgctgggatggacatcctattacaccaagctttgtagctgtatttgttaccttcagctaatgcttcctagcagttgaattactaggca

SEQ ID NO: 127545 - DNA, 601 bp, Human
aaaataaaatttaaaaaaaaagaaaaaagagaaaatcgggccttatatcattttctacatcctattcggcccatggaagcgtaagtgtcttcagcctctgttgacccttgtcccccaccctttctctgtgatactccaccttacccagaacctgactgtcctcaggccctgggtagtgggagctgcctcaagactcctgaggccccacaagaggcttttgaattgcagcagtggatgtgggtagttgtgtaggacagagggaggcgacagcatcgtttctcccctttcttccttcagctgrggctgtggcatggcagtgtgggccatccagtgtctagagggcttgtggccacgcagtcgtgggtgggatgcatatgttcatgaggtttgctctgttctttcctctgcagggtgttcaggatgtgctaacctgcgggtgtctgtgtgggtgtctgagtgtcaggaggtgggtgtctgtgtacaagtatgggttggggtgtgtgtgtataaatgtcagcttaattcacaccccaacaacgtaagaggaaacttctcagtcatgaggttcaagttcttgttactcctatgagctgtagtagga

SEQ ID NO: 127546 - DNA, 601 bp, Human
gagaaatggagctgggtggggcagaggcctggcaagtaaacctggatggagtgtaggaagcctccttccaccattcattcctgttgaccaaaggggcatccctgcaggcactcctgcctccttttccacttttgttttcaactttgactcccactaccaaggagttctcgggaaagagggtaggcctgtgggttaggagggcaccatggagggtagtctgtggggctgggtgagatgggtgtgggaacgcagccctgtgtttaagggtatgtgtgctgcctgcttgctgtgggcagggtgscttctgatgccctcccagcccttgggccactgtgtcttgtgttttctgcagacaaagcatggagattttcagctgttgtgaattctgcgtttcacaccgagtccctaatagtggaatcgcgttgccttccccccccctcttttttttgccttgacagctccaaccttataattttaccttctttttccttgcatacactctttttcttccctttcccgttcctggggcttttgccattcatcgctggggaccccctttaggagggattgctcctgacaagaggggaggggcttcctgtca

SEQ ID NO: 127547 - DNA, 601 bp, Human
ttttgttttcaactttgactcccactaccaaggagttctcgggaaagagggtaggcctgtgggttaggagggcaccatggagggtagtctgtggggctgggtgagatgggtgtgggaacgcagccctgtgtttaagggtatgtgtgctgcctgcttgctgtgggcagggtggcttctgatgccctcccagcccttgggccactgtgtcttgtgttttctgcagacaaagcatggagattttcagctgttgtgaattctgcgtttcacaccgagtccctaatagtggaatcgcgttgccttscccccccctcttttttttgccttgacagctccaaccttataattttaccttctttttccttgcatacactctttttcttccctttcccgttcctggggcttttgccattcatcgctggggaccccctttaggagggattgctcctgacaagaggggaggggcttcctgtcaaacattgggagttgatgttttgtttggtaaaatgtctgtaaataggctgtgaggcagtcgttctacatggatccctgtgtatgccagcgtctttttgtgtctgagcatgtctccaagcatgtgaatgtc

SEQ ID NO: 127548 - DNA, 601 bp, Human
cagggtggcttctgatgccctcccagcccttgggccactgtgtcttgtgttttctgcagacaaagcatggagattttcagctgttgtgaattctgcgtttcacaccgagtccctaatagtggaatcgcgttgccttccccccccctcttttttttgccttgacagctccaaccttataattttaccttctttttccttgcatacactctttttcttccctttcccgttcctggggcttttgccattcatcgctggggaccccctttaggagggattgctcctgacaagaggggaggggctwcctgtcaaacattgggagttgatgttttgtttggtaaaatgtctgtaaataggctgtgaggcagtcgttctacatggatccctgtgtatgccagcgtctttttgtgtctgagcatgtctccaagcatgtgaatgtcaggagcagagagaaagggaagggaagaagaagggaggagagagaagagggatggtgtttgggggcattgggatggctctcttccttcttggtctaaatcacagagcctgatcaggagagggtcagagttccagactcttgaagagtcaggaagaacatcagaag

SEQ ID NO: 127549 - DNA, 601 bp, Human
gaactcagtgtcttctcctctctgttgtattttttttttttaattccccatctccccaggttggatttgtcttttattaagatataattcacataataaaattcactattttaaagtgtacaaggccaggcatggtggctcatgcctgtaatcccagcgttttgggaagccgaggcaggaggattgcttgaggctaggagttcaagaccagcctgggcaacacagggagacctcatctctgcaaaaaataaaaaataaaaaaattagcagtacttggatttgtattttattaagatttaawtcacataataaaattcagtattttaaagtgtacagggccaggcatggtggctcatgcctataatcccaacattttgggaggccaaggcaggcagatcacttgaagtcaggagttcgagaccagcctggccagcatggtgaaaccctgtctttactaaaaatacaaaaaaaacattagccaagtgtggtgatgcagcctgtaatcccagctactcgggaggctgaggcaggagaatcacttgagctcaggaggcagaggttgcagtgagacaagatcgcgtcactgtaccccagcctgggc

SEQ ID NO: 127550 - DNA, 601 bp, Human
cagggactttggccagcaaatctctccttgcacccagccccacggaggtgaccccccagtcgcccctcaactcaatatacgtgtggttccctgtgcgtgtgagtggtctgtggggaggcctgtggggtgcggtttcgcaggaggggagtgagggctgaaaagcaacgagctagcaggcttggggtcctaatgagaaaattgcttccagccagggagccctgctctgcggctgaaattgcatccagccccagccaactttgctgccgcagtacccgcccttcggaaggagttggggaagcargcgggcagggggaggagcgggctttgcacatgactcaggcccccccaccgccccgttctatatgaacacaccttgaagagtctcttctgcctcacggggaggagcttgagggtcaggcttggctctggacccgaccgtttgatccttgggaggcagaggagggagtggggagggatttcctttctgttttgctcagttctgctgcacttatgaggtgctcactgtgtgcagagggcttggagaggtgagcttgcataggctgggcccacatagggtgggcccacccacccggtggtattc

SEQ ID NO: 127551 - DNA, 601 bp, Human
gccacacccccagcctcggctccccagggccccgggccctcccctgctcatgtcctcctcaggctgaggagaggggaacaagctattaaaagtaaataaatacataaaaagaaaacccactagtgtctcagagtcctgtgggtcaggataagaatgtcagaaactgtcatgtggcaggccagcatggggcctagagacccctgagtgtgtacactgaggtctggttgtggtgggctgggcagggcagggggcacttctttgtccagtaagccagatgttggactacctggggaaggcagctcctcccttcctccctccctccccgcaaccgaggccctagtctatactacctggaagcctgggcctctctgccccaactcccactttttccttttcccttttagcagcttataaacatccttctcccatctttttggctctgctcccagaagggggctgttcagggatcctggagggctggggagagaggcaagctccttggggcctgaggggagaaagacagctggaactggccccacccccaggacagtacagctacaagtgaccctaggaacaggggagggggttgccctaagttggg

SEQ ID NO: 127552 - DNA, 601 bp, Human
gggctaaagtgaatttcctgctctatagggtctcacttcttccaccttccttttcttagccagttgttccttctctgagccttctccttttccttttcttcttccttccctcccttccccagaagcattcaggggtgggtgagtaggggctccttgtcctggggtctccccagttcctcactctgctgagtgcccaccagacagatgctggcagctgcatgcagcccagcagttgtgcacacaaagccactcttgagtatctttaggaaagttttcctctttctgtttttttttttcttcrcccaaaggaataatttcctctctgctcttttttgtttttgtcccctttccctgcctctctcagaatcttgtactgtactgctctgattcttcttgccccagtcttctttctttgctttggccctgattctctactgtggctcctcctctctctccctttctctctatcttttagttttagttttgtcttttggttgctctctggctctggggcttcctgccttctcgcatccctcctccaaactcctgcttgtcccaggcgcatcccttgagtggcctgcagagcctccgcctcctgttt

SEQ ID NO: 127553 - DNA, 601 bp, Human
tctgccattatatttgcagagaaacctctctgttgctctttgtagatggtagtgggccaggccccaagggagcccctctgttcactggcagtggtccctgggtcaagacaccaaaaactgcaatctaggacacactcaccatgtactcaagagcgtgagctcctggggaggggagctgagggtcagccacagcttcccccaccagggtgggaggtggcatttgaacagagttgagaaggaggaataagcattcagcaaatggagatgaagggaaatagtaatccaggtggaaggacaggcracatttatgtagccccaactatgagccaggccctgagctaagcaccttattatacatgttttctcatttattccttacccaggaatgctaatggtaggtgttatctcccttttacagatgaggaaacagttcataacttgaccaaagtcacaggctggtaggttctggagcacggatgtgaattcgggggagccttggtatgccgttgctggccacccacctccttcctcctcctaccctccatttcagcatgcccccttcggcccctctgtgctggggcaaggccagctcacccaggat

SEQ ID NO: 127554 - DNA, 601 bp, Human
gtgcggggcctgcgaacaggagataaagaattcaggcagagtgttttttctcactaaccgtggatttgtgtatttgttcagctggtggctctgataagccccattctgccagataaaagcagagcagccacgaggcagggcctggggaggggcatcctaaaggggccttcctcctttctgtcccaaatcccagggttatcccctcccccggggaagcccagacagggaaggcagtcacgacatggagatgctctgcagctcctgtcacctgtccagagcaggtgtagacctcaaggcaagrctccccaaagagcctgccaggtaagaaagctggcccacgttgtgcctctggtgggcaggacgtctccttgcctccccaggagctgcctccccaggagccctttcaccatggacctagtggcctctctgggccctgcagccactggctggttcctgccagcctccttcctctatctatccaaggcacatccccgagctgacagggtgctcagagaccttcccccgtcacatccctggtgtcccgaggtgcctgcggccctatcggggcaggggtctactcttgctgagctagttaaggccc

SEQ ID NO: 127555 - DNA, 601 bp, Human
actcccagactcaagtgatccctcctgtgtgccaccctggctaatttttaaatgtttgttgtagagacggggtcttgttatgtttcccaggctgacctccaactcctggatcaagtgatcctcccaccttggcctcccaaagcactgggattacaggtatgagccacagcactcagccatgtctttgtttaaaatggtttaaaatgttgaggctgggcacagtggctcatgcttgtaatccctgtactttgggaggccaaggcaggaagactgcttgaggccaggagttcgaggctgcagygagctgtgatcatgccactgcactacagcctggatgacagggcgagatcctgtctctatttaacagatactggctgggcgcggtgtctcacgcctgtaatcccagcactttgggaggctgaggtgggcggatcacaaggtcaggagatcgagaccattctggctaacacggtgaaaccctgtctctactaaaaatacaaaaaattagccgggcgtggtggtgggcgcctgtagtcccagctactcgggaggctgaggcaggagaatggcgtgaacccgggaggcagagcttgcagtgagc

SEQ ID NO: 127556 - DNA, 601 bp, Human
tggctgggcgcggtgtctcacgcctgtaatcccagcactttgggaggctgaggtgggcggatcacaaggtcaggagatcgagaccattctggctaacacggtgaaaccctgtctctactaaaaatacaaaaaattagccgggcgtggtggtgggcgcctgtagtcccagctactcgggaggctgaggcaggagaatggcgtgaacccgggaggcagagcttgcagtgagctgagatcgcaccactgcactccagcctgggtgagagagcgagactcagtctcaaaaaaaaaaattctttargctgggcacagtggctcatgcctgtaatcccagcactttgggaggccaaggcaggcagatcacttgagcccaggagtttgagattaaccaggacaatatggcaaaatctcatctctagaaaaaaaaaaaagcaaaaatctaccaggcctggtggcgtgcacctgtagtgctggttacttggggggctgaggtgggaggattgcatgagcccaggaggattgcttgccgtgatccgtgtttgtgccactgcactccagtctggatgacagagcgagaccctgtctcaaataataataataa

SEQ ID NO: 127557 - DNA, 601 bp, Human
tctcaaataataataataacacttttttaaaaagccaaataaaataaagacaagatcctaccctgcctcatctgcctcatcctaatctcccagcgctggttgtgatcaaactttatttacaaaaacaaatggctggcctttggaccctagtttgcctatttgattattattattattattatttttgtattgcattaaaacatcatggatcctgatgactgacttttttgtgccgccttaacttttgtgcctgtggcggctgccttacctgctcaggatcctcaggaccctctgaccggcrgctcccctcctctcctgtccctcccactggctgcctccttggccctgacgcccttttttccctgcccacgtgcatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacaggtgagtccagagggccccaggagcccggctacagcctcatctcca

SEQ ID NO: 127558 - DNA, 601 bp, Human
gatgacccttcagtgggacaacggtccctggttggaatgtggaggtttctagacctctgggaaaaatccagagcctcagcagcatgctgtaataggagaagctctagctcctctgtagccagccctcccagcttggaagcctgctgcgagaggtcaggcagggaggatgctcaaagggctgtggtggggaaaggcatcccggaagcccacaccagaggctgcctgctgccaccagccccgtgctgccttggtgtgctctggcagagcgagcatttgctaagtgctggtgtattgatttgcrgcggggccgtggctccgcctcctcactctgtccctaagggaagccagtcctcttccctccctcctgttcccctcctgctcctttcctcctcgtctcccttctccctttgcccatcgagggtttctcttggctgactctgcagctccttagcatactggtagcttcgcccacctctctctggacaagctctgtccacttttagggccatggagggaagagcagacctgacctctgacagctgctgtgcttgcatcagagatgccagcagagttcacggggagctaccagcctatgcccagc

SEQ ID NO: 127559 - DNA, 601 bp, Human
gccaggatttggagtcaaattcaggctggcctagagaccggccaaggttaggccaaggagccaaacctaaccacagaacccttgagaaagtgggtcatttagtcccctggccattctgagcctctggtcctgagggctgggtcctgagcctctcccttgacttgactgttcaagattgaggactctgatatagagccatagtttttaaaaaaacgacagaggactcattttgcctagaagcttctcttcctgaggcaggcacttgctccaagcagaccatggacaaaacaccgcaaacagscaccttgattaagcaaggagtgtggcccagctggggagcaacttctgagtttccttgtgtggcctgtgtggcctgttgtactgaagagagggagagggggctcagcggggagcctgcttgatggagcccacgcccggcttctgggaggaggctagagacagcactgtgctacacaagaggctgatgcatagctgcagagagccagagggcccggctccgccactgatccagtgggtagggagtggcagcgcccagctgtgcttgcactacagccactgttaagcagtgcttctcagactt

SEQ ID NO: 127560 - DNA, 601 bp, Human
tgaaagtgtctccagacattgccagtgtctccttgagggggacagaattacccctgggtgagaactgatgctttctggggtgggtcaggggttacacaacagaactaaagcacctggtccagggctggacactgagggtcctgagctgataagcacagtctcagcacaggggagccccatacaccagctcattgtcatcgtccagctgaaatctgtgaggacagaacgaggcactggctggagacatcaaggggatgggctcctcagggcttgctcaccgataggaggaggagcacacagyatcctctctgggtctcgcatccgggtgcccggaagggcggaactctatcccacaggagaggtgctggtttaggatgaagagcgcaggccaggccttcctgagcccacgctgcagtggtcatcagggtcctgttcagagcagcaggaggtgtgtgcccaaacctccagggaggtctctccaaggaacctgcctgggagaggcaggggcgcctctgtctgtcctttggcacctgtgtgtcctgaagccagaaggccaacccacgcaaggccatgcacagggcctggaggagaaaatccagtt

SEQ ID NO: 127561 - DNA, 601 bp, Human
ggcgcgcaggccaggggtgctggcgggggtgggagggggcggggaggcacagccatgccatcttcatgcctgattgctgtttttttttttttgttttttgtttttgttttttaatttttttgttgtttcgttgttccccccacaccaagaaaatcaaatgtaaccacaaggcgacgccaccaccatcccctttttgccttgcccctcacctccatccctgggcccttgggcctcaaagacgcagcaggccagcccgaccccttccccctcagtctcacatttggtttctcgttgttcctctttttttttcccccccttccatccctctcccgtcccttctccgcaattcctttcccaggttagatgttccaaggacgagggagggctgtgggctttggcttacttcatctctctctctgtctctctttcttttcttttcttttctttttttttcctcttaaaccaatgacaaattttgtcaaagggaaaagaagaaaaatcattcgagaggtcccaggtagacccggcgtgaaggacaggaggatggggcgggtgctgtctgtgggccagggtgggcagctctgggggtgggcaggccaca

SEQ ID NO: 127562 - DNA, 601 bp, Human
gatcaagccactgcactccagcctgggcaacagaacaagactctgtctcaaagaaaaaaaaaagagtaaaaggcaggcatgcgtcctggaaacaggtgcacacaggacaaatggcatggaagcagaaaggagataggtacacaggcccccagccctctcctgcaacaggaaaccagtatagacccagaggacacagtagagaggaacccacggacatatacacatagagaggttcaggtgcacacaccgagaaagtgcaggcaggtagacagcaagaagataactgcccacagagaggacrggcactgtcgcaaaagggacaggtgaacacgcacagagggatctggcttggttacccccaggggctcaggtgggcagggtgggtcaggaaggcttacctctctgttattcctctccaaaaatgctacggctgttgggctgaccatatggtccttcatttcctggaggtaaggacagcattagggaggaaagacactcaggctgggcgcggtggctcacgcctgtaatcctagcactttgagagaccaagccgggtggatcacctgaggtcaggagttcgagaccagcctgatcaacatgg

SEQ ID NO: 127563 - DNA, 601 bp, Human
ttaaaaatacaaaaattaggccaggcgcagtggctcatgcctgtaattccagcactttgggaggctgaggcaggtggatcacctgaggttgggagttcaagatcagcctgaccaacatggagaaaccccgtctctactaaaaatacaaaattagccaggcatggtggcgtatgcctataatcccagctactcgggaggctgaggcaggagaattgtttgaacccaggaggcggagattgcggtgagccgagattgcaccattgcactccagcctgggcaacaagagtgaaactccatctcaaaaaaaaaaaaaaaaaaatacagaagttaccctggcatggtgacgagcacctgtaatcccagctacttgggaggctgaggcaggagaatcgcttgaacccaggaggcagaggttgcagtgagctgagatcaagccactgcactccagcctgggcaacagaacaagactctgtctcaaagaaaaaaaaaagagtaaaaggcaggcatgcgtcctggaaacaggtgcacacaggacaaatggcatggaagcagaaaggagataggtacacaggcccccagccctctcctgcaacaggaaacc

SEQ ID NO: 127564 - DNA, 601 bp, Human
aaaaaaaaaaaaaattagccgggtgtggtggcatgtgcctgtattacagctactcaggaggctgaggctggagaatcgttgagcccaggaggcggaggttgcagtgagccgagactgcgccactgcactccagcctggcaacagagtgagactgcatctcaaaaaaaaaaaaaaaaaaaaaaaaaggaagttatgtgcgatggctcacgcctgtaatcccagcactttggaaggctgaggcaggcagatcagttgatgtgaggggtttgagaccagactgaccaacatgacaaaaccctaytaaaaatacaaaaattaggccaggcgcagtggctcatgcctgtaattccagcactttgggaggctgaggcaggtggatcacctgaggttgggagttcaagatcagcctgaccaacatggagaaaccccgtctctactaaaaatacaaaattagccaggcatggtggcgtatgcctataatcccagctactcgggaggctgaggcaggagaattgtttgaacccaggaggcggagattgcggtgagccgagattgcaccattgcactccagcctgggcaacaagagtgaaactccatctca

SEQ ID NO: 127565 - DNA, 601 bp, Human
ccacctcatttgctgttgccctgtctttcttactgaaagtgtccagatcaggtcttcccaggccaggggcccagataaagcaagtgggatctctttctcgacacccccaaagatgatgaggttccccaatcagcggttaaaggcaatgggacctacacacatgagggaaacataagcgccccccagcccatcactatcctctccagataggaacagcggcccaccctggggtactcacttcggccagtgctggcttctcagtgtgaaggccacatggactccctcttgctcttagccctgrgagcccccaagcgccctgccctaaaagtgcggcggccccccaccttggggaaagcagtagtggagaggctgtccagcttcccctgcgtggactccagtgagcgacggccaagaaaacccaaccaaggcccccatagttcccctgccctggccagaagcgcccaggcccgagcccgctccaagctcactccgtagaactccaaaccctccggacttggctcgaaagcccccaccaaggctcctgcacgaccccaggccccagatctcattctagagtcggtccttgggaaggatccactct

SEQ ID NO: 127566 - DNA, 601 bp, Human
ccgtttagtctataactgcaaaaccacatacaaaagggataggggactcatcgctgagccccagggacccatccagcccgttcatttttacacagagggcagctggttggaactgtgcggagaagcggcacatctgggcatggcacagtggccagccagcctgggcagcagggtgtgtcccccctcctggaatctgggtcatgcttagataactgctagaaagcccgactaattacccacccttgcctgcctacatctcgatagatgttaagccctcctcaaggtttatttcaagcaggcmgggatttaaagaaacacagaagatctgcattttgatagcatctccacagaagaaaatgtgggcttcacctttttcctctggatctttgattaaaaaaaaaaaaatttaaaaggcatttacctacctaagatgtccacatgggtgctgattctcctggtgttccctctcggctactcggggtaggaaaagctggacatggtgctctaaaatggacccaccacctcatttgctgttgccctgtctttcttactgaaagtgtccagatcaggtcttcccaggccaggggcccagataaagcaa

SEQ ID NO: 127567 - DNA, 601 bp, Human
agagaactgtgggaaaaaaataatagaagacacaagaatgttcccagtggcacaaacagaaatgacacaaatgcccatcaacagtagaatggatagattgtattagagtcacatacacagaagtgagcaaaagaagccagtggcaaaagaacgtactgtgtgactccatttacatgtttaaaagaggcaaaatgaaccttagaagtcaggtgagcggtacccttgttgggggagcaactaggaggcggtatggggagggggacttccagggcactgatcgggacctgggtgctggatacgygggtgtgttcattttgtaaaaatctatgcatctgaatatatgtacttgcctgtacatatattagactttatttaagtacctacacactttttttttcactctcaggatatgcttaaacatttttttttaatggcagaaatatttagattaaaaagtagaatgttctgccctggtatcgtgactctgacattccacgtgtctttctctttacactggcctgaattcttttattcactacctccctccccaggtctctgtccatcccctctcatctccaaccctcccacccaccccgccacc

SEQ ID NO: 127568 - DNA, 601 bp, Human
tcgtcttttggtttttggagctttttggattggggaattgtggataagaaattgcaccctttttgaaaatactcccattggaaaagccgtgctaaattttacttcgcagaattttgctcctctggaaataccagccaagccggtctagtacaaggatcacgtaagtgacaccatcctgccctctacggcagtaccttctagaacattctatctctcaggacaggccaagagtctgataacctgctcccatgtctcccagcgcttctcatgcagaaagtttctctttagagagcttttcttaaaaaaaaaaaaaaaaaaatgagaggagtgccaatcagccaatgtccacagatgtcaaagtgatgtcacctgatgtcaatgtgactttaggtgtcttgttaagatttctgcaaaccggatgaaaagctggaattctacgtgtaattcaggcgactgtgcgtgataatacacagacctgcttccagtgttcctccgatggcctgagtttctacatcatgttcagtgggagacctggtggcacagggagggctggaaagatgacattcaccttggcacttggtagaaggagtgagtggcatta

SEQ ID NO: 127569 - DNA, 601 bp, Human
ctgcaaaacatactcaaatgcacaccaagtagaatgaatgaaaactgtaaattaagacttcaaactgaagtcagttcaggttaggttttacctctatatgagctcgtcttttggtttttggagctttttggattggggaattgtggataagaaattgcaccctttttgaaaatactcccattggaaaagccgtgctaaattttacttcgcagaattttgctcctctggaaataccagccaagccggtctagtacaaggatcacgtaagtgacaccatcctgccctctacggcagtaccttytagaacattctatctctcaggacaggccaagagtctgataacctgctcccatgtctcccagcgcttctcatgcagaaagtttctctttagagagcttttcttaaaaaaaaaaaaaaaaaaatgagaggagtgccaatcagccaatgtccacagatgtcaaagtgatgtcacctgatgtcaatgtgactttaggtgtcttgttaagatttctgcaaaccggatgaaaagctggaattctacgtgtaattcaggcgactgtgcgtgataatacacagacctgcttccagtgttcctccgatg

SEQ ID NO: 127570 - DNA, 601 bp, Human
ggcacaagggtagatcagatagatgttatacaatttagttaatgggtgaagacaggtaccttttctcatttgctcagcaaacgtttataggacgcctgctttgtcccacacactggggttgcagtggtgaggaacagggtaaagatcatgggtctcacagcctcagagcttgactttttcctggggaatggtagaactaccagggaggggtggaaccccacccaagagaaccccttctttctctctctctagtgcaggcacatagctttgaatgacatccttaatctttcttatttctctraccgggatttaacactattacttccactcctttccatagatccacatccttaatcctaagccatcgaggccagacgtgctttggaattcagaactcagggcttttagacgcattgcaaagatgggaatgtaaaatggtacaaccacttaggaaaacagtttgagagcctcttataaaattaaacatacacctaccacacaactcagcaatctcactcctgggttaatttacccaagagaaatgaaatgtatgaaatgaaatgttcccactaaaacccataagccaatgtttatagcagct

SEQ ID NO: 127571 - DNA, 601 bp, Human
tcccaaagtcctaaacatacaatcttattgatttttacaaaagtgtgcaaaattcacttgatactggaaaaggtacaaataaggtggtaagcggagagacttggtcattcccaagtcaaacagaacaccaaatatcagggagacccacacatagacagctaccctaccatacacccttatatccaacatccacccatccacccacccattcaaccatctatcatccactcatccacccatccagtcatccatatttttacccctcaatccagtctagtcatctgcctatttattcatccarccatatattcactcatacaccaatccatccagtcatccatccagtcatccattcacccatccatttgtccacccacccatcgagtcatctaccaatctacttatccacccacctaccctccaatcacccatccttccttccttccttcatcccatccatccatccatccactcatccatgcatctgttcaaccatccatccatccatccatccatccatccatccatccatccacccagccatccaacactaactgcagaggatgcctccatcccctctaaaccacaaacatccagctat

SEQ ID NO: 127572 - DNA, 601 bp, Human
taagatgctgaactgcatccctggtttctaccagccagatgccagtagcatcttgccccctccccctacattcgtgacaaccaaaaacgtctccagacattgccaaaagtccccttgggggaaaaattgctcccagttcaaaagcactgctttacatgcagcccaggaaaaattccaaaccatttaactgttctttctctgttccttgtcatcaacatcctgaatataccagtcacctgttctcaaaattccttctacagattcaaagaaagtggtaacagcagagtttcaattatgggcwtggagtgccatatatagacaggaatttcattcagaaaactatcagaaccttggacagagattcacacacaaagatgtttactgcactgttatttataatggcaaaacaaacagccagagattgttacatgaatataatacacgtataaagtggaacattatcagatattaacaacagtcttttctggggttgccaccaacccatacagcaccactgtatgaatttaaacaagacacccctttctctggttgtgaaattaaacaagacacccatttctctgattgtgaacttaaacaaaac

SEQ ID NO: 127573 - DNA, 601 bp, Human
gatttctcaaccttggtattactgacatttggagctggataattctttactgagaaaggctgtcctgtgcattttaagatgctgaactgcatccctggtttctaccagccagatgccagtagcatcttgccccctccccctacattcgtgacaaccaaaaacgtctccagacattgccaaaagtccccttgggggaaaaattgctcccagttcaaaagcactgctttacatgcagcccaggaaaaattccaaaccatttaactgttctttctctgttccttgtcatcaacatcctgaatakaccagtcacctgttctcaaaattccttctacagattcaaagaaagtggtaacagcagagtttcaattatgggcttggagtgccatatatagacaggaatttcattcagaaaactatcagaaccttggacagagattcacacacaaagatgtttactgcactgttatttataatggcaaaacaaacagccagagattgttacatgaatataatacacgtataaagtggaacattatcagatattaacaacagtcttttctggggttgccaccaacccatacagcaccactgtatgaattta

SEQ ID NO: 127574 - DNA, 601 bp, Human
cggctggtctcaaaacaaatatacaaaaggaagcccatttttgttatgaaaatcaaaaagtttaggtatatcggggggaaaaaaggagtggttattccatttcctttggaaaaaaacaaaatcctcaccatagttcacaaagcccagaataagccaaccttgtcacctccctgccctcacgtcctcccattcacctagcatacagtaggtgctcagtcaacatttatgaatgaatgaacgcactccttcccattcccctccatctctaagctgatatgctccagggtctctctcctgtacrttcctaagggtgtggggatcaaggggatatagaaacacagtccataccagcagcattcaccatgccaggagaccaaagaaagtaaggcacgattttcaaacagggcaacagaaggggaaggagagagaaggggaggccgccgcagttttcattccaacattttccagctctgggtgagatttccttctatacactcatctatatttacatcaacgaatctgtcggtagcaagcctgttgcttcttgtgtgggatctaaagttcacagaaagctggcttagacacccagctaggaagacaa

SEQ ID NO: 127575 - DNA, 601 bp, Human
ctgcttcactccccagagagaaccatcagagcctccccacaccagcccctgacttctcctactcctcagatcaccctaaatcaagcccacatctccccttgggtttcctcctatctcagtttctcagttgtatctcctgtcacctccaaatgcagctaagatcacctgggagatctttatttttgagccttagtacttaccacactcaaactatcctttacctgtttatctggtccttggactccctctctctccccacccagaatatcagccacaccagggcagggatttttgtccgtgygtttatttctctctgtgttttgtccatctacgtcccagtgcccacgccaaggaggaaattaagagcttgctggtcattagagaaaagtaaatgaccagcaatgactacctgctgagaatttactatgtgccacgcatgatgttttacagtcaccatccacttaatccttgcaacattcctgcaagaaaatgctacactgcttatcttatagatgacgaaacagagtggttaagattaggtagcttcccaaaagccacaccaccgatagaaacctagtcctagcccaggcgtggtagctca

SEQ ID NO: 127576 - DNA, 601 bp, Human
tgcctcagtctcccgagtagctgggactgcgggtgtgcaccaccatgcccagctaatttttgtatttttagtagagatggggtttcaccatgttggccaggatgatctcgatctcctgacctcatgatctgcccgcctcggcctcccaaagtgttgggattacaggtgtgagccaccacatgtggcctgtaattaatttctaaaattgcaatagccatgtgtggctactgcctaccttatttggcagcataggtctcccgggctcaagagatcctcctacctcagcctcccaagtagctgrgactacaggcatgtgccaacaccctcggccaatttttgtatttttttgtagagacggggtttcaccatgttgcccagcctgctctcaaactcctgggttcagcctctcaaagtgctgggattacaggcacaagccattgagcctagcctggtctgcatctgtaagtgatccaagactatggccaagggtgagacaaacaccttaggggagcaatgaagaaattaggaactcacttgggtcctccacctttcctttctcagcactggccacctgttcaggggccttcacctgtccccttgg

SEQ ID NO: 127577 - DNA, 601 bp, Human
gtaatgtttaaatgttgcccaggctggtctcaaactcctggcttcaagcaatcctcccatttcagcgtcccaaagtgctaggattataggtgtgagccactgcatctgaccctactcagcactttgaatcatcccatcatttacttctcacagccctgggagggaggtgccagcaggtctctagttttagagagaagggagcttgtggttcagagagggtaagtggcttgcccaaggtcacacagctccaacttcagtctacctgcttagccacctaatgggctttctgctaactctggckgaactttagaaacccttggggagttttcaaacattccccactccaggggaagccctggacaaatctctccagcatctgtgggggtggagcttggggcatcagcattttcctttttcttttcttttttttttttttttttttttttttgagacagagtcccactctgtcacccaggctggagtgcagcagtgccatctcagcttactgcaacctccacctcccaggttcaagcagttctcctgcctcagcctcccaagtagctgggactacaggtgtgtgccaccacacctgggtaatttt

SEQ ID NO: 127578 - DNA, 601 bp, Human
caggctgatgagtagaaccagggtgcccagagggggaaacaggtgggggcagcccccagtggggagaggaagacccagaaatgcagggagctgggctttcacacagtctcacctggatggcgagaggttgtcagccagggaaggcgagttcaaaaacccccaaaatcagaataggtcaatctatacagacagaagattagtagttgccaggggctgggggagcggggagagacagggagtgagcgctcagtgagtacggggtctcctttttggggtcttggaactacagagacgtgatggktgcacaacactgagtgtattaaatgccaccaaactgtacactttaaaatggttaatggtcaattttatgttatgggaattttatctcaatgttttaaaaattaaaaaaaaaaaatcccacacccaaacccattaaccattagctctaaggctgctgacctcattttttaaaattcatgcttattacacaggcactgcttactatcaatccaaggcacccgctcagcattttgggtttctttcttttttagaaatagggtctcactcttgtcccccaggctggagtgcagtggcaccatca

SEQ ID NO: 127579 - DNA, 601 bp, Human
gattaagccaggctgatgagtagaaccagggtgcccagagggggaaacaggtgggggcagcccccagtggggagaggaagacccagaaatgcagggagctgggctttcacacagtctcacctggatggcgagaggttgtcagccagggaaggcgagttcaaaaacccccaaaatcagaataggtcaatctatacagacagaagattagtagttgccaggggctgggggagcggggagagacagggagtgagcgctcagtgagtacggggtctcctttttggggtcttggaactacagagasgtgatgggtgcacaacactgagtgtattaaatgccaccaaactgtacactttaaaatggttaatggtcaattttatgttatgggaattttatctcaatgttttaaaaattaaaaaaaaaaaatcccacacccaaacccattaaccattagctctaaggctgctgacctcattttttaaaattcatgcttattacacaggcactgcttactatcaatccaaggcacccgctcagcattttgggtttctttcttttttagaaatagggtctcactcttgtcccccaggctggagtgcagtgg

SEQ ID NO: 127580 - DNA, 601 bp, Human
gacctgctgctgggattaagccaggctgatgagtagaaccagggtgcccagagggggaaacaggtgggggcagcccccagtggggagaggaagacccagaaatgcagggagctgggctttcacacagtctcacctggatggcgagaggttgtcagccagggaaggcgagttcaaaaacccccaaaatcagaataggtcaatctatacagacagaagattagtagttgccaggggctgggggagcggggagagacagggagtgagcgctcagtgagtacggggtctcctttttggggtcttkgaactacagagacgtgatgggtgcacaacactgagtgtattaaatgccaccaaactgtacactttaaaatggttaatggtcaattttatgttatgggaattttatctcaatgttttaaaaattaaaaaaaaaaaatcccacacccaaacccattaaccattagctctaaggctgctgacctcattttttaaaattcatgcttattacacaggcactgcttactatcaatccaaggcacccgctcagcattttgggtttctttcttttttagaaatagggtctcactcttgtcccccaggc

SEQ ID NO: 127581 - DNA, 601 bp, Human
taataagaatagcagtaaggaggccgggtgcggtggctcacgtctgtaatcccagcattttgggaggctgaggcgggcggatcacgaggtcaggagatcgagaccatcctggctagcagtgaaaccccgtctctactaaaatacaaaaaaactagccgggcgtggtggtgggtgcctgtagtcccagctactcgggaggctgaggcaggagaatggcgtgaacccaggaggcagagcttccagtgagccgagatcgtgccactgcactcccgcttgggtgacagagtgagactccgtctcaaaaaaaaaaaaaagaatagcagcaaggcaaaccttctttttcttttttccacctgagaacctagtttcactttgtgaaaaagacaaagtgacgtgtccactaaaccttcttctccatggactgaatttctcagttccccctgcagtcagatggaccatgggtattggctgtcttccattaccccaaatccactctccttccttctttacccttctaggactgtcacatggggggctgacctgtgtggatgggctcactgggctcccagccctctggctttggacaatgggggacatttat

SEQ ID NO: 127582 - DNA, 601 bp, Human
ttcttaccatgtgctgggcactgggctaagcttttctgcctatgctcttgtattgaatctgatcaaaaactcatcagattaggacaatattattattgttgttattattcattgagaccgtggcctccgaatctagatagcctaggctgaaatcccacttttgttgcttgaggggtgcaagacctcagatagtgagtctctctctctgtttcggttttctctttttgttacacgggatgataacagtacccacccctcagggcactgaaaggatgagctaaattgatgcaagcgaggtgcytggcatattgaccagaactctcattaccatggctgtccttattttacagatgaggaaactgaggcacgggaaggtgaagtcatgggcagccaccactgccagaagtggagagctggcaaagttggggagagggtgataaaaactaggaatcacggctctcatgataggtggacctagaagacagcactggggaacttggtcctgtctacctctcacctcattgtcctagacctgggagtgggcagaaggcagggacctgctggtcagctgccagaggcaatgaggggttgctcttccgtt

SEQ ID NO: 127583 - DNA, 601 bp, Human
tgtctctaattttaaaatttctaaaaaatagagaaaaaaagttacacacacatttttgactgcacaggagttcattgccccaacccctatgttgttcaagagtcaactatatttatctatgaatatataattacataacataaaatggtttattactattataaataacatgctgagttcttaccatgtgctgggcactgggctaagcttttctgcctatgctcttgtattgaatctgatcaaaaactcatcagattaggacaatattattattgttgttattattcattgagaccgtggmctccgaatctagatagcctaggctgaaatcccacttttgttgcttgaggggtgcaagacctcagatagtgagtctctctctctgtttcggttttctctttttgttacacgggatgataacagtacccacccctcagggcactgaaaggatgagctaaattgatgcaagcgaggtgcctggcatattgaccagaactctcattaccatggctgtccttattttacagatgaggaaactgaggcacgggaaggtgaagtcatgggcagccaccactgccagaagtggagagctggcaaagtt

SEQ ID NO: 127584 - DNA, 601 bp, Human
atataatgcatataacatataaaatctgtcttcatcgactgtttatgttactggtaaggcttctggtcaagaatagactgttagtagttaagctttgggggagtcagaagttatacacaggctgggtgcgggggctcacacctgtaatcctagcactttgagaggctgaggcaggaggatcacttgagcccaggagttcgagatcaacctgagcaacaaaagcgagaccttgtctctaattttaaaatttctaaaaaatagagaaaaaaagttacacacacatttttgactgcacaggagktcattgccccaacccctatgttgttcaagagtcaactatatttatctatgaatatataattacataacataaaatggtttattactattataaataacatgctgagttcttaccatgtgctgggcactgggctaagcttttctgcctatgctcttgtattgaatctgatcaaaaactcatcagattaggacaatattattattgttgttattattcattgagaccgtggcctccgaatctagatagcctaggctgaaatcccacttttgttgcttgaggggtgcaagacctcagatagtg

SEQ ID NO: 127585 - DNA, 601 bp, Human
aaggcagaagggcgggaggcaaatgctgagaaggtggcctttgagtgaagtcctgaaggagaggagggagaagccatgaggtcacctgagagaagaacaatgcagacagaggaaacagccagtgcaaaggccctgaggtaggactgtgcctggtgtgtctgaggaagagtaaagacaatggcaggagctgggtgagaggccagagatgctcgtgggcttctccaagtgatcttctcgggctttctcccaaggcagagaaaatcagcaatgggaaaggaaaatggcaacttctggagcttgrgaagaaaagaggaaagaggaaagaaaaaacgaagagagggaagaggaggaggacaggcctgagctcagagtcctgccaccttcactcttcatgtcttatcagacaaacaagcctggagtcaggagagcccatgtcccagtggcctgccatgctgtcctaaaagacagaccaacagagagaaagaaaggctggcctttaagaaaggaagggcaaagaagaacataaacaaagcaacagaaaaagtaaagctaatatataataacatatactataccagccgttgacaaactctggcccatg

SEQ ID NO: 127586 - DNA, 601 bp, Human
aaaacgaataaaatcaccttcccttgtggagatcatagtgatgtagggtgacagatagcagacagatgagtaagtaagaaggtgaaaagttccaaaggggaaaataaggcagaagggcgggaggcaaatgctgagaaggtggcctttgagtgaagtcctgaaggagaggagggagaagccatgaggtcacctgagagaagaacaatgcagacagaggaaacagccagtgcaaaggccctgaggtaggactgtgcctggtgtgtctgaggaagagtaaagacaatggcaggagctgggtgataggccagagatgctcgtgggcttctccaagtgatcttctcgggctttctcccaaggcagagaaaatcagcaatgggaaaggaaaatggcaacttctggagcttgagaagaaaagaggaaagaggaaagaaaaaacgaagagagggaagaggaggaggacaggcctgagctcagagtcctgccaccttcactcttcatgtcttatcagacaaacaagcctggagtcaggagagcccatgtcccagtggcctgccatgctgtcctaaaagacagaccaacagagagaaagaaaggctggcct

SEQ ID NO: 127587 - DNA, 601 bp, Human
ctgcttcctgtgtcttgaagagtgccttggccaccatgtatactccttcagtgtttgctaaacaaatgcacagccccatgaggcaaggactgttttgcccattttatggaggaggaaaactgagactcataatcaggtatgcagcagcaaactgtctgaattcacagcccaaactcaacacagcgatcgttccttattattattcacacagcaaagatggaccaggcagtgttctaagggctggggatgcaacagaagacaaaatagataaagctgagccctcatggaggtgatgctgtayctggttcagttgtttcctgcccaaactctcatccactctcacttttggctctgacagtggcctctgagtaacacagtgtgacatgccttcaactatgatctgaatgttctatagaagccgcctttccattatgcaactgtggtggcttttcttttgttatacgacgattatttgtcaaccccactatctttgcactcaaccatgggccccctgggctcagagacctcgtgacagtcatcttctcatcaccacatctgcaaatgtgtgggtggatggggcagcaacagtccacctcctcca

SEQ ID NO: 127588 - DNA, 601 bp, Human
ccactattacctgccaggaccaacactgtcacctccttcctaattccccagcttctgccctgcctgcccccaaccttcaaagtctgttcttttcacagcagccagaggagcctatgaatatctgagtcaggtcacgtccctcctctgctcaaaagccctccgtggctcccagctccctcagagcaaaagccaaagtcctccccgcagcccataaggccctccaaaacctgtcccgtcacctctctgtccttatccttgcaccttccctctctcttgctcactggcttcagccacatctgcytcctcactgtcacacatgtcacatatacccctacctcagggcctttgcaccagctgttccttctttctctagacatcctcacagcttcctcaagtcttggctccaatgccatcgcctcgataaagctctatctaatacagcaactgcctccccagccctttctctgctgttctcttcccattacccttataatcttctaaagtactatgcaacttacctactatttttgtttcttatcatacatctctccccatgagcatgtaagctcccagagggcagggacttttgtctgcttcctgt

SEQ ID NO: 127589 - DNA, 601 bp, Human
ctgtgattagatatcagccccaaaatgcagataatgaggtatacagtcagcctagtctacgtcctgctgcagtaacaaacaatccccagatctcagtggttgaacacaccccaggtctatttttctactcatgctatgaagtgggatggggactgatctatgtcatcctctctccagcacttactttgagagagggtccatctttgtgcatccatgacagtggaggcaggaaaaaggaaacatggtgaatcccatgctcacccttaaggcttctgtccggaaggactcatgtcacttcccytcacatttcattgatgaaaccaaatcacacagccatacctaacttcagggaggtggggaaaatgacactctactctgtgcccagagaaaaacaagaaatgttagctgaacaaggtaaaggataccccctcaggaagatcatatgacttgcccaaagtaaagcagctttgaaggtgtcagaagtgggacctgaattcaagactaaatggtccatgtctttttgcactatcaccctgaacttggcaggagttgagaattaaatctagatagcagtgaagagaaacatcaatggaggcagggg

SEQ ID NO: 127590 - DNA, 601 bp, Human
tcctggagacactgtgattagatatcagccccaaaatgcagataatgaggtatacagtcagcctagtctacgtcctgctgcagtaacaaacaatccccagatctcagtggttgaacacaccccaggtctatttttctactcatgctatgaagtgggatggggactgatctatgtcatcctctctccagcacttactttgagagagggtccatctttgtgcatccatgacagtggaggcaggaaaaaggaaacatggtgaatcccatgctcacccttaaggcttctgtccggaaggactcaygtcacttcccttcacatttcattgatgaaaccaaatcacacagccatacctaacttcagggaggtggggaaaatgacactctactctgtgcccagagaaaaacaagaaatgttagctgaacaaggtaaaggataccccctcaggaagatcatatgacttgcccaaagtaaagcagctttgaaggtgtcagaagtgggacctgaattcaagactaaatggtccatgtctttttgcactatcaccctgaacttggcaggagttgagaattaaatctagatagcagtgaagagaaacatcaat

SEQ ID NO: 127591 - DNA, 601 bp, Human
cttataagagacagaagaggccaggtgcagtggctcacacctgtaatcccagcacttcgggaggctgaggagggaggatcacttgagcccagaagttcaagaccagtctgggcaatatagtgagatcccatctctatcaaaaatttaaaaattagctgagtatggtggtgcacgcctgtaagtcccagctgctcaggaggctgaggtgggaggattgtttgatgctgggaagcagcagttgcagtgagctataattgcactgctgtactcttgtacagggtgacagagtgaggccctgacaaaaaaaaaaaaaagagagagagagaagaggaagagaagacactgacatgaaggagaaggccatgtgaagacagaggcagagactgcagtgatgcagccacaagccaatcaagccaatgtatgctaacaactaccagaaactggaagaatcaaggaagcattcttctctagagccgtccaagggagctcagcactgctgatgccttgattttggtcttccagccttcagaactgggtgacaatatatttatgttgttttaagccatatagttcatggcaatttgtcctggcagccctagga

SEQ ID NO: 127592 - DNA, 601 bp, Human
tcccacagaaatatctataatctcagtagactccaaagtggtctatccatttcattctccagagagaagccagggcattatgctaagtgaaagaagccagacacgaaaggtcacacagtgcctgaattcatttatatgaaagagccagtataggtaaatccatagaaacagaaaacaaatttgtagttaccaggagtggtgggggttggggggataccgggaggggaggatgaggagcaactgcctcatggatacagggttttctggaggggtggtgatgaaaatatttcagcactagaargaggtggaggttgtacaatattgtgaatgcgctgaatgccactgaattgctcattttaaaatggttaacttatgttgcatgaatttcacctcaatacaaaaattattttattgagacaggatctcactctgttgctcaagctagagtgcaggggcacaatcacggcttactggagcctcaacctttggggctccagcaatcctcctacctcagcctcccgggtagctgggactacaggtgcacactatcacacccagctaatttttaatttttatttttatttgtagtgatggggtctcc

SEQ ID NO: 127593 - DNA, 601 bp, Human
ccacttcctcactgcacattcttctcctaccctccccaggctggtttctagcccccatcactcaaccaaaactcttccaaagaggatcaccaaagacccccaggctgccaaatcccagggccatttttctgtgcccagattacttgaccatgcccttcttaatgttgttctagttttcctcctatcctcctggtctctacttctcaatcttccctttttgctcctctttttctatccaatctctaaatgttggtcttccctggggcttaatcctaggtaatcaccctttatctatctctaycctctttctagagcttgcatgcatttcgatgtattttgccattctcttgttgccctttctccctaaaatatccactcattgccctgtttggcatcctggtagaggcagggctgacttctgtgactgcatcatccaagccctgcaacgctgccctccaccacatcttctgccttctgggttggcttggccaacgggaggcaccagcaagagatcagagaggagggggagttggggcatttctccatttgatttcctccctgctacagtgtgtggtcttagcaatagctataccactctgtg

SEQ ID NO: 127594 - DNA, 601 bp, Human
aacctttttttaaaaaaagggggatgccaggcatggtggctcacacctgtaatcccagctactggggaggctgaggcacgaggatcactcgagcccagaaggtcaaggctgcagtgagctgtgatcacttcactgcactccagcctgggtgacacagtgagaccctatcttttaaaatgataataataactatctcaccatacatccttgtgcacttgtgataattttcctgcagcataaattccaagatgtgaagttgctggatgtcagaggggatgcacactgactttttcttttcttwttttttttttgtgagacagagtctcagtctgtcgcccaggctggggcgcagtggggtgatctcggctcactgcagcctctgcctcctgggttcaagtgattctcctgtctcatcctcccgagtagctgggattacaggcacctgccaccatgcccagctaatttttttatttttagtgaggatagggtttcaccacgttggccaggctagtctcgaactcctgacctcaggtgatccacccacctcggcctcccaaagtgctgagattacaggcatgagccaccatacccggcccacatt

SEQ ID NO: 127595 - DNA, 601 bp, Human
ctgtctgggagaagagtaacccaggaggggaagcagccagtacaaagaatgtgtgtgggaaaaaatttgaaagacaaacacgaaattgctagcagaggttatctctgggaggtgggatggggtaagggcttttcaccttctaaatgacacactacacattttttaagcttttaaaaaaccacacaaaacaacaagcccatattcttttcataattaaaacctttttttaaaaaaagggggatgccaggcatggtggctcacacctgtaatcccagctactggggaggctgaggcacgaggrtcactcgagcccagaaggtcaaggctgcagtgagctgtgatcacttcactgcactccagcctgggtgacacagtgagaccctatcttttaaaatgataataataactatctcaccatacatccttgtgcacttgtgataattttcctgcagcataaattccaagatgtgaagttgctggatgtcagaggggatgcacactgactttttcttttctttttttttttttgtgagacagagtctcagtctgtcgcccaggctggggcgcagtggggtgatctcggctcactgcagcctctgcc

SEQ ID NO: 127596 - DNA, 601 bp, Human
gctgattttttttcctctgagccctcaaccatttagagaagcatgatatggacggttttcaagagtccttccctctctcttttaaatttccattatttatttatttatttatttatttatttatttatttgtagagatgggtctcgctatgttgcccaggctagtctcaaactcctgggctcaagctatcctcctgcctccccacctcccaaaacactgggattacaggcgtgagccactgcatccagctacagggaagttaatgttttaataaaagctggaggaggcaagggaatgagcyctgtttctgtctgggagaagagtaacccaggaggggaagcagccagtacaaagaatgtgtgtgggaaaaaatttgaaagacaaacacgaaattgctagcagaggttatctctgggaggtgggatggggtaagggcttttcaccttctaaatgacacactacacattttttaagcttttaaaaaaccacacaaaacaacaagcccatattcttttcataattaaaacctttttttaaaaaaagggggatgccaggcatggtggctcacacctgtaatcccagctactggggaggctgaggc

SEQ ID NO: 127597 - DNA, 601 bp, Human
cgatcttggctcactgcagcctccatttcctgggttcaagctattctcgtgcctcagcctccctggtagctgggactgcaggcacccaccaccatacctggctaatttttgcatttttagtagagttggggtttcaccatgttggccagactggtctcgaactcctgacctcaagtgatctgcccacctcaacctcccaaagtgctgggattacaggcgtgagccaccatgcccatccgagactctgtcttttaaaatactgctgctgctgctgctactttcttcaataataataataatmatcatcatcatcatcatctgaccacgcatccttgtgcacttgtgagaatttttctgcagaataaattccgtgatgtgaaattgctgattttttttcctctgagccctcaaccatttagagaagcatgatatggacggttttcaagagtccttccctctctcttttaaatttccattatttatttatttatttatttatttatttatttatttgtagagatgggtctcgctatgttgcccaggctagtctcaaactcctgggctcaagctatcctcctgcctccccacctcccaaaacact

SEQ ID NO: 127598 - DNA, 601 bp, Human
gctggagtgcatggagtgcagtggcacgatcttggctcactgcagcctccatttcctgggttcaagctattctcgtgcctcagcctccctggtagctgggactgcaggcacccaccaccatacctggctaatttttgcatttttagtagagttggggtttcaccatgttggccagactggtctcgaactcctgacctcaagtgatctgcccacctcaacctcccaaagtgctgggattacaggcgtgagccaccatgcccatccgagactctgtcttttaaaatactgctgctgctgctgatactttcttcaataataataataataatcatcatcatcatcatctgaccacgcatccttgtgcacttgtgagaatttttctgcagaataaattccgtgatgtgaaattgctgattttttttcctctgagccctcaaccatttagagaagcatgatatggacggttttcaagagtccttccctctctcttttaaatttccattatttatttatttatttatttatttatttatttatttgtagagatgggtctcgctatgttgcccaggctagtctcaaactcctgggctcaagctatcct

SEQ ID NO: 127599 - DNA, 601 bp, Human
tgggtcagcacccaggctggagtgcatggagtgcagtggcacgatcttggctcactgcagcctccatttcctgggttcaagctattctcgtgcctcagcctccctggtagctgggactgcaggcacccaccaccatacctggctaatttttgcatttttagtagagttggggtttcaccatgttggccagactggtctcgaactcctgacctcaagtgatctgcccacctcaacctcccaaagtgctgggattacaggcgtgagccaccatgcccatccgagactctgtcttttaaaatagtgctgctgctgctgctactttcttcaataataataataataatcatcatcatcatcatctgaccacgcatccttgtgcacttgtgagaatttttctgcagaataaattccgtgatgtgaaattgctgattttttttcctctgagccctcaaccatttagagaagcatgatatggacggttttcaagagtccttccctctctcttttaaatttccattatttatttatttatttatttatttatttatttatttgtagagatgggtctcgctatgttgcccaggctagtctcaaactcctg

SEQ ID NO: 127600 - DNA, 601 bp, Human
catctatgttgtagcaaagattagtatttcattcctttttaaggcagactaatatctgaggaaggcatatcacacttggtttatctgttcatccatggatggacttttgggatatctcatcctgttgactacctagaataggtaaatccatagagacagaatgcagatgggtggttgccagaggctggaggaaggtggtggggaggggagaaggagagagactgcttaatgggtacaaggtctcctttaggggtggtgaaaatgttctggagctagacagaggtggtagttacataacagytggagtgcagtaaatgccacagagccgttcactttaaaatggttaattttctgttatgcaaattgcacctgattttttttaaattccattttggttttgcttttttttttttctttccccttgactctctcctcagggttcccatcatgggcctttactcattgcactttaccctgggcgacacagtgaggctctgtcctttttttttttttttccttttctttttttttaagacggagtcttgcacctaacctgggtcagcacccaggctggagtgcatggagtgcagtggcacgatct

SEQ ID NO: 127601 - DNA, 601 bp, Human
tctcgatctcctgaccttgtgatctgcccaccttggcctcccaaagtgctgggattacaggcgtgagccactgcgcccggccaacttttcctatttttgcccttctaggtcttggttccttttcttttctttccttttcttttggtttcttttcttttctcttctcttctcttttctttttgagacagagtcttgctctgccacccaggctggagtgcaatggtgcaatctcggttgactgcagcctccacctcctgggtgcgagcaattctcctgcctcagcctcccgagtagctgggaytacaggcgtgcagcaccatacctggctaattttttgtattttttagtagagacatggtttcaccatgttggccaggctagtcttgaactcctgacctcaagtgatctgcccacctcagcctcccaaagtactgggattacaggcatgagccaccgcgtccagccttagttccttttcttcaaggagggagggaagggacaatacctaccgtcatcatagctgaacagacctctcaaatctgaaatgtttccaagaacatactgcagtgcatgcatatgtgtggtccactcactaaatatt

SEQ ID NO: 127602 - DNA, 601 bp, Human
aaaagaaaacttaatatgcttataaaaacaggatacaatttatctcattgtaatcatgcaataaatgttcattactttatgacaattgctgctaatagtaaataacttttccaattttttttttttttttttttttagagaccgagtcttgctctttcgcccaggccagactgcagtggtgctatctcggctcactgcaagctccgcctcccaggttcacgccattctcctgcctcagcctcccgagtagctgggattacaggcgcctgccaccgcgcccggctaatttttagtatttttrgtagagacggggtttcaccgtgttagccaggatggtctcgatctcctgaccttgtgatctgcccaccttggcctcccaaagtgctgggattacaggcgtgagccactgcgcccggccaacttttcctatttttgcccttctaggtcttggttccttttcttttctttccttttcttttggtttcttttcttttctcttctcttctcttttctttttgagacagagtcttgctctgccacccaggctggagtgcaatggtgcaatctcggttgactgcagcctccacctcctgggtgcgag

SEQ ID NO: 127603 - DNA, 601 bp, Human
agcaactattaacactctctgagacatctgcaaagacctacatttcacatacagggtagaggcaaaaaagattaatcatgtcatcaggaaaatcaaatgaagagaaaattaaaaacagtatcaaataggtttgtgtgtcatttgtttttcatattatccaacaatgtccaacactttggttctgaaatgagaagtctactcagggctgctaaatcatgcttctgcttagaaaactggcaatatctgcactaaaaaatagtagtgcagaggagttgaaaggatttggggatcagacgtggcyttgaccttgggcaaggcagtttccttctctgagcctcagtttcctcatatataaaaggtagaaaatagcatcaacctcataggttgtgtgagaatggaatgagctgatacacacaataatctattacagggccctgcatatagtaagtgctcaaggaatgtgagtgttttatattgtttattttggttcccatgatgactagaaaatttaatgtgggccaaatgcagaggtagatgcctatcatctcagccctttgggaggccaaggcagaggatcgcttgaggccaggagtttgaggac

SEQ ID NO: 127604 - DNA, 601 bp, Human
tcaggtttgtcaactctttgtgaccttgtctccactatggggactgctgatgggtgggttctaaggaaacagatacttgtagcagttagccaggtcattgagcttgtgtgaagaagccaaacagacctcattttcatgtaagttccatgctcatcacaatcaccaggaaaaagagtagagggtaccagaaccctagatatatgggtttaagacatattccttggtccattaaacacataccccaatttcactctgcaatatgatcaactattatggggccattaacaagcacagcgaccayaattacagctgccttgtttccaactgcttctttgggcagataccgtggtaagcactttgtttcagttaattccttgcaacatttctacaaggtgggttctgtggtaagcctcattttccacacaagaaaatccaggctcagagagattaaacaaattttcaaggtcacataggaggtactggcagagctggggctcacacccaggtctgcccaactccacagtctatgcctttttttgtttgtttgtttgagttagggtcttgctctgttgcccagggtgaaatacagtggcacgatcac

SEQ ID NO: 127605 - DNA, 601 bp, Human
ccacctgctgagtcagaacctgcatttaaaaagatcgccaggggatttgtgtgcaccgggaagtttaggaagtgctaagtgcctctatttcagggataggaggaggagctcaggtaattgcggttttgagtcatccagaaagaggtgggggttcctgtttctcctccaagctttctcctccacgttctgaccccagggggagaactgaacagccctgggtaccagccttctgctcccacttgggtaaagagcctgagaagaaaccgaagattttgatgaaataaaagcaatgttggaatgmgacaaaagcagaaaagaaaatttcagcctaatgcatgtggaagtattcaaagccttcccatggatcccatctcactcaaaagcaaaaacaaagtccttccagcaccagcaaggtgcatgacctgctcccattacctccctcccctcatctcctctattctctcccttagtcactcagctacagcaacgccggcctcccttttattccccaaactccccaggcacatttgtacccaggggcctttgtacctgctgttcattctcctggaatagtctttccccagacatccacatgactccc

SEQ ID NO: 127606 - DNA, 601 bp, Human
ggacgttatcaagaaagttaaaaggcaagtaacagaataggagaagctatttgcaaatcatgtatctgataagggtctagtactatataaagaacatttacggccaggtgtggtggctcacgcctgtaatcccagaactttgggaggccaaggcgggtggatcatgaggtcaggagatcgagaccatcctggctaacacggtgaaaccctatctctactaaaaaaatacaaaaaattagccgggcgtggtagcgggcatctgtagtcccagctactcgggaggctgaggcaggagaatggygtgaacctgggaggcggagcttgcagtgagccaagatcgtgccactgcactccagcctgggcgacagagcgagactctgtctcaaaaaaataaaaaataaagagagaacatttacaacacaacaacaaaaagataatccaattgaaaaatggacaggaggctggaatagacatttctccaaagaagacagtcaaatggccaatatgtacatgagggtattagtgatcagggaagtgcaaatcaaaccccaacgggatactgcttcacatccactaggatagctattaaaaacaaacaaac

SEQ ID NO: 127607 - DNA, 601 bp, Human
atatgctgggctttatcaaaatttaaaccttttgtgcatcaaaggacgttatcaagaaagttaaaaggcaagtaacagaataggagaagctatttgcaaatcatgtatctgataagggtctagtactatataaagaacatttacggccaggtgtggtggctcacgcctgtaatcccagaactttgggaggccaaggcgggtggatcatgaggtcaggagatcgagaccatcctggctaacacggtgaaaccctatctctactaaaaaaatacaaaaaattagccgggcgtggtagcgggcrtctgtagtcccagctactcgggaggctgaggcaggagaatggcgtgaacctgggaggcggagcttgcagtgagccaagatcgtgccactgcactccagcctgggcgacagagcgagactctgtctcaaaaaaataaaaaataaagagagaacatttacaacacaacaacaaaaagataatccaattgaaaaatggacaggaggctggaatagacatttctccaaagaagacagtcaaatggccaatatgtacatgagggtattagtgatcagggaagtgcaaatcaaaccccaacgggat

SEQ ID NO: 127608 - DNA, 601 bp, Human
ttcccatctgttacagcaacgtttctcgagctacaatcattttcactctgcctgaatgattttttttttccacattagcttgccactggtacttctacttgcttaccagtctttcaatggacgctttttatttagctttattttaagtgaaaatgcaaagatctagaaatcataggtttgctaggctagttatagtttttagaagactgtgacattgtgaaatgtatgtttggtctttgacactgtttcctggtgtacagctcctaaaacccttgggatctccaaagggatgtctttttgyaggctaaggattgactgatggctggcagcttctaggtagcttcaggatgggggttggtcaccgggaaaaccaaggcatgattagaggtttggatttaaatcattgaccgttggtgatcaacttgattttcagcccctctgccctcccagaggttggggggtggggctgaaagtcgcaaccctcgaatcatgccttggtctttctggtgaccagtccccctcctgaagctacctagaagctgccagccacacccttctcctatatctcaccctttgcatctcttcatctgtatcctttgta

SEQ ID NO: 127609 - DNA, 601 bp, Human
tggcttccagctgctaatctatcatatttgaaattaagctacaagctcttctccatcagagccccaatgtgaatgttttcccatctgttacagcaacgtttctcgagctacaatcattttcactctgcctgaatgattttttttttccacattagcttgccactggtacttctacttgcttaccagtctttcaatggacgctttttatttagctttattttaagtgaaaatgcaaagatctagaaatcataggtttgctaggctagttatagtttttagaagactgtgacattgtgaaatrtatgtttggtctttgacactgtttcctggtgtacagctcctaaaacccttgggatctccaaagggatgtctttttgcaggctaaggattgactgatggctggcagcttctaggtagcttcaggatgggggttggtcaccgggaaaaccaaggcatgattagaggtttggatttaaatcattgaccgttggtgatcaacttgattttcagcccctctgccctcccagaggttggggggtggggctgaaagtcgcaaccctcgaatcatgccttggtctttctggtgaccagtccccctcct

SEQ ID NO: 127610 - DNA, 601 bp, Human
ggcatgtagattgttaaaggtttggaataggacttctgtactggctgataagtggccagtatcctcacctccagttcctctgcagaacctccggctggttctggcttccagctgctaatctatcatatttgaaattaagctacaagctcttctccatcagagccccaatgtgaatgttttcccatctgttacagcaacgtttctcgagctacaatcattttcactctgcctgaatgattttttttttccacattagcttgccactggtacttctacttgcttaccagtctttcaatggackctttttatttagctttattttaagtgaaaatgcaaagatctagaaatcataggtttgctaggctagttatagtttttagaagactgtgacattgtgaaatgtatgtttggtctttgacactgtttcctggtgtacagctcctaaaacccttgggatctccaaagggatgtctttttgcaggctaaggattgactgatggctggcagcttctaggtagcttcaggatgggggttggtcaccgggaaaaccaaggcatgattagaggtttggatttaaatcattgaccgttggtgatcaact

SEQ ID NO: 127611 - DNA, 601 bp, Human
cttagaggaaagcatatacacatttcaaccacagttcatcatatatggatctgaaaactccttgaagacagtaactgtaccttatttagcttgcttttctcctttgtcataatcacaatcccttgcacccagacattctcaaaaaacattcaccaagttgaaataaaagcaagatatcctcaagcaaatcaagagacccatgcacgtacaacacttaaaaccttgagttctggaatgcataatcttctgttcatctcccagttccatcacttacttgctgggtggccttaagcaagttacrctctgagtttctgattcctcagtggtcagatgggaatattaatatttcctaattcagtgggttgttgcaaggattaaattagagaatgggcataaagcactctggaagcagccaacaataatgagctattattttaattgtaacagaaagcatctgctgtaatatacagctgagacatggaggtggggtgttggcagaaaggaggcaggcgcataacaaggggagggagaacacaagggctcagccttcctgagcctggcccggaccacaccaaccaaaagcctcgtaatccttcagcta

SEQ ID NO: 127612 - DNA, 601 bp, Human
tccaactcctgagctcaagcaattctcccaggcatgtaccaccatgcctggttaatttttattttattttatgttttacagatgggggggtggtctcactgtgttgcccaagctggtcttgaactcctgagctcaagtgatcctcccacctcagcctcccaaagtgctgagattacaggcatgcaccaccacacccagctcaattttgaattttctatgagtgacaaataaacttctgccgtgtttaagtcatttcctagctttggatcttttgttataccagcaagtgctacctcatacrgggtgcttagaggaaagcatatacacatttcaaccacagttcatcatatatggatctgaaaactccttgaagacagtaactgtaccttatttagcttgcttttctcctttgtcataatcacaatcccttgcacccagacattctcaaaaaacattcaccaagttgaaataaaagcaagatatcctcaagcaaatcaagagacccatgcacgtacaacacttaaaaccttgagttctggaatgcataatcttctgttcatctcccagttccatcacttacttgctgggtggccttaagcaa

SEQ ID NO: 127613 - DNA, 601 bp, Human
atggagttattggatgatgtgggctgacaatgaagagccacaatatggcaagggtcagggtccgtcagtcattggaggagatgagcctgtcaactaggaacaattattttggacttttttttttcgagatggggtcttgctctgttgcccaggctggagcacggttggatgatcatagctcactgtgccctccaactcctgagctcaagcaattctcccaggcatgtaccaccatgcctggttaatttttattttattttatgttttacagatgggggggtggtctcactgtgttgcccargctggtcttgaactcctgagctcaagtgatcctcccacctcagcctcccaaagtgctgagattacaggcatgcaccaccacacccagctcaattttgaattttctatgagtgacaaataaacttctgccgtgtttaagtcatttcctagctttggatcttttgttataccagcaagtgctacctcatacagggtgcttagaggaaagcatatacacatttcaaccacagttcatcatatatggatctgaaaactccttgaagacagtaactgtaccttatttagcttgcttttctccttt

SEQ ID NO: 127614 - DNA, 601 bp, Human
aagcacaatctgatacttcccagcttcccttgcagtgatgtgtggtcatgtgaccgagttctagccaataggatatgaatggaacaggtatgggtcacaccccttccaaactcataaacctttccaagtatcaccttctatgctcacttctccttcctggtttgatacagacaagcatggagttattggatgatgtgggctgacaatgaagagccacaatatggcaagggtcagggtccgtcagtcattggaggagatgagcctgtcaactaggaacaattattttggacttttttttttcgagatggggtcttgctctgttgcccaggctggagcacggttggatgatcatagctcactgtgccctccaactcctgagctcaagcaattctcccaggcatgtaccaccatgcctggttaatttttattttattttatgttttacagatgggggggtggtctcactgtgttgcccaagctggtcttgaactcctgagctcaagtgatcctcccacctcagcctcccaaagtgctgagattacaggcatgcaccaccacacccagctcaattttgaattttctatgagtgacaaataaactt

SEQ ID NO: 127615 - DNA, 601 bp, Human
atttcccttttcttctaagcacaatctgatacttcccagcttcccttgcagtgatgtgtggtcatgtgaccgagttctagccaataggatatgaatggaacaggtatgggtcacaccccttccaaactcataaacctttccaagtatcaccttctatgctcacttctccttcctggtttgatacagacaagcatggagttattggatgatgtgggctgacaatgaagagccacaatatggcaagggtcagggtccgtcagtcattggaggagatgagcctgtcaactaggaacaattattytggacttttttttttcgagatggggtcttgctctgttgcccaggctggagcacggttggatgatcatagctcactgtgccctccaactcctgagctcaagcaattctcccaggcatgtaccaccatgcctggttaatttttattttattttatgttttacagatgggggggtggtctcactgtgttgcccaagctggtcttgaactcctgagctcaagtgatcctcccacctcagcctcccaaagtgctgagattacaggcatgcaccaccacacccagctcaattttgaattttctatg

SEQ ID NO: 127616 - DNA, 601 bp, Human
caaaacatggaaagctatgatcctgtaaatgattactatgaaaaaggtgtccagtgaagaagggtcttagaatagaagagcccagacttagctgagaggagagtagagagtgggaagaggaggaaccagccattggtaccagatactaatgtccctactggaatctaataaaagtttttaaggtccctgacagactagtaggtcattctccaaatccatttcccttttcttctaagcacaatctgatacttcccagcttcccttgcagtgatgtgtggtcatgtgaccgagttctagccartaggatatgaatggaacaggtatgggtcacaccccttccaaactcataaacctttccaagtatcaccttctatgctcacttctccttcctggtttgatacagacaagcatggagttattggatgatgtgggctgacaatgaagagccacaatatggcaagggtcagggtccgtcagtcattggaggagatgagcctgtcaactaggaacaattattttggacttttttttttcgagatggggtcttgctctgttgcccaggctggagcacggttggatgatcatagctcactgtgccctc

SEQ ID NO: 127617 - DNA, 601 bp, Human
aagatccctctgtgaacacccaagcccatgagagctagcccagagtccttacaacagactgctgacatctgaaggcctctacagaaacagcccaataggccacagctccttctgtgagaggcaacattgctctgaaacaaatctgcattgtgagagcccggccagcacagtgtgggtgctgcaacccatcacatccgccaagagagacagaacctggagcagcaacaaaacatggaaagctatgatcctgtaaatgattactatgaaaaaggtgtccagtgaagaagggtcttagaatagragagcccagacttagctgagaggagagtagagagtgggaagaggaggaaccagccattggtaccagatactaatgtccctactggaatctaataaaagtttttaaggtccctgacagactagtaggtcattctccaaatccatttcccttttcttctaagcacaatctgatacttcccagcttcccttgcagtgatgtgtggtcatgtgaccgagttctagccaataggatatgaatggaacaggtatgggtcacaccccttccaaactcataaacctttccaagtatcaccttctatgc

SEQ ID NO: 127618 - DNA, 601 bp, Human
acattttttaaacaataaaaaagttagccactaggctgtttctagatgagtttcctagtagactaagagaaaagtgcccagtaccataatatgcccttggaacccaccaaggtcccaagccaccgaactgtgagcacagccaacaaagatccctctgtgaacacccaagcccatgagagctagcccagagtccttacaacagactgctgacatctgaaggcctctacagaaacagcccaataggccacagctccttctgtgagaggcaacattgctctgaaacaaatctgcattgtgagarcccggccagcacagtgtgggtgctgcaacccatcacatccgccaagagagacagaacctggagcagcaacaaaacatggaaagctatgatcctgtaaatgattactatgaaaaaggtgtccagtgaagaagggtcttagaatagaagagcccagacttagctgagaggagagtagagagtgggaagaggaggaaccagccattggtaccagatactaatgtccctactggaatctaataaaagtttttaaggtccctgacagactagtaggtcattctccaaatccatttcccttttctt

SEQ ID NO: 127619 - DNA, 601 bp, Human
ccagagcctagaacaggacctggcacacagaagtgttcaataaatagtcattgaataaatgaatgtatacacaggtgtttgctctattattctctacttagttttgcatgggatcttgctaggttacccaagctggtctcaaactagttaggctcaagcaatcctctctctccagcctcctgagtaattggggttacaggcatgtgccactgtacccagctttatacacttttaatttttattttgtggagatgtggtcttgctatgttgctcaggctcgtctcaaactcctgggcccaarcaatcctcccaccttggcctcccaatgtgctgggatacaggcatgagccaccctgcccagctttacattttttaaacaataaaaaagttagccactaggctgtttctagatgagtttcctagtagactaagagaaaagtgcccagtaccataatatgcccttggaacccaccaaggtcccaagccaccgaactgtgagcacagccaacaaagatccctctgtgaacacccaagcccatgagagctagcccagagtccttacaacagactgctgacatctgaaggcctctacagaaacagc

SEQ ID NO: 127620 - DNA, 601 bp, Human
tgtcccagagcctagaacaggacctggcacacagaagtgttcaataaatagtcattgaataaatgaatgtatacacaggtgtttgctctattattctctacttagttttgcatgggatcttgctaggttacccaagctggtctcaaactagttaggctcaagcaatcctctctctccagcctcctgagtaattggggttacaggcatgtgccactgtacccagctttatacacttttaatttttattttgtggagatgtggtcttgctatgttgctcaggctcgtctcaaactcctgggcycaagcaatcctcccaccttggcctcccaatgtgctgggatacaggcatgagccaccctgcccagctttacattttttaaacaataaaaaagttagccactaggctgtttctagatgagtttcctagtagactaagagaaaagtgcccagtaccataatatgcccttggaacccaccaaggtcccaagccaccgaactgtgagcacagccaacaaagatccctctgtgaacacccaagcccatgagagctagcccagagtccttacaacagactgctgacatctgaaggcctctacagaaa

SEQ ID NO: 127621 - DNA, 601 bp, Human
tgacactctgttccagctctcctcatggctcactcactcacctcccttaggttttcattcagatgtcacatgcccagtgaagtcttccctggcttccagcacccctcacccctgcctgccacacatcccatccctcccctgctttatttttcctctgtacccctcaccgccatctgacacactagattcattcatcaattgtgtccatctccatcagtagactctcagctccatgaggacaggggatttttctattttgtttactgctgtgtcccagagcctagaacaggacctggcacayagaagtgttcaataaatagtcattgaataaatgaatgtatacacaggtgtttgctctattattctctacttagttttgcatgggatcttgctaggttacccaagctggtctcaaactagttaggctcaagcaatcctctctctccagcctcctgagtaattggggttacaggcatgtgccactgtacccagctttatacacttttaatttttattttgtggagatgtggtcttgctatgttgctcaggctcgtctcaaactcctgggcccaagcaatcctcccaccttggcctcccaatg

SEQ ID NO: 127622 - DNA, 601 bp, Human
aaggaatgggtctagggagggagaaaacagggattagaaaggttagaaaggttttgttttgctgggtacagtggcttacgcctgtaatcccagcactttgggaggccatgccaggtggatcacttgaggtcaggagttcaagaccagcctggccaacatggcgtaaacccgtctctactaaaaatacaaaaattagctagatgttgtggtacacgcctgtaatccaagctacttgggaggctgaggcaggagaatcacttgaaactgggaggcagaggctgcagtgagctgagattgtacyactgcactccagcctgggtgacagagggagactcttgtcaaaaaaaaaaaaaaaaaaaaaaagagaaaggttgtgttttgatagcaggttactccattacttctctatccccaattctccccattcttctggtcaccttctctagccatgtgggtcttcttactgttgaccaaacatgtcagatacagtccagcctcagagcctttgcactggctgttccctttgcctgacactctgttccagctctcctcatggctcactcactcacctcccttaggttttcattcagatgtcacatgc

SEQ ID NO: 127623 - DNA, 601 bp, Human
ttaaaaaatattttgaagtgtaaaaataggtagcatatatttcttatatacttaggcagccaaagtgtgaatacataaatgcaaataataaacataaaattcaggaaagtgcccctggatgggggagagaaaggaatgggtctagggagggagaaaacagggattagaaaggttagaaaggttttgttttgctgggtacagtggcttacgcctgtaatcccagcactttgggaggccatgccaggtggatcacttgaggtcaggagttcaagaccagcctggccaacatggcgtaaacccktctctactaaaaatacaaaaattagctagatgttgtggtacacgcctgtaatccaagctacttgggaggctgaggcaggagaatcacttgaaactgggaggcagaggctgcagtgagctgagattgtaccactgcactccagcctgggtgacagagggagactcttgtcaaaaaaaaaaaaaaaaaaaaaaagagaaaggttgtgttttgatagcaggttactccattacttctctatccccaattctccccattcttctggtcaccttctctagccatgtgggtcttcttactgttgac

SEQ ID NO: 127624 - DNA, 601 bp, Human
tttaaaaaatattttgaagtgtaaaaataggtagcatatatttcttatatacttaggcagccaaagtgtgaatacataaatgcaaataataaacataaaattcaggaaagtgcccctggatgggggagagaaaggaatgggtctagggagggagaaaacagggattagaaaggttagaaaggttttgttttgctgggtacagtggcttacgcctgtaatcccagcactttgggaggccatgccaggtggatcacttgaggtcaggagttcaagaccagcctggccaacatggcgtaaaccygtctctactaaaaatacaaaaattagctagatgttgtggtacacgcctgtaatccaagctacttgggaggctgaggcaggagaatcacttgaaactgggaggcagaggctgcagtgagctgagattgtaccactgcactccagcctgggtgacagagggagactcttgtcaaaaaaaaaaaaaaaaaaaaaaagagaaaggttgtgttttgatagcaggttactccattacttctctatccccaattctccccattcttctggtcaccttctctagccatgtgggtcttcttactgttga

SEQ ID NO: 127625 - DNA, 601 bp, Human
ctccaaaattgctaggattacaggtgtgagccaccattcccagcccacatatttcttatctatgcatgtagtcaaagtgtaaactattctcactctgatgctatttaaaaaatattttgaagtgtaaaaataggtagcatatatttcttatatacttaggcagccaaagtgtgaatacataaatgcaaataataaacataaaattcaggaaagtgcccctggatgggggagagaaaggaatgggtctagggagggagaaaacagggattagaaaggttagaaaggttttgttttgctgggyacagtggcttacgcctgtaatcccagcactttgggaggccatgccaggtggatcacttgaggtcaggagttcaagaccagcctggccaacatggcgtaaacccgtctctactaaaaatacaaaaattagctagatgttgtggtacacgcctgtaatccaagctacttgggaggctgaggcaggagaatcacttgaaactgggaggcagaggctgcagtgagctgagattgtaccactgcactccagcctgggtgacagagggagactcttgtcaaaaaaaaaaaaaaaaaaaaaaagaga

SEQ ID NO: 127626 - DNA, 601 bp, Human
gttgcccaggctggccttaaacccttgggctcagggaatcctcccacctcagcttccagtagctggaattccaggtgcttgcccgctgcacccagctcatgcagaatgttttactttcccctccctgttcctagcttacaacccaacaggacactaaacagcaccttggaatttggagtaataaaatttgagcaatgtgcctcatttgaaggagatagaaccaccagacaaaaaggataactgactaccagagaaataagagcaagaaaagcaagtgaaagaaatgcatggagaattcaamaagaaaggagaaggggatgtgaaaggaacccaatctagaatagaaggtcttcatgataggatcaggattccctgagaatctaataaaaactacagaccagaaaaaaaaatatacatatacacaattttcttcttgcataaaatttcagtgggttcattcatcccaacgatgagctctcacccttaggacctatctgttctagatgaagtatttctcctctagaggaatgagtctagaatctcttccatcagatgacaggaaactagaagaaaggccaccttgttgtaagcagggagatac

SEQ ID NO: 127627 - DNA, 601 bp, Human
ggtgaaacatggtccagcaaatatcatgacaaccaaaagctttgaacaataaaaagatcgatgctctctcaatggtataactcactgagaatgacaaaaagcatttgtgtcacagtggggaatccttttggtaccaaggatgactgatccatggaggggagaaactactgcagagagacattaaaataaaatgctgctggtatttataggaactgttgctggtctcatgagttagaatgctggttgtgttttgttgttgttgttggaatgctgtttacatgtgaaggcaactaagagcagktgcatggggcaggggtgaagaaagaaaggaggtaagaagcaactacatgtatttattcaattaatcaaaaaggagagaggacatgagaggtgtatggtcaagacactgacccctctgagacttggtttcctcaactatataataaaaagcgaggaactgggattattctctgaggatccctttcttattctctggaaagaggccataggctagtcagggggcaagaggaaggaagagagagctgggctctagtggcagaacctgaggggtgatattaaacatttataccacttccattgc

SEQ ID NO: 127628 - DNA, 601 bp, Human
ttggaggcaggctggcatttgtcatagcaattcgagaaaacaagacctcagtcggcccccaaacctgcggagagatggatggcaaggtcttctccagccccacagggaaaatggccaagaagctcagtatggaacaaggtcacctggccatctggcctttactcagtccctctccaccccagctggaggcagagggagggaagagaacattttagcacaatacggtgtgctgggagctgtccagggtgctgaaacctgtaacccgctaagcttccaacttccgctccttgagttagcgccragtagaccccaaggcaaaaactagggtccaatggttaatttgggaggtaatgcaaggaattataagtgaggaatgaggaagagagagattggtaaagggtacactagtgaatgggttttatgtgaacaactaggattcaattttactgaggcacctctatgatgctgtataacatatttcagtgttttcccactgagcaatggggaagccagggtatttatacactgactccctagctcactggttgagggatgctaccgaggttgttaagcatctggctcagcaaactctgtgatgcca

SEQ ID NO: 127629 - DNA, 601 bp, Human
gcaagaccctgtctcgaggaaaaaaaaaaaaaaaaaagagtctcggtttgttgcgagtccagtggcatgatcttggtctcccggcttcaagcggcccaccaggcagccacctccctgccctggtgagaggagaggagtcattaggcatgcaaactgtagaggcagtgggacagatgccccttggaggcaggctggcatttgtcatagcaattcgagaaaacaagacctcagtcggcccccaaacctgcggagagatggatggcaaggtcttctccagccccacagggaaaatggccaagamgctcagtatggaacaaggtcacctggccatctggcctttactcagtccctctccaccccagctggaggcagagggagggaagagaacattttagcacaatacggtgtgctgggagctgtccagggtgctgaaacctgtaacccgctaagcttccaacttccgctccttgagttagcgccgagtagaccccaaggcaaaaactagggtccaatggttaatttgggaggtaatgcaaggaattataagtgaggaatgaggaagagagagattggtaaagggtacactagtgaatgggtttta

SEQ ID NO: 127630 - DNA, 601 bp, Human
aagcgattcacccaccttggcttcccaaagtgtttggattacaagcatcagccaccatgccccaccaagtcaggggatgctactactctcattttccagatgaagaaatggaagattcagggaggtacagtaacttgcccaaggtcacacagcttggaaacagtggagtcaggttgggaatccactctaaccccaaagaccaggtcttaaccactatgcttccttacgtgtctatgtagactggctgtcctcatttagagatgcctgcacaagaagcagctgggttgcaaagcaatgtttwaaaaaaattattttttgagacagagtcctattctgttggccaggcatggtggctcacagctgcaatcccagcactttgagaggccaaggcgagtggatcacctgaggggagaagttcgagatcagcctggccaacatggtgaaaccccctctctactaaaaatgcaaaaattagccaggcatggtggtgtgcgcctgtaatcccagctacttgggaggctgaggtgggagtgcttgaacctgggaggcggaggctgcagtgagccaagatcgcgccactgcactccagcctgggcaacag

SEQ ID NO: 127631 - DNA, 601 bp, Human
gttgttgttttgtgttttgttttgtttgtttgagacaaggtctcgctctgttggactgcagtggtgcaagcacggctcactgcagacttgacctcctgggctcaagtgattctcccacctcagcctcctgagtagctggaattacaggcacacactatcacacccagataatttttgctttgttttgtttttgtagagatggagtttcaccatgttgcccagaatggccttgaactcccaagtttaagcgattcacccaccttggcttcccaaagtgtttggattacaagcatcagccacsatgccccaccaagtcaggggatgctactactctcattttccagatgaagaaatggaagattcagggaggtacagtaacttgcccaaggtcacacagcttggaaacagtggagtcaggttgggaatccactctaaccccaaagaccaggtcttaaccactatgcttccttacgtgtctatgtagactggctgtcctcatttagagatgcctgcacaagaagcagctgggttgcaaagcaatgtttaaaaaaaattattttttgagacagagtcctattctgttggccaggcatggtggctc

SEQ ID NO: 127632 - DNA, 601 bp, Human
tcagatattgggaacccaactaataatagcaaacgttccctacagttaactaactggtctatggaactgggcctggggaagtagtaataattattatcatcattataatgatagttattagtcttacaatagctaatataattgagcacttattctgtgccagtttttgttctgaatgccttatatgtatctcactgacttttaccttttgaggtaggtgcaattattattcccattccacagatgaggaagctgaggcccaatggactatatcactttctctttcttcagactgtccctrggcaagtaacatccataaacccagcccagcatgggtcagacattaactcattgaaccttgaaaacaactccataaggtggtagtattttgttgttgttttgtgttttgttttgtttgtttgagacaaggtctcgctctgttggactgcagtggtgcaagcacggctcactgcagacttgacctcctgggctcaagtgattctcccacctcagcctcctgagtagctggaattacaggcacacactatcacacccagataatttttgctttgttttgtttttgtagagatggagtttcacc

SEQ ID NO: 127633 - DNA, 601 bp, Human
tgccttggcctcccaaagtgctgagattacaggagtgagccaccatgcccagctttctctttcttttctgactatcctgttcccctgtttcctggtattgccaaacaaaccacttgtcctcaaattttttttttttttttttgagatggagtcttgctctgtcacccaggctggagtgcagtggtgcgatcttggcttattgcaagctccgcctcccaggttcacgccattctccttcctcagcctcccgagtagctgggactacaggcgcccaccaccacgctcagctaatttgttgtawttttaataaagacggggtttcaccatgttagccaggatggtctcgatttcctgacctcgtgattcgttgccctcaaatctttgtctcaggatcagtctgggttctgggttcttcttttttcttttttttttttgacggagtctcgttctgtcgcccaggctggagtgcagtggtgccatctcagctcactgcaagctccgcctcccgggttcacgccattctcctgcctcagcctccccagtagctgggactacaggtgaccgccatcatgcctggctaatttttttttttttgttttgt

SEQ ID NO: 127634 - DNA, 601 bp, Human
ctctgtgcaagtgacacagtaatgacacgtcatctacattgattgctgagggtcagggatggaaaggaatctgaaaatatgctctgagggcccacagaagtcagggcaaaaggccccagggaacaggaatggggccccagtggccccaggtaaataccagatgggctctgttgccccattccttgaatctggaccagcttcattgcttgctttggacaacagtggccaacacgatgttgtgccattcctgggactagcccttaagaaggctgaacacttcctctttctcttagaatcccaytgctgccacgtgaactagctcaggctagcctgctggaggatgaaaagctgccatgtgaactagctcaggctagcctgctggagggtgaaagaccatagggagtggagcacagtcattccagccgaggtcatcctggaccagtctgcagccagctaacagccaaacagaagagccacccagctgacccgcagctgaccaaagatgcatgaatgagctcaactgagaccagataaagcacccaactgggcccagcctaaactgccacccttcagaatcatgagctaaataaatgcttgtcat

SEQ ID NO: 127635 - DNA, 601 bp, Human
gagtgaaaccccatctcaaaaaaaaaaaaaaaaaaaaaaagaaacaaaaagagttggggcgggagggagaagagttaaggtctccacatagacacccaaccagcctggcctctgcccccacctgagcccctgagccaatggaatcagagccaggtttccatccagctctgatcaggagtgggtaacatttcaacaaacaaaatccaaagccccagtggacagagggagccaggttgcgtgtctgtgcatgtcagcatggcagacaagaaatctcttcccttgcacgccaaccacctgtgarggttcagaactcagatatcacagtgagatttgataaaagctggaagcatctgaggaggctgtgtaatcattcccacttttctttccagcttgctgtatgatgggccctctgctctcagcagagtttttgctgacattttttcctccttttctctgtgcaagtgacacagtaatgacacgtcatctacattgattgctgagggtcagggatggaaaggaatctgaaaatatgctctgagggcccacagaagtcagggcaaaaggccccagggaacaggaatggggccccagtggccccagg

SEQ ID NO: 127636 - DNA, 601 bp, Human
cagaagttgcagtgagccaagatcacgccactgcactccagcctgggcaacaagagtgaaaccccatctcaaaaaaaaaaaaaaaaaaaaaaagaaacaaaaagagttggggcgggagggagaagagttaaggtctccacatagacacccaaccagcctggcctctgcccccacctgagcccctgagccaatggaatcagagccaggtttccatccagctctgatcaggagtgggtaacatttcaacaaacaaaatccaaagccccagtggacagagggagccaggttgcgtgtctgtgcrtgtcagcatggcagacaagaaatctcttcccttgcacgccaaccacctgtgagggttcagaactcagatatcacagtgagatttgataaaagctggaagcatctgaggaggctgtgtaatcattcccacttttctttccagcttgctgtatgatgggccctctgctctcagcagagtttttgctgacattttttcctccttttctctgtgcaagtgacacagtaatgacacgtcatctacattgattgctgagggtcagggatggaaaggaatctgaaaatatgctctgagggcccacag

SEQ ID NO: 127637 - DNA, 601 bp, Human
tgacagtggacagaaggaagcctggttctacagtggggcagagctgtgtccaaatcctggctctagccacacagaactgtgagaaggtttgaagatgataagctatgtaaaggatctaagacccagcagatgctcagttcatgctctctgaagttgatctctacgccggcctcggtttccataaacctaacactgcagaagggaagagaggtggaggcagctaagaaaagaaaagggccaggtgtggtggctcacgcctctaatcccagcattttgggaggctgaggagggtggatcaccygaggtcaggagttcaagaccagcctggccaacatggcgaaaccctgtctctactaaaaatacaaaaattagccaggtatggtggcgtgctcctgtaatcccagctactcaggaggctgaggtgggagaattgcttgaacccaggaggcagaagttgcagtgagccaagatcacgccactgcactccagcctgggcaacaagagtgaaaccccatctcaaaaaaaaaaaaaaaaaaaaaaagaaacaaaaagagttggggcgggagggagaagagttaaggtctccacatagacacccaac

SEQ ID NO: 127638 - DNA, 601 bp, Human
caccctcctgagtagctgggaccacaggcgcgtgccaccacacctggctaatttttgtacttttagtagagacaggatttcactgtgttgcccaggctggtctggaactcctgggctcaagcaatcttcccaccttggcctcccaaagtactgggattatgggtgtgagccactgtgcccagccaggcatttttttttttaattttttaaaaataatttgttttttgagatggagtctcactctgtctcccaggctggagtgcagtggcgcaatcttggctcactgcaacctctgcctccygggttcaagcaattctcctgcctcagcctcctgggtagctggaattacaggtgcatatcaccatgcctggctaatttttttttttttttagaagagatggggtcttgctatattgcccaagctggtctcacactcccaatctgcccaactcagcctcccaaagtgctgggattacaagcataagccatcacgcccagccccagccaagcatctcgttatagcaatgtgagaacgggctaatacaggccccaattttcagatggggaaactgaggctcagagagacaacagtcttgccaga

SEQ ID NO: 127639 - DNA, 601 bp, Human
cgtgatcatagctcactgcagcctcgacctcctgggttcaagtgatcctcctgtctcggcctcctgaatagctgggactacaggctactgttattactgataccttcatttgtcctgtgaaataggtacaatgagcccctgagatattaggttggtgcaaaagtaattgtggtttttgccattacttttaatgtactttggatctgtgtctgtccgcaaccaaatcttatggcgaattgtaatccccaatgttggaggtggggcctggtggaaggtaattggatcatgggggcagatttcygccttggtgctattctcgagatcgtgagtgagttcttgtgagattggacatttaaaggtgtgtagcatctccccactctctctcttcctcctgttctggccatgtgaggacacctgctccagctttaccttctgccatgattgtaagtttcctgaggccttcccagaagctgagcagatgctgccatgctttctgtagagcctgcagaatcgtgagtcaattaaacctcttttctttataaattaccccagtctcagggtttttatttatttattattattattattatttttacaaggt

SEQ ID NO: 127640 - DNA, 601 bp, Human
tataaaaaaacttaaaaattagccaggcatctggctcatgcctgtaatcccagcgctttgggaggctgaggtgggcggatcacgaagtcaggagatggagaccatcctggctaacacggtgaaaccccgtctctactaaaaatacaaaaaattagccaggcgaggtagcaggcacctgtaatcccagctactcgagaggctgaggcaggagaatggcatgaacctgggagatggggcttgcagtgagccgagattgcgccactgcactccagcctgggctacagtgcgagactctgtctcaaaaaaaaaaaaaaaaaattacccaggcatcatggcgtgtgcccatagtcctagctactcaggaggctgacgtgggaggattgcttgagcctgggaggtcaaggctgcaataagccatgatcacaccactgcactccagcctcggcaacaaagcaagacgctgtctcaaaaaaaaaaaaaaaaaaaaaaagtcagctgaagaagatggacccccagggacatggaaactggtttgcacccagagccttggatcagggcctgcattgtggggaagtgaccttggtctggctggtaggcgggg

SEQ ID NO: 127641 - DNA, 601 bp, Human
ggatcactggaggtcaggagttccagaccagcctagccaacatggtgaaacaccgtctctactaaaaatacaaaaattagccgggcctggtggcaagcacctgtaaccccagctactcgggaggctgaggctggagaatcgcttgaacccaggaggcggaggttgcagtgagccaagatggcaccattgcactccagactgggtgacagagcgagactccatctcaaaaataaataaataaataaataaataaataaataaaaattaaaaatttcaaaaaataaaaaatttgaacccatgraagcagagagaatggtggttaccaggggctggtggtggagggattggggagatattaggcaaaggatacaaagtttcagtcagacaggaggaatacgttttagagatcttttgcacagcatggtgaccacaattaatgataacgtattgtagtgtatgtttcaacgtactatacaacataatgtaatatacaacataaggtattgtatatttcaaaattgctaaaagagtagattttaagcgttctcaccacaaaaaataagtatgcgatgtagtggatatgttaattggcttgatttaa

SEQ ID NO: 127642 - DNA, 601 bp, Human
actaaaaatacaaaaattagctgggcgtggtggtgcacacctctagtcccagctactcaggaggctgaggcaggagaatcgcttgaacccgggaggctgaggttgcagtgggctgagatcatgccactgcactccagcctagcaacagagtgagactccgtctcaaaaaaaaaaaaaaaaaaaaaattttaggccaggtgcagtggctcaacgcttgtaatctcagcactttgggaggccgaggtgggtggatcactggaggtcaggagttccagaccagcctagccaacatggtgaaacmccgtctctactaaaaatacaaaaattagccgggcctggtggcaagcacctgtaaccccagctactcgggaggctgaggctggagaatcgcttgaacccaggaggcggaggttgcagtgagccaagatggcaccattgcactccagactgggtgacagagcgagactccatctcaaaaataaataaataaataaataaataaataaataaaaattaaaaatttcaaaaaataaaaaatttgaacccatggaagcagagagaatggtggttaccaggggctggtggtggagggattggggag

SEQ ID NO: 127643 - DNA, 601 bp, Human
gtccctactaaaaatacaaaaattagctgggcgtggtggtgcacacctctagtcccagctactcaggaggctgaggcaggagaatcgcttgaacccgggaggctgaggttgcagtgggctgagatcatgccactgcactccagcctagcaacagagtgagactccgtctcaaaaaaaaaaaaaaaaaaaaaattttaggccaggtgcagtggctcaacgcttgtaatctcagcactttgggaggccgaggtgggtggatcactggaggtcaggagttccagaccagcctagccaacatggkgaaacaccgtctctactaaaaatacaaaaattagccgggcctggtggcaagcacctgtaaccccagctactcgggaggctgaggctggagaatcgcttgaacccaggaggcggaggttgcagtgagccaagatggcaccattgcactccagactgggtgacagagcgagactccatctcaaaaataaataaataaataaataaataaataaataaaaattaaaaatttcaaaaaataaaaaatttgaacccatggaagcagagagaatggtggttaccaggggctggtggtggagggatt

SEQ ID NO: 127644 - DNA, 601 bp, Human
cccataatcccatcactttggaagcccgaggcaggcagatcacgaggtcaagagattgacaccatcctggccaacatggtgaaaccctgtccctactaaaaatacaaaaattagctgggcgtggtggtgcacacctctagtcccagctactcaggaggctgaggcaggagaatcgcttgaacccgggaggctgaggttgcagtgggctgagatcatgccactgcactccagcctagcaacagagtgagactccgtctcaaaaaaaaaaaaaaaaaaaaaattttaggccaggtgcagtggytcaacgcttgtaatctcagcactttgggaggccgaggtgggtggatcactggaggtcaggagttccagaccagcctagccaacatggtgaaacaccgtctctactaaaaatacaaaaattagccgggcctggtggcaagcacctgtaaccccagctactcgggaggctgaggctggagaatcgcttgaacccaggaggcggaggttgcagtgagccaagatggcaccattgcactccagactgggtgacagagcgagactccatctcaaaaataaataaataaataaataaataaataaa

SEQ ID NO: 127645 - DNA, 601 bp, Human
ttcacaatagccaagatgcaggtacaacccaaatgtccatcagtaaaggaatggatgaagaaaatatggcgtgtatatgtacacaatgaagtactattcagtctttaaaaaggagcaaattccatcttttgcgacaacgtgcatgaacctggaggacattatactaagatgaaacaagccagacacagaaacgcaaatagtacacaatctcgcttatatgtgagctctaaaaaatttgaggccgggcgtggtggcccataatcccatcactttggaagcccgaggcaggcagatcacgagrtcaagagattgacaccatcctggccaacatggtgaaaccctgtccctactaaaaatacaaaaattagctgggcgtggtggtgcacacctctagtcccagctactcaggaggctgaggcaggagaatcgcttgaacccgggaggctgaggttgcagtgggctgagatcatgccactgcactccagcctagcaacagagtgagactccgtctcaaaaaaaaaaaaaaaaaaaaaattttaggccaggtgcagtggctcaacgcttgtaatctcagcactttgggaggccgaggtgggtggat

SEQ ID NO: 127646 - DNA, 601 bp, Human
agctaggactacaggcgtgcaatgccacgcccagctaatttttgtatttttagtagagacagggtttcatcatgttggccaggctggtctcaaactcctgaactcaggtatctgcccgcctcggcctccccaagtgctgggattacaggcgtgagccaccattagaacaatgagacaagcaggtcaggaggagatagcacatggacagggggtgaggatgttaccacctagtcatggcaggggcttgatgcccctggaagattttactggcacaattcatattacaaattatttagtgaayacttactatgtgccaggctgtgttctaggctctgggggaatagcagtgaacaaaacagacagaagtccctgccctcatggagctggcattctagtgggggcaggggattggcaataaccaataaacaagtaaatatagcttggcagatgctcttcaggggtgtagagggaaattaagcctagaggcggggagtggggtggcacagtgcaggtgaggcagttacatgttagaaggacacttgagcaaagacccaaaggaagtgaggggggagccaagcagatatctgggggaagagtgttc

SEQ ID NO: 127647 - DNA, 601 bp, Human
agagatgtgtgcccccctcactgtgcccctcactcctatttttagtttcaaagcgtccaaaaaaaaaaaaaaaaaaaagcttcagagccaatgagacctctaagggccccagtgggtcaaatcttgatttaaaaaaaattccacttctgggtctatatccaaaagaattgaaagcagggactcagctatttgtacacacaggtttacagcagcattatttacaatagccaaaaggtggaagccaagtgcccatctggatgaacagataagcaaagtgtggtccatccacacaatggaataygattcggcctggaaaagaaggaaattctgactcatgctacaatatggatgagactggaggacattatgctccacgaaacaaaccagtcacaaaaagacaaatactgtatgattctactcacaggggggacccaaagtagccaaattcacagagatagaaactagaacggcgggtgccaggggctgggggagtggggagtgtggagtagggtggggggagtggggaggggggaagggggagtcggggagaggggaagggggagcggggagtgagagtttcctgggggcagagcttcagttt

SEQ ID NO: 127648 - DNA, 601 bp, Human
cctcttcagccactaaaattagctccatctctagtccacatccccagcacgcctgtcctggtttctctgggctcccagccacttgcgatattgtgtctcagatgccacacgctgcctgcctgatgtcacagccgcttcctaaaacaagaggtattttgagatcttggagggggtgggagcggggggaagggagggatttcacacatcttcctcccggggtgtttttaaaaaacgctgacacgagagatgtgtgcccccctcactgtgcccctcactcctatttttagtttcaaagcgtccaaaaaaaaaaaaaaaaaaaagcttcagagccaatgagacctctaagggccccagtgggtcaaatcttgatttaaaaaaaattccacttctgggtctatatccaaaagaattgaaagcagggactcagctatttgtacacacaggtttacagcagcattatttacaatagccaaaaggtggaagccaagtgcccatctggatgaacagataagcaaagtgtggtccatccacacaatggaatacgattcggcctggaaaagaaggaaattctgactcatgctacaatatggatgagactgga

SEQ ID NO: 127649 - DNA, 601 bp, Human
actcctgggtctgaatcccagctctaccactccgtagctgtgtgacctttggacagttacttaacctctctgggcatcggtttcctcataggtaaaatgtggataataacaggttgtttttttttgtgtgtgtgacagagtttcactcttggagtgcagtggagtgatctcgactcactgcaacctccgcctcctgggttcaagcgattctcctacctcagccaagtagctgggattacaggcacctgccaccatgcctggctaatttttgtattattagcagagacagggtttcaccctkttggtcaggctattcttgaactcctgacctcaggtgatccacctgccttggcctcacgacgtgctgggattataggcgtgagccactgcgcagggcaagagctcttatcttataggctctttagaagattaaatgggttaatatttgtaaagggctcatagtaaatgctagttgttattctcatcacaatttacctggattattaggctgatgagtgcaatgcagttgaactgaagttttacaagggcagaaagcaggcctgtcttgttgaccgatgtgtcatcagggcctagcacatag

SEQ ID NO: 127650 - DNA, 601 bp, Human
aacaaacaaacaaacaaacaaacatacacacacactctgggatcacactcctgggtctgaatcccagctctaccactccgtagctgtgtgacctttggacagttacttaacctctctgggcatcggtttcctcataggtaaaatgtggataataacaggttgtttttttttgtgtgtgtgacagagtttcactcttggagtgcagtggagtgatctcgactcactgcaacctccgcctcctgggttcaagcgattctcctacctcagccaagtagctgggattacaggcacctgccaccaygcctggctaatttttgtattattagcagagacagggtttcaccctgttggtcaggctattcttgaactcctgacctcaggtgatccacctgccttggcctcacgacgtgctgggattataggcgtgagccactgcgcagggcaagagctcttatcttataggctctttagaagattaaatgggttaatatttgtaaagggctcatagtaaatgctagttgttattctcatcacaatttacctggattattaggctgatgagtgcaatgcagttgaactgaagttttacaagggcagaaag

SEQ ID NO: 127651 - DNA, 601 bp, Human
acccttttaggattctttccaaagatccaaggagatgtgtgttaagggcatggcacataacaactgctcagtgtgactggtgattacttctattgcagaagcaggaaaacacagtggtaaaaacaaacaaacaaacaaacaaacaaacaaacatacacacacactctgggatcacactcctgggtctgaatcccagctctaccactccgtagctgtgtgacctttggacagttacttaacctctctgggcatcggtttcctcataggtaaaatgtggataataacaggttgtttttttttktgtgtgtgacagagtttcactcttggagtgcagtggagtgatctcgactcactgcaacctccgcctcctgggttcaagcgattctcctacctcagccaagtagctgggattacaggcacctgccaccatgcctggctaatttttgtattattagcagagacagggtttcaccctgttggtcaggctattcttgaactcctgacctcaggtgatccacctgccttggcctcacgacgtgctgggattataggcgtgagccactgcgcagggcaagagctcttatcttataggctctttaga

SEQ ID NO: 127652 - DNA, 601 bp, Human
taggaagaaaacaattctaatacttggaattaaagacatagtgggcgtggttaatagcagattagacatagctaaagaggcaactggtaagctggtgagagacaggtaccattattctcctcatttgacaaataagtaaactgaggcacacagagagccagcatcttggtttgctgggaaataaatcacaaattggcatccacctaactcaagatctgtgctgttatccactctgccattctgtttaaacccaagggaatggtgtcctctctctgcctgagcctctgaatgtcttccccayttgctattttctttggcaaaatattttagggaaaatagaatttgtctaaaaatgcctgacagaagaaaggcacattgtgttgcattagcatgcaggcaacaatgcctagcggggaaaaatggcacagcaatttccgtctctaaaacatttaccttccattaactaattatggcccacagttcatagtcaaggggcttgggggtgtttatctttacacagacacagggaaaatggaagaaatgcaccgataaaagtggtcccccccagggcatgcgtggtggctcaggcctgtattcctag

SEQ ID NO: 127653 - DNA, 601 bp, Human
agtcaccaatgtgaagatattaggaagtggggcctttgggaggtgattagatcatgaagacagagggattcatgctctcatgaaagaggtttcagagagctgcctcaactcttttcaccatgtaaagatgcagtaggaagaccccttctatgaaacaagaaatggcccctcatcagacaccaaatctgtcagtgccttgatcttcccagcctccagaactgtggaaaataaatttctgaggtgtataagccacccagtttaaggtattttattatagccacctgagaggattaaaacaggygctctctgggcaaaggaagtgtcctcatccagatttggagggtcaggagagggtttttggaggaaataatgcctattctgagacttgacagcaaagggtggaaagaagaagagtatttcaaaaagaaggaaaaataattccaaggctatccagtgacagaaagtataggatgctaggggatccttaaaaagttcaatgggctggatgtggtggctaacccctgtaatgccaatactttgggaggccaagatgggaggactgcttgagcccaggagtttgagaccaacctgggaaacatag

SEQ ID NO: 127654 - DNA, 601 bp, Human
cagtgaaccctccagaagttatgttgatgtcctaatccctggaatgctaccttatttagaaaaaataaggtatgcaggtacgatttagttaagaatatgagggcaagagtttattcctggattttctgagtggggcctaaatgcagtcatatgtatccttatgacacagcagaagagggaactttgagagggaagaggagaacgccctgtcaccactgaggcagagactggagtgaagcaactccaaatccaatggaaggatcctcccccggatcctttggagggaccctggtgacacctygatttcagacctatggcctccaaaacagtgagagaatacatttcccttgtttgaagccgtgtggtttatggtacagtcatgtgctacataacgatgttttgatatgttttgatcaacagcggactgcctatacaatggtggtcccatatggttataactgtatttttactgtaccttttctgtttagatatgttttttattttttatttttttgagatggagttttgctctgtcacccaggctggagtgcagtggcatgatctcagctcactgcaacctccacctcccaggttcaagcga

SEQ ID NO: 127655 - DNA, 601 bp, Human
ccaagacacagacctccatggccagccctgtcccctgtcaagagctctcccggccccatgttcttttccttcctggcggttagcacagtagatgctcaaaaaggtatctgtgacaatatttgtgttgcaaatgatgtcaaaactgtgcaaaaccatgttggtttgaatcctggctctgccacttactgttcctcctcaggtgagttacttaaccccactctgtcttgatttctctgtggttttccccatagagagaagacatttgttaatgtatgaaaagtccttagaacaatggaatgargcttccatgaagtcagctttctcaggtccacagcaaatatttgggggagtggaggtgggggcagaacccttcaggcattcagtacaaggtagtggtgtgtgtacgtgggaggcagtcccagatgtcagaacctgaattcaaagcgcattctggctgtagtgggttgaacagtgaaccctccagaagttatgttgatgtcctaatccctggaatgctaccttatttagaaaaaataaggtatgcaggtacgatttagttaagaatatgagggcaagagtttattcctggattttctgagtg

SEQ ID NO: 127656 - DNA, 601 bp, Human
tccctatgttgcccaggctggtctcaaactcctgggctcaagcaatcctctggcctcagcttaccaaagtgttgggattacaggcgtgaggcacagcatttaggctgtgtgcggtggctcatgcctgtaatcctagcacttcgggaggccgaggcggtggatcacctgagatcaggaattcgggaccagcctagccaacatggtgaaaccctgtctctactaaaactacaaaaatcggccgggcgcggtggctcacacctgtaatcccagcactttgggaggctgaggcaggtggatcacraggtcaggagttcgagacaagcctggccgacatggtaaaacctcatctctactaaaaatacaaaaaattagctgggcgtgttggcgggcgcctgtaatcccagctactcaggaggctgaggcaagagaatcacttgaatccaggaggcggaggtggcagtgagctgagatcgcgccactgcactccagcccaggcaacagtgctacactccatctcaaaaaacaaaaacaaacaaacaaatttaaaaaatccaaaaattagctgggtatggtggtgcatgcctgtagctacttgggaggc

SEQ ID NO: 127657 - DNA, 601 bp, Human
aaacagaattttaaatttcgcttaattttttttgagacaaggtcttgctctttcacccatgctggagtgcagtggcacaatcacagctcactgcagccttgacctcttgggctcaagcgatcctcctgcctcatcctcccgagtagctgggaccacaggcctgcaccaccacgcctggctaatttatttttattttttatagagatggggtctccctatgttgcccaggctggtctcaaactcctgggctcaagcaatcctctggcctcagcttaccaaagtgttgggattacaggcgtgrggcacagcatttaggctgtgtgcggtggctcatgcctgtaatcctagcacttcgggaggccgaggcggtggatcacctgagatcaggaattcgggaccagcctagccaacatggtgaaaccctgtctctactaaaactacaaaaatcggccgggcgcggtggctcacacctgtaatcccagcactttgggaggctgaggcaggtggatcacaaggtcaggagttcgagacaagcctggccgacatggtaaaacctcatctctactaaaaatacaaaaaattagctgggcgtgttggcggg

SEQ ID NO: 127658 - DNA, 601 bp, Human
cctgtgtgagtgagaaacagaattttaaatttcgcttaattttttttgagacaaggtcttgctctttcacccatgctggagtgcagtggcacaatcacagctcactgcagccttgacctcttgggctcaagcgatcctcctgcctcatcctcccgagtagctgggaccacaggcctgcaccaccacgcctggctaatttatttttattttttatagagatggggtctccctatgttgcccaggctggtctcaaactcctgggctcaagcaatcctctggcctcagcttaccaaagtgttgkgattacaggcgtgaggcacagcatttaggctgtgtgcggtggctcatgcctgtaatcctagcacttcgggaggccgaggcggtggatcacctgagatcaggaattcgggaccagcctagccaacatggtgaaaccctgtctctactaaaactacaaaaatcggccgggcgcggtggctcacacctgtaatcccagcactttgggaggctgaggcaggtggatcacaaggtcaggagttcgagacaagcctggccgacatggtaaaacctcatctctactaaaaatacaaaaaattagctg

SEQ ID NO: 127659 - DNA, 601 bp, Human
tgaagcttcctacgctgataaaaatattctctatccatgctgtccaatatgatagccaccacccacaagggatgattaagcacttgaagtgcagcctgtgtgagtgagaaacagaattttaaatttcgcttaattttttttgagacaaggtcttgctctttcacccatgctggagtgcagtggcacaatcacagctcactgcagccttgacctcttgggctcaagcgatcctcctgcctcatcctcccgagtagctgggaccacaggcctgcaccaccacgcctggctaatttatttttattttttatagagatggggtctccctatgttgcccaggctggtctcaaactcctgggctcaagcaatcctctggcctcagcttaccaaagtgttgggattacaggcgtgaggcacagcatttaggctgtgtgcggtggctcatgcctgtaatcctagcacttcgggaggccgaggcggtggatcacctgagatcaggaattcgggaccagcctagccaacatggtgaaaccctgtctctactaaaactacaaaaatcggccgggcgcggtggctcacacctgtaatcccagcactttgggag

SEQ ID NO: 127660 - DNA, 601 bp, Human
tcaaaaaaaaagcaggcagatagcagcgaaggacaatgtgccacattaaggagcttggatagtatcttgaaagcaataagggtttaaaaaccagggaatgttggagacacgtggcacaagaaaggtgtcatctagatggacagaagaccctcatgatcccatgacagcgactgggaaggggtaattaaaaacaaagaaacacaagccaaaagcatcatcaggctgagaagagaaaatgtcttagcatggctgagaacacactcaagaaatagaagctctgccgggtgtggtggctcatgtgtgtagtcccagcactttgagagaccaaagtgggcggatcgcttgagcccaggagttagagaccagcctgggcaacacggcgaaactccatttctaccaaaagtcctaaaaaaaatttgcccgggtgtggtggcgtgtgcctgtagtcccagctattccagaggctgaggggggaggatcgcctgagcctgggaggtcaaggctacagtgagctgagatcacacctctgcactcgagcctgggtgaaaaagagagatcctgtctcaaaacaaaagcaaaacaaacaacaacaacaacagaa

SEQ ID NO: 127661 - DNA, 601 bp, Human
agagttctgggagttgaggtataaagacttaaaatctggcaagaggaagatgaggtcatggtaggagatatggtaaggcagtagtagaccaatatcattcctgatcttgacatgtgaaatggttgatcctttgacaatcctgtgtgtgtgtgtgtgtgtgttgtgtgtctgtgtgatgtcttttattagactcaaagtacaaatacgccaggcacttagccttgtcattgttgatgtctgtatctccagcatctagcacagcgcctggtacaaagtaaatgtctcctcaaataataataakaagaagaagaataagaatttctttttgaggcagggtcttattctatcacccaggctggagtgcagtggctcgctcttggctcactgcaacctccaccttcagggctcaaatgatcctcccgttttagcctcccgaatagctgggactacgtgcatgccactatacctggctagtttttgtattttgtgtagagacagtgttttgccatgttgcttaggctgatctcgaactcctgattcaagctcagaagtgaatcaggagttcaagcaatcctcccaccttggcttcccaaagtgctag

SEQ ID NO: 127662 - DNA, 601 bp, Human
cttatgcatgttgggattctttgttacagctgcaagcatatctaatacacttaataggaacttataaacagtaactaatacacttgggcaggtaaattgtcagtttcatgagaccatggatttgcctctttggttcactgatggatctctggtgtctagaacagggctgagcaggtggaagggttcaataagtgtttgttgaatgagctatcagcttccaatttttctttgcagctgactggaaagcagagaagtatagtagatgcaagctctggctcccaggtgggaaagggttgggttyatatcctgcctgattatttactaattgtctacattgggcaattgccaagcctcagtttcctcatagggaggttggagaattatataaaagctctttctttttgtggacagagtgaggattcaacgtgatcattcatgagaagtgctgagcacaccacctgatgcatagtaagtgctcaggaagtagcggtcatgattatctggacttttctcattctctgggcaaacaaaaagcacagaagctgcccctgcaataggctctgacaaatttcaggccccgaggggagggaggccaggcttg

SEQ ID NO: 127663 - DNA, 601 bp, Human
agctgggcatggtggcgcgcacctctagtcccagctacttggaaggctgaggcaggagaattgcttgaacccaggaggcagaggctgcagtgagctgagtttgcaccacagcactccagcctgggcaacagagtgagactccatctcaaaaaaaaaaaaaaaagaaaagaaaaagaaaaagaaaaagaaatgatctggctgggcacagtggctcatgctgggattacaaatcccaggactttgggaggcccaggtggtggatcacttgaggtcagcagtttgagaccagcctggccaacakggtgaaaccctgtctctactaaaaaatacaaaaattagctgggcatggtggtgcttacctgtagtcccagctacttgggaggctgaggcaggagaatcatttgaacccagaaggcagaggctgcagtgagccgagattgtgccactgtactctagcctgggcaacagaatcagactctgtctcaaaaaaaagaaaaaaaaaaaaaagaaattatctaacttacgttatttgaccgtaggttataaggatcccattccagagagggtcctgccccatacccagaaggaatgcatgctctga

SEQ ID NO: 127664 - DNA, 601 bp, Human
cagctgtggtagctcatgctgggattacaaatcccgggactttgggaggccgacgtgggtggatcacttgaggtcaggagtttaagaccagcctggccaacatggcaaaacactgtctctactaaaaatacaaaaattagctgggcatggtggcgcgcacctctagtcccagctacttggaaggctgaggcaggagaattgcttgaacccaggaggcagaggctgcagtgagctgagtttgcaccacagcactccagcctgggcaacagagtgagactccatctcaaaaaaaaaaaaaaaagaaaagaaaaagaaaaagaaaaagaaatgatctggctgggcacagtggctcatgctgggattacaaatcccaggactttgggaggcccaggtggtggatcacttgaggtcagcagtttgagaccagcctggccaacatggtgaaaccctgtctctactaaaaaatacaaaaattagctgggcatggtggtgcttacctgtagtcccagctacttgggaggctgaggcaggagaatcatttgaacccagaaggcagaggctgcagtgagccgagattgtgccactgtactctagcctgggc

SEQ ID NO: 127665 - DNA, 601 bp, Human
ggtttggttcccgaaccacctgctattgcatcttttttttttggacggagtcttgctttgtcgctagactggagtgcagtggcgtgatttcagctcactgcaacctccacctccctggttcaagcaattcccctgcctaagcctcccaagtagctgggattacaggcacgtgacaccattcctggctaattttttgtattttagtagagatggggtttcaccatgttgaccaagatggtctcgatctcctgacctcgtgattcgcctgcctcggcctcccaaagtgctgggattacaggcrtgagccaccgcacctggccccaattgcatctttatttgaacaaatatcttagttttcatgtaatcatgtctttttttgccttagagtttgtgctttacaagttcagtggaggaagtccttctcccttcctgggttcacagctattctccagcattttttttcctttaatgtaaagttctccccactcacagaaggtcctcccaagctccttaaccttctacatggagagcaattcttcattttatttgtcttttaaagtaaaggattgaacaaaaggacatgtttctatttcgggtggtt

SEQ ID NO: 127666 - DNA, 601 bp, Human
cagctcactgcaacctctgcttcccaggttcaagcaattctcctgcctcagcctctcgagtagctgggactacaggcatgcgccaccatgcctggctaatttttttttatttttagtacggacgcggttttaccatgttagccagggtggtctcgatctcctgacctcacaatctgcccatctcggcttcccaaagtgctgggattacaggcgggagccactatgccccacctacatttttattttttatgtttagagacaggtctcactctgtcacccagactggagtgcagcggtgcgmtcatagttcactgcagcctcaaattcctgggctcaagcaatcctgtctcagcctcctgagtagctgggactacaggcatgcaacactttgcctggctaattcttaaaatgttggtagagatgaggtctctctgtttcccaggctggtctcaaacccctggcctccagtgatcctcccaccttggccttccaaagcactgggattacaggtgtgagccactgcacccagaccctcatgtagccttgatcaacactgtctgacagaactttctggatgataaatctgttctcaatctgtgct

SEQ ID NO: 127667 - DNA, 601 bp, Human
taccaaggagcagaaccacttcccatacagtctatattcttgccactcctaggttggactgagtgatcctcttcaagttcattcttaaatcacccagctttccccttcttgaaaaaactatttcttcctcttcttttttttttttttttttttttgagacaaagtcttgctctgtcacccaggctggagtgcaatggtgtgatctcagctcaatgcaacctctgcctcccgggttcaagtgattttcctgcctcagcctcctgagtagctgggattacaggcacatgccaccatgcctggstaatttttgtatttttagtagagacagggtttcatcatgttggccaggctggtctcgaactcctgaccttaagtgatccacctgcctcgccctcgcaaagtggtggggttacaggcgtgagccaccccctggcgagaaaactatttctgaaattcattttctgaatcttcaaatgcagagtcaagttctttgctctcctcaggttacgggatatctttacctttggtctgtatgacgcctgtctcttgtttataccttcattcattcatgcattaattcccctatatctctctataccct

SEQ ID NO: 127668 - DNA, 601 bp, Human
aaacaggcccaaaatgtgaataggcagattaggggagtgagaaggagaggagacaggagagtgagaagatgttagcatggttagaaagcaggggaggggatggggatgtagtggccccctaacctcaggttagataaagtacctgcctcttacagactcaggccaaatatttctaagatgggtaccaaggagcagaaccacttcccatacagtctatattcttgccactcctaggttggactgagtgatcctcttcaagttcattcttaaatcacccagctttccccttcttgaaaaaackatttcttcctcttcttttttttttttttttttttttgagacaaagtcttgctctgtcacccaggctggagtgcaatggtgtgatctcagctcaatgcaacctctgcctcccgggttcaagtgattttcctgcctcagcctcctgagtagctgggattacaggcacatgccaccatgcctgggtaatttttgtatttttagtagagacagggtttcatcatgttggccaggctggtctcgaactcctgaccttaagtgatccacctgcctcgccctcgcaaagtggtggggttacaggcgt

SEQ ID NO: 127669 - DNA, 601 bp, Human
ttaaaaagatgacacagaggaatgtctgcaaatcagtgagaataacacagcaaccccaataggaaaacaggcccaaaatgtgaataggcagattaggggagtgagaaggagaggagacaggagagtgagaagatgttagcatggttagaaagcaggggaggggatggggatgtagtggccccctaacctcaggttagataaagtacctgcctcttacagactcaggccaaatatttctaagatgggtaccaaggagcagaaccacttcccatacagtctatattcttgccactcctaggtgggactgagtgatcctcttcaagttcattcttaaatcacccagctttccccttcttgaaaaaactatttcttcctcttcttttttttttttttttttttttgagacaaagtcttgctctgtcacccaggctggagtgcaatggtgtgatctcagctcaatgcaacctctgcctcccgggttcaagtgattttcctgcctcagcctcctgagtagctgggattacaggcacatgccaccatgcctgggtaatttttgtatttttagtagagacagggtttcatcatgttggccaggctggtc

SEQ ID NO: 127670 - DNA, 601 bp, Human
tttagagacagagtcctagtatgctgcccaggctggactcaaactcccagtctcatgagatcctactgccttggactcctgagtaggtggaactataggcctaagccactgtgcctggctttgcaaaatttatttttattttttattttattttttagaaattttcatctgttttgttcatagcatctccagcacctaaagctgtgcctggcatacagtaggcactcaataaatgtttactgaatgaataatgaagcaaaaatgtagaaaagtgtggttgataattaacagagtatattcyagaagaggtggaaggctcagtatttaaagaagagagtccaggcgtggtggcttatgcctgtaatcccagcactttgggaggctgaggcaggaggattgtttgagctcaggagttcaagaccagcctgggcaacataaagagaccccatctctacaaaaaatataaaaattagccggccatggtggtacactcctccagctgctcgtgaggctaaggtgggcggatcacctgagcctggcaggtcgaggcagcagtgagctgtgattgtgccactgcatttctgcctgggcaacagagtga

SEQ ID NO: 127671 - DNA, 601 bp, Human
cacacagaaataaagtattttgagaaaggagaggtcactggtctccagggccgcacagaggtgagtaagagtaaaggatgaagaatgcatttcatacggcatcagggtcacgtcagtcttgcgggggctgatggttgagggagaacaagaggagaagaactggaaatgtgagcctgggtaggagaggagattttcagggtgggagagaactgaatatgggtcaagggagagaagttgatgatgtatctcttggcctttagagagctgcaccgcccaataaagtaaccactagccacacatrgctatttaaatacagatttaaattcatttaaattaaatgaaaaattcgcttgtaccagtcacgttttaagtgctcccaagccacatgtggctggtgcatacatacatacttcatcagtgcagaaagttccattggactttgatgttctagcatgtccatccccgtagggcagatattttctattctttctttctttttttttttttttttgagacagggtctcattctgttgcccaggctggagtgcagtggcacgatctcggcttattgcatcctccgcttcccaggttcaagcgattc

SEQ ID NO: 127672 - DNA, 601 bp, Human
taactgaaggatgaagttgctgtcaatggagatggggaagatggaggaagaaggtttcaaagatcaagaactgggttgtagacatgttgagtttgagatgccagttttccgtcactccttagttaaaatcttccaatggcttccatcaggcttggagtaaaatttaaagtctaccatgaccacatgaccttgcgtgatgtgactcctgctgaccaccttgtcccacaacaccctggccactccgacttcctttctgttctgccagcaggaaaagctcactttctgctttattgagaattaytatattggctgtctcctctgccgtccccattccttcaactctcatcttttgcctagctggcctcttcgaattcttcaggttgaaactcagattctgccttctcagagagaacatccctcaacttcctagctaaagagatcctgcctcttcactctctggaattatattgtttgtttgtttgtttatttatttatttttaagacaggatctcactctgtcacccaggctggcgtgcagtgcacagtcacagctcactgcggacttgacctctcaggctcaagcaatccttccaccttgtcc

SEQ ID NO: 127673 - DNA, 601 bp, Human
ctaactgaaggatgaagttgctgtcaatggagatggggaagatggaggaagaaggtttcaaagatcaagaactgggttgtagacatgttgagtttgagatgccagttttccgtcactccttagttaaaatcttccaatggcttccatcaggcttggagtaaaatttaaagtctaccatgaccacatgaccttgcgtgatgtgactcctgctgaccaccttgtcccacaacaccctggccactccgacttcctttctgttctgccagcaggaaaagctcactttctgctttattgagaattwctatattggctgtctcctctgccgtccccattccttcaactctcatcttttgcctagctggcctcttcgaattcttcaggttgaaactcagattctgccttctcagagagaacatccctcaacttcctagctaaagagatcctgcctcttcactctctggaattatattgtttgtttgtttgtttatttatttatttttaagacaggatctcactctgtcacccaggctggcgtgcagtgcacagtcacagctcactgcggacttgacctctcaggctcaagcaatccttccaccttgtc

SEQ ID NO: 127674 - DNA, 601 bp, Human
tgtgccagatattcagagagtgcctaaagatgctaccaaggacaaagcaatagtgggaaaagatatagtatgtcagacggtgtgaagtgctatggagaacaatatggcagcccctagggcttccaatggaaagactgagtgtggagcaggagagaggtatcaagggtgactccagggttttggcctgagctaactgaaggatgaagttgctgtcaatggagatggggaagatggaggaagaaggtttcaaagatcaagaactgggttgtagacatgttgagtttgagatgccagttttccrtcactccttagttaaaatcttccaatggcttccatcaggcttggagtaaaatttaaagtctaccatgaccacatgaccttgcgtgatgtgactcctgctgaccaccttgtcccacaacaccctggccactccgacttcctttctgttctgccagcaggaaaagctcactttctgctttattgagaattactatattggctgtctcctctgccgtccccattccttcaactctcatcttttgcctagctggcctcttcgaattcttcaggttgaaactcagattctgccttctcagagaga

SEQ ID NO: 127675 - DNA, 601 bp, Human
gcatgagccactatgcccagcctgaagcattctaagaagatcgtagacctgctgggcacaaaagctcctgcctgtaatctcagctactcgggaggctgaggcaggaggatcgcttgaggccaggagttccagaccagcctgagcaacatggcaagaccttgtcgctattaaaaaaaataataacaattaaaaaaatgggcggggcattgtggtgtgtgcctgtaatcccagctactcgggaggctgttggtgggaggaccacttaagtttgggattttgaggctgcagtgagctgtgatcrtgccactgcattccaggctggaagacagagcgagaccctgtatcttaagagataaaagatattttgcacatggttttccttggaatctggtcaatattctacactttcatgtgtttcaactgaagtgctcaaaggccacatgtggccagcggtgactgtatcaaacagcacaagtgcagagaaatagacatttgaataaagactgggagaaagcaagggaagcaagagagtgagccatatgaatatgtcagggaaaactctaggcaaatggaacagccggtgcaaaggtccagctggtgc

SEQ ID NO: 127676 - DNA, 601 bp, Human
tgcctgctttggcctcccaaagtgctggtatttgaggcatgagccactatgcccagcctgaagcattctaagaagatcgtagacctgctgggcacaaaagctcctgcctgtaatctcagctactcgggaggctgaggcaggaggatcgcttgaggccaggagttccagaccagcctgagcaacatggcaagaccttgtcgctattaaaaaaaataataacaattaaaaaaatgggcggggcattgtggtgtgtgcctgtaatcccagctactcgggaggctgttggtgggaggaccacttragtttgggattttgaggctgcagtgagctgtgatcatgccactgcattccaggctggaagacagagcgagaccctgtatcttaagagataaaagatattttgcacatggttttccttggaatctggtcaatattctacactttcatgtgtttcaactgaagtgctcaaaggccacatgtggccagcggtgactgtatcaaacagcacaagtgcagagaaatagacatttgaataaagactgggagaaagcaagggaagcaagagagtgagccatatgaatatgtcagggaaaactctagg

SEQ ID NO: 127677 - DNA, 601 bp, Human
cccccgcctcccaggttcaagcaattctcgtgcctcagcctcccgagtagctgggcttataggtgtgcaccaccacacccggctatttttttgtatttttcatagagacggggtttcaccatgttggctgggctggttttgaactcctgacctcaagtgatccacccaccttggcctcacaaactgttgggattacaggcatgagccactgtgcccagccttttttttttttttttttaatttttgttgagagatacggtctcactctgtcccccaggctagagtgcagtggtgtgatcayagctcactgcagtctcaatctctcaggctcaagtgagcctcccacctcagcctctcatgtagctgggaccacaggcatgcgtcaccatacccagctatttttaaaaagaatttttttgtagaaacggggtctcactttgttgcctggtttcaaatccctgggctcaagcaatcctcctgccttggcctcccaaagtgttgggattacaagccactgtgctcagccttgatggattttaaaattaaggtatgtacatttttttttagacataatgctatcatgcacttaacagactatagt

SEQ ID NO: 127678 - DNA, 601 bp, Human
agcccatggatcaagaagtaattctctatttcaagtcttatgatttaagggatacatttcataaggctatagctgccatagataaattcctttgatgcatctgggcaaaggaaattgaaaactttctgaaaagcattcaccattctagataccattaggaacatttgtggctgttccagtggctcatgcctgtaatcccagcacttagggagatcaaggcaggaggatcacttgaggccaagagttcaagaccagtctgggcaacatagtgagacctcaactcaattaaaaataaaaaaamaatccacaacaaacaaacaacaaaaagaacatttgtgattcgtgggaacaggtcaaaatatcaacattaataggaattttgaggaagtcaattccgatcctcatggatgactttgaggagttcaagacttcactggaggaagacactgcagaagtgatggaactagcaagagaactagagttagaagtggagcctgaagatgtgactgaattgctgcagcctcatgatcaaacttcaatgcatgaggcgttacttgttatggaagagcaaagaaagtgatttcttgagatggattctact

SEQ ID NO: 127679 - DNA, 601 bp, Human
tttatattacatatatgttatatatataatttatattacatataacatgttatatatatatatgtattttagatgaagtcgcactcttgttgcccaggctggagtgcaatggcacgacctcagctcactgcaacctctgactcccaggttcaagcgattctcctgcctcagcctccagggtagctgggattacaggcacctgctaccatgcctggctaatttttttgtatttttagtagagttggggtttcaccatgttggccaggctggtcttgaactcccgacctcaggtgatccacaygcctcggcctcccaaagtggtgggattacaggtgcgagccactgtacccagccagaaaaaagatttctttcaaaatattactgctgacaatgcactggttatccaggacctctaatgggcatgtacaagaagatgaatgttgtttttatgacttctaacacaacatttttttttttttttgagacagagtctcactctgtcgctgcagtggtgtgatcttggctcactgcaacctctgtcttcaagagggttcaagcaattctcctgcctcagcctcccaagtggctgggattacagtca

SEQ ID NO: 127680 - DNA, 601 bp, Human
atgttatatatgatacactacacataatatatgttatatatgatacactacacataatatatgttacatatgatacactacacataatatatgttatatatgatatatataacacaatatgttatatgtgacatatataacacataatatatgtgacatatatacacataatatatgttatgtgtgatatataacacatgttatatgtgatatataacacatatgttatatgtgatatatataacacatgatatatgttatatgtgatatataatttatattacatatatgttatatataaaatttatattacatataacatgttatatatatatatgtattttagatgaagtcgcactcttgttgcccaggctggagtgcaatggcacgacctcagctcactgcaacctctgactcccaggttcaagcgattctcctgcctcagcctccagggtagctgggattacaggcacctgctaccatgcctggctaatttttttgtatttttagtagagttggggtttcaccatgttggccaggctggtcttgaactcccgacctcaggtgatccacacgcctcggcctcccaaagtggtgggat

SEQ ID NO: 127681 - DNA, 601 bp, Human
cactgttgagatctactcagaaaaaaatatatatataatatataacacataatatatgttatatataacatatgagatatataacacataatatatgttatatataacacactacacatatgttatatatgatacactacacataatatatgttatatatgatacactacacataatatatgttacatatgatacactacacataatatatgttatatatgatatatataacacaatatgttatatgtgacatatataacacataatatatgtgacatatatacacataatatatgttatrtgtgatatataacacatgttatatgtgatatataacacatatgttatatgtgatatatataacacatgatatatgttatatgtgatatataatttatattacatatatgttatatatataatttatattacatataacatgttatatatatatatgtattttagatgaagtcgcactcttgttgcccaggctggagtgcaatggcacgacctcagctcactgcaacctctgactcccaggttcaagcgattctcctgcctcagcctccagggtagctgggattacaggcacctgctacca

SEQ ID NO: 127682 - DNA, 601 bp, Human
ttgtgctttgctttattgcaatttgtagatattgtgtttcttacaaattgaagatttgtggcaaccctgtgtcaaggaggtctatcagggccattttttttccaacagcgtgtgctcactttgcgtctctgtgtcacactctggtaattcttacggtatttcaaacttttacataattattacatctgttatggtggtctgtgatcagtgatctttgatgtgactatagtcattgtttgggggtgccacgaaccacatccatagaagatggcaaacttgatcgataaatattgtgtgtgtyctgactgctctaccaactggccatttccccatctctcccgctttccttgggccttcctattccccgagacataacaatattgaaattaggtcagtgtataactgtacaatggcctttaagtgctcaagtgaaaagaagagttgcacgtctctcactttaaattaaaagctagaaatgattaaacacagtgaggaaggcgtgtcaaaagctgagatagggccagggatggtggctcatgcctgtaatccgagcattttgggaggctgaggtgagaggatggcttgagcctaggagtttgag

SEQ ID NO: 127683 - DNA, 601 bp, Human
tctcaagattacccctagaggagagatgggcatattaggttgggctgaccttttccaccatccacaagtgggcgtctgagcgtatcctatgtgctgggtagagtgacatatgagactatccctgccccatggagctgatgcagaagagaagtggttaagaaaaacatgcacacaatgagtgaatctgttgcaggtgtgatgccttctcagctaggaagacaatggctttgaggggcacacagcaggtcgtgttaactagtccagggcctgggataccccctacttcaagtcaagttcccayagatgagggggagaaatctggccagtggggaaagaactttccaggctgagagtggccatgacagagagcttgggactgaaagagggcttggcaaattcaagaaatgacatggtgtcaccactgggatttggatggtgaggttcaagcagcaagtcatgaagccagagtaggcaggggccatgacatacaactttacaaaaaatgaatttatttatttttatttttggagacagggacttattctgtcacccaggcttgagtatagtggtgcaacaacagctcactgcagcctcaacctcc

SEQ ID NO: 127684 - DNA, 601 bp, Human
gaaatgctgaataccagagggtctgtggttaatggaaggttggtcacagcaaataacttggggatttttcagtttatttttattttagacatggggtcttgctctgatgcccaggctggaatgcagtggtgcaatcatagctcgctacagcattgaactcctgggctcaagcaatcctcctgccttagcctactgagtagctgggattacaggtgggaaccaccacatctggcttgatttttcagttttatccaggggcttgggtcttaacacttcagtctgtggccaactggtatctgtwcctcttgccttagggctgtctccaaatctggggcaggcccagggaatgaactttaagggagcagccctcaaccaaagattgctgggagttggtggatcaataccgcagctccctcacccttcattctggatcacttaagaggtgagttccacgtgggctcccagtaggacggagctcagttgcctacaggacaactcacccttccttgccccacctcccctctccttctccaacccttctggggtcacctctcagatgaactacttgcacaaggattgccctaaattcttgtttcaggat

SEQ ID NO: 127685 - DNA, 601 bp, Human
ctggctagaaggcagctacagaccccaagcctctggtcaaaaagagtcccttttgtaaatgcaagttagtaaggatgatagcagtaggtgggatgaggcttccatagaaaccctccgagcaagaccctgtcatgagacctcatttgtaaaagtattgctgttgaaacacagggtcccacctggccctgtttcctgaacatgtccatttcagagctaagtgatgtacagtgcgtggtcaaggcacaatacaataaaagagactgtcatcagaacttcatataatggacaagaaatgctgaayaccagagggtctgtggttaatggaaggttggtcacagcaaataacttggggatttttcagtttatttttattttagacatggggtcttgctctgatgcccaggctggaatgcagtggtgcaatcatagctcgctacagcattgaactcctgggctcaagcaatcctcctgccttagcctactgagtagctgggattacaggtgggaaccaccacatctggcttgatttttcagttttatccaggggcttgggtcttaacacttcagtctgtggccaactggtatctgtacctcttgcctt

SEQ ID NO: 127686 - DNA, 601 bp, Human
atgctaacctattcagaaataaataagaaaacaaaaaaatgggtgtgatcctgcttgtgtggaccagccagcatcagctggctagaaggcagctacagaccccaagcctctggtcaaaaagagtcccttttgtaaatgcaagttagtaaggatgatagcagtaggtgggatgaggcttccatagaaaccctccgagcaagaccctgtcatgagacctcatttgtaaaagtattgctgttgaaacacagggtcccacctggccctgtttcctgaacatgtccatttcagagctaagtgatgyacagtgcgtggtcaaggcacaatacaataaaagagactgtcatcagaacttcatataatggacaagaaatgctgaataccagagggtctgtggttaatggaaggttggtcacagcaaataacttggggatttttcagtttatttttattttagacatggggtcttgctctgatgcccaggctggaatgcagtggtgcaatcatagctcgctacagcattgaactcctgggctcaagcaatcctcctgccttagcctactgagtagctgggattacaggtgggaaccaccacatctggctt

SEQ ID NO: 127687 - DNA, 601 bp, Human
tcggtctcccaaagtgctgggattccaggtgtgagccactgtgcccagtcaacctggctaatttctaaaaaaaaaaaaaaaatttgtagatattggcgggggggtgggggtggtgttcctcacaatgttgcccaggctggtctcgaacttgtggcctcaagtgatcctcccaaagtgctggaattacaggcatgagccaccatgcctggctaaattattattattaaccaagacaagaagatagaaaaaggacagccctgttttatttttgctttttacatttttttttggctcaacctayacttaatcttgaccctgcatatggcagccacccttaaacggggactagatgtatctgtggagaatgagaaagcagcaaggaatgagtatgaattttagagctcattactgtccactctaagaattcaggtgagtaatttaacctccttaagcctcaaccgtctcatctgtaaaatgggtgttcgctgggtgactgtgaggatgaaataaggtaattcatgtaaagtccttctgtagtgccctgcacgcagcaggcactcattaaatgggaatggtcattgccaccagtggtacggcccag

SEQ ID NO: 127688 - DNA, 601 bp, Human
gtggcgtgatttcagctcactgcaacctccgccccccgggttcaagtgattctcctgcctcagcctcccgagtagctgggattatagatgcccgccaccacgcccggctaagttttgtatttttagtagagacggggtttccccattttggccaggcaggtctcgaactcctgacctcaggtgatccacccatccaccttggcctcccaaagtgctaggattataggcatgagccactgcacccagcctataaattgtttgtttttaaactttttgttgtctgtttttttgagacaaggtytcactctgttgtccaggctggagtgcagtggtgctatcacagctcactgcagccttgacctcctgggctcagatcctcctgcctcagccttttaagtagctgggactacaggtgtgcaccatcatgcctgctaatttttttttttttttgagacagggtttcgccatgttgcccaggctggtcttaaaactcctgagctcgctctatctgcccgcttcggtctcccaaagtgctgggattccaggtgtgagccactgtgcccagtcaacctggctaatttctaaaaaaaaaaaaaaaatt

SEQ ID NO: 127689 - DNA, 601 bp, Human
tcaaataaatctatatatatattttatagagacagggtctcactatgttatccaggctggtctcgaactcctgacctcaagcgatcttccagcctctgcctcccaaagttctgggattacaggcatgagccacagagcccagccaactttaaagtacttaataaaggtatttgacatgctgttccatttgatgatcttttgggcaagaaaggggtgggagtccattgcttttggagccatattcctgggtgttgggcaacttgcacccagaagagggagccattttcttaattttttttttctgccaagaggcggtgtcttttcctcattcataaaaggccgccatataggctagttgctgctctgggtaggaaagcggttggcggtcccaatttcaaccccaaggaaccagactcaacattatttcactggcttctagtgacaagcccctgaggtggccatacatgtaaagtcactctcattttacagaagtgggaagcaaggctaacagagatgctgtgattcacccagagaatgcatgagaaatggcagaactaggcagggcgcggcggcggttcacgcctctaatcccagcactttg

SEQ ID NO: 127690 - DNA, 601 bp, Human
cttccaaagttctgggattacagacgtgagtctccacgcctggccttattattttttaaaaagcacttttaactttaaagtatttatttatttatttattttaattagccaggcatgatggtgcatgcctgtagtcctagctactctagggactgaggcaggaggatcgttaaggctgcagtgagctatgattgtgccactgcgccccagcctgagtggcagagcaagacgctgtctcaaataaatctatatatatattttatagagacagggtctcactatgttatccaggctggtctcraactcctgacctcaagcgatcttccagcctctgcctcccaaagttctgggattacaggcatgagccacagagcccagccaactttaaagtacttaataaaggtatttgacatgctgttccatttgatgatcttttgggcaagaaaggggtgggagtccattgcttttggagccatattcctgggtgttgggcaacttgcacccagaagagggagccattttcttaattttttttttctgccaagaggcggtgtcttttcctcattcataaaaggccgccatataggctagttgctgctct

SEQ ID NO: 127691 - DNA, 601 bp, Human
caaaaataaggattgcaaaaaataggaggaggccgatctgcagcaaagggatcatcgccttcatgatcgacttcaggacgacttgtaaacctggggggacacagagagaggccccataagcccatgagcaagtacccccaaaccccgccaccaagacgcccaggtctctcccagacaaagcaggtgtgttcctgagggaacattaagcacccaggagcctggggattgggcaatggtgaaggaagcaccacacggaggctgatccttatcatgggaacaacacttcctaggttttttttttcctttgagacagggttttgcactgctgcccaggctggagtgcagtggcacaatcacagctcactgcagcctcaacctcctgggctcaggtgatcctcctgcctcagtccctgcaatagctaggactacaggcatgcaccaccatgcctggctaagttttaaaacttgtttgtagagatggggtcttgctatgttgcccaggctggcctgaaacccctggtctccaaggactcaaactcctcagcctcctaaagtgctaggattataggtgtgagccaccatacctggcccctattattat

SEQ ID NO: 127692 - DNA, 601 bp, Human
gatttttccaagaggccctgccccatattcattctctctctctctctctctctctcgcatttccgcctgggtgacgaggccaggagcagaaatagctctgcctcaattaacaccttcttcatcggggaaagaaataattaggacattccatattgagcaaacttcacaagcccaggagagaaagagacaggaggagcaagagaaaaagaggaaaaaaaaaaccaacaaaccaaaacccacaaaaaaacccaaacctccaaccattgcaaataaaccttccccagtgggttttccctccccstggggaggagtggggagggagggctcaggggctgcctctgcggatccacttgggggtcactgggtggagagggtgggtggaaatccactcccagacagaatcttcttctgtggctgcctttcccaaataaggggcctgaaacctctttctctgcccacctgggttcccctttgggcttcttgattccttctatccactccttcaattcacagctcccttgacccaaatcatcagaaccagaactgctattcagtctgtctgcacccagatggccagtggtccaaatactgaaatactgaa

SEQ ID NO: 127693 - DNA, 601 bp, Human
ctagggtagaaaaacataaaataaaacttcacagaaacctaggatccaggagtcctggtttctctgctcacggctgatttttccaagaggccctgccccatattcattctctctctctctctctctctctcgcatttccgcctgggtgacgaggccaggagcagaaatagctctgcctcaattaacaccttcttcatcggggaaagaaataattaggacattccatattgagcaaacttcacaagcccaggagagaaagagacaggaggagcaagagaaaaagaggaaaaaaaaaaccaamaaaccaaaacccacaaaaaaacccaaacctccaaccattgcaaataaaccttccccagtgggttttccctccccgtggggaggagtggggagggagggctcaggggctgcctctgcggatccacttgggggtcactgggtggagagggtgggtggaaatccactcccagacagaatcttcttctgtggctgcctttcccaaataaggggcctgaaacctctttctctgcccacctgggttcccctttgggcttcttgattccttctatccactccttcaattcacagctcccttgaccca

SEQ ID NO: 127694 - DNA, 601 bp, Human
agtctagggtagaaaaacataaaataaaacttcacagaaacctaggatccaggagtcctggtttctctgctcacggctgatttttccaagaggccctgccccatattcattctctctctctctctctctctctcgcatttccgcctgggtgacgaggccaggagcagaaatagctctgcctcaattaacaccttcttcatcggggaaagaaataattaggacattccatattgagcaaacttcacaagcccaggagagaaagagacaggaggagcaagagaaaaagaggaaaaaaaaaacmaacaaaccaaaacccacaaaaaaacccaaacctccaaccattgcaaataaaccttccccagtgggttttccctccccgtggggaggagtggggagggagggctcaggggctgcctctgcggatccacttgggggtcactgggtggagagggtgggtggaaatccactcccagacagaatcttcttctgtggctgcctttcccaaataaggggcctgaaacctctttctctgcccacctgggttcccctttgggcttcttgattccttctatccactccttcaattcacagctcccttgac

SEQ ID NO: 127695 - DNA, 601 bp, Human
tagtctagggtagaaaaacataaaataaaacttcacagaaacctaggatccaggagtcctggtttctctgctcacggctgatttttccaagaggccctgccccatattcattctctctctctctctctctctctcgcatttccgcctgggtgacgaggccaggagcagaaatagctctgcctcaattaacaccttcttcatcggggaaagaaataattaggacattccatattgagcaaacttcacaagcccaggagagaaagagacaggaggagcaagagaaaaagaggaaaaaaaaaaccaacaaaccaaaacccacaaaaaaacccaaacctccaaccattgcaaataaaccttccccagtgggttttccctccccgtggggaggagtggggagggagggctcaggggctgcctctgcggatccacttgggggtcactgggtggagagggtgggtggaaatccactcccagacagaatcttcttctgtggctgcctttcccaaataaggggcctgaaacctctttctctgcccacctgggttcccctttgggcttcttgattccttctatccactccttcaattcacagctcccttga

SEQ ID NO: 127696 - DNA, 601 bp, Human
aaatcgaggcttcctcccctctggtggcaccacccacatctgtcccctcaaaaccccactcggacccaagccaaccccatggcctcttctcctttagctagtctagggtagaaaaacataaaataaaacttcacagaaacctaggatccaggagtcctggtttctctgctcacggctgatttttccaagaggccctgccccatattcattctctctctctctctctctctctcgcatttccgcctgggtgacgaggccaggagcagaaatagctctgcctcaattaacaccttcttcatcrgggaaagaaataattaggacattccatattgagcaaacttcacaagcccaggagagaaagagacaggaggagcaagagaaaaagaggaaaaaaaaaaccaacaaaccaaaacccacaaaaaaacccaaacctccaaccattgcaaataaaccttccccagtgggttttccctccccgtggggaggagtggggagggagggctcaggggctgcctctgcggatccacttgggggtcactgggtggagagggtgggtggaaatccactcccagacagaatcttcttctgtggctgcctttcc

SEQ ID NO: 127697 - DNA, 601 bp, Human
gtagcgtgatctcggctcactgtaacctctatgtcccaggttcaagtgattctcctgcctcagcctctcaagtatgtggtactacaggcacacgccaccatgcccggctaatttattttttttgtatttttagtagagacggggtttcactatgttggccaggctggtcttgaactcctgaccttttgatccgcctgcctcggcctcccaaagtgctgggattacaggcgtgagccactgcacccggccaatttttaaatttttattttagcagagacagggtctggctatgttgcctagrctggtctcaaactaacggcctcaagggatactcccacctcagcctctcaaagtgctgggattacaggtgtgagccactgcacctggcccctttcaggcatacaatagctactgaattttcatatttaggggggcgtgggtataatcacacattagccttcactgttaaaaatggctgcaaatgaggggtcttgtttcctctaactattttggaagctcttagaaagcaggaagccttccactttatctttgcttccttctaagcgattggcacggtgctgggcacacaggaactgggctc

SEQ ID NO: 127698 - DNA, 601 bp, Human
tttgagacaaaatctcactctgttgcccaagctggagtgcagtagcgtgatctcggctcactgtaacctctatgtcccaggttcaagtgattctcctgcctcagcctctcaagtatgtggtactacaggcacacgccaccatgcccggctaatttattttttttgtatttttagtagagacggggtttcactatgttggccaggctggtcttgaactcctgaccttttgatccgcctgcctcggcctcccaaagtgctgggattacaggcgtgagccactgcacccggccaatttttaaayttttattttagcagagacagggtctggctatgttgcctaggctggtctcaaactaacggcctcaagggatactcccacctcagcctctcaaagtgctgggattacaggtgtgagccactgcacctggcccctttcaggcatacaatagctactgaattttcatatttaggggggcgtgggtataatcacacattagccttcactgttaaaaatggctgcaaatgaggggtcttgtttcctctaactattttggaagctcttagaaagcaggaagccttccactttatctttgcttccttc

SEQ ID NO: 127699 - DNA, 601 bp, Human
ctctctttttttttttttttttgagacagggtctcactttgtcacccaggctggagtgcgggcaccatcatagcttactgcagccttgcagcctccaattcctgggctcaagtgatccttcttcctcagcctcctgagtagctaggactataggcatgtaccaccactcatggctaatttttaaatttttttattttgagacaaaatctcactctgttgcccaagctggagtgcagtagcgtgatctcggctcactgtaacctctatgtcccaggttcaagtgattctcctgcctcagccactcaagtatgtggtactacaggcacacgccaccatgcccggctaatttattttttttgtatttttagtagagacggggtttcactatgttggccaggctggtcttgaactcctgaccttttgatccgcctgcctcggcctcccaaagtgctgggattacaggcgtgagccactgcacccggccaatttttaaatttttattttagcagagacagggtctggctatgttgcctaggctggtctcaaactaacggcctcaagggatactcccacctcagcctctcaaagtgctgggattaca

SEQ ID NO: 127700 - DNA, 601 bp, Human
agaggagacctccactggtcaacagagctgtgtgtatggagcagccccagggtgctctatggggtcactacagttgtggcatccttgtgtttgatcctgaatccttggctctgccccactccagctgctgacaagtgacctgcctggggactgcttacctgcatagtaggtgagggaaggtgaactgtggtgaggacagagtggggtttaaaacttgcacacctaaatatctatcaaaattataaatgcatttaggctgggtgcagtggctcacacctgtaatcctagcactttgggaggytgaggcaggaggattgcttgaggccaggagtctgagagcagcctgggaaacatagtgagaccccatctctataaaattgttcttaaaaattagctaggtatggtggtgtgtgcctgtggtcccagctactcaggaggctggggtgggaggatcacctgagcccaggagtttaaggctgcagtgagctatgattacaccactgcgctccagcctggacgacagagggagaccttgtctccaaaaaaacaaaacaaaaatcttccccaaaaataaaattataaatgcatttagtctttgatc

SEQ ID NO: 127701 - DNA, 601 bp, Human
cacgcccccagcatcttaatctgaacccccagacgctttctctggtcatccaaccctgtgacatatcccttttttatgctcacaatttttttcagctcccattccccactcccattctctccctgagttcccagccttctccatttcccagtctctttccctctcaggagggttcatttcctgctggaacctcctctcacaccagccttgcaaagtaaaaacctagaacccacaaaaattccccagtgagttttggccaattgggctgaccctttgtccaagctgtttgcaggtgacggccaagagagggcctgagctcggatctgctgcatgttcccagagatgctacactcagacgaggttttcatgcaaattagaacaccatgtcccttccccacatccttttttctgtcaataaattatcaggataacagtagaaatcgtatgttgtctatgatatgaatgacattcttgtgcagtgcgtgacaggcgcaactgttcatgtggctccttttgctgcctactcccaactaaaacgggcctttgttgatcaggattacaaggatgagtttttgcaaatctccctccacccacaagtggg

SEQ ID NO: 127702 - DNA, 601 bp, Human
tgatgtttataaccgagccctctggaaattcatgcttcctgtcccaccactgggcacgcccccagcatcttaatctgaacccccagacgctttctctggtcatccaaccctgtgacatatcccttttttatgctcacaatttttttcagctcccattccccactcccattctctccctgagttcccagccttctccatttcccagtctctttccctctcaggagggttcatttcctgctggaacctcctctcacaccagccttgcaaagtaaaaacctagaacccacaaaaattccccagygagttttggccaattgggctgaccctttgtccaagctgtttgcaggtgacggccaagagagggcctgagctcggatctgctgcatgttcccagagatgctacactcagacgaggttttcatgcaaattagaacaccatgtcccttccccacatccttttttctgtcaataaattatcaggataacagtagaaatcgtatgttgtctatgatatgaatgacattcttgtgcagtgcgtgacaggcgcaactgttcatgtggctccttttgctgcctactcccaactaaaacgggcctttgt

SEQ ID NO: 127703 - DNA, 601 bp, Human
ggctggtcttgaactccttgtctcaaacaatcctcccacctcagcttcctaagtagctgggattacagatgtgagccaccaaggctggccatttattattgatgtatcaatcaatcaatcaatgatttattttagtgtgactctctcgacagattatgtaagataaggacacctaggacactgtttgcctaagaaaggttcattctcctccctttctccctgcctcctggtctaggaatgacccgagaccttcttctttctccccgctaaccatttagcaagacaagtttaattggctcamgccaatttgggaggctgaggttggtggatcacttgaacttacgagttcgagaccagcctggccaacatgatgaaaccccatttttactaaaaatacaaaaaattagctgaccatgctggtgcatgcctatagtcccagctacttgggaggaagaggtaggagaattgcttgaaccccagaggtgagccaagtgagccaagatcgcaccactgcactccagcctgggcaacagagtgagactccatctcaaaaaaaaaaaaaaaaagtaaactgtgatcatcatagagaaatttgaagata

SEQ ID NO: 127704 - DNA, 601 bp, Human
ttttgagatgtagttttgctcttgttgcccaggctggagtgtaatggcgtgatctcagctcactgcaacctctgtttcccaggttcatatgattcttctgcctcagcctcctgcgtagctgggactacaggcgtgtgccaccacgcctggctaatttttgtatttttagtagagacggggtttcaccctgttggccaggctggtctcgaattcctgacctcgtgatccacccgcctcggcctcccaaagtgctgggattacaggcgtgagccaccgcatctggctaattaaaaaaaaaaawttttttaagatgagtcttgctgtgtttcccaggctggtcttgaactccttgtctcaaacaatcctcccacctcagcttcctaagtagctgggattacagatgtgagccaccaaggctggccatttattattgatgtatcaatcaatcaatcaatgatttattttagtgtgactctctcgacagattatgtaagataaggacacctaggacactgtttgcctaagaaaggttcattctcctccctttctccctgcctcctggtctaggaatgacccgagaccttcttctttctccccgcta

SEQ ID NO: 127705 - DNA, 601 bp, Human
catgagctcaggagatcgagaccatcctggccaacatggtgaaaccccgtctttactaaaatacaaaaaattagctgggcgtgttggtgcatgcctgtagtcccagctactcaggaggctgaggcaggggaatcacttgaacctgggagtcagaggctgcagtgagccgagatcacgccactgtactccagcctggcgacagagcaagactccatctcaaaacaaaacaaaaccccccaaaattagctgggtgtggtggcacgcacctgtaatcccagctacttgggaggttgaggcacargaatcgcttgaacccaggagatggaggttgtagtgagccgagattgcgccactgcactctagcctgggtgacagagtgagacgctgtctcaaaaaaaaaaaaaaaaaaaaaagagagacaaagagagagagggaaaaagaaagagtcagagagagacggatgaagggtgatgaattgtgtccagagctgtgtgtgaaccctggctttgtcactcttggctaggggaccttggcaggtcacgtcaccctgtgggcctccgtttcctcatctggaagatggggttaaaaatatctttcctca

SEQ ID NO: 127706 - DNA, 601 bp, Human
aaagtctaatgctttgattttggtcaagacaaacatctatgaatgaaaaagggcatgggtcaaaggtgattccaaacattagcaaccactggccaggggacacgcatttatttatttatttatttttaattattaggttttttttgagacagggtctggttctgtcacccaggctggagtgcaggggtgtaatcacagctcggtgcagcttcaaacccttgggctcaggcaatcctccttcctcagcctcccgagtagctgggactacaggtacacaccaccatgcccagctaattaattwtttttcttttttaaagatggggtcttgctttttgaccaggctggttttgaactcccggtctcaagcaatcttcctgcctcagcttctcaaagggctgggattccaggcgtgagccaccacgcctggccagggacatgcatttatgatcacaaattaaacgcagtttttctgcttttctaattgacattcaccaaaggagagaaatagagaagaagagaaactcacagagaaaagcacaaagaagggtgaggagaagggagagaaggagaaggaggtggagaaagagaaggaagagagaga

SEQ ID NO: 127707 - DNA, 601 bp, Human
catgctcattcacttacgcgctttatctgtcgttactttcacgctacaggagcagattgagtcgttgcgatggagaccatctggcccacaaagcctaaactatttaatgtctgctgtctgccctttttatcccaactgatcactggctttccccaccaacacgtcaactcctctgtgtccagaagagtgtctgcatacagtaggcattcaatgatggttgttgaatgaaccagtgatttatagtccaaagtctaatgctttgattttggtcaagacaaacatctatgaatgaaaaagggcrtgggtcaaaggtgattccaaacattagcaaccactggccaggggacacgcatttatttatttatttatttttaattattaggttttttttgagacagggtctggttctgtcacccaggctggagtgcaggggtgtaatcacagctcggtgcagcttcaaacccttgggctcaggcaatcctccttcctcagcctcccgagtagctgggactacaggtacacaccaccatgcccagctaattaattatttttcttttttaaagatggggtcttgctttttgaccaggctggttttgaactc

SEQ ID NO: 127708 - DNA, 601 bp, Human
ctctcaagtagctgggcctacaggcatgctccaccatgtccagctaatttttaaatttttttttttgtagagatggggtctcactatgtgcctaggctggtcttaaactctagggctcaagggatcctcctgcctcagcctcccaaagtgttagaattatagatcataatggccacggtgcccggccattcggggtgtataagaagaactgcaacctctcatcttgacaatgcacaaactctctactgttttattctatcccggacctctcaccaccctctaacactatctctaaggcagygatccacaaactacagcccgcgggccagccacctgtttttataggttaacgtttaattggcccacagccatgctcattcacttacgcgctttatctgtcgttactttcacgctacaggagcagattgagtcgttgcgatggagaccatctggcccacaaagcctaaactatttaatgtctgctgtctgccctttttatcccaactgatcactggctttccccaccaacacgtcaactcctctgtgtccagaagagtgtctgcatacagtaggcattcaatgatggttgttgaatgaacca

SEQ ID NO: 127709 - DNA, 601 bp, Human
gctcactgcagccccaacctcccaggctcaagcagtcctcccatctcagcctctcaagtagctgggcctacaggcatgctccaccatgtccagctaatttttaaatttttttttttgtagagatggggtctcactatgtgcctaggctggtcttaaactctagggctcaagggatcctcctgcctcagcctcccaaagtgttagaattatagatcataatggccacggtgcccggccattcggggtgtataagaagaactgcaacctctcatcttgacaatgcacaaactctctactgttytattctatcccggacctctcaccaccctctaacactatctctaaggcagtgatccacaaactacagcccgcgggccagccacctgtttttataggttaacgtttaattggcccacagccatgctcattcacttacgcgctttatctgtcgttactttcacgctacaggagcagattgagtcgttgcgatggagaccatctggcccacaaagcctaaactatttaatgtctgctgtctgccctttttatcccaactgatcactggctttccccaccaacacgtcaactcctctgtgtccag

SEQ ID NO: 127710 - DNA, 601 bp, Human
tctgtctcctgggttcaagcaattcttgtgcctcagcctcccaagtagctgggactacaggcgcctgccaccatgcccagctaattttttgtattttagtagagacggggtttcaccatgtagcctagggtggtcttgcactcctgagctcaggcaatctgcctgccttggcctcccaatgtgctaggattacaggcatgagccaccgtgccaggctgatagatgtatatattttttggatacatgtgatactttaatgcattcatatgatttgttccttcaggtctgttttttttgtttktttgttttttttttttgagacagttcttgctctgtcatccgggctggagtgcagtggcatgatcggctcactgcagccccaacctcccaggctcaagcagtcctcccatctcagcctctcaagtagctgggcctacaggcatgctccaccatgtccagctaatttttaaatttttttttttgtagagatggggtctcactatgtgcctaggctggtcttaaactctagggctcaagggatcctcctgcctcagcctcccaaagtgttagaattatagatcataatggccacggtgcccgg

SEQ ID NO: 127711 - DNA, 601 bp, Human
tggatggagaaactgaagctgagagaggcaacatgatgtgcctggatcacacagggtgcagatggcatgggtgggactagacccgtcattctggcctttacaaccaactgattttttcccacttcaccccttctccgtacttgcatagtattttaagtaaataacaatgggcccaagagagcttcaagggtgagggatgttactgattcatcccagtatcgctggtggtgcctggtgcttagaaagcgctccataaatactcatcaaacaaactaatggctgagtcccagcaaaatccttmagtgccttctgttttacggtttattttcctctaatttttttgagcatggttcattgagaaaaagtatacaggatgttaaaaaaacaaaaacaaaacaaaacaaaaggaaaaaaccccaaaactcagctcaggagaacacccgtttctccagtatatgggataaacatgggggtggatttgagtgtgaaaaagctgaagtctgacagtgaccgtgagagaggctgtgtgtcccactttatacccgttatagatcatgccaggcctgctaattattttttcagtgctctttttcccctttca

SEQ ID NO: 127712 - DNA, 601 bp, Human
gaactcctgggctcaagcaatccgccctcctcagcctcccaaagagttgggattacaggggtgagccaccatgcccagcttggtggatcatttaaataataaacacaggaaatgtgtttatcccaaatccaaatgattaagctatttttctgggaaaggagaggcagaaggcagaattatggtcgcattagccaagtctttttgggctgatgaaatactccccacatcttcctcgattcccgccatctctgtgcctggtggatggagaaactgaagctgagagaggcaacatgatgtgccyggatcacacagggtgcagatggcatgggtgggactagacccgtcattctggcctttacaaccaactgattttttcccacttcaccccttctccgtacttgcatagtattttaagtaaataacaatgggcccaagagagcttcaagggtgagggatgttactgattcatcccagtatcgctggtggtgcctggtgcttagaaagcgctccataaatactcatcaaacaaactaatggctgagtcccagcaaaatccttaagtgccttctgttttacggtttattttcctctaatttttttg

SEQ ID NO: 127713 - DNA, 601 bp, Human
cctcggcctcccaagtagctgggattacaggcacgcaccaccacgctcagctaatttttttgtatttttttagtaaagatggggtttcgccatgttggccaggctggtcttgaactcctgggctcaagcaatccgccctcctcagcctcccaaagagttgggattacaggggtgagccaccatgcccagcttggtggatcatttaaataataaacacaggaaatgtgtttatcccaaatccaaatgattaagctatttttctgggaaaggagaggcagaaggcagaattatggtcgcattwgccaagtctttttgggctgatgaaatactccccacatcttcctcgattcccgccatctctgtgcctggtggatggagaaactgaagctgagagaggcaacatgatgtgcctggatcacacagggtgcagatggcatgggtgggactagacccgtcattctggcctttacaaccaactgattttttcccacttcaccccttctccgtacttgcatagtattttaagtaaataacaatgggcccaagagagcttcaagggtgagggatgttactgattcatcccagtatcgctggtggtgcc

SEQ ID NO: 127714 - DNA, 601 bp, Human
atcccagtgtccagatcagcaccagggacatagtaggtgctcactaagcattagttgcatagtcaatacaaatgttcctggggttcctgttggtggatcatttattttatttatttatttatttatttatttatttatttatttagggacagaatctcactctgtcgcccagactggagtgtgatggcacgatctaggctcactgcaacctctgcctcccaggttcaagtgattcttgtgcctcggcctcccaagtagctgggattacaggcacgcaccaccacgctcagctaatttttttgtatttttttagtaaagatggggtttcgccatgttggccaggctggtcttgaactcctgggctcaagcaatccgccctcctcagcctcccaaagagttgggattacaggggtgagccaccatgcccagcttggtggatcatttaaataataaacacaggaaatgtgtttatcccaaatccaaatgattaagctatttttctgggaaaggagaggcagaaggcagaattatggtcgcattagccaagtctttttgggctgatgaaatactccccacatcttcctcgattcccgccatctct

SEQ ID NO: 127715 - DNA, 601 bp, Human
agcatcttctcagactaccgtgggataaaactagaaatcaataccaagaagaatttcagaaatgatgcaaatatatggatattacgcaacatgctcctgaacaaccattgggtcaatgcagaaattaagatggagacttaaaaaattttggaaatgaatgaaaatagagacacaacacaccaacacctgtgagatgcagcagaagcagtgctgagggaagtttacacttgaccttagctaaagggccaagaagcaactaagagggaagtttatagcatcaaatacctacatcacaaaaaayagaggccagatgttggtggctcacgcctctcatcccagcactttggggggctaaggcaggaggatcgcttgagctaggggtttgagaccagcctgggcaacacagtgagaccccatctctaaaaaataaaaataaaaaaattagctgggtgtggtgctgtgcaccagtagtcccagctactggggatgctgaagtgggaggttcacttgagcctaggaggcagaggttgcagtgagtcaagatcatgctgctgtactccagcctgggcaccacagtgagactctgtctcaaaaaagcaaa

SEQ ID NO: 127716 - DNA, 601 bp, Human
gattagctaggtctcaagtgactgcactgaacagagcccccttcttccccactgccaacctgcactggacatgtagcatgagcaggaaatacatctgttgtcaaaagtcatggaggctttggggatgtttgttactgcagcataacttggctgccctgaccaatacatctttttaattaaatttttatattttgtagagagggggtctctgttgcccaggctggtctcgaactcctgggctcaagtgatcctcctgcttcagcctcccaaagtgctgggatttcaggcatgagccaccacrcccagccagattgatacagtttgatatctctgtagcttgctccttcacctctttctggtctttctttcttttttttctttctttttttttttgagatggggtcttgctctgttgcccaggctggagtgcaatggtgtgatctcagctcactgcaacctccacctcctgggtccaagtgattctctgcctcagcctccagagtagctgggattacaggtgcccgccaccacacctagctaatttttgtattttttaaaatagagacaagatttcaccttgttggtcaggctggtcttgaac

SEQ ID NO: 127717 - DNA, 601 bp, Human
gtgggaccttctagcattccttttttccttctggaatagcaagtggcaatgttctaggtgattagctaggtctcaagtgactgcactgaacagagcccccttcttccccactgccaacctgcactggacatgtagcatgagcaggaaatacatctgttgtcaaaagtcatggaggctttggggatgtttgttactgcagcataacttggctgccctgaccaatacatctttttaattaaatttttatattttgtagagagggggtctctgttgcccaggctggtctcgaactcctgggctyaagtgatcctcctgcttcagcctcccaaagtgctgggatttcaggcatgagccaccacgcccagccagattgatacagtttgatatctctgtagcttgctccttcacctctttctggtctttctttcttttttttctttctttttttttttgagatggggtcttgctctgttgcccaggctggagtgcaatggtgtgatctcagctcactgcaacctccacctcctgggtccaagtgattctctgcctcagcctccagagtagctgggattacaggtgcccgccaccacacctagctaat

SEQ ID NO: 127718 - DNA, 601 bp, Human
ccacctggcttccttgcagtttctcaaccacgccaagcacagtcctacctcggcccttgcacaggctgtccctccctgcctggaatgctctttcctgagattgctacatggtttcccctcacctccttcaggttttttactcaaatgccaccttctgagggaggcctcccctgatggccctttacaattgcatccctcatttctggtccccattgtttcttttttcccatttgcatttcaccgcctatatactttacttatttctcttgttctctcgtcttcctggctggaatgtccattygacaagagggaggggctttgtcctttttgttccctgctgtattcctgtattcccagccccctaggacaacatctggcacacagtcggtgctcaataagtggtgtctgttgaatgactgattgagaggtgtgtccaagttccctgcatagctcagatcgtcaaccccaagccaagctccctcctgaactctcatctgcaccatcctctctggggagtgggcttctgctgcctgattttagagacactttttctcttccaaactcatccaattattcaattccatactctggaatcaacaat

SEQ ID NO: 127719 - DNA, 601 bp, Human
caggaaataaatgaagttactcagttactgaatggcagagggggcctccaaccctcccatctccttgcttttatctcctccccttttccctcgctcattcggttccagccacctggcttccttgcagtttctcaaccacgccaagcacagtcctacctcggcccttgcacaggctgtccctccctgcctggaatgctctttcctgagattgctacatggtttcccctcacctccttcaggttttttactcaaatgccaccttctgagggaggcctcccctgatggccctttacaattgcayccctcatttctggtccccattgtttcttttttcccatttgcatttcaccgcctatatactttacttatttctcttgttctctcgtcttcctggctggaatgtccattcgacaagagggaggggctttgtcctttttgttccctgctgtattcctgtattcccagccccctaggacaacatctggcacacagtcggtgctcaataagtggtgtctgttgaatgactgattgagaggtgtgtccaagttccctgcatagctcagatcgtcaaccccaagccaagctccctcctgaactctca

SEQ ID NO: 127720 - DNA, 601 bp, Human
caagtctcaggaggcaccatggcccagctgacatcttgatggtctgtggcccagctgaccttgatggtctgtggactcctggcctcctgaactgcgagagaataaataaatttctgttgttttcagctactctatttgtggttctttgtggttcaagctacaggaaataaatgaagttactcagttactgaatggcagagggggcctccaaccctcccatctccttgcttttatctcctccccttttccctcgctcattcggttccagccacctggcttccttgcagtttctcaaccacgycaagcacagtcctacctcggcccttgcacaggctgtccctccctgcctggaatgctctttcctgagattgctacatggtttcccctcacctccttcaggttttttactcaaatgccaccttctgagggaggcctcccctgatggccctttacaattgcatccctcatttctggtccccattgtttcttttttcccatttgcatttcaccgcctatatactttacttatttctcttgttctctcgtcttcctggctggaatgtccattcgacaagagggaggggctttgtcctttttgttc

SEQ ID NO: 127721 - DNA, 601 bp, Human
ggatttcagaccaagtctcaggaggcaccatggcccagctgacatcttgatggtctgtggcccagctgaccttgatggtctgtggactcctggcctcctgaactgcgagagaataaataaatttctgttgttttcagctactctatttgtggttctttgtggttcaagctacaggaaataaatgaagttactcagttactgaatggcagagggggcctccaaccctcccatctccttgcttttatctcctccccttttccctcgctcattcggttccagccacctggcttccttgcagttyctcaaccacgccaagcacagtcctacctcggcccttgcacaggctgtccctccctgcctggaatgctctttcctgagattgctacatggtttcccctcacctccttcaggttttttactcaaatgccaccttctgagggaggcctcccctgatggccctttacaattgcatccctcatttctggtccccattgtttcttttttcccatttgcatttcaccgcctatatactttacttatttctcttgttctctcgtcttcctggctggaatgtccattcgacaagagggaggggctttgt

SEQ ID NO: 127722 - DNA, 601 bp, Human
gacaaggaccaccaagcactgttggcaaaccaccagaagctaggagggaggcaagaagggatttcagaccaagtctcaggaggcaccatggcccagctgacatcttgatggtctgtggcccagctgaccttgatggtctgtggactcctggcctcctgaactgcgagagaataaataaatttctgttgttttcagctactctatttgtggttctttgtggttcaagctacaggaaataaatgaagttactcagttactgaatggcagagggggcctccaaccctcccatctccttgctttkatctcctccccttttccctcgctcattcggttccagccacctggcttccttgcagtttctcaaccacgccaagcacagtcctacctcggcccttgcacaggctgtccctccctgcctggaatgctctttcctgagattgctacatggtttcccctcacctccttcaggttttttactcaaatgccaccttctgagggaggcctcccctgatggccctttacaattgcatccctcatttctggtccccattgtttcttttttcccatttgcatttcaccgcctatatactttacttatttc

SEQ ID NO: 127723 - DNA, 601 bp, Human
catgtgaaatggagatgaaggcgggatcagggtgatacgtctacaagacaaggaccaccaagcactgttggcaaaccaccagaagctaggagggaggcaagaagggatttcagaccaagtctcaggaggcaccatggcccagctgacatcttgatggtctgtggcccagctgaccttgatggtctgtggactcctggcctcctgaactgcgagagaataaataaatttctgttgttttcagctactctatttgtggttctttgtggttcaagctacaggaaataaatgaagttactcagtyactgaatggcagagggggcctccaaccctcccatctccttgcttttatctcctccccttttccctcgctcattcggttccagccacctggcttccttgcagtttctcaaccacgccaagcacagtcctacctcggcccttgcacaggctgtccctccctgcctggaatgctctttcctgagattgctacatggtttcccctcacctccttcaggttttttactcaaatgccaccttctgagggaggcctcccctgatggccctttacaattgcatccctcatttctggtccccattgttt

SEQ ID NO: 127724 - DNA, 601 bp, Human
gcctgggagacagagcaagaccctgtgtctaaaataaagaaacaaacaaacaaataagtaaataataagaaaaggagaaacctgggcacagagacaaccttgcacagagggagaaggccatgtgaaatggagatgaaggcgggatcagggtgatacgtctacaagacaaggaccaccaagcactgttggcaaaccaccagaagctaggagggaggcaagaagggatttcagaccaagtctcaggaggcaccatggcccagctgacatcttgatggtctgtggcccagctgaccttgatggtctgtggactcctggcctcctgaactgcgagagaataaataaatttctgttgttttcagctactctatttgtggttctttgtggttcaagctacaggaaataaatgaagttactcagttactgaatggcagagggggcctccaaccctcccatctccttgcttttatctcctccccttttccctcgctcattcggttccagccacctggcttccttgcagtttctcaaccacgccaagcacagtcctacctcggcccttgcacaggctgtccctccctgcctggaatgctctttcctgaga

SEQ ID NO: 127725 - DNA, 601 bp, Human
accactgcactccagcctgggagacagagcaagaccctgtgtctaaaataaagaaacaaacaaacaaataagtaaataataagaaaaggagaaacctgggcacagagacaaccttgcacagagggagaaggccatgtgaaatggagatgaaggcgggatcagggtgatacgtctacaagacaaggaccaccaagcactgttggcaaaccaccagaagctaggagggaggcaagaagggatttcagaccaagtctcaggaggcaccatggcccagctgacatcttgatggtctgtggcccagctgaccttgatggtctgtggactcctggcctcctgaactgcgagagaataaataaatttctgttgttttcagctactctatttgtggttctttgtggttcaagctacaggaaataaatgaagttactcagttactgaatggcagagggggcctccaaccctcccatctccttgcttttatctcctccccttttccctcgctcattcggttccagccacctggcttccttgcagtttctcaaccacgccaagcacagtcctacctcggcccttgcacaggctgtccctccctgcctggaat

SEQ ID NO: 127726 - DNA, 601 bp, Human
gggagagggacaggactgaaagggaaaaacagccgaggcccttccataccaaggcagcccgtccatctcaggtgctgccaacaagacccgaatctgcccttgcctgggtcctcgacaagcttgggaacctctggccacaggacatgctacccagcaccacaacagacacacgtggaggcttggactgtttgagctcatttaatcctctcatgaaccccaggagtgggtatataattatccccatcctcccgggtgagaaagctgaggcacagagaggtctattttttttttttttttttttgagatggagtctcactctgtcacccaggctggagtgcaatggcactatcttggctcactgcaacctctacatcctgggttcaagcaattctcctgcctcaccctcccaagtagttgggattacaggtgcttgctaccatgcccagctaatttttctatttttagtagaggcggggtttgaccatgttggccaggctggtctcgaactcccgacctcaggcgatccactcacctcggcctcccaaagtgctgggattacaggtgtgagccatcacgcctggccgagaggtcaagttacatg

SEQ ID NO: 127727 - DNA, 601 bp, Human
tcctctctccatcactttggcggctgagggttctcgttcccatttctcagggctaaatatagcccagggaacgaaactctgcaccggccgccagtagggagactctgagccatcacgaggagcaggctcagatgacagggacagggtggaggatgggggagagggacaggactgaaagggaaaaacagccgaggcccttccataccaaggcagcccgtccatctcaggtgctgccaacaagacccgaatctgcccttgcctgggtcctcgacaagcttgggaacctctggccacaggacaygctacccagcaccacaacagacacacgtggaggcttggactgtttgagctcatttaatcctctcatgaaccccaggagtgggtatataattatccccatcctcccgggtgagaaagctgaggcacagagaggtctattttttttttttttttttttgagatggagtctcactctgtcacccaggctggagtgcaatggcactatcttggctcactgcaacctctacatcctgggttcaagcaattctcctgcctcaccctcccaagtagttgggattacaggtgcttgctaccatgccca

SEQ ID NO: 127728 - DNA, 601 bp, Human
gccaccagcccacatccttgttttaacgagctcagaaatgccaatgctttgcttctggaaggttctggaagaaagaaccgagtcagcggaacattgctggacagaaggcagcactggctttgtgctcctctctccatcactttggcggctgagggttctcgttcccatttctcagggctaaatatagcccagggaacgaaactctgcaccggccgccagtagggagactctgagccatcacgaggagcaggctcagatgacagggacagggtggaggatgggggagagggacaggactgacagggaaaaacagccgaggcccttccataccaaggcagcccgtccatctcaggtgctgccaacaagacccgaatctgcccttgcctgggtcctcgacaagcttgggaacctctggccacaggacatgctacccagcaccacaacagacacacgtggaggcttggactgtttgagctcatttaatcctctcatgaaccccaggagtgggtatataattatccccatcctcccgggtgagaaagctgaggcacagagaggtctattttttttttttttttttttgagatggagtctcactctg

SEQ ID NO: 127729 - DNA, 601 bp, Human
acttataatccgcggatttttctgtatgtttattctacttcaattcttaaaaagttgtttttttttgagacggagtcttactctgttgccgaggctggagtgcagtggcatgatctcagctcactgcaacctctgcctcccgggttcaagcaattctcttgcctcagcctcctgagtagttgggattacaggcgcccgccaccatgcctggctaatttttgtatttttagtagagatggggtttcaccatgttggtcaggctggtcttgaactcctcacctcctgatctgcctgccttggyctcccaaagtgctgtaattacaggcgtgagccactgagcccggcagaagtttttttttaatagtcaactttaccttaaaaagaaagaaaatgctgatacgtgctgcaacatgggtgaaccttgagggcattatgctatgtgaaataaaccagtcataaaagggaaaatcctgtatgattccatttataggaggtccctagagtcgtcagatttataaaaacagaaagtagcatggtgggtgccaagggctgggggagggggaacagggagttcgcgtttagtggggacagagttacattt

SEQ ID NO: 127730 - DNA, 601 bp, Human
tgttatcaataggagagagaggatacatgcaatgaacaatgccacaggtcacatgagatcttaaaaagttaacgtcaagcaaaagaagccagacttcatttatgcaaaatacaaaacaggctaaactggtgaatgatgctcaaagtcctggtaggggtacccttgcggggaggtagtgactaggaacaggatatgaggggggcttctggggctgagaagtttctgtttcctcatttgtgtgctggttacatggatgtgtttagtttgtgacaattaatcaagctcttcacttataatccgyggatttttctgtatgtttattctacttcaattcttaaaaagttgtttttttttgagacggagtcttactctgttgccgaggctggagtgcagtggcatgatctcagctcactgcaacctctgcctcccgggttcaagcaattctcttgcctcagcctcctgagtagttgggattacaggcgcccgccaccatgcctggctaatttttgtatttttagtagagatggggtttcaccatgttggtcaggctggtcttgaactcctcacctcctgatctgcctgccttggcctcccaaagtgc

SEQ ID NO: 127731 - DNA, 601 bp, Human
ctgttacatatttgatctgttgttgaccaaaatgccattgtgcagtgtataactgtatgtacctttgccaacacccagtaattcttggatagttactgatccaagatcactacaattagatagtaattccgaaatagtaattctgaataattacacaacagaaagcacacacaagaacattcatagcaatggtattcatcatagctccaaattgcaaacaatccacactgttatcaataggagagagaggatacatgcaatgaacaatgccacaggtcacatgagatcttaaaaagttaaygtcaagcaaaagaagccagacttcatttatgcaaaatacaaaacaggctaaactggtgaatgatgctcaaagtcctggtaggggtacccttgcggggaggtagtgactaggaacaggatatgaggggggcttctggggctgagaagtttctgtttcctcatttgtgtgctggttacatggatgtgtttagtttgtgacaattaatcaagctcttcacttataatccgcggatttttctgtatgtttattctacttcaattcttaaaaagttgtttttttttgagacggagtcttactctg

SEQ ID NO: 127732 - DNA, 601 bp, Human
actacttgaaaaattggttgagagtttctatgctaaaattaattaagtcatgcttaacaatgggcatacattctgaaaaatgtgtcactaggtcattttgttgtgcaaacatcatggagtgtacttacacaaacctagatggtatagcctactacacacctaggctgcatggtctcgcctattgctcctaggctacaaacccatacagcatgttattctatggaatactgtaggcaattgtaactctatagtgtatctaaaaatatctaaaaacaggccgggtgcggtggctcacgcctgyaatcccagcactttgggaggccgaggcgggcagatcatgaggtcaggagatcgaggccatcctggctaacatggtgaaaccccgtctctactaaaaatacaaaaaaaattagccgggcctggtgacgggcgcctgtagctacctgggaggctgaggcaggagaatggcgtgaacccagaaggcggagcttgcagtgagcggagatcacaccactgcactccagcctgggcaacagagcgagacttcgtctcaaaaaaaaaagaatctaaaaacagaaaagctatagtaaaaatactgtat

SEQ ID NO: 127733 - DNA, 601 bp, Human
tctatttccaaataaggtcacattctgaggtactgggggttaggacttcaacatatgaattttggggtgagacaataaaacccataacacatggtacaactacttgaaaaattggttgagagtttctatgctaaaattaattaagtcatgcttaacaatgggcatacattctgaaaaatgtgtcactaggtcattttgttgtgcaaacatcatggagtgtacttacacaaacctagatggtatagcctactacacacctaggctgcatggtctcgcctattgctcctaggctacaaacccrtacagcatgttattctatggaatactgtaggcaattgtaactctatagtgtatctaaaaatatctaaaaacaggccgggtgcggtggctcacgcctgcaatcccagcactttgggaggccgaggcgggcagatcatgaggtcaggagatcgaggccatcctggctaacatggtgaaaccccgtctctactaaaaatacaaaaaaaattagccgggcctggtgacgggcgcctgtagctacctgggaggctgaggcaggagaatggcgtgaacccagaaggcggagcttgcagtgagcgga

SEQ ID NO: 127734 - DNA, 601 bp, Human
catggcattcttcctgtgagtgtgcctgtctctgtgccaaaatctcccctttttatatggacaccatcgtattagattaggacccaccctaatgatctcatcttaactgctatggttggtgcaaaaataacggcagttttgccaatggcaaaacctttacatgtgcaatgaatctatttccaaataaggtcacattctgaggtactgggggttaggacttcaacatatgaattttggggtgagacaataaaacccataacacatggtacaactacttgaaaaattggttgagagtttctaygctaaaattaattaagtcatgcttaacaatgggcatacattctgaaaaatgtgtcactaggtcattttgttgtgcaaacatcatggagtgtacttacacaaacctagatggtatagcctactacacacctaggctgcatggtctcgcctattgctcctaggctacaaacccatacagcatgttattctatggaatactgtaggcaattgtaactctatagtgtatctaaaaatatctaaaaacaggccgggtgcggtggctcacgcctgcaatcccagcactttgggaggccgaggcggg

SEQ ID NO: 127735 - DNA, 601 bp, Human
tcttggcttgtagaggcatcatcctgagctctgcctttgtttaaacatggcattcttcctgtgagtgtgcctgtctctgtgccaaaatctcccctttttatatggacaccatcgtattagattaggacccaccctaatgatctcatcttaactgctatggttggtgcaaaaataacggcagttttgccaatggcaaaacctttacatgtgcaatgaatctatttccaaataaggtcacattctgaggtactgggggttaggacttcaacatatgaattttggggtgagacaataaaacccrtaacacatggtacaactacttgaaaaattggttgagagtttctatgctaaaattaattaagtcatgcttaacaatgggcatacattctgaaaaatgtgtcactaggtcattttgttgtgcaaacatcatggagtgtacttacacaaacctagatggtatagcctactacacacctaggctgcatggtctcgcctattgctcctaggctacaaacccatacagcatgttattctatggaatactgtaggcaattgtaactctatagtgtatctaaaaatatctaaaaacaggccgggtgcg

SEQ ID NO: 127736 - DNA, 601 bp, Human
ttgctgattcttggcttgtagaggcatcatcctgagctctgcctttgtttaaacatggcattcttcctgtgagtgtgcctgtctctgtgccaaaatctcccctttttatatggacaccatcgtattagattaggacccaccctaatgatctcatcttaactgctatggttggtgcaaaaataacggcagttttgccaatggcaaaacctttacatgtgcaatgaatctatttccaaataaggtcacattctgaggtactgggggttaggacttcaacatatgaattttggggtgagacaayaaaacccataacacatggtacaactacttgaaaaattggttgagagtttctatgctaaaattaattaagtcatgcttaacaatgggcatacattctgaaaaatgtgtcactaggtcattttgttgtgcaaacatcatggagtgtacttacacaaacctagatggtatagcctactacacacctaggctgcatggtctcgcctattgctcctaggctacaaacccatacagcatgttattctatggaatactgtaggcaattgtaactctatagtgtatctaaaaatatctaaaaacaggc

SEQ ID NO: 127737 - DNA, 601 bp, Human
gctgctgtaacaaggaaccacaacctaggtggcttaaacaacaaagatttattgtcttacagttatagaggccaaaaatccaagctcaaggtgtcagaagggctggttccttctgagagctgtgagacagaatctgttttatgcctctctcctagcttctggcggtttgctggcaatctttgctgattcttggcttgtagaggcatcatcctgagctctgcctttgtttaaacatggcattcttcctgtgagtgtgcctgtctctgtgccaaaatctcccctttttatatggacaccatcrtattagattaggacccaccctaatgatctcatcttaactgctatggttggtgcaaaaataacggcagttttgccaatggcaaaacctttacatgtgcaatgaatctatttccaaataaggtcacattctgaggtactgggggttaggacttcaacatatgaattttggggtgagacaataaaacccataacacatggtacaactacttgaaaaattggttgagagtttctatgctaaaattaattaagtcatgcttaacaatgggcatacattctgaaaaatgtgtcactaggtcatttt

SEQ ID NO: 127738 - DNA, 601 bp, Human
agtgtggctttaaaagcccacctttaaaagcatgtatgacactgctgctgcctggaagaaaggctaaaatgagaaagaagttaagatgaggtcattactaccaggtgtctgtgaagctgtggagcaactggaaccctcataatctgccaatgggagggcaccatgctgtattcatctcctgtggctgctgtaacaaggaaccacaacctaggtggcttaaacaacaaagatttattgtcttacagttatagaggccaaaaatccaagctcaaggtgtcagaagggctggttccttctgagrgctgtgagacagaatctgttttatgcctctctcctagcttctggcggtttgctggcaatctttgctgattcttggcttgtagaggcatcatcctgagctctgcctttgtttaaacatggcattcttcctgtgagtgtgcctgtctctgtgccaaaatctcccctttttatatggacaccatcgtattagattaggacccaccctaatgatctcatcttaactgctatggttggtgcaaaaataacggcagttttgccaatggcaaaacctttacatgtgcaatgaatctatttccaaata

SEQ ID NO: 127739 - DNA, 601 bp, Human
agggggaaatggaggaacgttttctgaagaaaacatccaaagggtaaagctctctcttaattatgttctcctcacataacataattgacctgggaacggagtaagaaacacaagaggacttcccagaccacagtccagaaggagaaggaaaaagtaaaccaaacaaaacacaaaacctattgaaatggattaattaatccctggttccttctcttctcccaacacagtcatagactccccttagaggagatgcatgaccacagagtctgatggcctggtgaaatcaccaagccagacagayggtccatgagccctttcctcaagtgtctccctgctccattccctgcagccttaatgccaatcacaaaaaattctcagaagtttcagctcaattttcaagaggaaaaaagtccacaaatagaatactctctgaaacagaaaatagaacactatagcaagaaggaagtaagatgaggggaagaaaatcaaggagaggaggttggggggtggagagagaaagagagacagagagagagagggagagagagagagagagagagagagagagagagagagagagagagaaaagaatgataaaagc

SEQ ID NO: 127740 - DNA, 601 bp, Human
tgatgatgagggggatgaagtacaaccagttccaagtgttccctgaggcatcgttgctctgtagggtgtgaggagggaaagcaggtgagagttgactgggactcagatagaacctgacaggtgagggaaggggaagctcggttctcttgtggctctgtcttaaatgttcttggcttgtggagttctggggctctggcatcccagagggggaaatggaggaacgttttctgaagaaaacatccaaagggtaaagctctctcttaattatgttctcctcacataacataattgacctgggaayggagtaagaaacacaagaggacttcccagaccacagtccagaaggagaaggaaaaagtaaaccaaacaaaacacaaaacctattgaaatggattaattaatccctggttccttctcttctcccaacacagtcatagactccccttagaggagatgcatgaccacagagtctgatggcctggtgaaatcaccaagccagacagatggtccatgagccctttcctcaagtgtctccctgctccattccctgcagccttaatgccaatcacaaaaaattctcagaagtttcagctcaattttc

SEQ ID NO: 127741 - DNA, 601 bp, Human
acaactgtgcctaggtaaagaaaaaggccaggcacagtggctcatgtctgtaatcccagcactttgtgaggctgagatgggagtatcatttaaggccaggaatttgagaccagcctggacaacacagtgggccccatctctatgaaaaataaaaaatgtagctgggcatggtggcatacacttgttgccttagctactcaggaggctgaggcaggaggatcgcttgtgcctaggagttctaggttacagtgagctatgatcgccccctacactccagtctgggtaataaagctagacaccrtctcaaaaaaaaacaataaaaaagaaaaaaaccgaaaggataaaaccatgccatgccaaccaccactggctgcatacctcattctcattctcttcatacttttggctaataattatttcagccctcttttaagttagaccaataagccatgaatgaaagatttctgcagcaggttggcttctctgccataggtcccacctcttcctgtttcccttcttccttttcctgtttggaacatgaagtggccatccggagggcgtgaggcagccatcttaagaccatgaggtatccacgagattg

SEQ ID NO: 127742 - DNA, 601 bp, Human
ggttctccacccgttccctttctttggcaaactccctggagaagcatagaaaagccagagtatggctgttttgaaaatgttaggaaacgtttgtgtgtgtgtttgtgtgtgtgtgtgtgtgtgtgtgtgtgtgtttgtgtgtgtgtgtgtgtttggggattcagaagtccctggaggtcaggagttttcaacaggaggagtcaggacttctgggaaaagactgggatattatagtgatgggtgcttctgccagcttcacacatttcccgacaactgtgcctaggtaaagaaaaaggccagrcacagtggctcatgtctgtaatcccagcactttgtgaggctgagatgggagtatcatttaaggccaggaatttgagaccagcctggacaacacagtgggccccatctctatgaaaaataaaaaatgtagctgggcatggtggcatacacttgttgccttagctactcaggaggctgaggcaggaggatcgcttgtgcctaggagttctaggttacagtgagctatgatcgccccctacactccagtctgggtaataaagctagacaccgtctcaaaaaaaaacaataaaaaagaaaaaaa

SEQ ID NO: 127743 - DNA, 601 bp, Human
actgcatgactctctttgtactctgtggcctgggatctccatccctgggccccaggatgaaagggcctcacctgcttttgagatccactccatgtacccattgagctcacgttcaatctgttgttgccgcctcagcttcagaaaagcccgccggttctccacccgttccctttctttggcaaactccctggagaagcatagaaaagccagagtatggctgttttgaaaatgttaggaaacgtttgtgtgtgtgtttgtgtgtgtgtgtgtgtgtgtgtgtgtgtgtttgtgtgtgtgtgtgtgtttggggattcagaagtccctggaggtcaggagttttcaacaggaggagtcaggacttctgggaaaagactgggatattatagtgatgggtgcttctgccagcttcacacatttcccgacaactgtgcctaggtaaagaaaaaggccaggcacagtggctcatgtctgtaatcccagcactttgtgaggctgagatgggagtatcatttaaggccaggaatttgagaccagcctggacaacacagtgggccccatctctatgaaaaataaaaaatgtagctgggcatggtggcataca

SEQ ID NO: 127744 - DNA, 601 bp, Human
tagccttctccaaactgcatgactctctttgtactctgtggcctgggatctccatccctgggccccaggatgaaagggcctcacctgcttttgagatccactccatgtacccattgagctcacgttcaatctgttgttgccgcctcagcttcagaaaagcccgccggttctccacccgttccctttctttggcaaactccctggagaagcatagaaaagccagagtatggctgttttgaaaatgttaggaaacgtttgtgtgtgtgtttgtgtgtgtgtgtgtgtgtgtgtgtgtgtgtttgtgtgtgtgtgtgtgtttggggattcagaagtccctggaggtcaggagttttcaacaggaggagtcaggacttctgggaaaagactgggatattatagtgatgggtgcttctgccagcttcacacatttcccgacaactgtgcctaggtaaagaaaaaggccaggcacagtggctcatgtctgtaatcccagcactttgtgaggctgagatgggagtatcatttaaggccaggaatttgagaccagcctggacaacacagtgggccccatctctatgaaaaataaaaaatgtagctgggc

SEQ ID NO: 127745 - DNA, 601 bp, Human
gcttagccttctccaaactgcatgactctctttgtactctgtggcctgggatctccatccctgggccccaggatgaaagggcctcacctgcttttgagatccactccatgtacccattgagctcacgttcaatctgttgttgccgcctcagcttcagaaaagcccgccggttctccacccgttccctttctttggcaaactccctggagaagcatagaaaagccagagtatggctgttttgaaaatgttaggaaacgtttgtgtgtgtgtttgtgtgtgtgtgtgtgtgtgtgtgtgtgtgtttgtgtgtgtgtgtgtgtttggggattcagaagtccctggaggtcaggagttttcaacaggaggagtcaggacttctgggaaaagactgggatattatagtgatgggtgcttctgccagcttcacacatttcccgacaactgtgcctaggtaaagaaaaaggccaggcacagtggctcatgtctgtaatcccagcactttgtgaggctgagatgggagtatcatttaaggccaggaatttgagaccagcctggacaacacagtgggccccatctctatgaaaaataaaaaatgtagctg

SEQ ID NO: 127746 - DNA, 601 bp, Human
cttctctgaatttgggagttcccaacatgacatgtatttgtttgctttatctctctcattagaatatcagagctctgagggcagggatttggtgtgtattgtttactcccatatcctcagtgcttagatcagtgcctggcacacagcaggtgctccctaaatgtttgttaaatggctgaacaaataaatatgtgcctaccgtgtatcaggcacttctctccccaagtgactcagctgagattattttactaaatactccaatagtactatgacttaggcactaccatcgcctccatgtaasagctgaggaaacggaggtacagggatgtgtggtgcatgggtaaaaagtggcagggccgggatgtaaaccagcgtctgatttcagaattcaagttacgtgatgtcagatcctggcttcatcttagacttcttcatatcagactctggattcttgttgataaaatttgggactaccaattcaggttctctttctcctcccatcataaccctcccagcttagccttctccaaactgcatgactctctttgtactctgtggcctgggatctccatccctgggccccaggatgaaagggcctcac

SEQ ID NO: 127747 - DNA, 601 bp, Human
tagtctgttttatcttccttctctgaatttgggagttcccaacatgacatgtatttgtttgctttatctctctcattagaatatcagagctctgagggcagggatttggtgtgtattgtttactcccatatcctcagtgcttagatcagtgcctggcacacagcaggtgctccctaaatgtttgttaaatggctgaacaaataaatatgtgcctaccgtgtatcaggcacttctctccccaagtgactcagctgagattattttactaaatactccaatagtactatgacttaggcactaycatcgcctccatgtaacagctgaggaaacggaggtacagggatgtgtggtgcatgggtaaaaagtggcagggccgggatgtaaaccagcgtctgatttcagaattcaagttacgtgatgtcagatcctggcttcatcttagacttcttcatatcagactctggattcttgttgataaaatttgggactaccaattcaggttctctttctcctcccatcataaccctcccagcttagccttctccaaactgcatgactctctttgtactctgtggcctgggatctccatccctgggcccca

SEQ ID NO: 127748 - DNA, 601 bp, Human
catcaccttcctgtcttcctctcctccagctgtccccacctctcactctgtttcagctgcactggcttccttgctgtgtctcaaatacgttcctagctcagggcctttgcacttgctgtctctgcctggaatgccccttcccttgacatccccacagcttccttcttcacgtccttcaggtctctctgctcagagggtacttccttagagaagccttccctgaccaccctgcctctaacttcctactcttttttttttctctgacacagagtctcactctgttgcccaggctggagtgcartggtgcgacctcagctcactgtaacctctgcctcctgggttcaagcaattctcctgcctcagcctcccgagtagctgggattacaggcgtgcgccaccatgcctggctaatttttgtatttttagtagagacagggtttcaccatgttggccaggctggtctcgaatgcctgacctcaggaaatctgcccgccttagcctcccaaagtgctgggattacaggcgtgagccaccgcgcccggccaacttcctactctgttttatcttcctagtctgttttatcttccttctctgaatttgg

SEQ ID NO: 127749 - DNA, 601 bp, Human
cacagcctataagcccctgcttgatctgatctccatcaccttcctgtcttcctctcctccagctgtccccacctctcactctgtttcagctgcactggcttccttgctgtgtctcaaatacgttcctagctcagggcctttgcacttgctgtctctgcctggaatgccccttcccttgacatccccacagcttccttcttcacgtccttcaggtctctctgctcagagggtacttccttagagaagccttccctgaccaccctgcctctaacttcctactcttttttttttctctgacacrgagtctcactctgttgcccaggctggagtgcagtggtgcgacctcagctcactgtaacctctgcctcctgggttcaagcaattctcctgcctcagcctcccgagtagctgggattacaggcgtgcgccaccatgcctggctaatttttgtatttttagtagagacagggtttcaccatgttggccaggctggtctcgaatgcctgacctcaggaaatctgcccgccttagcctcccaaagtgctgggattacaggcgtgagccaccgcgcccggccaacttcctactctgttttatcttc

SEQ ID NO: 127750 - DNA, 601 bp, Human
cgcaaaataaaaaccaatgtccacaccacagcctataagcccctgcttgatctgatctccatcaccttcctgtcttcctctcctccagctgtccccacctctcactctgtttcagctgcactggcttccttgctgtgtctcaaatacgttcctagctcagggcctttgcacttgctgtctctgcctggaatgccccttcccttgacatccccacagcttccttcttcacgtccttcaggtctctctgctcagagggtacttccttagagaagccttccctgaccaccctgcctctaacttsctactcttttttttttctctgacacagagtctcactctgttgcccaggctggagtgcagtggtgcgacctcagctcactgtaacctctgcctcctgggttcaagcaattctcctgcctcagcctcccgagtagctgggattacaggcgtgcgccaccatgcctggctaatttttgtatttttagtagagacagggtttcaccatgttggccaggctggtctcgaatgcctgacctcaggaaatctgcccgccttagcctcccaaagtgctgggattacaggcgtgagccaccgcgcccgg

SEQ ID NO: 127751 - DNA, 601 bp, Human
tttagagcagttaccatcaaagggatgcctctgctccccgtcagtttcatcctcggcgaggatcacctcttctgaagaggaagagcacagagttaagctcctgcatttggaggatgagttctcccttggaccaggaagaagggtctgcccggccacccccattctctgctgactgatggtgacagctcaaccgaccaaaaaacatgctgctgggtggtttgtgacttcaagccccacctccgcaacagtagcaatagccaacattctccccacctcgcgcaaaataaaaaccaatgtccayaccacagcctataagcccctgcttgatctgatctccatcaccttcctgtcttcctctcctccagctgtccccacctctcactctgtttcagctgcactggcttccttgctgtgtctcaaatacgttcctagctcagggcctttgcacttgctgtctctgcctggaatgccccttcccttgacatccccacagcttccttcttcacgtccttcaggtctctctgctcagagggtacttccttagagaagccttccctgaccaccctgcctctaacttcctactcttttttttttctctgac

SEQ ID NO: 127752 - DNA, 601 bp, Human
gcacaaagcagaaaaaaccaggtccatggttaaaacaaaaaagtggaggccagaatagggaaactctgcatggaagtcctaaaattcctccaagaggaacgtctaccctctgcaagatccttagaaccagtcacctgctctcccccgactccccaccacagcttctcccttctcccctgggacccacccctgaggtgggtttagagcagttaccatcaaagggatgcctctgctccccgtcagtttcatcctcggcgaggatcacctcttctgaagaggaagagcacagagttaagctccygcatttggaggatgagttctcccttggaccaggaagaagggtctgcccggccacccccattctctgctgactgatggtgacagctcaaccgaccaaaaaacatgctgctgggtggtttgtgacttcaagccccacctccgcaacagtagcaatagccaacattctccccacctcgcgcaaaataaaaaccaatgtccacaccacagcctataagcccctgcttgatctgatctccatcaccttcctgtcttcctctcctccagctgtccccacctctcactctgtttcagctgcactggc

SEQ ID NO: 127753 - DNA, 601 bp, Human
gtgtgccatgacacctagctaatttttgtatttttagtagagatggggtttcgccatgatggccaggccggtcttgaactcctggcctcaagtgatccacccgccttggcctcccaaagtgctgggattacaggcatgagccaccacgcccagcccctgtctaaccagttttctaaagtatgagaagataaatctcaagcaagaagttgcatttttcagggagtactattatttttcttattgctgttattattatattgcagacatattattctggcctatctctaaattctttttttttcttttgaaacagggtctcactctgtcacccaggctggagtggagtggtgcccactgcaacctcgacctcttgggctcaagtgatcctcccacctcagcctcctgagtagctgggaccataggtgcgtgtgcccccacatctggctaagtttattttttgtagagacggaacctcattatgttgcccaggctggtcttgaactcccaggctcaagtgttcctcctgtcttggcctcccaaagtgttgggattacagatgtgagccacagacagaccgcatccaaccctatctctaaattct

SEQ ID NO: 127754 - DNA, 601 bp, Human
tagtttagcctcctgagtagctgggattacaggcgtgtgccatgacacctagctaatttttgtatttttagtagagatggggtttcgccatgatggccaggccggtcttgaactcctggcctcaagtgatccacccgccttggcctcccaaagtgctgggattacaggcatgagccaccacgcccagcccctgtctaaccagttttctaaagtatgagaagataaatctcaagcaagaagttgcatttttcagggagtactattatttttcttattgctgttattattatattgcagacayattattctggcctatctctaaattctttttttttcttttgaaacagggtctcactctgtcacccaggctggagtggagtggtgcccactgcaacctcgacctcttgggctcaagtgatcctcccacctcagcctcctgagtagctgggaccataggtgcgtgtgcccccacatctggctaagtttattttttgtagagacggaacctcattatgttgcccaggctggtcttgaactcccaggctcaagtgttcctcctgtcttggcctcccaaagtgttgggattacagatgtgagccac

SEQ ID NO: 127755 - DNA, 601 bp, Human
ccatccttctagagcaagctaagcccagagcctctccctgaagtgccattaccattacaggtttatttgtgtaattctctgtttaatttctatttcctgcactggactgtgagctccatgtaggtagggatttggtttgtgtcttttttttttttttttttttgagacaggatcttgctctgttgcccaggctggagggcagtgatgagatctcagctcactgcaacctctgcttcccaggttcaagtgatgctcccgcctcagcctccagagtagctggaactacaggctaatttttttygtatttttagtagagccagggtttcaccatgttggccaggctggtctcgaactcccgacatcaggtgatccgctcatctcagcttcccaaagtgttgggattacaggcgtgagccactgtgcctggctcagtttgtgtctttttttttttttctgtgcccaggctggagtgcagtaacacaataatggcttattgcagcctccacttcccaggctcaagtgatcctcccagctcagcctcgtgactgccttgtcttgtttgcaaccaagcacctaatataagcaggtcccccatgaatac

SEQ ID NO: 127756 - DNA, 601 bp, Human
tccaggtagccttccctgactgctccccatccttctagagcaagctaagcccagagcctctccctgaagtgccattaccattacaggtttatttgtgtaattctctgtttaatttctatttcctgcactggactgtgagctccatgtaggtagggatttggtttgtgtcttttttttttttttttttttgagacaggatcttgctctgttgcccaggctggagggcagtgatgagatctcagctcactgcaacctctgcttcccaggttcaagtgatgctcccgcctcagcctccagagtrgctggaactacaggctaatttttttcgtatttttagtagagccagggtttcaccatgttggccaggctggtctcgaactcccgacatcaggtgatccgctcatctcagcttcccaaagtgttgggattacaggcgtgagccactgtgcctggctcagtttgtgtctttttttttttttctgtgcccaggctggagtgcagtaacacaataatggcttattgcagcctccacttcccaggctcaagtgatcctcccagctcagcctcgtgactgccttgtcttgtttgcaaccaagcacct

SEQ ID NO: 127757 - DNA, 601 bp, Human
ggcccttgtggtggcaaaggtctgagccctgcctctcacactgttccttctgctatcaccaccacagtgatctcctacccatccttcagttcccagcttaaccgtcacttcctccaggtagccttccctgactgctccccatccttctagagcaagctaagcccagagcctctccctgaagtgccattaccattacaggtttatttgtgtaattctctgtttaatttctatttcctgcactggactgtgagctccatgtaggtagggatttggtttgtgtcttttttttttttttttttttgagacaggatcttgctctgttgcccaggctggagggcagtgatgagatctcagctcactgcaacctctgcttcccaggttcaagtgatgctcccgcctcagcctccagagtagctggaactacaggctaatttttttcgtatttttagtagagccagggtttcaccatgttggccaggctggtctcgaactcccgacatcaggtgatccgctcatctcagcttcccaaagtgttgggattacaggcgtgagccactgtgcctggctcagtttgtgtctttttttttttttctgtgcccag

SEQ ID NO: 127758 - DNA, 601 bp, Human
agcttcctaaatagatgggactataggtgtgtgccataatgcctggctaagtttttcaacattttgtttttcagagatggagccttgttatgttgcccaggctggtcttgaacggctgatcttaggagatcctcctgcactggcctcccaaagcagtgggattacaggcgtgaaccactgtacctcgtcataaaacagattttaaacaatggaggtaacgtaacacgtgagacagacataattgatcaaatactcaagacacctactgagcgctccaattcttgacatttgcttacaggarattaaacagatgcacacacgagtggaagcagaatgagttctccattacaaagaaaagcgtgttttggctggaaattaaaaatgcaaatgaaaacaagctttaaggtttcattacaaacccacttaactgggaaaggaaattaaattggtaatattcgatggcctgggtggggaatccatgaacatatgcatacttggcaggtttataaatgggttccatgtttttgaaactcagaatggctctttgaataatgagttgaaaagctgttaatatctttgatcctataattatccccaagga

SEQ ID NO: 127759 - DNA, 601 bp, Human
tattttatttttttaagagacaggttctcactctgttgcccacgttgcagtgcagtggcacaatcatagctcactgcaaccttgaattcctgggttcaagaaatcctcctgccttagcttcctaaatagatgggactataggtgtgtgccataatgcctggctaagtttttcaacattttgtttttcagagatggagccttgttatgttgcccaggctggtcttgaacggctgatcttaggagatcctcctgcactggcctcccaaagcagtgggattacaggcgtgaaccactgtacctsgtcataaaacagattttaaacaatggaggtaacgtaacacgtgagacagacataattgatcaaatactcaagacacctactgagcgctccaattcttgacatttgcttacaggaaattaaacagatgcacacacgagtggaagcagaatgagttctccattacaaagaaaagcgtgttttggctggaaattaaaaatgcaaatgaaaacaagctttaaggtttcattacaaacccacttaactgggaaaggaaattaaattggtaatattcgatggcctgggtggggaatccatgaacat

SEQ ID NO: 127760 - DNA, 601 bp, Human
atgttattttatttttttaagagacaggttctcactctgttgcccacgttgcagtgcagtggcacaatcatagctcactgcaaccttgaattcctgggttcaagaaatcctcctgccttagcttcctaaatagatgggactataggtgtgtgccataatgcctggctaagtttttcaacattttgtttttcagagatggagccttgttatgttgcccaggctggtcttgaacggctgatcttaggagatcctcctgcactggcctcccaaagcagtgggattacaggcgtgaaccactgtrcctcgtcataaaacagattttaaacaatggaggtaacgtaacacgtgagacagacataattgatcaaatactcaagacacctactgagcgctccaattcttgacatttgcttacaggaaattaaacagatgcacacacgagtggaagcagaatgagttctccattacaaagaaaagcgtgttttggctggaaattaaaaatgcaaatgaaaacaagctttaaggtttcattacaaacccacttaactgggaaaggaaattaaattggtaatattcgatggcctgggtggggaatccatga

SEQ ID NO: 127761 - DNA, 601 bp, Human
acaaataaaatcatctaaatggggtctggttttcctaaaaaagcagagttacaatggcagcttccattcataatggatcaacttttttttgttttgttttcatatgctccacattttacttatttatcattgtgctgcttcttcgtcttcttcttcctcttcttcttcctcttccccttccccttcctcctcctcttcttcttcctcttccccttccccttcctcctcctcttcttcttccccttccccttcctcctcctcttcttcttccccttccccttcccattcctcctcctcctcytcttcttcttcttccttcttccttcttcttctttcctcctcttcttcttcttcttctttttttttttttttaatacaggccaggtacagtgtctcacacctgtaatcacaacactctgggaggccaaggtgggaggctcatttgaagccagggttttgagaccagcctgggcaacatagcgagaccgtgtctctatcaagtattagctgggcactgtggcatgcgcctgtagcctcaaatgatcctctcaccttggccttccaaaacattgggattataggcatgagccaccgcaccagg

SEQ ID NO: 127762 - DNA, 601 bp, Human
tcctggaggctgcaggggaggaggagggattgagaaggagaagatgttgatcaaagggtataagttgcagttagactggaggagtaagttttagtgatctattgcattgcattgcattgcatcgcatttagtgatgcattaatacattattgtgtatttatattgcattattaataaatagtaatgtgttgcatatttcaaaattgctaagagatttttaatgccttccccacacacaaaaaacggtgaggtggtgaggcgatggatgtgttaattagcatgactgaatcattctatgatrtatacatagattaaaacatcacactgcactccataaacatacacaattaccatttgtcagctgcaaataaattaataaaaaatcatgcctgtaatcccagaactttgggaagccagggcaggaggatcacttgaggccaggagtttgagaccagcctgggcaacatagccagaccccatctcaacaacaacatcaacaacaacaacaaattagctgggtgtggtggtgcctgtagtcccagctacttgggaggctaagctgggaggatcgcctgagcccaggagctccaggctgcagaga

SEQ ID NO: 127763 - DNA, 601 bp, Human
tattttggatattagctccttatcagatgtattgtttgcaaacgttttctcacattccttaggttgtctctttcctctgctgaacgcttcctttgctgtgcacaaattttttagtttgatacgatcccatttgtccattttggcttctgttgcctgtgcttttgaggtcctgtccaaaaaatcattcccgagaccaatgccatggagctttctccttatgttttcttggagcatctttaccatttcaggtctgacatttaagtcttttcagaacatctgcactcccacgttcacttcagcrttattcacaatagccaaaatatggaagcaaactaagtgtcccacaatggatgaatggataaagaaaatgtggtatgtatacaaatagaatactatacagccctaaaagaaagaaattctgtaatgtgtgacaacagggacagaactggaggacattatactgagtaaaataagctggcacagaaagacaattacagtatgatctcacatgtgggagcttaaaactaaaaaaaattgatctcatagaaagagcaggaaggtggttcctggaggctgcaggggaggaggagggattgagaag

SEQ ID NO: 127764 - DNA, 601 bp, Human
ccaacatggtgaaaccccgtatctactaaaaatacaaaaattagccgggcatggtggcacacgcctgtaatcccagctactcgggaggctgaggtgggaggacggcatgagcctgtgaggttggggttgtagtgagctgtgatcgtgccattgcactccagcctgggtgatggagtgagacttgtctcagaaaaaaaaaaaaaaaaaagaaatcgcatacagaaacacagaaagaagaccatatgacaacagaggcagagactggaattatgcatctatgaactgaggaacaccaagtatsgctggcagcaccagaaactaagaaaataccatggaacagattctcccctaaaaccttctgagggaacgtggtggctctgctgacaccttgatttcagtttggacttctggcctctagaactgtgagagaagaaatttctgttgttttaagccactgggtttgtgacattttgtaatggcaactctgggaactcaataccacccatatagagcctgtgttattaaaatgatgtaaatggatccccgtttccccacatccttgccagcacttgttatgatttgtcttttttttttttcttgt

SEQ ID NO: 127765 - DNA, 601 bp, Human
ctcaagagctgaaatcatgactaggttcacgtgccagccattgagaaagtccttcctgatcactcagcctgaagacacattccccacgacaggcatacccttcactggtaagggagagggaaatgaatattaattgaacacctactaagtgctggaccccatgctaggcactgtcacttctgttagttgaatttcatactcactttgtcccacgttccctttttctatacattcctgtctctcgtttttctctgtggtctggaattataattgcagacaatttctagatttttaaaaatcrctttcatgagatgttttattcaacccaatacatccaaaatattaccatttcaacatggaatcaatatcaaggtggattcaaaagatattttatactctttcttttgtactaagtattcccagccggacgtgttattatgaagtacatcctagttcagggtcagccacattcaagggatcaagagccggtgtaactggtaccagtctgaaatgttcttttcctttttttttttttttcttttttttttgagatagagtctcattctgtcacccgggctggagtgcagtggcacgatcttgg

SEQ ID NO: 127766 - DNA, 601 bp, Human
caccttggtaaactggagacaaccacacttcctacctcaaagggccatccaaaggcataaatgaattaatacatcttagcgtgatgctaagtggtaccttacgattattggatataaatcttctagtacaacctcaagagctgaaatcatgactaggttcacgtgccagccattgagaaagtccttcctgatcactcagcctgaagacacattccccacgacaggcatacccttcactggtaagggagagggaaatgaatattaattgaacacctactaagtgctggaccccatgctaggyactgtcacttctgttagttgaatttcatactcactttgtcccacgttccctttttctatacattcctgtctctcgtttttctctgtggtctggaattataattgcagacaatttctagatttttaaaaatcactttcatgagatgttttattcaacccaatacatccaaaatattaccatttcaacatggaatcaatatcaaggtggattcaaaagatattttatactctttcttttgtactaagtattcccagccggacgtgttattatgaagtacatcctagttcagggtcagccaca

SEQ ID NO: 127767 - DNA, 601 bp, Human
acactgaaaacctggcttaatcaccaaccagcagatgaccttgggcaagccaccttggtaaactggagacaaccacacttcctacctcaaagggccatccaaaggcataaatgaattaatacatcttagcgtgatgctaagtggtaccttacgattattggatataaatcttctagtacaacctcaagagctgaaatcatgactaggttcacgtgccagccattgagaaagtccttcctgatcactcagcctgaagacacattccccacgacaggcatacccttcactggtaagggagagrgaaatgaatattaattgaacacctactaagtgctggaccccatgctaggcactgtcacttctgttagttgaatttcatactcactttgtcccacgttccctttttctatacattcctgtctctcgtttttctctgtggtctggaattataattgcagacaatttctagatttttaaaaatcactttcatgagatgttttattcaacccaatacatccaaaatattaccatttcaacatggaatcaatatcaaggtggattcaaaagatattttatactctttcttttgtactaagtattc

SEQ ID NO: 127768 - DNA, 601 bp, Human
tatttctaaggcatcctctcttaaccataagttatgaacatttccagagatgtacataaaaattattaatacatgtatgtttctgtttctatctgtctatcttatgagctccgtctttctctgtctctcttccaacatccccttcaccagcacccctctgtccctctctcttagaaaggaatcacaggagcatttgttggtctgaattccagcttccagctctcaggtctaagggagatgggttccattgtcatagcaacagtaacattggccccagtgacagttatagaaatggctaaargaaagggcagattcaatgaggaccaaagaagatacacatactaccagagaaagagaagtggaaaaagggtgtgagggagggatcagggagttggcaggggtggggctgggtgatactcacaaaggaagtcggagagccactcgggctggttgtagtgaacaatagcaacacacagcgtgttgagagctaccaaactgagtacagtccagtagaaggcctgagttttgaccatgcggcggatgtagaaacgcatcctcctctcctttttgtgaaaaaaggtcgagttctccagcttggcac

SEQ ID NO: 127769 - DNA, 601 bp, Human
aaataagtagagaaaatgagggcaacatataagccactccttatttctaaggcatcctctcttaaccataagttatgaacatttccagagatgtacataaaaattattaatacatgtatgtttctgtttctatctgtctatcttatgagctccgtctttctctgtctctcttccaacatccccttcaccagcacccctctgtccctctctcttagaaaggaatcacaggagcatttgttggtctgaattccagcttccagctctcaggtctaagggagatgggttccattgtcatagcaayagtaacattggccccagtgacagttatagaaatggctaaaggaaagggcagattcaatgaggaccaaagaagatacacatactaccagagaaagagaagtggaaaaagggtgtgagggagggatcagggagttggcaggggtggggctgggtgatactcacaaaggaagtcggagagccactcgggctggttgtagtgaacaatagcaacacacagcgtgttgagagctaccaaactgagtacagtccagtagaaggcctgagttttgaccatgcggcggatgtagaaacgcatcctcct

SEQ ID NO: 127770 - DNA, 601 bp, Human
agaagagagaagtagagtcagaaataagtagagaaaatgagggcaacatataagccactccttatttctaaggcatcctctcttaaccataagttatgaacatttccagagatgtacataaaaattattaatacatgtatgtttctgtttctatctgtctatcttatgagctccgtctttctctgtctctcttccaacatccccttcaccagcacccctctgtccctctctcttagaaaggaatcacaggagcatttgttggtctgaattccagcttccagctctcaggtctaagggagakgggttccattgtcatagcaacagtaacattggccccagtgacagttatagaaatggctaaaggaaagggcagattcaatgaggaccaaagaagatacacatactaccagagaaagagaagtggaaaaagggtgtgagggagggatcagggagttggcaggggtggggctgggtgatactcacaaaggaagtcggagagccactcgggctggttgtagtgaacaatagcaacacacagcgtgttgagagctaccaaactgagtacagtccagtagaaggcctgagttttgaccatgcggcg

SEQ ID NO: 127771 - DNA, 601 bp, Human
aaaaaaaaaaaaaaaaaaggcaaaaaacgcaattaattttgcaccaacctaacaggaaagaagcagaaggtttgaaagaagagagaagtagagtcagaaataagtagagaaaatgagggcaacatataagccactccttatttctaaggcatcctctcttaaccataagttatgaacatttccagagatgtacataaaaattattaatacatgtatgtttctgtttctatctgtctatcttatgagctccgtctttctctgtctctcttccaacatccccttcaccagcacccctctgtcyctctctcttagaaaggaatcacaggagcatttgttggtctgaattccagcttccagctctcaggtctaagggagatgggttccattgtcatagcaacagtaacattggccccagtgacagttatagaaatggctaaaggaaagggcagattcaatgaggaccaaagaagatacacatactaccagagaaagagaagtggaaaaagggtgtgagggagggatcagggagttggcaggggtggggctgggtgatactcacaaaggaagtcggagagccactcgggctggttgtagtgaacaa

SEQ ID NO: 127772 - DNA, 601 bp, Human
cctactgtagcctgggtgacagagcaagaccttgtctaaaaaaaaaaaaaaaaaaaaaaagcaacaattatgccctaccctccaaccaacaagctaaccaaccttaggccgattttaaaaggaatgagaaaaatatcagtgggtctccatcttgtagtttttgccctggttcgatgagaaggatcggatatagattattgccaaggacttttgtgttgactggtgggttcctgggtgtttatcacatttaaaaaataaactaattaactgaataattcacataataacaatggaccataamggccccataatgccagggtgctgtgatctaacaattatatttaatctacttctacgtgactgagctccaaaggataaaaggaaatagaaatcataatgatatcctatttgtaatcctgaagttaagtacttagttggagcgacacaggcaacccacctaaggtatggcttttctcctaactcagaaaacttgtcttatgtcccctagaaatcctgtgttgtgagtgacctaaaaagtcttgagtaagacaaagccttttgttctttgatgagcaagcataaaattgcaaatgcctcaggg

SEQ ID NO: 127773 - DNA, 601 bp, Human
attctgcatagtctagaagggagaaggaggaaacagagaggaggttaggcttgctgagggtaggggttccaggtggctctgactttccttttattatcatttttaaactttttattttttgtagagatgaggtcttgctatgctgttaggctggtttcaaactcctggcctcaaacagtttccctgatttggcctccaacatgctagaactacaggcatgtgtcaccacacccaacttctgacttatcttttttctttttaaaatttttatgtggagatgggggtctcactatgttgcccwggctggtcttgaactcctggcctcaagtgatcctcccagcacagcctcccaaagtgctgggattatatacatgacccactgtggccacgccctgtccaaggtgtccttcccatgggcctcagtttcccctctgttaaaaaggaagagctggctgggcatggtggctcacgtctgtaatcccagcactttgggaggcctaggcggtcagatcaactgaggtcaggagtttgagaccagcctggctaacatggcaaaccccgcctctactaaaaatacaaaaattagccagtgtggtgacac

SEQ ID NO: 127774 - DNA, 601 bp, Human
ggggtgactttacctttctccctttaatgtgtccaggtatctgtcattccaggcaagagctggagaaatgaactcttagaaacaagagcacttaccccacagtcaaagcagttgaaggaagagtggaagtaaggccgcgtcccaagcccgtacatttttataaacatttcggacataaagagtcctaagaaaatgaattctgcatagtctagaagggagaaggaggaaacagagaggaggttaggcttgctgagggtaggggttccaggtggctctgactttccttttattatcatttttwaactttttattttttgtagagatgaggtcttgctatgctgttaggctggtttcaaactcctggcctcaaacagtttccctgatttggcctccaacatgctagaactacaggcatgtgtcaccacacccaacttctgacttatcttttttctttttaaaatttttatgtggagatgggggtctcactatgttgccctggctggtcttgaactcctggcctcaagtgatcctcccagcacagcctcccaaagtgctgggattatatacatgacccactgtggccacgccctgtccaaggtgt

SEQ ID NO: 127775 - DNA, 601 bp, Human
tttctaggatgaattcctagcaatggaatgctgggtcatatctccatcttgtagtttttgccctggttcgatgagaaggattggacgtagattattctccaggacttaggttttgtgtggactagtgggttactgggtgttaatcacatttaaaaaataaattaattaactgagtaattcacaaaataacaaaggaccataatggctccataatgccagggtgttgtaatctaacaattatacttcatctacctccacatgactgagctacaaaggaaaagaagaaatagaaatcatattratgtcctgtttgtaatcctgaagttgggtacttagttggagcgacacaggcaacccacctaaggcatggcttttctcccaacttggaaaacttgtcttatgtcccccacttagctttccaaagggggtctatacgttttcctcccactggcggtggttgagggttctgggtacactgtatccttgccagtgtttgggattgttttctcattccttctgcatccatctgagtctctcatattcaggggtgactttacctttctccctttaatgtgtccaggtatctgtcattccaggcaag

SEQ ID NO: 127776 - DNA, 601 bp, Human
tttttttagtatagacggggtttcgccatgttggccaggctggtcttgaactcctgacttcaggtgatccacctgcctccgcctctcaaagtgctgggattataggtgtgagccactgtgcctggcctacttttatttcttagagatggggtctcactctcttgtccaggctggagggcagtggtgtgatcatagctcactgcagcctcaaactgctgggctcaagcaatcctcccaccttagccttctgagtagctggggctacaggtgtgcaccaccacacctggctaattattattawtttttgtagagacagggtcttgctatgttgcctgggctggttttcaactcctgggctcaagcaattctgctgcctcagcctcctgaatagctgaggctataggcatgaggcatcacacccggctttcttttctttttaatggaaagaaattggttttattctttaactacttgggtcatttatgtagggaaggtttgcttgtttgtatgtattttgttttctccaacaacataattttctataatggcagaaaacagtacaacattcagttattataaattattaagctggctgggtgtg

SEQ ID NO: 127777 - DNA, 601 bp, Human
attcacataacataaaattcacactttgaattacacaattcagtgcctttaggtacatgcacaatattctgcaactatcacctctatcaagttccaaaacatttgcatcacccccaaaggaggccctgtccccatgagcagttactccccactctccctcacccagaccctagcaaccactaatctactttctgtctctatggatttgcctgctctggacatttcatacaaatggaattatgcaatacttgaccttttgtgtttggtttcttttaccgagcgttgtgttttcaaggtcctygcctttttaacgtattcaagtatcatccttaaaaaatacagtttaaggcggggcgtggtggctcacgcttgtaatcccagcactttgggaggccagggcaggtggatcacctgagatcaggatttcgagaccagcctgggcaaattgctgaatcccggtctctacaaaaaatacaaaattagccgggggtggtggtgcatgcctctaatcccagctacttgggaggctgaggcgggagaatggcttgaacccgggaggtggaggttgtagtgagccaagattgcgccactgcactccagc

SEQ ID NO: 127778 - DNA, 601 bp, Human
gaggtgaaattcacataacataaaattcacactttgaattacacaattcagtgcctttaggtacatgcacaatattctgcaactatcacctctatcaagttccaaaacatttgcatcacccccaaaggaggccctgtccccatgagcagttactccccactctccctcacccagaccctagcaaccactaatctactttctgtctctatggatttgcctgctctggacatttcatacaaatggaattatgcaatacttgaccttttgtgtttggtttcttttaccgagcgttgtgttttcraggtcctcgcctttttaacgtattcaagtatcatccttaaaaaatacagtttaaggcggggcgtggtggctcacgcttgtaatcccagcactttgggaggccagggcaggtggatcacctgagatcaggatttcgagaccagcctgggcaaattgctgaatcccggtctctacaaaaaatacaaaattagccgggggtggtggtgcatgcctctaatcccagctacttgggaggctgaggcgggagaatggcttgaacccgggaggtggaggttgtagtgagccaagattgcgccactgc

SEQ ID NO: 127779 - DNA, 601 bp, Human
aggagagggtcatgatcctgccactgcactctagcctgggcaacagagcaagaccctatctcaaataaaataaaaaataaaataaaataaaaagggacatgtggataccctggaagtttccagagacactgtgatataactaccatcctgaattttgtaataaccattttcttaccttaaaaaaaactgaggtgaaattcacataacataaaattcacactttgaattacacaattcagtgcctttaggtacatgcacaatattctgcaactatcacctctatcaagttccaaaacatttkcatcacccccaaaggaggccctgtccccatgagcagttactccccactctccctcacccagaccctagcaaccactaatctactttctgtctctatggatttgcctgctctggacatttcatacaaatggaattatgcaatacttgaccttttgtgtttggtttcttttaccgagcgttgtgttttcaaggtcctcgcctttttaacgtattcaagtatcatccttaaaaaatacagtttaaggcggggcgtggtggctcacgcttgtaatcccagcactttgggaggccagggcaggtg

SEQ ID NO: 127780 - DNA, 601 bp, Human
acattcatctcctgatctgttggcctcaccataattgaataatgataaccataaaatctgtgtttcaaagtggtgtgaaaaggccaggtagagaaggaggagttcagggaagccccttggatgtggagcaggcactttcatctgtgacactgagaggtgttggcccgtggggccaggtggaggctgtacctgaaacaccgtcattattgctgctggaaaagtatcgaagttggtgggaggagtcccttcatcgaaattaaacctgcagggaggacacagacatttcacgttggccccaccyggggtgctctgagggtgtggctcagtatctcatctccaaggaaacgaacgtctccatcatctctgtccccaggaaaccctgagtggtacccagggccctgcccatttgggtgaccgcaatgggtgtctgggctacgaggaaggcagcctgcacggtggaggggactgtgtgttccctgagcctgaccccagggaaccaggagttggaattcctgtgaaggacttactggccgccgaagagttgcattcccaaaagggcgaagacgacaatgaacaggaaaaggagaaacaacaggctgat

SEQ ID NO: 127781 - DNA, 601 bp, Human
taaaaatacaaaaattagccaggcatggtggtatgcacctgtagtctcagctactcgggaggctgaggcaggagaatcgcttgaacccaggaggcagaggttgtagtgagccaagaacgtgccgtcgcactccagcctgggcaacagagcgagactccatctcaaaaaaaaaaaaaaaatcgcttatgtgggggctcagaacttcccttcatggaaggtttcctcttcaactccctgtcttggggtctcatttagaaactacctccccaggagaaggagagagtgaagtcacattttctayacactctcagtccctcaaagagaaagaatccaccaaagatgctctgaaggtcccggctgggccagtcccaagcctcagggaatgcgcccacatgggtgcagaagttgctttgggttgatcaccctggaatatgagaccaaggtatcttcagatttgatgggtgtattagccattttttttctctgccttttttttaagagacagggccttgctctgtggtgcaggctggagctcacggcagccttgaactcctgggctcaagcaatcctcccgccttggtctcccaaagtgctgagatta

SEQ ID NO: 127782 - DNA, 601 bp, Human
gcactttgggaggccgaggcaggcagatcacgaggccaggagttcgagaccagcctggccaacatagtgaaaccctgtctctactaaaaatacaaaaattagccaggcatggtggtatgcacctgtagtctcagctactcgggaggctgaggcaggagaatcgcttgaacccaggaggcagaggttgtagtgagccaagaacgtgccgtcgcactccagcctgggcaacagagcgagactccatctcaaaaaaaaaaaaaaaatcgcttatgtgggggctcagaacttcccttcatggaargtttcctcttcaactccctgtcttggggtctcatttagaaactacctccccaggagaaggagagagtgaagtcacattttctatacactctcagtccctcaaagagaaagaatccaccaaagatgctctgaaggtcccggctgggccagtcccaagcctcagggaatgcgcccacatgggtgcagaagttgctttgggttgatcaccctggaatatgagaccaaggtatcttcagatttgatgggtgtattagccattttttttctctgccttttttttaagagacagggccttgctctg

SEQ ID NO: 127783 - DNA, 601 bp, Human
ttcctagtctccacccaccagatgccagtagcaccctctccctagctgtgacaaccaacaatgcttgcagacattgctacatgtccttggaggacagacttgtccttgggtgagaacctctgagctaaagatacatgactagcgatcagtgctattaataatcgcttatgggccaggtgtggtggctcatgtctgtaatcccagcactttgggaggccgaggcaggcagatcacgaggccaggagttcgagaccagcctggccaacatagtgaaaccctgtctctactaaaaatacaaaamttagccaggcatggtggtatgcacctgtagtctcagctactcgggaggctgaggcaggagaatcgcttgaacccaggaggcagaggttgtagtgagccaagaacgtgccgtcgcactccagcctgggcaacagagcgagactccatctcaaaaaaaaaaaaaaaatcgcttatgtgggggctcagaacttcccttcatggaaggtttcctcttcaactccctgtcttggggtctcatttagaaactacctccccaggagaaggagagagtgaagtcacattttctatacactctcagtcc

SEQ ID NO: 127784 - DNA, 601 bp, Human
tttatccaccaacggctgctccttttaaggtgtggcacaaaaaattcacagtactgctggactgcagttccttgggggcagagcaggggaccagagaaagaccaaggcaaaggattaggtgttgacagacgcaagttgtgctgatgcatactgaaagaaccaaggggatattcaaacagcacctacatgctcctttaaaaaagatccaacttccttccttctatccatatccccatgaggataaagtaaatgttaaagaactccaaaaacatgaatctgctaaaacagggtttctaagcckcagcactgctgatatttggggccagattattctatttggggctgtcctgtgcattgtaggatattgagcagcattcctagtctccacccaccagatgccagtagcaccctctccctagctgtgacaaccaacaatgcttgcagacattgctacatgtccttggaggacagacttgtccttgggtgagaacctctgagctaaagatacatgactagcgatcagtgctattaataatcgcttatgggccaggtgtggtggctcatgtctgtaatcccagcactttgggaggccgaggcaggc

SEQ ID NO: 127785 - DNA, 601 bp, Human
ggtaaccggggcttggtcttgctggggagctctaggggtcatcccacctgagggtgagggagctggggtatttatccaccaacggctgctccttttaaggtgtggcacaaaaaattcacagtactgctggactgcagttccttgggggcagagcaggggaccagagaaagaccaaggcaaaggattaggtgttgacagacgcaagttgtgctgatgcatactgaaagaaccaaggggatattcaaacagcacctacatgctcctttaaaaaagatccaacttccttccttctatccatatycccatgaggataaagtaaatgttaaagaactccaaaaacatgaatctgctaaaacagggtttctaagccgcagcactgctgatatttggggccagattattctatttggggctgtcctgtgcattgtaggatattgagcagcattcctagtctccacccaccagatgccagtagcaccctctccctagctgtgacaaccaacaatgcttgcagacattgctacatgtccttggaggacagacttgtccttgggtgagaacctctgagctaaagatacatgactagcgatcagtgctatta

SEQ ID NO: 127786 - DNA, 601 bp, Human
gtttgtctgggaggtgatctcaggaagcaccagtaggggagaggagaagtgagaaaagggaaaagagggtggaacgtaaacagtatgtgatcaagcgagtttccactgtaggtaaccggggcttggtcttgctggggagctctaggggtcatcccacctgagggtgagggagctggggtatttatccaccaacggctgctccttttaaggtgtggcacaaaaaattcacagtactgctggactgcagttccttgggggcagagcaggggaccagagaaagaccaaggcaaaggattaggtrttgacagacgcaagttgtgctgatgcatactgaaagaaccaaggggatattcaaacagcacctacatgctcctttaaaaaagatccaacttccttccttctatccatatccccatgaggataaagtaaatgttaaagaactccaaaaacatgaatctgctaaaacagggtttctaagccgcagcactgctgatatttggggccagattattctatttggggctgtcctgtgcattgtaggatattgagcagcattcctagtctccacccaccagatgccagtagcaccctctccctagct

SEQ ID NO: 127787 - DNA, 601 bp, Human
ccccgtcctgatctgccatgggcaggtggtaactttgccagagaaacattctcccaccgcctccaccttggtgagctcctgggcgttggccagattgtccacagcgatggccaagaacacattcaggagggtgtctgcaaatgtctgagtcaggaaaagcaaccactggtgggacaccacttgggccctgggtatctgggtctctcagtaccctcccttgagcccctgcaacctctcctctgccagaggtccaggcctgtccccttctctctctccatgaaggatacagttcccaaagagygtcagtacaatgaaatagatggagaacaccatgccgccctgcacgcccccctgagacttgatcccgtcgtacatgacctcgttccagtcttcgcccgtcaggatctgaaaggggaggaagaaacacacagccaacccccctctcagccacgggccccttggagatgcagctgtggagccggaatccgcccaccccatccccaagcccaggaggtctttaacaatcctgcccggtttgcagagccagactccgtgttggcttctccttggcttttctctttgtttgcgagtagaaagggcc

SEQ ID NO: 127788 - DNA, 601 bp, Human
agtttgacatctaactcattatgaagcctattttaacacacagccagataacaaaaaataaaaatgtcccttctcttcctacaatgaagactttcctgcagcctatttttttttcttttgtttgttttcagagacagagtctcccttggttgcccagcctggagtgcagtggcacaatcatagctcactgtaaccttgaactcctgggctcaagcaatcctcccacctcagcctcccaagcaactgggactacaggtgcatgccactatgcctgtatacatttaattttttttttttttttgtagagacagggtctcactatgttgcccaggctggtcttgaacttctggcctcaaatgatcctcccatttcggcctcccaaagtgctgggattccaggcatgtgccaccatgcctggcccctgcatcctgtcttaatgagctggaaagcagtgcaaagattttcctctcactaggctttctgagccatgtgaactctctgaaccaactttcaaaaaacaccaactaccctcacacacagaagagcctggcatccgatggcccctgccatgcactgtcaacagcccccagaaggagaatga

SEQ ID NO: 127789 - DNA, 601 bp, Human
tgctcgtcctaaaaggcacgtggaatctttgttcacaaaacatgaactaggccttggggactcacttctgaccctgttgctgaccaggggcaacatttgaaatatttcgaccaatcagaaccaaggctccccaattggaatgggtacctgctattggttaagtgtattgctatcccctctgtgtataagtttgacatctaactcattatgaagcctattttaacacacagccagataacaaaaaataaaaatgtcccttctcttcctacaatgaagactttcctgcagcctatttttttttcttttgtttgttttcagagacagagtctcccttggttgcccagcctggagtgcagtggcacaatcatagctcactgtaaccttgaactcctgggctcaagcaatcctcccacctcagcctcccaagcaactgggactacaggtgcatgccactatgcctgtatacatttaattttttttttttttttgtagagacagggtctcactatgttgcccaggctggtcttgaacttctggcctcaaatgatcctcccatttcggcctcccaaagtgctgggattccaggcatgtgccaccatgc

SEQ ID NO: 127790 - DNA, 601 bp, Human
tcttcctcttgctcgtcctaaaaggcacgtggaatctttgttcacaaaacatgaactaggccttggggactcacttctgaccctgttgctgaccaggggcaacatttgaaatatttcgaccaatcagaaccaaggctccccaattggaatgggtacctgctattggttaagtgtattgctatcccctctgtgtataagtttgacatctaactcattatgaagcctattttaacacacagccagataacaaaaaataaaaatgtcccttctcttcctacaatgaagactttcctgcagcctrtttttttttcttttgtttgttttcagagacagagtctcccttggttgcccagcctggagtgcagtggcacaatcatagctcactgtaaccttgaactcctgggctcaagcaatcctcccacctcagcctcccaagcaactgggactacaggtgcatgccactatgcctgtatacatttaattttttttttttttttgtagagacagggtctcactatgttgcccaggctggtcttgaacttctggcctcaaatgatcctcccatttcggcctcccaaagtgctgggattccaggcatgtg

SEQ ID NO: 127791 - DNA, 601 bp, Human
ctgggtacataacagctgctaaccaaatatttattgagtgaaagtgggtggaaggacaagaagtgtctcttcctaaagctcagttctgtcaaggaccacccccactgcttcccaaatctgtgcctgggatagtgtggacgttcaggagccagggtagcatcccagggattaggggcacttacacagctatagacatgttggccgcggacagaggactcacttctgccacctccttggctttctgtagggcaagtttctggttcgctgcttcttcttcctcttgctcgtcctaaaaggcacrtggaatctttgttcacaaaacatgaactaggccttggggactcacttctgaccctgttgctgaccaggggcaacatttgaaatatttcgaccaatcagaaccaaggctccccaattggaatgggtacctgctattggttaagtgtattgctatcccctctgtgtataagtttgacatctaactcattatgaagcctattttaacacacagccagataacaaaaaataaaaatgtcccttctcttcctacaatgaagactttcctgcagcctatttttttttcttttgtttgttttcagag

SEQ ID NO: 127792 - DNA, 601 bp, Human
tcttgttggtgttgttgttgcggttctcctgcgggtccaccaccagcggccggtccaagtgcgtcttcatgtctggccgcaggtgccgcgtgtaggcagccttccagcgctcgtccgggtccatttcgttatacagggcctcccggctggccagcaagttctgctttcgcatctcactggtccgctgctcccacacggacttggctggcttttgattcttctgttgctctttcctgcagtggcatggtcacaggacttagagcattgctaggcactgtagcttggatggatgacccaggckaaccaacccacatctcagcctcccactcctgctctccaccctctactccccactgaatgctaggagtctgtgagcatctgagtcaggtcccagcctcctctgctcaagaaccctccatggctcccacctggctaggggcaaaagcccaagtcctcccccctgacccagaaggccctgtgtaatctgcttgtcacctccttgccttcacctcctcacacttactattcgattctagtcacacaggcctccttcacatcaggcatgttcctgcctcagggccattgcctatgctgttccctc

SEQ ID NO: 127793 - DNA, 601 bp, Human
tcaggctccactgagtccttagccctacggaattacaatttgtgttttaacaagatccctggggattcacatacacattagattttgagaagtgctggcctacctcatatgtcatacaacaggatcacttaaacccatcattaaaaaaatcaatattatgccctgatggtaatataaaagaggactaagagcaggttaatttgtaataggacaatgtctacgatgtctattttaatgggtaagttgttgagtccctatatgcagaatcactatagcatctgctagaaagtattacaaaatrtcgttatgaaaaagaggatgctggttctgaatggataagttgctggcctggaagatgcctcaaaagctttctaacatttttatttatttttaaaaggtgaggtctcactatgttgcgcaggctggtcttgaactccggggctcaagtggatcctcccaccttggcctcccaaagtgctgggactacaggcatgagccaccacatcccgctgcatccaaagctttgaaactctgctctcccttcaattctaacggcccaaagtgccttttctttttctttattttttattttattttttga

SEQ ID NO: 127794 - DNA, 601 bp, Human
gactttctaatgtccctcaaagaggtgaaaaatcttgcttgtaattacctgtgcttttagtttgcttgtttgtttgggttttttctttctttctttcttttttttttttttgagacaaggacttgttctgttgcccaggttggaatgcaatggcataatcatagctcactgtaatcttgaactcctgggctcaagcaatcctcctgcttcagccttccaagtagctagaactacaggcacctgccgccacacctggctaattaaaaaacttcttttgtagagatcgaggtctccttatgtygcccaggttggtctcgaactcctggcctcaagcgattctccttcctcagcctcccaatgcactgggattacaggtgggagccactgcacctgatcctgtgcttttagtttaaacctaactcttttacataagaacacaacatattttttgtatgtttttaatatacattgcattttcctgcaatgcaactattaaataaatggaagaaagactagactcttttgtatatggaactttgccaagaggtgttcaacattgtggaacatcttgacactgctggcaactcccctcatgtggttt

SEQ ID NO: 127795 - DNA, 601 bp, Human
agaggaaaggataattcttttccatatgagactgtcttgtacatggtagggtatttagtatactggcctcccattctctaaatgctcaggctggtctcgaactcctgggctcaagcaatcctttgcctcagcctcctgagtagctgggattacaggtgcataccactgtacctggctttttttttttttttttttttttgagacagagtcttgttctgttgcccaggctggagtgcagtggtgtgatctcagctcactgtaacctctgcctcgcaggacaattcttgtgcctcagcctccygagtagctgggattataggcgtccaccaccacgcctggctaattttttgtatttttagtagagacagggttttgccatgttggccaagctggttctgaacccctgacctcaggtgatccacctgtctctgcctcccaaagtgctgggattacaggcgtgaaccatcacactggcctgtacctggctcttcattggtctttactatacagagagtgctgtggtaaacactttattccacctaaactcccgttttgatctctcattcccctgagtgactgacagccccagagtctcatcaat

SEQ ID NO: 127796 - DNA, 601 bp, Human
tggagaatgaaaaacacagggtacgtttgcaaaaagcctcaaggaatgactgaagaagaggaaaaatgtacaaggcagacctccgaaggccactggctttgtcacaacagagaacgaaaatgtctttttattattttatattctcaaataaagttttatctttgccactttttttaaagcagatgaatgactgatcttgaatttttttctcttaaagtgcatgaatcttcatgaacttttatttccaaagagccttagaacctctttatcagccaaatgaataatgtctctcccggccagrttgtttgatgtgtctattaataatggaattagcagtactcccctggttcagaatgggggtctggccagctgaggctatgggggtgaaagtggggagatagtttcttcctctgaagaagagagggagcaggaaccatctgtgggatttgggcaagctgggtccttattgctttttatgtttattgatgagagtattactaacagtattagctgacacttcctgagtgcttactattactgctaaaaatagcattcattgagtacttaataatattcatattaataatagctaacatggcca

SEQ ID NO: 127797 - DNA, 601 bp, Human
ttggagaccagccttggcaatgtggcaaaaccctgtgtctacaaaaaatacaaaagattagctaggcatggtcatgcacacctgtagtcccagctgctcgggaggctgaggtgggagaatcacctgagctcaggaagtcaaggctgcagtgagccatgattgtaccactgtactccggggcctggatgacaaagcgagaccatgtctcaaaaaaaaaaaattatcaatatgctggagaatgaaaaacacagggtacgtttgcaaaaagcctcaaggaatgactgaagaagaggaaaaatgyacaaggcagacctccgaaggccactggctttgtcacaacagagaacgaaaatgtctttttattattttatattctcaaataaagttttatctttgccactttttttaaagcagatgaatgactgatcttgaatttttttctcttaaagtgcatgaatcttcatgaacttttatttccaaagagccttagaacctctttatcagccaaatgaataatgtctctcccggccagattgtttgatgtgtctattaataatggaattagcagtactcccctggttcagaatgggggtctggccag

SEQ ID NO: 127798 - DNA, 601 bp, Human
tcatttaatccctgcaactaccaccatccgagatgggtatagtgatcagccccatttcacacaggaggagactgaggttcagagaggcaaagttacccagagttacccagctggaaaacagctgagctgggctctctggtgttcaaagctttaatggggcagcttggtacagtggcttacgcctgtaatcctagcactttgggaggctgaggaaggaagatcgcttgagcccaggagtttgagatcagtctggggaacatagtgagaccccatctctaaaaaaaaaaaaaaaaaaaaaaaattagctgggcgtagttgcacgagactgttgttccagttacttgggaggctgaggtgggaagatcatttgagtccaggagtttgaggctacagtgagctatgattgtgccactgcactccagcctgggtaacagagcaagactgtttttttttaaaaaaaccaacttgggcccattgggggtaccgtaagaattagagtgctaagtaattaaccactccctacccccatgcaggataaactgtggagctcaaaagtccagcatctctcttcctgttccttttggggagcaggttgtcatgg

SEQ ID NO: 127799 - DNA, 601 bp, Human
tccttgtagagcgtctgttggctctgtttgttgggaaattttaacaagctcagcctgcagaggcctaatatcaatttccgggaggtttcatttccaaagtgtctccaaggagaactcaaaaggggcagaaaactttgaagctgcacccctacccccttctccctggggatctggcatcctctgcctggaataggtggccagttgcataacacctgctgtgcgtggcgttcttgtgccagctgatcacttgggcatccttctgcagagggctgtggacaccttgcctggggcacactcagaycctgagatcggattatgtgggggtgataataacagcagttcctgtttattgcttatctcgtgtccccaccccctgtcctaaggacctcacgtattaactcatttaatccctgcaactaccaccatccgagatgggtatagtgatcagccccatttcacacaggaggagactgaggttcagagaggcaaagttacccagagttacccagctggaaaacagctgagctgggctctctggtgttcaaagctttaatggggcagcttggtacagtggcttacgcctgtaatcctagcactttgg

SEQ ID NO: 127800 - DNA, 601 bp, Human
ttaactcctgggctcaagcgatcttcccaccctgggtagctgggattgcaggcacacactgccatgcctggttatttttattaatttttgtagagacagggtctcactatgttgttcaggctggtattgaactcctggggctcaagagatccacctgccttggccgcccaaagtgctgggattacaggtgtgagccaccacgcctggccctgtgtatgtatatgtgtatatatgtgtatatatatacatacacatatatatacacatttcagagagtgatatccctgccataaagcaggcycagttaagttataatttcaaagagaacctaaatcctttggccaccagctcaagaagccatggagaaactcgtggcggcattttcttagaggaataccatctaccaagagcagatggaaaagggtctgccaatgtgttttgtcttgtttttgcttccttgtagagcgtctgttggctctgtttgttgggaaattttaacaagctcagcctgcagaggcctaatatcaatttccgggaggtttcatttccaaagtgtctccaaggagaactcaaaaggggcagaaaactttgaagctgcacc

SEQ ID NO: 127801 - DNA, 601 bp, Human
tttctggcctaaatgaggtaaattctaaaccaatatttcctcaacatcttggacagtccacaaagaaatccctaattctaacctgcttgtgatgctttttgagaagttgtgtatcatgaaaacctggctgagagtattttctcatcatctgtaatgtgtgtgtgtgtctgtgtgtgtctgtgtgtgtataataataataatatatttttaagagacagggtcttgctctgttgcccaggctgaagtgcagtggtatgaccatagctcactgcaacttttaactcctgggctcaagcgatcytcccaccctgggtagctgggattgcaggcacacactgccatgcctggttatttttattaatttttgtagagacagggtctcactatgttgttcaggctggtattgaactcctggggctcaagagatccacctgccttggccgcccaaagtgctgggattacaggtgtgagccaccacgcctggccctgtgtatgtatatgtgtatatatgtgtatatatatacatacacatatatatacacatttcagagagtgatatccctgccataaagcaggcccagttaagttataatttcaaaga

SEQ ID NO: 127802 - DNA, 601 bp, Human
agtttctatattatatatataacatatatattatatatatttatcttatctatcttattttttgagatggagtcttgctctgtcacccaggctgaagtgtaatgcacgatctcggctcactgcaacctctgcctcccaggttcaagtgattctcctgcctcagcctccagagtagctgggactacaggcctgtgccaccacacccggctaatttttttttttttttctgtagttttagtagagacaggattttgccatgttggccaggctaaaactcctggcttcaagagatccattggcmttggcctcccaaagtgttaggattacaggcgtgagccaccatttctggcctaaatgaggtaaattctaaaccaatatttcctcaacatcttggacagtccacaaagaaatccctaattctaacctgcttgtgatgctttttgagaagttgtgtatcatgaaaacctggctgagagtattttctcatcatctgtaatgtgtgtgtgtgtctgtgtgtgtctgtgtgtgtataataataataatatatttttaagagacagggtcttgctctgttgcccaggctgaagtgcagtggtatgac

SEQ ID NO: 127803 - DNA, 601 bp, Human
tttgcaatgggaacgtctatcctatgcctgtcccgctgttatattctggaaacatacaaagatcacttgttctgtagtttctatattatatatataacatatatattatatatatttatcttatctatcttattttttgagatggagtcttgctctgtcacccaggctgaagtgtaatgcacgatctcggctcactgcaacctctgcctcccaggttcaagtgattctcctgcctcagcctccagagtagctgggactacaggcctgtgccaccacacccggctaatttttttttttttttctgtagttttagtagagacaggattttgccatgttggccaggctaaaactcctggcttcaagagatccattggccttggcctcccaaagtgttaggattacaggcgtgagccaccatttctggcctaaatgaggtaaattctaaaccaatatttcctcaacatcttggacagtccacaaagaaatccctaattctaacctgcttgtgatgctttttgagaagttgtgtatcatgaaaacctggctgagagtattttctcatcatctgtaatgtgtgtgtgtgtctgtgtgtgtctgtgtg

SEQ ID NO: 127804 - DNA, 601 bp, Human
cccttccaatttctcccttttgcaatgggaacgtctatcctatgcctgtcccgctgttatattctggaaacatacaaagatcacttgttctgtagtttctatattatatatataacatatatattatatatatttatcttatctatcttattttttgagatggagtcttgctctgtcacccaggctgaagtgtaatgcacgatctcggctcactgcaacctctgcctcccaggttcaagtgattctcctgcctcagcctccagagtagctgggactacaggcctgtgccaccacacccggmtaatttttttttttttttctgtagttttagtagagacaggattttgccatgttggccaggctaaaactcctggcttcaagagatccattggccttggcctcccaaagtgttaggattacaggcgtgagccaccatttctggcctaaatgaggtaaattctaaaccaatatttcctcaacatcttggacagtccacaaagaaatccctaattctaacctgcttgtgatgctttttgagaagttgtgtatcatgaaaacctggctgagagtattttctcatcatctgtaatgtgtgtgtgtg

SEQ ID NO: 127805 - DNA, 601 bp, Human
acggtgtttttagtaagtggaagagagacaagctaatttattttcagaccaaagtaggtaagtgggatgcttctatgaatacttcccggaaggagaaaccgaggcagttccactgtttctctgagactgcacaggggaaatagacaggtccaagcaactttctgccttctcagttttgtgagtgggtcatagagggacatttcagaagacaggctgacctgggtttgaatctcggcaatgtcttttttttttttttttttttgagacagggtctcactctgtcgcccaggttgtagtgcastggcgcgatctcagctcactgtaatcgccacctcccaggctcaggcaatcctcccacctcagccttcccagtagctgggacttcaggtgcctgccaccacgcctggctaactttttaatttttctttttgtagagatgaggtctcactatattgcccaggctggtctcaaactcctgggatcaagcgaccctcttgcctcagcctcccaaaatgctgggattataggcatgagccactacacacagggaaatctcagcaacatcactagctgtgcaaccctgtgtgatttgcttaacctc

SEQ ID NO: 127806 - DNA, 601 bp, Human
ctcctcattttatttttgcattttaacttgcaaaaacccacggtgtttttagtaagtggaagagagacaagctaatttattttcagaccaaagtaggtaagtgggatgcttctatgaatacttcccggaaggagaaaccgaggcagttccactgtttctctgagactgcacaggggaaatagacaggtccaagcaactttctgccttctcagttttgtgagtgggtcatagagggacatttcagaagacaggctgacctgggtttgaatctcggcaatgtcttttttttttttttttttttgagacagggtctcactctgtcgcccaggttgtagtgcagtggcgcgatctcagctcactgtaatcgccacctcccaggctcaggcaatcctcccacctcagccttcccagtagctgggacttcaggtgcctgccaccacgcctggctaactttttaatttttctttttgtagagatgaggtctcactatattgcccaggctggtctcaaactcctgggatcaagcgaccctcttgcctcagcctcccaaaatgctgggattataggcatgagccactacacacagggaaatctcagcaac

SEQ ID NO: 127807 - DNA, 601 bp, Human
atcctagctaagattccatctttcaagagtacaatttgggctgggcgcagtggctcacgcctgtaatcccagcactttgggaagcggaggcaggaggattgcttaaggccaggagttcaagaccagcttgggcaacatagtgagaccctatttctacaaaaaatgtgtaaattgacgggcgtggcgctgtgtgcctgtagttctagctacttgggaggccgaagtgggaggattgcttgagcctgggaggttgaggctgcagtgagccgtgatcgccccactgcactccagtctgggtgasagagtgagaccctgtcaccaaaaaaacaaaaaagaaaaggaaagggtacagtttggtcatggagaagtcatgtcccagatccctgcagtgcctggaattgagaggagcctgttcacttcttggtcagaggtcaagaccttcacgtgcccatggacaggtttccacaactccccatcatcttatttcttttctttctttctttcttttttcttgctctgtcgtacagtggcgtgatctcggctcactgcaacctctggctcccaggttcaagcgattctcttgcctcagcctcctgagtag

SEQ ID NO: 127808 - DNA, 601 bp, Human
ggtggccagcttgttgttcttcatgttgtcaatatcctctgccaggggtgggtcttggcggcccaggtcctgctggattggccgggtggttgacaggttggggcccgacacagggaccccggagccctggttctctctgaggaaggcaagtgaatgaaaaagaaccaacaactgatttaggataaaaggcaacagttcaggatcctagctaagattccatctttcaagagtacaatttgggctgggcgcagtggctcacgcctgtaatcccagcactttgggaagcggaggcaggaggatygcttaaggccaggagttcaagaccagcttgggcaacatagtgagaccctatttctacaaaaaatgtgtaaattgacgggcgtggcgctgtgtgcctgtagttctagctacttgggaggccgaagtgggaggattgcttgagcctgggaggttgaggctgcagtgagccgtgatcgccccactgcactccagtctgggtgacagagtgagaccctgtcaccaaaaaaacaaaaaagaaaaggaaagggtacagtttggtcatggagaagtcatgtcccagatccctgcagtgcctggaatt

SEQ ID NO: 127809 - DNA, 601 bp, Human
tatctggcctgacttccgccaccctggtgggagccccaggccccccctgcccttgctgggggccatactcacgggttggtcgtggacaggatgaacatggagctatagggaggcattggcttagggccgtcttccccacggtcgtcttcctcctcctccttcttctcttcctctttttttggcagtgggtctgggttggcgtttttgttcactgttgggacaagaaccaacacagggctccctccacaatttcccacaagtctctgggaactcctgtgtactcccagggcaggcaagaagyggctgacatttctaaagtgcctgctgtatataccaggcatcttatgacatcactgaacccttgtatagccctgaggttgatatattctgatctcctgtttacagatgaggaaattgaggcacagagaagtaaagtgacttgtctaaggtcacacagcaggaagtggcagagctggcatttggaacccaggcggcctggcccccgagagcctgctctcaaccactctatagccttgagtgcggtggggccctcatgggatattaacacagacctgcccctatcctcgttggaccttcacac

SEQ ID NO: 127810 - DNA, 601 bp, Human
gcaggtgaattcacgtctctggacctcagttttttcatctgtcaaatggagctaagcatagtaacaacctcagagaaattaaaaaaaattttaaggcactcagaacagtgcctggcactgagtagataccacataagtgtttccttagtaaaatcgataagtcaactaaataaaaaagtactttaaaggtacttttatttattactacccagggtgagttgccaagaggcagattatagaaagcagcttctcccccatcttatctgacatgatccttcattgtcaagaagcattttgagcrgtcaggctttcaagaaatatccctgggagacattcaattctaaaacaacctccgagccactacgacattcatgggataaatttctcccctaaatagtctatccatttcaaagatgcccaagacagaaggccatggaactcagacactatccgcccagaatctaaacccttacagagtctaggttagaaacagagttcaggtcctagggctgccacgtgcagttgttcaggctgtgtactgcacaaggcagccatttctaagggggtgcctcttacatcacagtgaagatttgtttattta

SEQ ID NO: 127811 - DNA, 601 bp, Human
tagttattgaaattatgaattgcaggccttatcagagccttgaatgtgccaatgggatgtgccagttaacctcttaataagtggagccaataataaatagttcataaggttgtgtgaatggcagcagagctgagtggttaagaacaaggaggctagagccagtgtctgggctcaaactccagctctcccactggcttgctgtgtgaccttgggcaggtgaattcacgtctctggacctcagttttttcatctgtcaaatggagctaagcatagtaacaacctcagagaaattaaaaaaaawtttaaggcactcagaacagtgcctggcactgagtagataccacataagtgtttccttagtaaaatcgataagtcaactaaataaaaaagtactttaaaggtacttttatttattactacccagggtgagttgccaagaggcagattatagaaagcagcttctcccccatcttatctgacatgatccttcattgtcaagaagcattttgagcggtcaggctttcaagaaatatccctgggagacattcaattctaaaacaacctccgagccactacgacattcatgggataaatttctccc

SEQ ID NO: 127812 - DNA, 601 bp, Human
tggtgtgaacgttatggggccacagtgttcttgtagagaagtttcgactgcgagatggacgagggagggggccggggagctgaacgctctttgcaaacagtccctggggcctggtctgagcactgcctagattcccttcagccctgggagctgccgtgccccctggatcatccatgcctgtgccctccctgccgaaggcaacgccttcttcagcatcctcgcgtcagcagggggtttgtggacccctccagggacacctcctccccacgcctggctcctggaggcccctgggggaaaccargctgcgggaagcaactaagcggactgtgaggaggctgagcactggctctagcttcctccaggagctgcgttctaattatttccttccatctcccccatcaggtccccaggggggcctgccaggcctgggaaggaagggaaagtgcatggtaagctgtgggcgggcttgagggatggggctcgccagctttgcctgggtcctaacctacttagccagggcagcagagccttggaccagcagaaaacacacttttttggctctgggttgggagggaagggttgggggagggagctggggagg

SEQ ID NO: 127813 - DNA, 601 bp, Human
accgggcgtggtggctcacgcctgtaatcccagcactttgggaggccaaggcgggcggatcacttgaggtcaggagtttgagaccagtctggctgatagtgtgaaaccccgtctctactaaaaatacaaaaattagccgggtgtggtggcgcctgcctgtagtcccagctactctggaggctgaggcaggagaatcgcttaaacccgggaggcggaggttgcagtgagccaagattgcaccactgcactccagcctgggtgacagagcaagactccatctcaaaaaaaaaaaaaaaaaaaagaatgcccatcaatcctgcaaaagcaacatgtactcatttaatgcgaagcatagaagtgtctcatttattgaatgttacagaagagcaaacataaattcagtttttaagaattggccagtgttggccaattacaggcatgtaagaattggaattacatgcctgtaattccagagctctgggaatctgaggagggaggattgcttgaggtcaagagttcgagaccagcctggcaacatagcgaggcccgtttctacaagcatttaaaaattagctgggtgtggtggtgcatgcctgtggtc

SEQ ID NO: 127814 - DNA, 601 bp, Human
ggcccactgtgcccggcccactgtgtttatttttatttatttatatatattttggagacagggtctcgctctgtcgccaaggctagagtgcagtgacgccatcttggctcactgcaacctccacctcctgggttcaagcgattcttgtgcttcagcctcccgagtagctgggattacagttgtgtgttaccacgcccagataatttttgtatttttggtagagacggggtttcaccatgttggccaggctggtctcaaactcctgacctcaggtgatccacccgccttggcctcccaaagrgtcactgtgtttattgtccaataaacattcaagctgcatttactgaggccaaccacttgcaaattatatgctctagaaacttcgcttttggtttataccctggaggaattcttatttattgagacagggtctcgctctgtcacccaggttggagtgcagtggtatgaacatggatcactacagccttgaccttccagacccaagtgatcctcccacctcagcctcccaagtggctgggaccacaggtgtgcaccaccacgctcggttaattaaaaaaaaaaaaattttttttttttttgg

SEQ ID NO: 127815 - DNA, 601 bp, Human
attacaggtgcgagcccggcccactgtgcccggcccactgtgtttatttttatttatttatatatattttggagacagggtctcgctctgtcgccaaggctagagtgcagtgacgccatcttggctcactgcaacctccacctcctgggttcaagcgattcttgtgcttcagcctcccgagtagctgggattacagttgtgtgttaccacgcccagataatttttgtatttttggtagagacggggtttcaccatgttggccaggctggtctcaaactcctgacctcaggtgatccacccrccttggcctcccaaagggtcactgtgtttattgtccaataaacattcaagctgcatttactgaggccaaccacttgcaaattatatgctctagaaacttcgcttttggtttataccctggaggaattcttatttattgagacagggtctcgctctgtcacccaggttggagtgcagtggtatgaacatggatcactacagccttgaccttccagacccaagtgatcctcccacctcagcctcccaagtggctgggaccacaggtgtgcaccaccacgctcggttaattaaaaaaaaaaaa

SEQ ID NO: 127816 - DNA, 601 bp, Human
agtgcttgatctcattcattacagggaaatgccaagcacaaccccaataagatctcactccacacccagcagatcggccaaatgaaacagtcgacagtaccaagtgttgacaaggatgtggaagaacaggagttcccatgagctactggtgcaagggccactgcgttcatttattttttaatttttttttgagatggtgtctcgctctgtcacccaggctggagtgcagtggcacaatcttggctcactggaacctctgcctcccgggttcaagcaattcttctgcctcagcctccaagtrtctgggattacaggcgcatgctaccacgcccggctaatttttgtatttttagtagagaccaggttttaccatattggccagtctggtctcgaactcctgacctcacgtgatctacccaccttggcctcccaaagtgctgggattacaggtgcgagcccggcccactgtgcccggcccactgtgtttatttttatttatttatatatattttggagacagggtctcgctctgtcgccaaggctagagtgcagtgacgccatcttggctcactgcaacctccacctcctgggttcaagcgat

SEQ ID NO: 127817 - DNA, 601 bp, Human
cttaataagctgtgcaagaggaaatcaaaagaccaataaattaggttcaagtattcctaatacttagatctttttcatctatttgaaaatgttatttcctgtggctcagtctaatccaaaaaagtgcttgatctcattcattacagggaaatgccaagcacaaccccaataagatctcactccacacccagcagatcggccaaatgaaacagtcgacagtaccaagtgttgacaaggatgtggaagaacaggagttcccatgagctactggtgcaagggccactgcgttcatttatttttwaatttttttttgagatggtgtctcgctctgtcacccaggctggagtgcagtggcacaatcttggctcactggaacctctgcctcccgggttcaagcaattcttctgcctcagcctccaagtgtctgggattacaggcgcatgctaccacgcccggctaatttttgtatttttagtagagaccaggttttaccatattggccagtctggtctcgaactcctgacctcacgtgatctacccaccttggcctcccaaagtgctgggattacaggtgcgagcccggcccactgtgcccggccca

SEQ ID NO: 127818 - DNA, 601 bp, Human
tcaagcccctgcacgatctgaccattcagctccctgccctcacttcctctcattctctcccttgctcacttccttttgttccccaagatgcttccacctcagggcctttgcacaggctgttctgtctctctggaatgctttcccccacatcccatttgattccgtctttctcctcctttatgacttagctcaaataacactttcccagtgaggactcccctgaccggctgtttaaattccatctcctggtgcttgagatcctctttacgaagtctctccttccctctgcccaccacacccycggccacttatcactccctgaacatttgttgtagttactgataatctcattgtccatctcccccacccaaatgtcagccccacaaggacagggatgtctgtctgtcaccatggcgtctccagcttataatacagggtcaggaatacagtaggtgctcaagaaatgtttgttgaatgaatgcatcaacagttggggctgtactgggtcctggaggagctgggctctgtgatctgtgtggttataacttatattcctgttatatgtggtgcttgaagaggaatcagagaccagagtgcctgg

SEQ ID NO: 127819 - DNA, 601 bp, Human
agctctggcttgccggctcttagatccaaactttgggatcctctttgatgcctctttgtcccaaatccctcattggtggctctatcagcaaaactcactggctctatttccagaaccttccaagaatctgtccacttctcacctcttctttggtcaccagcctgatcctgtccccgtcatcgcccatggggaccagtgtgatcacctgctcacaggtcctctggcttcccacagatgccaaagggcacctgtgaacacctggatcaagtccctcctctgctcagaacactctatggccctyacctcactcaaagtaagagccgaagagccctctctgtgatccccggcacaaggtgccccctcacctccccactcatctctctgtccttcgtttccccactgttctctcactccgcccagccacaccagcttccttgctgctcttcaaacacaccaggcatttctaatcctctgggagactcatcctctcaaggggggcattcttggaggctcaggatctcctggaatcccagctcttttttttttttttttttttgacagagtctcgctgtgtcacccaggctggaatgcagtggcaaga

SEQ ID NO: 127820 - DNA, 601 bp, Human
cggcccccctttgcctgatggaagccagctctggcttgccggctcttagatccaaactttgggatcctctttgatgcctctttgtcccaaatccctcattggtggctctatcagcaaaactcactggctctatttccagaaccttccaagaatctgtccacttctcacctcttctttggtcaccagcctgatcctgtccccgtcatcgcccatggggaccagtgtgatcacctgctcacaggtcctctggcttcccacagatgccaaagggcacctgtgaacacctggatcaagtccctcytctgctcagaacactctatggccctcacctcactcaaagtaagagccgaagagccctctctgtgatccccggcacaaggtgccccctcacctccccactcatctctctgtccttcgtttccccactgttctctcactccgcccagccacaccagcttccttgctgctcttcaaacacaccaggcatttctaatcctctgggagactcatcctctcaaggggggcattcttggaggctcaggatctcctggaatcccagctcttttttttttttttttttttgacagagtctcgctgtgtc

SEQ ID NO: 127821 - DNA, 601 bp, Human
caccccatccctagaccctgagaacatgtcctgtaatccgatgtgtggcccaggctgggggttgggggaaaagaggcaagaggaacccttgcgaggagacttacgtgaaggcaaaggctaccagggccccactgaccactatgaagtcgagaatattccagaggtcacggaagtaggcaccctgatgcaggacgagccccaggtcaatcatctgtgggggagaagagagggtgctcagaacccccacctgatccccaccctggggtgctgccacccactctctagcctctcggggagaggyagggaagccaatgaggccacctcatcttgcagggatgggcagtggccagaggactccagggaggagtggggagcccctgccccatgaggcggcccccctttgcctgatggaagccagctctggcttgccggctcttagatccaaactttgggatcctctttgatgcctctttgtcccaaatccctcattggtggctctatcagcaaaactcactggctctatttccagaaccttccaagaatctgtccacttctcacctcttctttggtcaccagcctgatcctgtccccgtcatcgccc

SEQ ID NO: 127822 - DNA, 601 bp, Human
agaatctaagtgtggcctacttaacagcccttctactggaaatgggccactattttggccctcctgacaaaccaagtcctcattgtttggtgagggagaccattcaagggcccctccagattggctcaggagggagcctagaggcagaggcacaggaggaagcccctgattctctcacgatgggagtgaatgtgtcaagatcctttcaaaacctgtcagggaatcattcaccatgatgggcacagccagggtccccaagatttgtttcttgattaaagactgattagatatttttcatccygctccaaatgtctacaacttcaggaatgtactgctaagtctgctatcagggccctaagggctaatggccactcacctgttgggtaccatcttgaaatagtcacccagaacttgggggccattttgaaatggttgccctagaacttgggtgccattttggaatggttacccagaactagggtgccaccttgagatggctgcccagaacttgggggtcaccttcgagtagccatccaagacttggggaccgtcttggaatggctacccagaacttgaaggccaccttggaactcagggacca

SEQ ID NO: 127823 - DNA, 601 bp, Human
taacctacagaacagcttgctaaacctgttttttttgtactcatcactattaaaattattcagtaaccatataaagcataatattctaaatagcaaattcattgatttttaattttttaaactttttatttttttgagacaagttcttcctgtgttccccagactggggtgcagtggtgcgatttcggctcactgcagccttgaacctcctgggctcaagcaattctcccacctcagcctcccgtgtagctgctagtgcaggcatactaccatgcctggctaattgtttttttttttttttagagatggggtctccctatgttacccaggctggtcttggcctcctgggctcaagcaatctgcctgtctcagcctcccaaagtgctgggattgcaggtgtaagccaccgtgcattgctctagtagtcaaatagacactgaaaagctttgaggagagggaaggatgtggggagggagaggagaagagaaaaagaaaagagtaaacgaacaaaaagagaggagaaagaggaggaaggagtgaaagagaaagagaaagaagtataatcagcctcccaaccttcatgatacatctccagctctga

SEQ ID NO: 127824 - DNA, 601 bp, Human
tgcagtggcatgatctcggctcactgcagtctccatctcctgggtccaagcaattctcctgccttacccacctgagtagctgggattacaggcatccgccaccatgcctggctaatttttgtattttttagtagagacagggttttgtcatgtcggccaggctggtctcgaactgctgacctcaggtgatccccctcccttggcctcccaaaatgctagggttacaggcgtgagccactgtgcccagcctattataatacattcttatatatgctgtttattagctaaaaaaatcattttktgtgtgtgtgtgggggtgcggcgggaacagtgctaacttgatagggaatgaattgtatctcgtttttattttacatttctctgaattccaagggttgatttacctccatttttactagttgccagcattctatcagatttctgtttatgtcctttgcccatttatccattgagaagtagtgtttcttattgatttgtaactgcttttcatattttaaagacatggactccttgtcttattcgtcacaatctttgtcccctaatttgatgtgcattgtattttgtttaattaattatttat

SEQ ID NO: 127825 - DNA, 601 bp, Human
ttttattataatacattcctttttttatttttgagacaaaatcttgctttctcacccaggctggagtgcagtggcatgatctcggctcactgcagtctccatctcctgggtccaagcaattctcctgccttacccacctgagtagctgggattacaggcatccgccaccatgcctggctaatttttgtattttttagtagagacagggttttgtcatgtcggccaggctggtctcgaactgctgacctcaggtgatccccctcccttggcctcccaaaatgctagggttacaggcgtgagscactgtgcccagcctattataatacattcttatatatgctgtttattagctaaaaaaatcattttttgtgtgtgtgtgggggtgcggcgggaacagtgctaacttgatagggaatgaattgtatctcgtttttattttacatttctctgaattccaagggttgatttacctccatttttactagttgccagcattctatcagatttctgtttatgtcctttgcccatttatccattgagaagtagtgtttcttattgatttgtaactgcttttcatattttaaagacatggactccttgt

SEQ ID NO: 127826 - DNA, 601 bp, Human
ggcaaaagctcaacaattgaaaggcttgcttctgggtcctttgtaggtcattcccctccctaaattgtgatggtcaactcggaggatggaggtgggacagtcacctcctcagcatttttttttttttttgagacagagtcttgctctgttgcccaggctggagtgcagtggtgcaatcttggctcactgcaacctccacttcccaggttcaagcaattcttctgcctcagcctcccgagtagctgagattacaggcgcctgctatcacgcttggctaatatttgtatttttagtagagacrgggttttaccatgttgcctggggtttcaccatgttgcccaggctggtcttgaactcctgaccccaggtgatccatctgccttggcctccgaaagagctaggattacaggcatgagccactgtgcccggccctcctcagcattacagtatgtcagctacaacagaggtctgagaggaaagtgacattggagacctgaacagcttgggcttggtaccatttatctgtgccacactcagtggtggtcactgggaggattcacaggataaaacccattcccctgggcacaggtggccaaggtaa

SEQ ID NO: 127827 - DNA, 601 bp, Human
acttgccaggatcctactggcaaaatctcacacctcccagttcctgcatgatctacaagcctgccagggttgacaggatggcctgaaatccctatccagatccttttcttgcataagaattaaaacaacaacattcaaaatggattttcaagagtgaagggtggctttatgcctgtaccaatttcatgagaacaatgtaaaagcttgactctgcaaacaggctgccaaattcctgtgagttgtaggccaattttgaatgcccttgtataacttgatatttaaaaagaaaactcagaaattwaaaaaaaagtcaactccccaaaagaatcattctgctgttttttttttttttttttttttttgagatggagtcttgctccgtcacccaggctggagtgcagtggcacaatcttggctcactgcaaccttcacctcctgggttcaagcaattctcctgcctcaccctcccgagtagctgggactacaggccctccccaccacacccagctagtttttgtatttttagtagagatggggtttcaccatgttggccatgctggtcttggacccctgacctcaagtgatccacctgcctcggcct

SEQ ID NO: 127828 - DNA, 601 bp, Human
ttttagggaaaaaagcagtagctcctattctggttttctagcagtttggctcttaggtgtgcaggaatggcttgatcaaggcacctggccagctgtgctgggcctgcagccctgccctgggggaggaacagcagtaccagatggactcttgacagtggggtggggagggtgtggtaggcgtgaggtttgagggtctcctctctcatcccttcggccatgatataaagatgctccctgttggactcatgtccgtcggctcttccaaaaccctgggagagtcccaggcacttgccaggatccyactggcaaaatctcacacctcccagttcctgcatgatctacaagcctgccagggttgacaggatggcctgaaatccctatccagatccttttcttgcataagaattaaaacaacaacattcaaaatggattttcaagagtgaagggtggctttatgcctgtaccaatttcatgagaacaatgtaaaagcttgactctgcaaacaggctgccaaattcctgtgagttgtaggccaattttgaatgcccttgtataacttgatatttaaaaagaaaactcagaaattaaaaaaaaagtcaac

SEQ ID NO: 127829 - DNA, 601 bp, Human
tcaggcaaaagaggccagaaacctgtaacggggagaagattccaaaactttttagggaaaaaagcagtagctcctattctggttttctagcagtttggctcttaggtgtgcaggaatggcttgatcaaggcacctggccagctgtgctgggcctgcagccctgccctgggggaggaacagcagtaccagatggactcttgacagtggggtggggagggtgtggtaggcgtgaggtttgagggtctcctctctcatcccttcggccatgatataaagatgctccctgttggactcatgtccrtcggctcttccaaaaccctgggagagtcccaggcacttgccaggatcctactggcaaaatctcacacctcccagttcctgcatgatctacaagcctgccagggttgacaggatggcctgaaatccctatccagatccttttcttgcataagaattaaaacaacaacattcaaaatggattttcaagagtgaagggtggctttatgcctgtaccaatttcatgagaacaatgtaaaagcttgactctgcaaacaggctgccaaattcctgtgagttgtaggccaattttgaatgcccttgt

SEQ ID NO: 127830 - DNA, 601 bp, Human
gagatgggtagcatctgacagctgaacccaacctcagtgatcttgtcggacttacttccctccacagtccctctgggctgcagtttcctcatctagatgggaaaaactgaggcacagagaggctaaaggacttgcacatctagagagaaatcaaacagacctggagggacaatttcttaaaacaataaggtcaatctaatacttgtggggctctcagccttgtctatgaggggatatgcacagaggacagacaaagcaagttaaaagaccagaaaggaaataagcagaggaccctggggtsgggggtggggggcgggtggagagttcagcgctcaggctgagaacctcagagcatccatgctccttccaatgtgccaactatccgataacaaggaaagacaataagcaaagtcctcatagggtgagagaccttctcaggcaaaagaggccagaaacctgtaacggggagaagattccaaaactttttagggaaaaaagcagtagctcctattctggttttctagcagtttggctcttaggtgtgcaggaatggcttgatcaaggcacctggccagctgtgctgggcctgcagccctgccct

SEQ ID NO: 127831 - DNA, 601 bp, Human
gagacgaggccacaatcacagcactgggggaagaatccttgctttgaccccaacaggccagaatggcaaggttcctttcaacaaggaagggaataaccttatgctcccttcccctattcccttcccctggatctcgcagccctgccaggcctcaaagaacccaggctggccaggctgctgagtatcattctgctcactgtgagcctccgtattcagggctgggagatgggtagcatctgacagctgaacccaacctcagtgatcttgtcggacttacttccctccacagtccctctgggcygcagtttcctcatctagatgggaaaaactgaggcacagagaggctaaaggacttgcacatctagagagaaatcaaacagacctggagggacaatttcttaaaacaataaggtcaatctaatacttgtggggctctcagccttgtctatgaggggatatgcacagaggacagacaaagcaagttaaaagaccagaaaggaaataagcagaggaccctggggtggggggtggggggcgggtggagagttcagcgctcaggctgagaacctcagagcatccatgctccttccaatgtgccaac

SEQ ID NO: 127832 - DNA, 601 bp, Human
caaacccaggtgtgggtatctcgcactctaatcttctttccatttcatcatacacaagaaaaataatgccttcaggggtgggggctgttttgaagatgaggatcaagagatagcagcctgagggctccatctttggcttcctgacagtttggctcctgggtatgcaggagcagcttgatcaaggcgctctgccagttgcggtcctgcctttgggggaagaacagccgcgccagatggactcttggcggtgagggcaggatcatgatctgccagctgctgagaaatgtcagttggccgcccygatgcatgggcacagagcgtgataccacgtgtgatggctcatgaaatggggtgtttatggtagacgcatggatacaagggacacagtcagtgaattgagcaggacacacacacacagatatttgggtgaggtgcaggaggggtggacatcttcagaagagcttcaatacatcccttggtgggaccacagggatagttttctcccatatcggagacgaggccacaatcacagcactgggggaagaatccttgctttgaccccaacaggccagaatggcaaggttcctttcaacaaggaagg

SEQ ID NO: 127833 - DNA, 601 bp, Human
cagctggtcctctcgtgattcattggaatcaggcttggggctcattaggcgccttcaacaatgactggagatccaggttagaaagacttgaccgccatcagaatggcggaaaccctgtcgccaagcggactctatggaattttccatccacgacccctctggaagttagtgatttttttttttttttttgaaacggagtctcgctctgtcgcccaggctggagtgcagtggcaagatctcggctcactgcaagctccgcctcccaggttcacgccattctccttcctcagcctcccgagtrctgggactacaggcgcccaccaccacgcccagctaattttttttgtatttttagtagagatggggtttcaccgtgttagccaggatggtctccatctcttgacctcgtgatccgcccaccttggcctcccaaagtgctaggattacaggtgtgagccaccgcgcccggctgtgatattttttaaaacacagaatggtttaaatgtctacaaatattccaagtggattctcctccacaccccctcatctccttttcctgtagtctgacttggggttctcaaattcagtgtatctaggaatt

SEQ ID NO: 127834 - DNA, 601 bp, Human
cgggttcaagaaattcttttgcctcagcctcccgagtagctgggattacaggcatgtgccatcacgtccggctaattttgtatttttagtagagacggggtttctccatgttggtcaggctggtctcgaactcccgacctcaagtgatccacctgcctcggcctcccaaagtgctgggattataggtgtgagccaccatgtctggcctacatttacttttgcagttgcagatttatcttaggttagcaatgctggttgtaagtggataatatagtttcctttttttttatttaaattaaakagatggaatctcagggtggagtgcagtggcacgatcatagctcaccgcagcctccaactcctgggctcaagtgatccttcagtctcagcctcccaaatggctgggactgcaggcatgcaccactgcacctggctaaagtttccttttgaaattgaactttagaatacatgttgatagaaaaaaagtcaaggaactgtacatccaggttgcacatggaactggctaaaatcttgatgtcccaaacaagtgacaattgggagcatgtctccatgggcattctgcatctcctcatctgaaaac

SEQ ID NO: 127835 - DNA, 601 bp, Human
gtctctgcctcccgggttcaagaaattcttttgcctcagcctcccgagtagctgggattacaggcatgtgccatcacgtccggctaattttgtatttttagtagagacggggtttctccatgttggtcaggctggtctcgaactcccgacctcaagtgatccacctgcctcggcctcccaaagtgctgggattataggtgtgagccaccatgtctggcctacatttacttttgcagttgcagatttatcttaggttagcaatgctggttgtaagtggataatatagtttcctttttttttwtttaaattaaagagatggaatctcagggtggagtgcagtggcacgatcatagctcaccgcagcctccaactcctgggctcaagtgatccttcagtctcagcctcccaaatggctgggactgcaggcatgcaccactgcacctggctaaagtttccttttgaaattgaactttagaatacatgttgatagaaaaaaagtcaaggaactgtacatccaggttgcacatggaactggctaaaatcttgatgtcccaaacaagtgacaattgggagcatgtctccatgggcattctgcatctcc

SEQ ID NO: 127836 - DNA, 601 bp, Human
tttttcagggaacaaagacgataattgtattttagcctgctaggcagagatatactccaggattcagaactctgaacctttttttttctttttaaaactaacatcatcattatcatctcaaggctgtgcccccaagtgtgagacacacgttggacagtcactgagataattttaggcagaacaggggcacagattaaataattggatctcagaggggcataatcatttctttttctttctttcttttttattatactttaagtttcttttccacgtatctttcagacgctctgcttttgcragaaaggaagcctcaggtagatgctaataggcctttaacacctccctaacacttagtaattttccttttaacaaagagcccagcttgaaggcaacaacattgtctggtttctgttagatttactttttttttttttttttgagatggcatttctctcttgttacccaggctggagtgaatggcgtgatctcagctcacagcagtctctgcctcccgggttcaagaaattcttttgcctcagcctcccgagtagctgggattacaggcatgtgccatcacgtccggctaattttgtatttt

SEQ ID NO: 127837 - DNA, 601 bp, Human
caaggtctgttggaactgagcttagcaatgcagaccccagagatgccatgacacccttggccaaccatgactcaggccccccaagaggagggtattgagtgggaccatgaatagcttgtggttcatggcactcatgacccatccagttgtccacaccagaaacctgagagtcatggtcaactgcctgccctctatccccatccccatccccagtgggtcaccttccttaacatcccgccatccattcctgggtgccatcccccctcacccgtctcccaacttgctcctcattccctgcctyttcttccatgttttatgcacacagtggctaaagccaatgaccttgtcactctttctcttgctcagaattcttctggagcacgtgaattctcagaagagcaagtgcaaacttctgggcatggcattcaatgctcttgaaaatctagtccaacttaccttcacctttgcattcccatttatggctacatatctcaagccccagccacattcttttgcctctgtctgcttatgcatatactgttcccgctgctagaaatgcccttcctccacttctccagtcacagaactacccggtcctcaa

SEQ ID NO: 127838 - DNA, 601 bp, Human
caggcctagaagtctggggtgagcttggcacagccctgcccttcctggtgaagagtggtccatttcacctgttaagcttgggctcgggagccagtaagtacgtggctttttgtggttctggtcccagggttggttgagggccctttgccatctggctgggcctgagcagctgtattgggtgtccctgagacccagcacaagggggttggctgattccccacccccatttctgcacagcttttcttttttcttttttgagacagggtctggctctgtcaccaaggctggagtgcagtggcaygatctcggctcactgcaacctccgcctcctgggctaaagccatcctcccacctcagcctcccaagtagctgggactacaggcacacgccactgcgcctggctaattgttttgtctttttgtagagatgaggtttcaccatgttgcccaggctggtttcaaactcctgagctcaagcaatctgccctcctcaccctctcaaagtgctgggattacaggtgtgagccactacacctggtcacagctattttcaaaaaagcccttggtctaggagtttagtggtcccctatgtattctttttt

SEQ ID NO: 127839 - DNA, 601 bp, Human
tactagagcctagaataggtagatgaaaagtcaaaattttatggaacaagaaatctagttcctgcttcccagatcacggttatacccttttaaatccatatgatgccttcatgcgaattaggaaaaaggatcttaaccccaagacacttcatctaaagaaaaactgccataatacacagattattttaggtcagctcactttactgccatctgctgggaagttgtaataatacaaatatccatacacgatggctaggatgttatcagcacctcctttaatgtgttgtccttgagcagtgtrcaacctgctcagctgtacatgataaccctgacagtcccccccaccgcaccccaccatctcccaatctcaccttgagctttggcagccgcttgatggttttaagaggtcgtagcacccggaggactcggagggatttaatcgtgttgatgtcttttcctttgctattgccactgtggaggaatgtttaggtgggaagaagggaagagaggaagcagaggtcaggttgggtagggggcagcccacagctccatgggaccctaccctcccaggcctagaagtctggggtgagcttggcacagc

SEQ ID NO: 127840 - DNA, 601 bp, Human
ttgtcaatgcacaaagccttaggcaggcagccatatttggttagatttccataacagtatctgttttctgtctttaatttttagtagagacagagtctaactatgttgcccaggctggtctcattctcctgggctcaagcaacactcctgccttggtctttcaaaatgcagggattacgggtgtgacttgatttaaagaaacatattacataagagataatactggggacccccaggtgaagcatagagtgaaagtgggtgctctaatgactggattttatttcccttaatatatatatatgtttttgaatgacaggcttttgggaaatgctggttcatgctattttggaatgggagatactagagcctagaataggtagatgaaaagtcaaaattttatggaacaagaaatctagttcctgcttcccagatcacggttatacccttttaaatccatatgatgccttcatgcgaattaggaaaaaggatcttaaccccaagacacttcatctaaagaaaaactgccataatacacagattattttaggtcagctcactttactgccatctgctgggaagttgtaataatacaaatatccat

SEQ ID NO: 127841 - DNA, 601 bp, Human
cagccaccacggcgaagatgaacatgaatagcatgtagacgatgaggatgttgaagacgtttttaagtgagttcaccacacagtcaaacacagcctgtggggtggagttgacagagagcatgaggggctggggacctgcccaaccttctgcctccagtggcccatcataccaaaatactgccatgatcattcccattttacaggcaaggtcataagtcaagtcactagggtaaggtccccccagctttcagaaataagcgttggaggagttggactcaatcctggcattctatggatctamaactcccagatgggataccagagatgcttttaagtgatacaggagcccaacacagaaaaacaaggtaacaaagttacttcctttccaactctctcaatccttttgagtgaaggagaaatttttacttagttgctaccatgttaacacctaccattgacattttccctctttaaccaagaaagagcagttgtcaatgcacaaagccttaggcaggcagccatatttggttagatttccataacagtatctgttttctgtctttaatttttagtagagacagagtctaactatgttgcccag

SEQ ID NO: 127842 - DNA, 601 bp, Human
ctaccatgtgttgcaaaatgccactttacactggtaacaatatcactatatatacacatacatatatatacacacacacatataatacatatgtgtgtgtgcgtgtacatatatatatatacatatatatatatatatatttttgttgttgttgtttgtttgtttgtttgtttgagatggagtctggctctgttgcccagactggagtacagtggcccaatctgggctcactgcaagctccgcctcccgggttcacgccattctcctgtctcagcctcccaagtagctgggactacaggcrtctgccaccatgcccagctaggtttttgtatttttagtagagacagggtttcaccgtgttagccaggatggtctcgatctcctgacctcatgatccgcccgcctcggcctcctaaagtgctgagattataagcatgagccactgcgcccggcctatatgtatatatttttgagaggcagggtctcactctgtcacgcaggctggagtgcagtggtaccatcatagtgcattgcagccttgaactcctgtgtttaaacaatcctcccgcctcagcctcccgggtagctgggactacaggtg

SEQ ID NO: 127843 - DNA, 601 bp, Human
ggaggcagagagacataggggacatttagaggttcatcaggctaagggaggttgctactccttttcaaggcaggaaacaagggttagttccagactcctatccagacatctggcatcctcctaatttcaataaatagccatcaagataacaacaggctaccatgtgttgcaaaatgccactttacactggtaacaatatcactatatatacacatacatatatatacacacacacatataatacatatgtgtgtgtgcgtgtacatatatatatatacatatatatatatatatatttttgttgttgttgtttgtttgtttgtttgtttgagatggagtctggctctgttgcccagactggagtacagtggcccaatctgggctcactgcaagctccgcctcccgggttcacgccattctcctgtctcagcctcccaagtagctgggactacaggcgtctgccaccatgcccagctaggtttttgtatttttagtagagacagggtttcaccgtgttagccaggatggtctcgatctcctgacctcatgatccgcccgcctcggcctcctaaagtgctgagattataagcatgagccactg

SEQ ID NO: 127844 - DNA, 601 bp, Human
atcaagataatcttttgctccaatattttaaaaaatcaaaattaatgcaaaaagtccatgatgaacaaatatcaatttcttcttctttttttttttcagggataggggtctccttctgttgtctaggctggagtacaatggcataatcacagctcactgcagccttgaactcttgggctcaagcgatcctcccacctcagcctcctgagtagctgggataacaggtatgagccaccacaagtggctcaaaattttaaataaagactaagtccatgattcagcctcacttttttttttttttgaaggcggggaggccatagtcttgctctgtcactcaggatgaagtgcagtggtgcaatctcggctcactgcaacctctgcctcctgggttcaagtgattctcgtgtctcagcctcctgagtagccgggaccacaggtgtgagccaccatgcctggcagctttttttttttttttttttttttttttttttttttggatttttagtagaaatggagttttgccatgatggccaggctgatctcaaactcctggcctcaagtgatacatctgccttggcctcctaaagtgttgggattacag

SEQ ID NO: 127845 - DNA, 601 bp, Human
gagggaggtgaggatgctgagggcacatgctggaatctaccaagcttccagcctggcatttccaagacctctgagagaaagaccattacttggacgaggtgagggagggaggcatttgttttgggtgcaaattaagggggtactgaaaatctcagtaatcaagataatcttttgctccaatattttaaaaaatcaaaattaatgcaaaaagtccatgatgaacaaatatcaatttcttcttctttttttttttcagggataggggtctccttctgttgtctaggctggagtacaatggcayaatcacagctcactgcagccttgaactcttgggctcaagcgatcctcccacctcagcctcctgagtagctgggataacaggtatgagccaccacaagtggctcaaaattttaaataaagactaagtccatgattcagcctcacttttttttttttttgaaggcggggaggccatagtcttgctctgtcactcaggatgaagtgcagtggtgcaatctcggctcactgcaacctctgcctcctgggttcaagtgattctcgtgtctcagcctcctgagtagccgggaccacaggtgtgagc

SEQ ID NO: 127846 - DNA, 601 bp, Human
caggctggagtgcaacggcgtgatcttgggtcactacaacctccgcctcccgggttcaaatgattctcctgcctcagcctcccaagtagctgggattacagacatgcgccaccaagcctggctaatttttttgtatttttagtagagacggggtttcaccatgttggccaggctggtcttgaactcctgacctcaggtgatccacctgcctcggtctcccaaactgttgagattacaggtgtgagccaccacgcctggccaatgtcagtcatttctactgctgtgcatgaagggcttgctstgtgctggaaacaatattcaacaattcatccccaccggctcagcaaccctcccagggaggttattactggctccactttgcacatgaggaacttgaggttcagcaatttaaagggacgtgctgaagaccacccacttataagtggccaagttgggatttaaagacaggttgtggcaatggagggagtagaggtgggtgtatgcatgtagagtgggtatttgagcacaggtggtgctgggtgctcaggaggtacaatggggatatatatgagagtgggtaagtgcacagcagctctgtaca

SEQ ID NO: 127847 - DNA, 601 bp, Human
aatttttgagcacaagcctgaagaactgaacctcagtctgacatactctctttttcatctggagcatctcagagggaggctgctctgctgctctgccagcctgggaaccagaataaagatggcaagatccacaactgatgttgacatgcagtgtgagcaaaaaataagtccctttgtggatatttggcaatgaaatctggggttgcttgttactgcggcataacctagtctaaactgactgatacatacactatatgatgtgtttcctctggaaactccatgaagggctgccctgaagacyggattcggttgggacaatgcttctgttccctcccccaggtacccctagaaaggggttcctgggtgttgtgtgtgttttaaagtttgtgtgtgtccccagtttttaaaggacagatggaattggaagtggcacctcatttttctccaggctgtattcctccatcatcttgtccccttgctcctggaaggtgatgatgatcaaggccacaaagatattgacaaagaagaaggggaacaccacaaagtagacgacgtagaaaatggacatctccatgcggtacccggggctggggccctggtt

SEQ ID NO: 127848 - DNA, 601 bp, Human
caagcatcctcccacctcagcctcccatgttactggggctaaaggtgtgcaccatcctgcctggctaatttttttgatttgtagtagagatggggtcttgctatgttggccaggctggtctcaaactcctgagctcaagtgatcctcctgcctcagcttcccaaaatgttgggattacaggtgtgagccaccacacctggcttggcttttcattcataaatattcaccacccttcgctaggggagattgtatttgcccactccactgatgtcagaatggatgtgtgacttgctttggctgrtgaaatgtgagcagaagtgacatgtgtaatttttgagcacaagcctgaagaactgaacctcagtctgacatactctctttttcatctggagcatctcagagggaggctgctctgctgctctgccagcctgggaaccagaataaagatggcaagatccacaactgatgttgacatgcagtgtgagcaaaaaataagtccctttgtggatatttggcaatgaaatctggggttgcttgttactgcggcataacctagtctaaactgactgatacatacactatatgatgtgtttcctctgga

SEQ ID NO: 127849 - DNA, 601 bp, Human
tggggttttgccatgttggccagggtggtctcgaactcctaggctcaagtgatttgcctgcctctgcctcccaaagtgctgggattacaggtgtgagtcactgtgcctgacctctgtgtttgttttttaaagatggagtcttgctgttgcccaggctggggtgcagtggcatgatcatagctcactgcaacctccacctcctgggctcaaaatatcttcccacctcagcctcctgagtaactggcactacaggcacgagttaccatgcctggctaattaaaaaaaaattttttttttttttgtagggacaggggcttgctttgctgcccaggctggttgagaactcctagcttcaagcgatcctcctgccttggcctcctgaagtgctaggattacaggcatgagccactgtgctcagcctgatttcagttttctttctttctttcttttttttgagacagagtttcactcttgttgcccaggctggagtgcagtgatgtgatctcggctcaccacaacctctgcctcccaggttcaagcgattctcctgcctcagcctcccgagtagctgggattacaggcatgcgccaccacacccggc

SEQ ID NO: 127850 - DNA, 601 bp, Human
tttgagacttgctctgttgctcaggctggagtgcagtggtgtgatctcagctcactgtaacctccactttgtgggttcaagcgattctcctgcctcagcctcctgagtagctgggatcatgggcacccacaagcacgccaggctaattttttgtagttttagtagagatggggttttgccatgttggccagggtggtctcgaactcctaggctcaagtgatttgcctgcctctgcctcccaaagtgctgggattacaggtgtgagtcactgtgcctgacctctgtgtttgttttttaaagatggagtcttgctgttgcccaggctggggtgcagtggcatgatcatagctcactgcaacctccacctcctgggctcaaaatatcttcccacctcagcctcctgagtaactggcactacaggcacgagttaccatgcctggctaattaaaaaaaaattttttttttttttgtagggacaggggcttgctttgctgcccaggctggttgagaactcctagcttcaagcgatcctcctgccttggcctcctgaagtgctaggattacaggcatgagccactgtgctcagcctgatttcagtttt

SEQ ID NO: 127851 - DNA, 601 bp, Human
ttaaggctaggcacagtgtctcatgcctgtaatcccagcattttgggaggctgaagcaggcagattgcttgatgccaggagttcgagaccagcctggccaacatggtgaaaccccgtctctactaaaaatataaaaattagcctggcatgctggtgtgcatctgtagtcccagctactcagaaggctgagatgggagaatcgcttgaacccaggaggtggaggtttcagtgagccaagattgtgccacggtactccagcttgggcaacagagcaagactgtgtctcaaaaaaaaaaaaaaagttttaaaaatggcgatctaacaatgaatatacttctccattaacacactgagtaggccgggtgcggtggctcccgcctgtaatcccagcactttgggaggccgaggcgggcggatcatgaggtcaggaaatcaagaccatcctggccaacatggtgaaaccccatctctactaaaaatacaaacaattagccaggtgtggtggcaggcacctgtagtcccagctactcgggaggctgaggcaggagaatggcgtgaacccagggggtggagctttcagtgagccgagattgcgccactg

SEQ ID NO: 127852 - DNA, 601 bp, Human
ctcctgcctcagcctcccgagtagctgagactacaggcatgcgccaccacacccagctaatttttgtactttttagtagagatggggtttcaccatgttggcaagggtggtctggatctcttgacctcatgatccacccacctctgtctcccaaagtgttgggattacaggtgtgagccaccgcactcagccaactatacttttgtgtgtgtgctatgaaccttggccatgtgagaatagtgctggctattttattttatgcataaaggcttgtaaatgcataacaaaatagcaagggctkcaaggttaccttttgtaataaaatagctatcaaaatattttttaaggctaggcacagtgtctcatgcctgtaatcccagcattttgggaggctgaagcaggcagattgcttgatgccaggagttcgagaccagcctggccaacatggtgaaaccccgtctctactaaaaatataaaaattagcctggcatgctggtgtgcatctgtagtcccagctactcagaaggctgagatgggagaatcgcttgaacccaggaggtggaggtttcagtgagccaagattgtgccacggtactccagc

SEQ ID NO: 127853 - DNA, 601 bp, Human
tgcttgggcctcagcctcacgagtagctgggattacaggcacacgccaccatgcctggctaatttttgtatttttagtagagacggggtttcaccatgttgtccaggctggtcttgaactcctgacctcaagggatctgccctcctcaagctcccaaactgccgggattacaggtgtgagccatcacactcagcccccaattttttaaaaaataattttaatttaatttaatttaatttatttatttattgagatggagtctcactctgtcacccaggctggagtgcagtggcaagatctyggctcactgcaacctccgcctcccacgttcaaatgattctcctgcctcagcctcccgagtagctgagactacaggcatgcgccaccacacccagctaatttttgtactttttagtagagatggggtttcaccatgttggcaagggtggtctggatctcttgacctcatgatccacccacctctgtctcccaaagtgttgggattacaggtgtgagccaccgcactcagccaactatacttttgtgtgtgtgctatgaaccttggccatgtgagaatagtgctggctattttattttatgc

SEQ ID NO: 127854 - DNA, 601 bp, Human
ctatgctggctaatttttcaatgttttctagagatgaggtcttgctatgttgcccaggctggtctgaaacgcctgggttcaagcaattcttctgccttggcagaagtcccaaagtgctgggactacaggcatgagccaccacacctggcctcaagtgcttctaataagtagcatctccaccaaatgaaagccactgttttggaggaaaaaggtccattagtaggatccctttcctagcatttatttatttattttgatacagggtcttgctctgtcacccagggtggggtgcagcggctcmatcacgactcactgcagccctgacatcctgggctgaatccatcctctcacctcagcctcctaagtagatgggactgcaggtgcacgccaccacaccaggctaattttgtactttttgtagagacagaatctcactatgttgtccaggttggtctcagactcctgggctcaagcgatccacctgcctcagcctcccaaagtgctgcgattacaggtgtcagccaccgtgcctggcccctagcatttattgagtgcccatgccaggccaggcttcatcctcaaccctctagatgcacgttag

SEQ ID NO: 127855 - DNA, 601 bp, Human
gcctataattccagcactttgggaggccaaggagggagaactgcttgaggccacgagttcaagaacaggctgggcaacagagtaagatcccatctcaaaaaaaaaaaaaaaaaaaaaaaagagaaagcagaggggaagctcagtgctggctcttgcaggattggcagggtgagggagatgcagctccaggccccagtggaagactcacttcaccagcagaagatcaactcagaataaaataactgcaggctaggtacggtggctcatgcctataatcccagcactttgggaggccgaggcrggcggatcacctgaggtcaggagttggagaccaacctggctgacgtggtgaatccccgtctctgctaaaaatacaaaaattagccgggcgtgatggtgggcgcctgtaatcccaactagtcgggaggctgaggcaggacaattgcttgaacccgggaagcagaggttgcagtgagccaagattgcaccactgcactccagcctgggcaacagagtgagaatccatctcaaaaaaaaaaaaataataataaattacagattcagtgattccctcccacctcaccaaaccaaatgaatcaga

SEQ ID NO: 127856 - DNA, 601 bp, Human
gcactcaatccttgtctcaggctctgcttctgggggagtccaaacaaagacaactttataggcgtttggtcacagacctcaacccctaggctagagagctcccctctatctcccaaatgttatacagggaacttgtggcttcatttaaaactgaaaggggagaccaggcgtggtggctcatgcctataattccagcactttgggaggccaaggagggagaactgcttgaggccacgagttcaagaacaggctgggcaacagagtaagatcccatctcaaaaaaaaaaaaaaaaaaaaaaargagaaagcagaggggaagctcagtgctggctcttgcaggattggcagggtgagggagatgcagctccaggccccagtggaagactcacttcaccagcagaagatcaactcagaataaaataactgcaggctaggtacggtggctcatgcctataatcccagcactttgggaggccgaggcgggcggatcacctgaggtcaggagttggagaccaacctggctgacgtggtgaatccccgtctctgctaaaaatacaaaaattagccgggcgtgatggtgggcgcctgtaatcccaactag

SEQ ID NO: 127857 - DNA, 601 bp, Human
ggtgggcgcctgtagtcccagctactccggaggctgaggcaggagaatggcgtgaacctgggaggcagagcttgcagtgagcagagattgcaccactgcactccagcctgggccacagagcgagactccgtcaaaaataaataaataaaaataaataaataaataaataaataaataaataaataaaaaggaattcaggtcccactggcacttttggcattttggcaggtgttgctggggccctgcccatagctcaactacacacctgaggtacactactttgcccagggtctctctgtgrctgcacaagtgttagggaattaatagctcccctgggagtggcctgtgattatgtctgatgggcactggaggataaatactccaattccctccctgtgaggtgggatgactctgtggtatgtgctctctgttgcctcctggaggtatccactgaaactgagccccatttgttcacagcaggaactggcttaataatacactctttcctggttgcctttctgtccctgtgtcacttcctctctcccttactgccctgcatcccagataaattccttgcactcaatccttgtctcaggctctg

SEQ ID NO: 127858 - DNA, 601 bp, Human
agcactttgggaggccgatgtgggcggatcacgaggtcaggagatcaagaccatcctggataacatggtgaatccccatctctactaaaaatacacgcacacaaaaatcaggcaggcgtggtggtgggcgcctgtagtcccagctactccggaggctgaggcaggagaatggcgtgaacctgggaggcagagcttgcagtgagcagagattgcaccactgcactccagcctgggccacagagcgagactccgtcaaaaataaataaataaaaataaataaataaataaataaataaataattaaataaaaaggaattcaggtcccactggcacttttggcattttggcaggtgttgctggggccctgcccatagctcaactacacacctgaggtacactactttgcccagggtctctctgtggctgcacaagtgttagggaattaatagctcccctgggagtggcctgtgattatgtctgatgggcactggaggataaatactccaattccctccctgtgaggtgggatgactctgtggtatgtgctctctgttgcctcctggaggtatccactgaaactgagccccatttgttcacagca

SEQ ID NO: 127859 - DNA, 601 bp, Human
gctgtgcttccctcctaggcgaagtgcctggggcctctgcgcccttctctggaaggcagtggtaacacagcaatcagacaatgaatgtgcgtcgctgagcatggaatatacagtaggtgcccaacagatgggatgttgttgtttcacaactgcctaaaaaaggaattcagggggccgggcgcggtggctcacgcctgcaatcccagcactttgggaggccgatgtgggcggatcacgaggtcaggagatcaagaccatcctggataacatggtgaatccccatctctactaaaaatacacrcacacaaaaatcaggcaggcgtggtggtgggcgcctgtagtcccagctactccggaggctgaggcaggagaatggcgtgaacctgggaggcagagcttgcagtgagcagagattgcaccactgcactccagcctgggccacagagcgagactccgtcaaaaataaataaataaaaataaataaataaataaataaataaataaataaataaaaaggaattcaggtcccactggcacttttggcattttggcaggtgttgctggggccctgcccatagctcaactacacacctgaggtaca

SEQ ID NO: 127860 - DNA, 601 bp, Human
gaccccaagcctgggctcattggcagatggccaaggagagggtctaggacaggacctctggggccctgagtcttccagaaaaggagaagggcaatgtggcctgtggggccaccacagagaggtccagagactcccatgttgagagtctcccaggcccggggctagaggagggaagacaccctggggacccctctatggccctgggagtggtgtccccacactggcctgagggctgtggctctctcctgcccactaactaggagagggttggttcaaacagaattgacttgaaacccattcyttctgggctcctgacatagggtggtgtttgggagccggctcagctttcagagcttttgagtgtctcagttccctcagtgtactcatctgcattattaattcctaggccaggatgcaggaaagcccacccctcagtgctggccctacagccaagctttggttacccccatctccccacaatgccctcctgaggggctgcccttgtccccggggccccagttctccctctctggtcatggccaagtgctggctcaagcagctatggctgccgggacacactgcctctgggaccgctcccccg

SEQ ID NO: 127861 - DNA, 601 bp, Human
agcatcatattcagcttgcttccggtttactttgggccatgggaggctctggcaggagataagggatgaggggagagaaaggttggggtgtttctcccctattgctctctgcctgcttgggccctggtctctgtctctccacattgacaggacagctcccacttggtggcttctcctggcctccggctcaggttccctccccacttcagcacctgggcaggtgacagctccccacggtgggtggtcgctggacaccttgccacccttgtgggtacccttcccttcccctccaccagtgagstctgcatttgggtgccttcagttgaaccctccgagggaattctcttacgagctgagaccaagacctctaccctgagccaatccacgtaaaccacttggcacagttccctggcacacagcaaggctgcgattctcgtgagctattgttatttttattgttagtaagatgacattggtatcacccttgacccttggctttgacacccttttttgaccattgcttccccctgcaaggatcttctaccctccccccaatctcctgagggaccccaagcctgggctcattggcagatggccaagg

SEQ ID NO: 127862 - DNA, 601 bp, Human
gaatggccccctcttttgtgtagttccccagcccctcctggccttctaggacggaagagcaggcaaacagatccttttctgtagggggatctgactgggacaccccaggagctgtcagtgtactctcaggagtcacccaggcctggctttgtgaccttgggagtgtctctcacttccccaggcattgaagatcagttttctttctttctttctttctttttttgagatggagttttcgcgcttgtcacccaggctggagtgcaatggtgtgaccgtcgctcactgcaacctccgccttccrggttcaagcaattttcctgcctcagcctcccgagtagctgggattacaggcatgcaccaccacacctggctaatttttttgtattgtcagtagagatggggtttcaccatgttggccaggctggtcttgaactcctggcctcaggtgatccgccggcttcggcctcccaaagtgctgggattacaggcatgagccaccgtgcccagctgaggtcagttttcccatctgtgaaatgaggcaacaccctcttcctcaggcccgaccacacccagatctattctcctgacttccctgcctgct

SEQ ID NO: 127863 - DNA, 601 bp, Human
acttgggtgcgggtgccgtaggacatatcaaagaatggccccctcttttgtgtagttccccagcccctcctggccttctaggacggaagagcaggcaaacagatccttttctgtagggggatctgactgggacaccccaggagctgtcagtgtactctcaggagtcacccaggcctggctttgtgaccttgggagtgtctctcacttccccaggcattgaagatcagttttctttctttctttctttctttttttgagatggagttttcgcgcttgtcacccaggctggagtgcaatggtrtgaccgtcgctcactgcaacctccgccttccgggttcaagcaattttcctgcctcagcctcccgagtagctgggattacaggcatgcaccaccacacctggctaatttttttgtattgtcagtagagatggggtttcaccatgttggccaggctggtcttgaactcctggcctcaggtgatccgccggcttcggcctcccaaagtgctgggattacaggcatgagccaccgtgcccagctgaggtcagttttcccatctgtgaaatgaggcaacaccctcttcctcaggcccgaccacac

SEQ ID NO: 127864 - DNA, 601 bp, Human
ctggagctgaaggcaaataagtgtgtatcacttgggtgcgggtgccgtaggacatatcaaagaatggccccctcttttgtgtagttccccagcccctcctggccttctaggacggaagagcaggcaaacagatccttttctgtagggggatctgactgggacaccccaggagctgtcagtgtactctcaggagtcacccaggcctggctttgtgaccttgggagtgtctctcacttccccaggcattgaagatcagttttctttctttctttctttctttttttgagatggagttttcgckcttgtcacccaggctggagtgcaatggtgtgaccgtcgctcactgcaacctccgccttccgggttcaagcaattttcctgcctcagcctcccgagtagctgggattacaggcatgcaccaccacacctggctaatttttttgtattgtcagtagagatggggtttcaccatgttggccaggctggtcttgaactcctggcctcaggtgatccgccggcttcggcctcccaaagtgctgggattacaggcatgagccaccgtgcccagctgaggtcagttttcccatctgtgaaatgaggc

SEQ ID NO: 127865 - DNA, 601 bp, Human
ggggaaggggaaaattctggctcactggagctgaaggcaaataagtgtgtatcacttgggtgcgggtgccgtaggacatatcaaagaatggccccctcttttgtgtagttccccagcccctcctggccttctaggacggaagagcaggcaaacagatccttttctgtagggggatctgactgggacaccccaggagctgtcagtgtactctcaggagtcacccaggcctggctttgtgaccttgggagtgtctctcacttccccaggcattgaagatcagttttctttctttctttctttytttttttgagatggagttttcgcgcttgtcacccaggctggagtgcaatggtgtgaccgtcgctcactgcaacctccgccttccgggttcaagcaattttcctgcctcagcctcccgagtagctgggattacaggcatgcaccaccacacctggctaatttttttgtattgtcagtagagatggggtttcaccatgttggccaggctggtcttgaactcctggcctcaggtgatccgccggcttcggcctcccaaagtgctgggattacaggcatgagccaccgtgcccagctgaggtca

SEQ ID NO: 127866 - DNA, 601 bp, Human
gtgaggggaaggggaaaattctggctcactggagctgaaggcaaataagtgtgtatcacttgggtgcgggtgccgtaggacatatcaaagaatggccccctcttttgtgtagttccccagcccctcctggccttctaggacggaagagcaggcaaacagatccttttctgtagggggatctgactgggacaccccaggagctgtcagtgtactctcaggagtcacccaggcctggctttgtgaccttgggagtgtctctcacttccccaggcattgaagatcagttttctttctttctttctttctttttttgagatggagttttcgcgcttgtcacccaggctggagtgcaatggtgtgaccgtcgctcactgcaacctccgccttccgggttcaagcaattttcctgcctcagcctcccgagtagctgggattacaggcatgcaccaccacacctggctaatttttttgtattgtcagtagagatggggtttcaccatgttggccaggctggtcttgaactcctggcctcaggtgatccgccggcttcggcctcccaaagtgctgggattacaggcatgagccaccgtgcccagctgag

SEQ ID NO: 127867 - DNA, 601 bp, Human
tacttgtaaaaagttcccgtctctctccttagaatgtcagctctatgggagcagacactctgtattcttggtctgttttgtttggcacccctccttctcgttctgtctccagcacttataatcacaccaggcacacagtaggtgctcaatgaatgtcttttgagtgcatgcatcactgtgagtcttgcaagtgtctgaggttggttgcaatggttagccccactctacatgagaagagatagcgcaagttgtccaagatcaaacagctggtagggagggctgggggctgtttggctactgyaagggtcctgatgtcccatgaacaccccatgccccatcttcctgccagccaggagaacaggctgttggagtctgtccctacagctctcttactggtgattgaaggtttcagctaacttcctccaccccacctgcccttctggggagctggaccatccttctaacctcttgacccaaagggacattggttcaaggctgtcttgtatgtagccggatggcaagatattttgattgccagctggagctccagccctctctagaaactcaggacaggggagaatgaccaggtgggggcacccca

SEQ ID NO: 127868 - DNA, 601 bp, Human
agtgctgagattacaggcgtgagccaccacgcccggcctgttgatgcttttacttgtaaaaagttcccgtctctctccttagaatgtcagctctatgggagcagacactctgtattcttggtctgttttgtttggcacccctccttctcgttctgtctccagcacttataatcacaccaggcacacagtaggtgctcaatgaatgtcttttgagtgcatgcatcactgtgagtcttgcaagtgtctgaggttggttgcaatggttagccccactctacatgagaagagatagcgcaagttktccaagatcaaacagctggtagggagggctgggggctgtttggctactgcaagggtcctgatgtcccatgaacaccccatgccccatcttcctgccagccaggagaacaggctgttggagtctgtccctacagctctcttactggtgattgaaggtttcagctaacttcctccaccccacctgcccttctggggagctggaccatccttctaacctcttgacccaaagggacattggttcaaggctgtcttgtatgtagccggatggcaagatattttgattgccagctggagctccagc

SEQ ID NO: 127869 - DNA, 601 bp, Human
acacagggcaaacccacatcaccccagccacttgggggcagcagctgagacagcactggttagtactgccgcatgccctctgccccctaaaccccagggacctgcccgcccaagcatctggcatttcctgtctcagcctggccaagccctggcctcagaactagtgggcttacctgggaggcagaaaggggcaactgagacctccttgcctgccaggacatgcctctccctactccaggttgggagttaattgtcccagaaggacccaaacacccaccccctatctttccctcaaattgaytgtaactcagggctggctaacaaaactacacacccattcacaataacaataacaacagcagtaatagttaacaaccaccattttcaaactcctggtttcctggcaggttctgtgccaagcacttcacgtttctttctttctttttcttccttttctttttgagacagagtttcactctgtcgcccaggctggagggcagtggcacaatcttggcttactacaacctctcgcctcctgagaatcaagtgattctcttgcctcagcctcctgagtagctgggattacaggcacctgccaccg

SEQ ID NO: 127870 - DNA, 601 bp, Human
caaaaaaccaatgggtttcggttcccgggcggggagtgggggtggtggtggcggtgggttgggagataagtcattggtgtatgaacacacagaccatgtcatggatgaacaaatgaatttcatagtgcattttgattggatgagtttttcagacggcgttgcgccaatatacagttttaagagcaggcatgaaaagagacaagacaagaaacacagtcattatccattgcacacagggcaaacccacatcaccccagccacttgggggcagcagctgagacagcactggttagtactgccrcatgccctctgccccctaaaccccagggacctgcccgcccaagcatctggcatttcctgtctcagcctggccaagccctggcctcagaactagtgggcttacctgggaggcagaaaggggcaactgagacctccttgcctgccaggacatgcctctccctactccaggttgggagttaattgtcccagaaggacccaaacacccaccccctatctttccctcaaattgattgtaactcagggctggctaacaaaactacacacccattcacaataacaataacaacagcagtaatagtta

SEQ ID NO: 127871 - DNA, 601 bp, Human
gactgcgtgcagcgtctgtgtgcagtgactgtgtgcacagtgtgtgcgcagtgactgagtgtgtgcacagtgactgtgtgtgcagtgtctgtgtgcagtgactgtgtgactgcgtgtgcacgtacagttcaaggctccaggagagggcctcagtgggccagccccacatgaagctaccagatccaagtctggcacttctgagttcctctgcctgagagtctttgccggcacactgcctggccttcaggtctcctttatcagacttggagagtcaagtctctgctggtcaaggccaaagatcttgtgggcttgagatggaggattggggacagcaggatggagagagctggaggggcgaggagacagttggcagctttcctggggcctggggtccatggagctgaatgggggacaggagtggtgagaggtggctgggagtggatttgcctctattgtctctgagtgtaggggatgtgtgtgcgggatggggcaagagagaggtgctgcgctgggaaaacccatccctttctctgcaaaagacgcaaaccaccccaaacagaaaacccccattcagaacccgataaaaacagagagacagagt

SEQ ID NO: 127872 - DNA, 601 bp, Human
ctgtgtgttcaatgtgtgaatgcagactgtgtgtgcatgcatagtggctctgtgtgcagtgactgtgtgtgcagtgtgtgtgcatagtgactgtgtgcagtgactgtgtttgcatagtgacagtgtgtgcagtgtatgtgtgcacagtgactgtgcagtgtgtgtccatagtgactacatgcagtgccagtgtgtgtacatagtgactgtgcacagtgtgtgtgcatagtggtgtgtgcagtgtgtgcatagtgactgtgtgtccagtttctgcgtgcagtgactgtgtgtgcgcagtgaytgtgtgtgtgcagtgtgtgtgcagtgtctgcgcagtgactgtgtgtgtggatagtgactgtgtgtgcagtgtctgtgtgcagtgactgtgtgtgcatagtgactgtgtgcagtgactgcagtgactgcgtgcagcgtctgtgtgcagtgactgtgtgcacagtgtgtgcgcagtgactgagtgtgtgcacagtgactgtgtgtgcagtgtctgtgtgcagtgactgtgtgactgcgtgtgcacgtacagttcaaggctccaggagagggcctcagtgggccagccccacatgaagctacc

SEQ ID NO: 127873 - DNA, 601 bp, Human
ctgtgtgtgcagtgactgtgtgtgtatagcgactgtgtgttcaatgtgtgaatgcagactgtgtgtgcatgcatagtggctctgtgtgcagtgactgtgtgtgcagtgtgtgtgcatagtgactgtgtgcagtgactgtgtttgcatagtgacagtgtgtgcagtgtatgtgtgcacagtgactgtgcagtgtgtgtccatagtgactacatgcagtgccagtgtgtgtacatagtgactgtgcacagtgtgtgtgcatagtggtgtgtgcagtgtgtgcatagtgactgtgtgtccagtktctgcgtgcagtgactgtgtgtgcgcagtgactgtgtgtgtgcagtgtgtgtgcagtgtctgcgcagtgactgtgtgtgtggatagtgactgtgtgtgcagtgtctgtgtgcagtgactgtgtgtgcatagtgactgtgtgcagtgactgcagtgactgcgtgcagcgtctgtgtgcagtgactgtgtgcacagtgtgtgcgcagtgactgagtgtgtgcacagtgactgtgtgtgcagtgtctgtgtgcagtgactgtgtgactgcgtgtgcacgtacagttcaaggctccaggagagg

SEQ ID NO: 127874 - DNA, 601 bp, Human
ggggctgagaagtgggggagggagagagatgtgtgcagtatgtactggagtgggggtacagggtgggtagatgtagcagagagggccagtgtgtgtgtgtgtgcatgcgtgcatgcatgcatgactgtatgtgagagacacagagacaggaacagtgaatgaggattagaggccaggtgtagtggctcacacctgtaatcccaacactttgggaggctgaggcgggtgcatcacttgaggtcaggagttcgagaccagcctggccaacatggtgaaaccctgtctctactaaaaatacaaraagtggcctggcgtggtggtacatgcttgtaatcccaggtactcaggaggctgaggcatcataattgcttgaaacggggaggcagaggttgcagttagctgacattgtgccactgcacgccagcctgggtgacagagcgagactctgtctaaaaaaaaaaaaaaaaaagagcgagagagagagagaattggagaatgagtgagaaaaagagaagaggtcatgactatgtgcagtgtctgtacatgcagtgactgtgtgttcagtgtgtgggtgcatagactgtgtgtgcagtgactgtgt

SEQ ID NO: 127875 - DNA, 601 bp, Human
tgatcttcctgcctcagcctcccaaagtgctgggattagaggcttgagtcaccgtgctcagcctatctcccagttttaagccagacccgactgctcccaggcacctcatctcagttcagacctgatctttccctgggtcctgcagaggacaaccctcccactgttctctctcctccactgtcatctcttgctgcgattcctggtgcccacctccagcccagcctcctgtcaagctgttccctgccctgcaaccagagcgagcttgtctagtcacatgaccagtcgcgcctcccctgcttcctatcctcccaggcccttcctggtgcttaggagaaagcccatattccacaatatagccccgccctccccagccccgggtcctgtccccttctgccttcttcggctgtctccaggccagcctttctcggctgtctttgcatcagccacattccctcgcttgcagatcctgacccctcacaggttccgtcccaccacagggcctttgcatgtgctgtcctgggcctggaatgctctgtgcatctctctctgccttgttaatgctgctcatccttcagctcgcagtgcaggtataattttaagt

SEQ ID NO: 127876 - DNA, 601 bp, Human
tcaggtgatcttcctgcctcagcctcccaaagtgctgggattagaggcttgagtcaccgtgctcagcctatctcccagttttaagccagacccgactgctcccaggcacctcatctcagttcagacctgatctttccctgggtcctgcagaggacaaccctcccactgttctctctcctccactgtcatctcttgctgcgattcctggtgcccacctccagcccagcctcctgtcaagctgttccctgccctgcaaccagagcgagcttgtctagtcacatgaccagtcgcgcctcccctgcttcctatcctcccaggcccttcctggtgcttaggagaaagcccatattccacaatatagccccgccctccccagccccgggtcctgtccccttctgccttcttcggctgtctccaggccagcctttctcggctgtctttgcatcagccacattccctcgcttgcagatcctgacccctcacaggttccgtcccaccacagggcctttgcatgtgctgtcctgggcctggaatgctctgtgcatctctctctgccttgttaatgctgctcatccttcagctcgcagtgcaggtataattt

SEQ ID NO: 127877 - DNA, 601 bp, Human
actcctgacctcaggtgatcttcctgcctcagcctcccaaagtgctgggattagaggcttgagtcaccgtgctcagcctatctcccagttttaagccagacccgactgctcccaggcacctcatctcagttcagacctgatctttccctgggtcctgcagaggacaaccctcccactgttctctctcctccactgtcatctcttgctgcgattcctggtgcccacctccagcccagcctcctgtcaagctgttccctgccctgcaaccagagcgagcttgtctagtcacatgaccagtcgcgcctcccctgcttcctatcctcccaggcccttcctggtgcttaggagaaagcccatattccacaatatagccccgccctccccagccccgggtcctgtccccttctgccttcttcggctgtctccaggccagcctttctcggctgtctttgcatcagccacattccctcgcttgcagatcctgacccctcacaggttccgtcccaccacagggcctttgcatgtgctgtcctgggcctggaatgctctgtgcatctctctctgccttgttaatgctgctcatccttcagctcgcagtgca

SEQ ID NO: 127878 - DNA, 601 bp, Human
gaactcctgacctcaggtgatcttcctgcctcagcctcccaaagtgctgggattagaggcttgagtcaccgtgctcagcctatctcccagttttaagccagacccgactgctcccaggcacctcatctcagttcagacctgatctttccctgggtcctgcagaggacaaccctcccactgttctctctcctccactgtcatctcttgctgcgattcctggtgcccacctccagcccagcctcctgtcaagctgttccctgccctgcaaccagagcgagcttgtctagtcacatgaccagtcgcgcctcccctgcttcctatcctcccaggcccttcctggtgcttaggagaaagcccatattccacaatatagccccgccctccccagccccgggtcctgtccccttctgccttcttcggctgtctccaggccagcctttctcggctgtctttgcatcagccacattccctcgcttgcagatcctgacccctcacaggttccgtcccaccacagggcctttgcatgtgctgtcctgggcctggaatgctctgtgcatctctctctgccttgttaatgctgctcatccttcagctcgcagtg

SEQ ID NO: 127879 - DNA, 601 bp, Human
ccagggatctggcagggagatgcgtgcagaaaacatgcttcccttcttggagccaagtgggggaggagacacatgaggcaggtaggggtggagacgggaagggtttggggcagtgggggaagggtactagtctgccctcatccaccctccatctcttcctgcatcagtaccaattctttccactgcccccagaacttctgacaagttccctcttcctgccttccacatttcaatccatggcttgggaggtgcagcttcctctcttcaacacctcccctgaacttcctggctagaatgtgawgggggtgggacacagcccctggaagacatgaggacagcgtccttgtggtcttttcttttccagtgctgtgctcagatgttcctcaagtgctcagaaggatatggagaccacccacctaagggctccagaaaagtcctactacttgtagacctcagctccaagctgcagcccccacaacacctgcctatctgacttatttcgggatgtcctaaaggcacctcaaacttgctatgcccacacctattctcttcccccaacctggtcctttccttgcactcgctcacctctatcacccagtat

SEQ ID NO: 127880 - DNA, 601 bp, Human
catgcaaaaaagccagggatctggcagggagatgcgtgcagaaaacatgcttcccttcttggagccaagtgggggaggagacacatgaggcaggtaggggtggagacgggaagggtttggggcagtgggggaagggtactagtctgccctcatccaccctccatctcttcctgcatcagtaccaattctttccactgcccccagaacttctgacaagttccctcttcctgccttccacatttcaatccatggcttgggaggtgcagcttcctctcttcaacacctcccctgaacttcctgkctagaatgtgaagggggtgggacacagcccctggaagacatgaggacagcgtccttgtggtcttttcttttccagtgctgtgctcagatgttcctcaagtgctcagaaggatatggagaccacccacctaagggctccagaaaagtcctactacttgtagacctcagctccaagctgcagcccccacaacacctgcctatctgacttatttcgggatgtcctaaaggcacctcaaacttgctatgcccacacctattctcttcccccaacctggtcctttccttgcactcgctcacctct

SEQ ID NO: 127881 - DNA, 601 bp, Human
tgcctggaaaatgaccttgatgactatgtcccagggccctctgcttctgccctgctaggattcctgggccccccacgacacccatttccagcctcacgggaaaagaaggataagagcacatctggccacccccacaccagaaaaggaggaggagggcacgccccctatcggaagagaaggccggcacgtcccctaccggaagagaagggcacgccccctaccggaaaagaagggtgagggcgcgcccctgccagaagagaaggaggagggcacgtcttgcattggaagaggagggtacatmctctatgggaacagaaggatgaaggcaggcaccccaccccacggaaacagaattatcagagcaggtccccttctcaccggaagagaagcatgagggcctggaagaaggtccggaagttattgtgctcagtgatttggaactcatcttcatcactgtcctcgtcctccacgtcgatgccaatgttaccaaacacctgtggaattggagggtgacgaccaggggctgccattcctccagtggcttctgggaaacccagctcaacctccatggctgcttctgtgaaccaggctcctctgaccc

SEQ ID NO: 127882 - DNA, 601 bp, Human
acttttgtgtgcagccaagatgatgaaccaaagaatcaagcctcacggtctgtaagcctgttttcttatttgtcggatagggctgccaagaatcccttcctcacagggtggtcaggaagattcagagataatgcctggaaaatgaccttgatgactatgtcccagggccctctgcttctgccctgctaggattcctgggccccccacgacacccatttccagcctcacgggaaaagaaggataagagcacatctggccacccccacaccagaaaaggaggaggagggcacgccccctatcrgaagagaaggccggcacgtcccctaccggaagagaagggcacgccccctaccggaaaagaagggtgagggcgcgcccctgccagaagagaaggaggagggcacgtcttgcattggaagaggagggtacatcctctatgggaacagaaggatgaaggcaggcaccccaccccacggaaacagaattatcagagcaggtccccttctcaccggaagagaagcatgagggcctggaagaaggtccggaagttattgtgctcagtgatttggaactcatcttcatcactgtcctcgtcctccac

SEQ ID NO: 127883 - DNA, 601 bp, Human
ctcacgcctgtaatcccagcactttgggaggccgaggcgggcggatcacgaggtcaggagatcgagaccatcctggctaacatggtgaaaccccgactctactaaaaatacaaaaaaattatctgggcgtggtggcgggcgcctgtagtcccagctactcgggaggctgaggcaggagaatggcgtgaacccgggaggcggagcttgcagtgagccgagatcgcgccactgtactccagcctggggaacagagcgagactccatctccaaaaaaaaaaaaaaaaaaaaaaaaagcccccccaaaaaacctacactgaacgagtgaaggaacttttgtgtgcagccaagatgatgaaccaaagaatcaagcctcacggtctgtaagcctgttttcttatttgtcggatagggctgccaagaatcccttcctcacagggtggtcaggaagattcagagataatgcctggaaaatgaccttgatgactatgtcccagggccctctgcttctgccctgctaggattcctgggccccccacgacacccatttccagcctcacgggaaaagaaggataagagcacatctggccacccccacaccaga

SEQ ID NO: 127884 - DNA, 601 bp, Human
cacggtggctcacgcctgtaatcccagcactttgggaggccgaggcgggcggatcacgaggtcaggagatcgagaccatcctggctaacatggtgaaaccccgactctactaaaaatacaaaaaaattatctgggcgtggtggcgggcgcctgtagtcccagctactcgggaggctgaggcaggagaatggcgtgaacccgggaggcggagcttgcagtgagccgagatcgcgccactgtactccagcctggggaacagagcgagactccatctccaaaaaaaaaaaaaaaaaaaaaaaaagcccccccaaaaaacctacactgaacgagtgaaggaacttttgtgtgcagccaagatgatgaaccaaagaatcaagcctcacggtctgtaagcctgttttcttatttgtcggatagggctgccaagaatcccttcctcacagggtggtcaggaagattcagagataatgcctggaaaatgaccttgatgactatgtcccagggccctctgcttctgccctgctaggattcctgggccccccacgacacccatttccagcctcacgggaaaagaaggataagagcacatctggccaccccc

SEQ ID NO: 127885 - DNA, 601 bp, Human
ccacaagaggagcttgcagtgagccgagatggcgccactgcactccagcctgggcaacagagagagactccatctaaaaaaaaaaaaaaaaaagggctgggcacggtggctcacgcctgtaatcccagcactttgggaggccgaggcgggcggatcacgaggtcaggagatcgagaccatcctggctaacatggtgaaaccccgactctactaaaaatacaaaaaaattatctgggcgtggtggcgggcgcctgtagtcccagctactcgggaggctgaggcaggagaatggcgtgaaccygggaggcggagcttgcagtgagccgagatcgcgccactgtactccagcctggggaacagagcgagactccatctccaaaaaaaaaaaaaaaaaaaaaaaaagcccccccaaaaaacctacactgaacgagtgaaggaacttttgtgtgcagccaagatgatgaaccaaagaatcaagcctcacggtctgtaagcctgttttcttatttgtcggatagggctgccaagaatcccttcctcacagggtggtcaggaagattcagagataatgcctggaaaatgaccttgatgactatgtccc

SEQ ID NO: 127886 - DNA, 601 bp, Human
caggcacgagtcactgcacctggccctattcccctttattcttgaattttatctttttccagcatcctctataatttgtttcctgattattcgtcttccccatggggatgttagcttccaaagtgcttaaaatgtctcttttctctatttcctggtgcatcctcgtttttcagccctgcctggcatgctgtaggtgctcaatacacctccacaagaggagcttgcagtgagccgagatggcgccactgcactccagcctgggcaacagagagagactccatctaaaaaaaaaaaaaaaaaagggctgggcacggtggctcacgcctgtaatcccagcactttgggaggccgaggcgggcggatcacgaggtcaggagatcgagaccatcctggctaacatggtgaaaccccgactctactaaaaatacaaaaaaattatctgggcgtggtggcgggcgcctgtagtcccagctactcgggaggctgaggcaggagaatggcgtgaacccgggaggcggagcttgcagtgagccgagatcgcgccactgtactccagcctggggaacagagcgagactccatctccaaaaaaaaaaaaaaaa

SEQ ID NO: 127887 - DNA, 601 bp, Human
ccaggaggtggagcacacacgttgagcacttgggctctggagctggccaggcaagccccaggtggaccacctccttttactgggagctgagagaagggaattcacattcttggctgtgcactgaagtccacagagagctttgaaaaaataccaatgcccgtgccccaccccagcagacttggattcagttggtctagggtgggatttgaggacactgatatgtttttttcttttcttttccttctctctctctttcttttcctttcttttctctctctctctcttttttttttttgacagrgtcttgctctgttacccaggttggagtgtagtggcacaatcactgctcactgcagcctcaacttcccaggctcaggtgatcctcccgcctcggcctcctgagtagctggggactacaggcacacgccaccactcctggctaatttttaaactatttttttttgtagagatggggtttcactgcattgctcaggctggtcactgttatgctttaaaagctcccctcttggctgggcgcggtggctcacacctgtaatcccagcactttgggaggctgaggtgggtggatcacgaggtcagg

SEQ ID NO: 127888 - DNA, 601 bp, Human
caggaggaacgggtggcgtgtgctgccagcatctggtggggggaggacagggatgctgccatacactgcagtgcacatgatggccccaccccaaagaatcagccacccccaaatgtcaacagtgctgagtttgagacgctcagggtcacctgatcccaggctggttcagagaagccttggagggaacaagccttcgacacagccacattccacagaaacccactcccctgaaaggaagccaggcttagggagcccagacggccctcacagtgtccacagactcaccagaaacgagcagaggaagatgaaggaaacaaagtaaaaataagcaaattcattgccacactctcgagtcaggatgccagagttcttatcacacggtttcccgctgaggcaggaaagcatgatgttgtgccaagcttccccggtggcactcctgaggacagggagaaatcagagactcggacacccagccctgactgggtaccaacgcctccccaggaggtggagcacacacgttgagcacttgggctctggagctggccaggcaagccccaggtggaccacctccttttactgggagctgagagaagggaattca

SEQ ID NO: 127889 - DNA, 601 bp, Human
catatccttataatgaatccgaccgctgaaaggagaagaaagggggttagtgcaggcaatgggttcacacgggctccctgggcacacagcgaggtcatgatgcccgaggctggggtgtccctggcttgaaggagtgggagagactggggacaagtgaaggtccccagtacattcccagacactggggagacccaggggtgtaggatgtcagtcgagttcgggactgcagggcacctcccctggggctctctctgcatctgcctcctccacagtctacatgggctacaggggtgggggggggcttgtggaatagaggccttggggacagcatccaattgctgtgacctaaaatcaaaagaggaagagttaggaaccagccaaagcccagccccagacccacggctctccccagcctctcggtctcatggagtacttgtttgaggctatgggaatagccaagaccacctcctgcccaccttcctcgtgacggcctcctctctggtgctgaggccagaggaagatggggcttaggctgctgagggccccccagtaatgcttcttcaggccccaagaccagcctgaactaaatcctcagttagtg

SEQ ID NO: 127890 - DNA, 601 bp, Human
agtttaatgcaagaaagagagatggctctgtttttttagagagagagagatatatatatatatatatgaaatatatatattgaagaaccccaagccacactcattccatggatgctagcaggttttagtggaagtcaaaccttgcaagcaaccctatgaggacatttcttgcctaagccgagagggggagatattactcgtaataaactgtacatatccttataatgaatccgaccgctgaaaggagaagaaagggggttagtgcaggcaatgggttcacacgggctccctgggcacacarcgaggtcatgatgcccgaggctggggtgtccctggcttgaaggagtgggagagactggggacaagtgaaggtccccagtacattcccagacactggggagacccaggggtgtaggatgtcagtcgagttcgggactgcagggcacctcccctggggctctctctgcatctgcctcctccacagtctacatgggctacaggggtgggggggggcttgtggaatagaggccttggggacagcatccaattgctgtgacctaaaatcaaaagaggaagagttaggaaccagccaaagcccagc

SEQ ID NO: 127891 - DNA, 601 bp, Human
ggctcttcctcccttctttccctcaagaccctggaaggcacatatgtctcgaggctcagtcttccctcctcctgacttactagtggtttcagctgggctcagcaccttcccatgtgtgggactatccacctgctcctctcccacccactccttttctctggtcccatttgttttttcttttcttttctttctttctttctttctttctttctttctttctttctttctttctttctttctttctttctttctttctttctttctttctctttctttctttctttctctctctctctctctctctctctctctctctctctctctttctttctttctttctttttctttctttttttttttttttttgagacagagtcttgctgtgtcccccaggctggagtgcaatggtttgatctcggctcactgcaacctctgcctcccaggttcaagtaattcttgtgctcagcttcccaagttgttgggattataggtgtgcaccaccatgcctggctaatttttgtatttttagtggagatggggtttcgccatgttgggccaggctggtctcaaattcctggcctcaagtgatccaccttcctca

SEQ ID NO: 127892 - DNA, 601 bp, Human
ttgagtcttgccacgtggccttggctcttcctcccttctttccctcaagaccctggaaggcacatatgtctcgaggctcagtcttccctcctcctgacttactagtggtttcagctgggctcagcaccttcccatgtgtgggactatccacctgctcctctcccacccactccttttctctggtcccatttgttttttcttttcttttctttctttctttctttctttctttctttctttctttctttctttctttctttctttctttctttctttctttctttctttctctttctttctytctttctctctctctctctctctctctctctctctctctctctctttctttctttctttctttttctttctttttttttttttttttgagacagagtcttgctgtgtcccccaggctggagtgcaatggtttgatctcggctcactgcaacctctgcctcccaggttcaagtaattcttgtgctcagcttcccaagttgttgggattataggtgtgcaccaccatgcctggctaatttttgtatttttagtggagatggggtttcgccatgttgggccaggctggtctcaaattcctggc

SEQ ID NO: 127893 - DNA, 601 bp, Human
gtcccccaccttccctgccacttcctccttgagtcttgccacgtggccttggctcttcctcccttctttccctcaagaccctggaaggcacatatgtctcgaggctcagtcttccctcctcctgacttactagtggtttcagctgggctcagcaccttcccatgtgtgggactatccacctgctcctctcccacccactccttttctctggtcccatttgttttttcttttcttttctttctttctttctttctttctttctttctttctttctttctttctttctttctttctttctttytttctttctttctttctctttctttctttctttctctctctctctctctctctctctctctctctctctctctttctttctttctttctttttctttctttttttttttttttttgagacagagtcttgctgtgtcccccaggctggagtgcaatggtttgatctcggctcactgcaacctctgcctcccaggttcaagtaattcttgtgctcagcttcccaagttgttgggattataggtgtgcaccaccatgcctggctaatttttgtatttttagtggagatggggtttcgccatgt

SEQ ID NO: 127894 - DNA, 601 bp, Human
tccacccctccagtcccccaccttccctgccacttcctccttgagtcttgccacgtggccttggctcttcctcccttctttccctcaagaccctggaaggcacatatgtctcgaggctcagtcttccctcctcctgacttactagtggtttcagctgggctcagcaccttcccatgtgtgggactatccacctgctcctctcccacccactccttttctctggtcccatttgttttttcttttcttttctttctttctttctttctttctttctttctttctttctttctttctttctttytttctttctttctttctttctttctttctctttctttctttctttctctctctctctctctctctctctctctctctctctctctttctttctttctttctttttctttctttttttttttttttttgagacagagtcttgctgtgtcccccaggctggagtgcaatggtttgatctcggctcactgcaacctctgcctcccaggttcaagtaattcttgtgctcagcttcccaagttgttgggattataggtgtgcaccaccatgcctggctaatttttgtatttttagtggagatggg

SEQ ID NO: 127895 - DNA, 601 bp, Human
tgacctacaggactgtgagctgacaaataggtgtgtcttaagctgctatgtctgtggtcatcatatagctcactgcagccttgacatcccagtctccagtgatcctcccactccagcctcccaagtagttgggactacaggtgcacatcaccacacctggctaattttaaaattttctgtagagatggggtctctctgtgttggccaggctgatcttgaactcctggcctcaagtgatcctcctgccttggcttcccaaagtgctgggattacaggtgtgagccactgctcccaacttccytgtgctctctttaccttcactttgttcctggcattaacaatatctgtcctccacccctccagtcccccaccttccctgccacttcctccttgagtcttgccacgtggccttggctcttcctcccttctttccctcaagaccctggaaggcacatatgtctcgaggctcagtcttccctcctcctgacttactagtggtttcagctgggctcagcaccttcccatgtgtgggactatccacctgctcctctcccacccactccttttctctggtcccatttgttttttcttttcttttctt

SEQ ID NO: 127896 - DNA, 601 bp, Human
cttccaggagcaaaaagctaaaaagccagtgataaaacaagacctcagtcctacagccacaaggacttcaattctgccaacacctgaatgaacctggaagtagattctcccccagatcctccagagaggagcccagcttggctgacaccttgatttcagcctcgtgagaccctcagcagacagcccagtccagctttttggacttctgacctacaggactgtgagctgacaaataggtgtgtcttaagctgctatgtctgtggtcatcatatagctcactgcagccttgacatcccagtcyccagtgatcctcccactccagcctcccaagtagttgggactacaggtgcacatcaccacacctggctaattttaaaattttctgtagagatggggtctctctgtgttggccaggctgatcttgaactcctggcctcaagtgatcctcctgccttggcttcccaaagtgctgggattacaggtgtgagccactgctcccaacttccttgtgctctctttaccttcactttgttcctggcattaacaatatctgtcctccacccctccagtcccccaccttccctgccacttcctccttgag

SEQ ID NO: 127897 - DNA, 601 bp, Human
aatttttgtatttttggtagagacggggtttcgccatgttggccaggctggtctcaaacttgtgacctcaagtgatctgcccgccttgccctcccaaagtgccaggattacaggcgtgagccaccatgccaggccctttgcagattttttttttttttttttttctaatagagtctcactctgtccagcctggagtgaagtggcgggatctcggctcactgcaacctctgcctcctgggctcaagtgattctcctaccttagccttccaagtagctgggattactggcgccagccaccacrcctggctaatttttgtatttttagtagagacagggtttcaccatgttggtcaggctggtcgtgaactcgtgacctcaagtgatctgcctacctcgccctcccaaagtgctgggattacaggcgtgagccaccgtgcccggccctttgcagattttaatctatattctttcactgtaataaactgtgagtataaaaacttttctcagttctgagttcttccagggaatcactgaacctgtgggtggttttgggacccctgaacacagattctcagagtgccacagaagctgagttacgatg

SEQ ID NO: 127898 - DNA, 601 bp, Human
ctggggtacaagtaacaactgtgacagccaaattcagagacatctccaggagtctttgaaaccctcaggaagggaatccagtaggtgtcatagaagctggggtgctaagcagtaaggactagctcagtaggctagtgttgtccaaaccctgcacattccgatgaaaggactggcccattgacttgctcctgggaggtgatctctaagcctttgaaatgtcctgcctgaagagtgtctttatttagcagggggccttgggccacactgtatagttcattctttttttttttttttttttttwaaaaaaaagagatagggtctcactatgttgcctaggctggtctcgaactcctggcctcaaacgatcctccagcctcagcctcccaaagtgctgggattataggcatgagtcactgtacccggccaatacagttcattctatttatttatttattttgagatggtgtttttgctctattgcccaggctggagtgcaatggtgcgatcttggctcactgcaacctcggcctcctagtttcaagtgattctcctgcctcagcttccccagtagctgggattacagccgcccgccgccacgcct

SEQ ID NO: 127899 - DNA, 601 bp, Human
tgagacggagtttcactcttgttgcccaggctggagtgcaatggtgcaatctcagctcactgcaacctctgcctcctgggttcaagcgattctcctgcctcagcctcccgagtagctgggattacaggtgtgcaccaccacgcccaactaattttgtatttttagtagagacggggtttcaccatgttggccaggctggtctcaaactcctgacctcaggtgatccaccctcctcagcctcccaaagtgctggggattacatgcgtgagccaccgcgtctggcctgtttttttttttttttgacagagtctctctctgttcccaggctgaagtgcagtcatgtgatctcgactcactgttacctccgcctcccaggttcaagagattctctcgcttcagcttcctgagtagctgggactacaggcacgcaccaccatgcctggctatcacctggttgtttgatgatcaaagtaacgtgcgtgcagccttgggacagtgtctgccataggattattactgcagtgacccatctgttcaaggctgggacgccctggagcatccccaacagaggaagttttggttttggttttattttgatttt

SEQ ID NO: 127900 - DNA, 601 bp, Human
gtccagctgggtggaggggagggcgttctggccaggtcccccttcctgcgttggggacgggggctccatgcgctggaacatgaggggtgtccggtcctggggaatggggcagagagcagtgtgtggacaagggtggggtggtgggacggtggtacccagaaggcattgcgacatccccagtatacacacacacacacacacacactctctcaggtctcatccatctagacccttccaattccacgcagaactggaccacttctcactcctccacccaagtcatagccccagcctggtcccrcgtcctcatctctcactgcaggcaccttctcccaggtctcccgctcctaccttcaaccccactgttccacaagagccaccagagggcgcccatgagcacttgagtcaggtcctatccctcctttgcttagaaccctccatggctcccacttgcttggggaaaaagccagagtccttcctgcagctcccatggccctgaaggatctgccctgtcacctccttgcccttgtctcctccctgctcttttccaccacactggcctctttgctgttacccaaacaacccaggcacggtccagcct

SEQ ID NO: 127901 - DNA, 601 bp, Human
gagaggggggacacaggacattgaatggaaaaaagcaacagccacagggaggagggaggggaggagggggagtgagacagggaggggaggagtcgaaaaccaacacaacaaagtgaaaagagaaatgagaaatggagttttgtaagtttcggggttaaaaatagcagaagtttcaaaaattactcacaggcgtccagaggacagaaatcataattgaaacaaaaacagaagccgggttaaaggaaagtgaaaggtcgggcggcacggcccagaactcaaatatgatccacaaccgaggagsaagcagctgcgggcggcggggagggggcggcgggtgggcaagggggctggggggacagcataggcagctggtgtggtggggatccgtgtccgctccggccgccgggcaccccggtggcttgggggcaggatgggaggtggtcacagccgggatccggggacctttgcctagagtggctgttggatggggtatccccttctctcctccccgcctcccggccgagcccagcctggggtcacttgcagccgcacccacctgccggtgcgccatgtgctctcggccctcgctgggcgagcggga

SEQ ID NO: 127902 - DNA, 601 bp, Human; identical to SEQ ID NO: 127565

SEQ ID NO: 127903 - DNA, 601 bp, Human; identical to SEQ ID NO: 127566

SEQ ID NO: 127904 - DNA, 601 bp, Human; identical to SEQ ID NO: 127567

SEQ ID NO: 127905 - DNA, 601 bp, Human; identical to SEQ ID NO: 127568

SEQ ID NO: 127906 - DNA, 601 bp, Human; identical to SEQ ID NO: 127569

SEQ ID NO: 127907 - DNA, 601 bp, Human; identical to SEQ ID NO: 127570

SEQ ID NO: 127908 - DNA, 601 bp, Human; identical to SEQ ID NO: 127571

SEQ ID NO: 127909 - DNA, 601 bp, Human; identical to SEQ ID NO: 127572

SEQ ID NO: 127910 - DNA, 601 bp, Human; identical to SEQ ID NO: 127573

SEQ ID NO: 127911 - DNA, 601 bp, Human; identical to SEQ ID NO: 127574

SEQ ID NO: 127912 - DNA, 601 bp, Human; identical to SEQ ID NO: 127575

SEQ ID NO: 127913 - DNA, 601 bp, Human; identical to SEQ ID NO: 127576

SEQ ID NO: 127914 - DNA, 601 bp, Human; identical to SEQ ID NO: 127577

SEQ ID NO: 127915 - DNA, 601 bp, Human; identical to SEQ ID NO: 127578

SEQ ID NO: 127916 - DNA, 601 bp, Human; identical to SEQ ID NO: 127579

SEQ ID NO: 127917 - DNA, 601 bp, Human; identical to SEQ ID NO: 127580

SEQ ID NO: 127918 - DNA, 601 bp, Human; identical to SEQ ID NO: 127581

SEQ ID NO: 127919 - DNA, 601 bp, Human; identical to SEQ ID NO: 127582

SEQ ID NO: 127920 - DNA, 601 bp, Human; identical to SEQ ID NO: 127583

SEQ ID NO: 127921 - DNA, 601 bp, Human; identical to SEQ ID NO: 127584

SEQ ID NO: 127922 - DNA, 601 bp, Human; identical to SEQ ID NO: 127585

SEQ ID NO: 127923 - DNA, 601 bp, Human; identical to SEQ ID NO: 127586

SEQ ID NO: 127924 - DNA, 601 bp, Human; identical to SEQ ID NO: 127587

SEQ ID NO: 127925 - DNA, 601 bp, Human; identical to SEQ ID NO: 127588

SEQ ID NO: 127926 - DNA, 601 bp, Human; identical to SEQ ID NO: 127589

SEQ ID NO: 127927 - DNA, 601 bp, Human; identical to SEQ ID NO: 127590

SEQ ID NO: 127928 - DNA, 601 bp, Human; identical to SEQ ID NO: 127591

SEQ ID NO: 127929 - DNA, 601 bp, Human; identical to SEQ ID NO: 127592

SEQ ID NO: 127930 - DNA, 601 bp, Human; identical to SEQ ID NO: 127593

SEQ ID NO: 127931 - DNA, 601 bp, Human; identical to SEQ ID NO: 127594

SEQ ID NO: 127932 - DNA, 601 bp, Human; identical to SEQ ID NO: 127595

SEQ ID NO: 127933 - DNA, 601 bp, Human; identical to SEQ ID NO: 127596

SEQ ID NO: 127934 - DNA, 601 bp, Human; identical to SEQ ID NO: 127597

SEQ ID NO: 127935 - DNA, 601 bp, Human; identical to SEQ ID NO: 127598

SEQ ID NO: 127936 - DNA, 601 bp, Human; identical to SEQ ID NO: 127599

SEQ ID NO: 127937 - DNA, 601 bp, Human; identical to SEQ ID NO: 127600

SEQ ID NO: 127938 - DNA, 601 bp, Human; identical to SEQ ID NO: 127601

SEQ ID NO: 127939 - DNA, 601 bp, Human; identical to SEQ ID NO: 127602

SEQ ID NO: 127940 - DNA, 601 bp, Human; identical to SEQ ID NO: 127603

SEQ ID NO: 127941 - DNA, 601 bp, Human; identical to SEQ ID NO: 127604

SEQ ID NO: 127942 - DNA, 601 bp, Human; identical to SEQ ID NO: 127605

SEQ ID NO: 127943 - DNA, 601 bp, Human; identical to SEQ ID NO: 127606

SEQ ID NO: 127944 - DNA, 601 bp, Human; identical to SEQ ID NO: 127607

SEQ ID NO: 127945 - DNA, 601 bp, Human; identical to SEQ ID NO: 127608

SEQ ID NO: 127946 - DNA, 601 bp, Human; identical to SEQ ID NO: 127609

SEQ ID NO: 127947 - DNA, 601 bp, Human; identical to SEQ ID NO: 127610

SEQ ID NO: 127948 - DNA, 601 bp, Human; identical to SEQ ID NO: 127611

SEQ ID NO: 127949 - DNA, 601 bp, Human; identical to SEQ ID NO: 127612

SEQ ID NO: 127950 - DNA, 601 bp, Human; identical to SEQ ID NO: 127613

SEQ ID NO: 127951 - DNA, 601 bp, Human; identical to SEQ ID NO: 127614

SEQ ID NO: 127952 - DNA, 601 bp, Human; identical to SEQ ID NO: 127615

SEQ ID NO: 127953 - DNA, 601 bp, Human; identical to SEQ ID NO: 127616

SEQ ID NO: 127954 - DNA, 601 bp, Human; identical to SEQ ID NO: 127617

SEQ ID NO: 127955 - DNA, 601 bp, Human; identical to SEQ ID NO: 127618

SEQ ID NO: 127956 - DNA, 601 bp, Human; identical to SEQ ID NO: 127619

SEQ ID NO: 127957 - DNA, 601 bp, Human; identical to SEQ ID NO: 127620

SEQ ID NO: 127958 - DNA, 601 bp, Human; identical to SEQ ID NO: 127621

SEQ ID NO: 127959 - DNA, 601 bp, Human; identical to SEQ ID NO: 127622

SEQ ID NO: 127960 - DNA, 601 bp, Human; identical to SEQ ID NO: 127623

SEQ ID NO: 127961 - DNA, 601 bp, Human; identical to SEQ ID NO: 127624

SEQ ID NO: 127962 - DNA, 601 bp, Human; identical to SEQ ID NO: 127625

SEQ ID NO: 127963 - DNA, 601 bp, Human; identical to SEQ ID NO: 127626

SEQ ID NO: 127964 - DNA, 601 bp, Human; identical to SEQ ID NO: 127627

SEQ ID NO: 127965 - DNA, 601 bp, Human; identical to SEQ ID NO: 127628

SEQ ID NO: 127966 - DNA, 601 bp, Human; identical to SEQ ID NO: 127629

SEQ ID NO: 127967 - DNA, 601 bp, Human; identical to SEQ ID NO: 127630

SEQ ID NO: 127968 - DNA, 601 bp, Human; identical to SEQ ID NO: 127631

SEQ ID NO: 127969 - DNA, 601 bp, Human; identical to SEQ ID NO: 127632

SEQ ID NO: 127970 - DNA, 601 bp, Human; identical to SEQ ID NO: 127633

SEQ ID NO: 127971 - DNA, 601 bp, Human; identical to SEQ ID NO: 127634

SEQ ID NO: 127972 - DNA, 601 bp, Human; identical to SEQ ID NO: 127635

SEQ ID NO: 127973 - DNA, 601 bp, Human; identical to SEQ ID NO: 127636

SEQ ID NO: 127974 - DNA, 601 bp, Human; identical to SEQ ID NO: 127637

SEQ ID NO: 127975 - DNA, 601 bp, Human; identical to SEQ ID NO: 127638

SEQ ID NO: 127976 - DNA, 601 bp, Human; identical to SEQ ID NO: 127639

SEQ ID NO: 127977 - DNA, 601 bp, Human; identical to SEQ ID NO: 127640

SEQ ID NO: 127978 - DNA, 601 bp, Human; identical to SEQ ID NO: 127641

SEQ ID NO: 127979 - DNA, 601 bp, Human; identical to SEQ ID NO: 127642

SEQ ID NO: 127980 - DNA, 601 bp, Human; identical to SEQ ID NO: 127643

SEQ ID NO: 127981 - DNA, 601 bp, Human; identical to SEQ ID NO: 127644

SEQ ID NO: 127982 - DNA, 601 bp, Human; identical to SEQ ID NO: 127645

SEQ ID NO: 127983 - DNA, 601 bp, Human; identical to SEQ ID NO: 127646

SEQ ID NO: 127984 - DNA, 601 bp, Human; identical to SEQ ID NO: 127647

SEQ ID NO: 127985 - DNA, 601 bp, Human; identical to SEQ ID NO: 127648

SEQ ID NO: 127986 - DNA, 601 bp, Human; identical to SEQ ID NO: 127649

SEQ ID NO: 127987 - DNA, 601 bp, Human; identical to SEQ ID NO: 127650

SEQ ID NO: 127988 - DNA, 601 bp, Human; identical to SEQ ID NO: 127651

SEQ ID NO: 127989 - DNA, 601 bp, Human; identical to SEQ ID NO: 127652

SEQ ID NO: 127990 - DNA, 601 bp, Human; identical to SEQ ID NO: 127653

SEQ ID NO: 127991 - DNA, 601 bp, Human; identical to SEQ ID NO: 127654

SEQ ID NO: 127992 - DNA, 601 bp, Human; identical to SEQ ID NO: 127655

SEQ ID NO: 127993 - DNA, 601 bp, Human; identical to SEQ ID NO: 127656

SEQ ID NO: 127994 - DNA, 601 bp, Human; identical to SEQ ID NO: 127657

SEQ ID NO: 127995 - DNA, 601 bp, Human; identical to SEQ ID NO: 127658

SEQ ID NO: 127996 - DNA, 601 bp, Human; identical to SEQ ID NO: 127659

SEQ ID NO: 127997 - DNA, 601 bp, Human; identical to SEQ ID NO: 127660

SEQ ID NO: 127998 - DNA, 601 bp, Human; identical to SEQ ID NO: 127661

SEQ ID NO: 127999 - DNA, 601 bp, Human; identical to SEQ ID NO: 127662

SEQ ID NO: 128000 - DNA, 601 bp, Human; identical to SEQ ID NO: 127663

SEQ ID NO: 128001 - DNA, 601 bp, Human; identical to SEQ ID NO: 127664

SEQ ID NO: 128002 - DNA, 601 bp, Human; identical to SEQ ID NO: 127665

SEQ ID NO: 128003 - DNA, 601 bp, Human; identical to SEQ ID NO: 127666

SEQ ID NO: 128004 - DNA, 601 bp, Human; identical to SEQ ID NO: 127667

SEQ ID NO: 128005 - DNA, 601 bp, Human; identical to SEQ ID NO: 127668

SEQ ID NO: 128006 - DNA, 601 bp, Human; identical to SEQ ID NO: 127669

SEQ ID NO: 128007 - DNA, 601 bp, Human; identical to SEQ ID NO: 127670

SEQ ID NO: 128008 - DNA, 601 bp, Human; identical to SEQ ID NO: 127671

SEQ ID NO: 128009 - DNA, 601 bp, Human; identical to SEQ ID NO: 127672

SEQ ID NO: 128010 - DNA, 601 bp, Human; identical to SEQ ID NO: 127673

SEQ ID NO: 128011 - DNA, 601 bp, Human; identical to SEQ ID NO: 127674

SEQ ID NO: 128012 - DNA, 601 bp, Human; identical to SEQ ID NO: 127675

SEQ ID NO: 128013 - DNA, 601 bp, Human; identical to SEQ ID NO: 127676

SEQ ID NO: 128014 - DNA, 601 bp, Human; identical to SEQ ID NO: 127677

SEQ ID NO: 128015 - DNA, 601 bp, Human; identical to SEQ ID NO: 127678

SEQ ID NO: 128016 - DNA, 601 bp, Human; identical to SEQ ID NO: 127679

SEQ ID NO: 128017 - DNA, 601 bp, Human; identical to SEQ ID NO: 127680

SEQ ID NO: 128018 - DNA, 601 bp, Human; identical to SEQ ID NO: 127681

SEQ ID NO: 128019 - DNA, 601 bp, Human; identical to SEQ ID NO: 127682

SEQ ID NO: 128020 - DNA, 601 bp, Human; identical to SEQ ID NO: 127683

SEQ ID NO: 128021 - DNA, 601 bp, Human; identical to SEQ ID NO: 127684

SEQ ID NO: 128022 - DNA, 601 bp, Human; identical to SEQ ID NO: 127685

SEQ ID NO: 128023 - DNA, 601 bp, Human; identical to SEQ ID NO: 127686

SEQ ID NO: 128024 - DNA, 601 bp, Human; identical to SEQ ID NO: 127687

SEQ ID NO: 128025 - DNA, 601 bp, Human; identical to SEQ ID NO: 127688

SEQ ID NO: 128026 - DNA, 601 bp, Human; identical to SEQ ID NO: 127689

SEQ ID NO: 128027 - DNA, 601 bp, Human; identical to SEQ ID NO: 127690

SEQ ID NO: 128028 - DNA, 601 bp, Human; identical to SEQ ID NO: 127691

SEQ ID NO: 128029 - DNA, 601 bp, Human; identical to SEQ ID NO: 127692

SEQ ID NO: 128030 - DNA, 601 bp, Human; identical to SEQ ID NO: 127693

SEQ ID NO: 128031 - DNA, 601 bp, Human; identical to SEQ ID NO: 127694

SEQ ID NO: 128032 - DNA, 601 bp, Human; identical to SEQ ID NO: 127695

SEQ ID NO: 128033 - DNA, 601 bp, Human; identical to SEQ ID NO: 127696

SEQ ID NO: 128034 - DNA, 601 bp, Human; identical to SEQ ID NO: 127697

SEQ ID NO: 128035 - DNA, 601 bp, Human; identical to SEQ ID NO: 127698

SEQ ID NO: 128036 - DNA, 601 bp, Human; identical to SEQ ID NO: 127699

SEQ ID NO: 128037 - DNA, 601 bp, Human; identical to SEQ ID NO: 127700

SEQ ID NO: 128038 - DNA, 601 bp, Human; identical to SEQ ID NO: 127701

SEQ ID NO: 128039 - DNA, 601 bp, Human; identical to SEQ ID NO: 127702

SEQ ID NO: 128040 - DNA, 601 bp, Human; identical to SEQ ID NO: 127703

SEQ ID NO: 128041 - DNA, 601 bp, Human; identical to SEQ ID NO: 127704

SEQ ID NO: 128042 - DNA, 601 bp, Human; identical to SEQ ID NO: 127705

SEQ ID NO: 128043 - DNA, 601 bp, Human; identical to SEQ ID NO: 127706

SEQ ID NO: 128044 - DNA, 601 bp, Human; identical to SEQ ID NO: 127707

SEQ ID NO: 128045 - DNA, 601 bp, Human; identical to SEQ ID NO: 127708

SEQ ID NO: 128046 - DNA, 601 bp, Human; identical to SEQ ID NO: 127709

SEQ ID NO: 128047 - DNA, 601 bp, Human; identical to SEQ ID NO: 127710

SEQ ID NO: 128048 - DNA, 601 bp, Human; identical to SEQ ID NO: 127711

SEQ ID NO: 128049 - DNA, 601 bp, Human; identical to SEQ ID NO: 127712

SEQ ID NO: 128050 - DNA, 601 bp, Human; identical to SEQ ID NO: 127713

SEQ ID NO: 128051 - DNA, 601 bp, Human; identical to SEQ ID NO: 127714

SEQ ID NO: 128052 - DNA, 601 bp, Human; identical to SEQ ID NO: 127715

SEQ ID NO: 128053 - DNA, 601 bp, Human; identical to SEQ ID NO: 127716

SEQ ID NO: 128054 - DNA, 601 bp, Human; identical to SEQ ID NO: 127717

SEQ ID NO: 128055 - DNA, 601 bp, Human; identical to SEQ ID NO: 127718

SEQ ID NO: 128056 - DNA, 601 bp, Human; identical to SEQ ID NO: 127719

SEQ ID NO: 128057 - DNA, 601 bp, Human; identical to SEQ ID NO: 127720

SEQ ID NO: 128058 - DNA, 601 bp, Human; identical to SEQ ID NO: 127721

SEQ ID NO: 128059 - DNA, 601 bp, Human; identical to SEQ ID NO: 127722

SEQ ID NO: 128060 - DNA, 601 bp, Human; identical to SEQ ID NO: 127723

SEQ ID NO: 128061 - DNA, 601 bp, Human; identical to SEQ ID NO: 127724

SEQ ID NO: 128062 - DNA, 601 bp, Human; identical to SEQ ID NO: 127725

SEQ ID NO: 128063 - DNA, 601 bp, Human; identical to SEQ ID NO: 127726

SEQ ID NO: 128064 - DNA, 601 bp, Human; identical to SEQ ID NO: 127727

SEQ ID NO: 128065 - DNA, 601 bp, Human; identical to SEQ ID NO: 127728

SEQ ID NO: 128066 - DNA, 601 bp, Human; identical to SEQ ID NO: 127729

SEQ ID NO: 128067 - DNA, 601 bp, Human; identical to SEQ ID NO: 127730

SEQ ID NO: 128068 - DNA, 601 bp, Human; identical to SEQ ID NO: 127731

SEQ ID NO: 128069 - DNA, 601 bp, Human; identical to SEQ ID NO: 127732

SEQ ID NO: 128070 - DNA, 601 bp, Human; identical to SEQ ID NO: 127733

SEQ ID NO: 128071 - DNA, 601 bp, Human; identical to SEQ ID NO: 127734

SEQ ID NO: 128072 - DNA, 601 bp, Human; identical to SEQ ID NO: 127735

SEQ ID NO: 128073 - DNA, 601 bp, Human; identical to SEQ ID NO: 127736

SEQ ID NO: 128074 - DNA, 601 bp, Human; identical to SEQ ID NO: 127737

SEQ ID NO: 128075 - DNA, 601 bp, Human; identical to SEQ ID NO: 127738

SEQ ID NO: 128076 - DNA, 601 bp, Human; identical to SEQ ID NO: 127739

SEQ ID NO: 128077 - DNA, 601 bp, Human; identical to SEQ ID NO: 127740

SEQ ID NO: 128078 - DNA, 601 bp, Human; identical to SEQ ID NO: 127741

SEQ ID NO: 128079 - DNA, 601 bp, Human; identical to SEQ ID NO: 127742

SEQ ID NO: 128080 - DNA, 601 bp, Human; identical to SEQ ID NO: 127743

SEQ ID NO: 128081 - DNA, 601 bp, Human; identical to SEQ ID NO: 127744

SEQ ID NO: 128082 - DNA, 601 bp, Human; identical to SEQ ID NO: 127745

SEQ ID NO: 128083 - DNA, 601 bp, Human; identical to SEQ ID NO: 127746

SEQ ID NO: 128084 - DNA, 601 bp, Human; identical to SEQ ID NO: 127747

SEQ ID NO: 128085 - DNA, 601 bp, Human; identical to SEQ ID NO: 127748

SEQ ID NO: 128086 - DNA, 601 bp, Human; identical to SEQ ID NO: 127749

SEQ ID NO: 128087 - DNA, 601 bp, Human; identical to SEQ ID NO: 127750

SEQ ID NO: 128088 - DNA, 601 bp, Human; identical to SEQ ID NO: 127751

SEQ ID NO: 128089 - DNA, 601 bp, Human; identical to SEQ ID NO: 127752

SEQ ID NO: 128090 - DNA, 601 bp, Human; identical to SEQ ID NO: 127753

SEQ ID NO: 128091 - DNA, 601 bp, Human; identical to SEQ ID NO: 127754

SEQ ID NO: 128092 - DNA, 601 bp, Human; identical to SEQ ID NO: 127755

SEQ ID NO: 128093 - DNA, 601 bp, Human; identical to SEQ ID NO: 127756

SEQ ID NO: 128094 - DNA, 601 bp, Human; identical to SEQ ID NO: 127757

SEQ ID NO: 128095 - DNA, 601 bp, Human; identical to SEQ ID NO: 127758

SEQ ID NO: 128096 - DNA, 601 bp, Human; identical to SEQ ID NO: 127759

SEQ ID NO: 128097 - DNA, 601 bp, Human; identical to SEQ ID NO: 127760

SEQ ID NO: 128098 - DNA, 601 bp, Human; identical to SEQ ID NO: 127761

SEQ ID NO: 128099 - DNA, 601 bp, Human; identical to SEQ ID NO: 127762

SEQ ID NO: 128100 - DNA, 601 bp, Human; identical to SEQ ID NO: 127763

SEQ ID NO: 128101 - DNA, 601 bp, Human; identical to SEQ ID NO: 127764

SEQ ID NO: 128102 - DNA, 601 bp, Human; identical to SEQ ID NO: 127765

SEQ ID NO: 128103 - DNA, 601 bp, Human; identical to SEQ ID NO: 127766

SEQ ID NO: 128104 - DNA, 601 bp, Human; identical to SEQ ID NO: 127767

SEQ ID NO: 128105 - DNA, 601 bp, Human; identical to SEQ ID NO: 127768

SEQ ID NO: 128106 - DNA, 601 bp, Human; identical to SEQ ID NO: 127769

SEQ ID NO: 128107 - DNA, 601 bp, Human; identical to SEQ ID NO: 127770

SEQ ID NO: 128108 - DNA, 601 bp, Human; identical to SEQ ID NO: 127771

SEQ ID NO: 128109 - DNA, 601 bp, Human; identical to SEQ ID NO: 127772

SEQ ID NO: 128110 - DNA, 601 bp, Human; identical to SEQ ID NO: 127773

SEQ ID NO: 128111 - DNA, 601 bp, Human; identical to SEQ ID NO: 127774

SEQ ID NO: 128112 - DNA, 601 bp, Human; identical to SEQ ID NO: 127775

SEQ ID NO: 128113 - DNA, 601 bp, Human; identical to SEQ ID NO: 127776

SEQ ID NO: 128114 - DNA, 601 bp, Human; identical to SEQ ID NO: 127777

SEQ ID NO: 128115 - DNA, 601 bp, Human; identical to SEQ ID NO: 127778

SEQ ID NO: 128116 - DNA, 601 bp, Human; identical to SEQ ID NO: 127779

SEQ ID NO: 128117 - DNA, 601 bp, Human; identical to SEQ ID NO: 127780

SEQ ID NO: 128118 - DNA, 601 bp, Human; identical to SEQ ID NO: 127781

SEQ ID NO: 128119 - DNA, 601 bp, Human; identical to SEQ ID NO: 127782

SEQ ID NO: 128120 - DNA, 601 bp, Human; identical to SEQ ID NO: 127783

SEQ ID NO: 128121 - DNA, 601 bp, Human; identical to SEQ ID NO: 127784

SEQ ID NO: 128122 - DNA, 601 bp, Human; identical to SEQ ID NO: 127785

SEQ ID NO: 128123 - DNA, 601 bp, Human; identical to SEQ ID NO: 127786

SEQ ID NO: 128124 - DNA, 601 bp, Human; identical to SEQ ID NO: 127787

SEQ ID NO: 128125 - DNA, 601 bp, Human; identical to SEQ ID NO: 127788

SEQ ID NO: 128126 - DNA, 601 bp, Human; identical to SEQ ID NO: 127789

SEQ ID NO: 128127 - DNA, 601 bp, Human; identical to SEQ ID NO: 127790

SEQ ID NO: 128128 - DNA, 601 bp, Human; identical to SEQ ID NO: 127791

SEQ ID NO: 128129 - DNA, 601 bp, Human; identical to SEQ ID NO: 127792

SEQ ID NO: 128130 - DNA, 601 bp, Human; identical to SEQ ID NO: 127793

SEQ ID NO: 128131 - DNA, 601 bp, Human; identical to SEQ ID NO: 127794

SEQ ID NO: 128132 - DNA, 601 bp, Human; identical to SEQ ID NO: 127795

SEQ ID NO: 128133 - DNA, 601 bp, Human; identical to SEQ ID NO: 127796

SEQ ID NO: 128134 - DNA, 601 bp, Human; identical to SEQ ID NO: 127797

SEQ ID NO: 128135 - DNA, 601 bp, Human; identical to SEQ ID NO: 127798

SEQ ID NO: 128136 - DNA, 601 bp, Human; identical to SEQ ID NO: 127799

SEQ ID NO: 128137 - DNA, 601 bp, Human; identical to SEQ ID NO: 127800

SEQ ID NO: 128138 - DNA, 601 bp, Human; identical to SEQ ID NO: 127801

SEQ ID NO: 128139 - DNA, 601 bp, Human; identical to SEQ ID NO: 127802

SEQ ID NO: 128140 - DNA, 601 bp, Human; identical to SEQ ID NO: 127803

SEQ ID NO: 128141 - DNA, 601 bp, Human; identical to SEQ ID NO: 127804

SEQ ID NO: 128142 - DNA, 601 bp, Human; identical to SEQ ID NO: 127805

SEQ ID NO: 128143 - DNA, 601 bp, Human; identical to SEQ ID NO: 127806

SEQ ID NO: 128144 - DNA, 601 bp, Human; identical to SEQ ID NO: 127807

SEQ ID NO: 128145 - DNA, 601 bp, Human; identical to SEQ ID NO: 127808

SEQ ID NO: 128146 - DNA, 601 bp, Human; identical to SEQ ID NO: 127809

SEQ ID NO: 128147 - DNA, 601 bp, Human; identical to SEQ ID NO: 127810

SEQ ID NO: 128148 - DNA, 601 bp, Human; identical to SEQ ID NO: 127811

SEQ ID NO: 128149 - DNA, 601 bp, Human; identical to SEQ ID NO: 127812

SEQ ID NO: 128150 - DNA, 601 bp, Human; identical to SEQ ID NO: 127813

SEQ ID NO: 128151 - DNA, 601 bp, Human; identical to SEQ ID NO: 127814

SEQ ID NO: 128152 - DNA, 601 bp, Human; identical to SEQ ID NO: 127815

SEQ ID NO: 128153 - DNA, 601 bp, Human; identical to SEQ ID NO: 127816

SEQ ID NO: 128154 - DNA, 601 bp, Human; identical to SEQ ID NO: 127817

SEQ ID NO: 128155 - DNA, 601 bp, Human; identical to SEQ ID NO: 127818

SEQ ID NO: 128156 - DNA, 601 bp, Human; identical to SEQ ID NO: 127819

SEQ ID NO: 128157 - DNA, 601 bp, Human; identical to SEQ ID NO: 127820

SEQ ID NO: 128158 - DNA, 601 bp, Human; identical to SEQ ID NO: 127821

SEQ ID NO: 128159 - DNA, 601 bp, Human; identical to SEQ ID NO: 127822

SEQ ID NO: 128160 - DNA, 601 bp, Human; identical to SEQ ID NO: 127823

SEQ ID NO: 128161 - DNA, 601 bp, Human; identical to SEQ ID NO: 127824

SEQ ID NO: 128162 - DNA, 601 bp, Human; identical to SEQ ID NO: 127825

SEQ ID NO: 128163 - DNA, 601 bp, Human; identical to SEQ ID NO: 127826

SEQ ID NO: 128164 - DNA, 601 bp, Human; identical to SEQ ID NO: 127827

SEQ ID NO: 128165 - DNA, 601 bp, Human; identical to SEQ ID NO: 127828

SEQ ID NO: 128166 - DNA, 601 bp, Human; identical to SEQ ID NO: 127829

SEQ ID NO: 128167 - DNA, 601 bp, Human; identical to SEQ ID NO: 127830

SEQ ID NO: 128168 - DNA, 601 bp, Human; identical to SEQ ID NO: 127831

SEQ ID NO: 128169 - DNA, 601 bp, Human; identical to SEQ ID NO: 127832

SEQ ID NO: 128170 - DNA, 601 bp, Human; identical to SEQ ID NO: 127833

SEQ ID NO: 128171 - DNA, 601 bp, Human; identical to SEQ ID NO: 127834

SEQ ID NO: 128172 - DNA, 601 bp, Human; identical to SEQ ID NO: 127835

SEQ ID NO: 128173 - DNA, 601 bp, Human; identical to SEQ ID NO: 127836

SEQ ID NO: 128174 - DNA, 601 bp, Human; identical to SEQ ID NO: 127837

SEQ ID NO: 128175 - DNA, 601 bp, Human; identical to SEQ ID NO: 127838

SEQ ID NO: 128176 - DNA, 601 bp, Human; identical to SEQ ID NO: 127839

SEQ ID NO: 128177 - DNA, 601 bp, Human; identical to SEQ ID NO: 127840

SEQ ID NO: 128178 - DNA, 601 bp, Human; identical to SEQ ID NO: 127841

SEQ ID NO: 128179 - DNA, 601 bp, Human; identical to SEQ ID NO: 127842

SEQ ID NO: 128180 - DNA, 601 bp, Human; identical to SEQ ID NO: 127843

SEQ ID NO: 128181 - DNA, 601 bp, Human; identical to SEQ ID NO: 127844

SEQ ID NO: 128182 - DNA, 601 bp, Human; identical to SEQ ID NO: 127845

SEQ ID NO: 128183 - DNA, 601 bp, Human; identical to SEQ ID NO: 127846

SEQ ID NO: 128184 - DNA, 601 bp, Human; identical to SEQ ID NO: 127847

SEQ ID NO: 128185 - DNA, 601 bp, Human; identical to SEQ ID NO: 127848

SEQ ID NO: 128186 - DNA, 601 bp, Human; identical to SEQ ID NO: 127849

SEQ ID NO: 128187 - DNA, 601 bp, Human; identical to SEQ ID NO: 127850

SEQ ID NO: 128188 - DNA, 601 bp, Human; identical to SEQ ID NO: 127851

SEQ ID NO: 128189 - DNA, 601 bp, Human; identical to SEQ ID NO: 127852

SEQ ID NO: 128190 - DNA, 601 bp, Human; identical to SEQ ID NO: 127853

SEQ ID NO: 128191 - DNA, 601 bp, Human; identical to SEQ ID NO: 127854

SEQ ID NO: 128192 - DNA, 601 bp, Human; identical to SEQ ID NO: 127855

SEQ ID NO: 128193 - DNA, 601 bp, Human; identical to SEQ ID NO: 127856

SEQ ID NO: 128194 - DNA, 601 bp, Human; identical to SEQ ID NO: 127857

SEQ ID NO: 128195 - DNA, 601 bp, Human; identical to SEQ ID NO: 127858

SEQ ID NO: 128196 - DNA, 601 bp, Human; identical to SEQ ID NO: 127859

SEQ ID NO: 128197 - DNA, 601 bp, Human; identical to SEQ ID NO: 127860

SEQ ID NO: 128198 - DNA, 601 bp, Human; identical to SEQ ID NO: 127861

SEQ ID NO: 128199 - DNA, 601 bp, Human; identical to SEQ ID NO: 127862

SEQ ID NO: 128200 - DNA, 601 bp, Human; identical to SEQ ID NO: 127863

SEQ ID NO: 128201 - DNA, 601 bp, Human; identical to SEQ ID NO: 127864

SEQ ID NO: 128202 - DNA, 601 bp, Human; identical to SEQ ID NO: 127865

SEQ ID NO: 128203 - DNA, 601 bp, Human; identical to SEQ ID NO: 127866

SEQ ID NO: 128204 - DNA, 601 bp, Human; identical to SEQ ID NO: 127867

SEQ ID NO: 128205 - DNA, 601 bp, Human; identical to SEQ ID NO: 127868

SEQ ID NO: 128206 - DNA, 601 bp, Human; identical to SEQ ID NO: 127869

SEQ ID NO: 128207 - DNA, 601 bp, Human; identical to SEQ ID NO: 127870

SEQ ID NO: 128208 - DNA, 601 bp, Human; identical to SEQ ID NO: 127871

SEQ ID NO: 128209 - DNA, 601 bp, Human; identical to SEQ ID NO: 127872

SEQ ID NO: 128210 - DNA, 601 bp, Human; identical to SEQ ID NO: 127873

SEQ ID NO: 128211 - DNA, 601 bp, Human; identical to SEQ ID NO: 127874

SEQ ID NO: 128212 - DNA, 601 bp, Human; identical to SEQ ID NO: 127875

SEQ ID NO: 128213 - DNA, 601 bp, Human; identical to SEQ ID NO: 127876

SEQ ID NO: 128214 - DNA, 601 bp, Human; identical to SEQ ID NO: 127877

SEQ ID NO: 128215 - DNA, 601 bp, Human; identical to SEQ ID NO: 127878

SEQ ID NO: 128216 - DNA, 601 bp, Human; identical to SEQ ID NO: 127879

SEQ ID NO: 128217 - DNA, 601 bp, Human; identical to SEQ ID NO: 127880

SEQ ID NO: 128218 - DNA, 601 bp, Human; identical to SEQ ID NO: 127881

SEQ ID NO: 128219 - DNA, 601 bp, Human; identical to SEQ ID NO: 127882

SEQ ID NO: 128220 - DNA, 601 bp, Human; identical to SEQ ID NO: 127883

SEQ ID NO: 128221 - DNA, 601 bp, Human; identical to SEQ ID NO: 127884

SEQ ID NO: 128222 - DNA, 601 bp, Human; identical to SEQ ID NO: 127885

SEQ ID NO: 128223 - DNA, 601 bp, Human; identical to SEQ ID NO: 127886

SEQ ID NO: 128224 - DNA, 601 bp, Human; identical to SEQ ID NO: 127887

SEQ ID NO: 128225 - DNA, 601 bp, Human; identical to SEQ ID NO: 127888

SEQ ID NO: 128226 - DNA, 601 bp, Human; identical to SEQ ID NO: 127889

SEQ ID NO: 128227 - DNA, 601 bp, Human; identical to SEQ ID NO: 127890

SEQ ID NO: 128228 - DNA, 601 bp, Human; identical to SEQ ID NO: 127891

SEQ ID NO: 128229 - DNA, 601 bp, Human; identical to SEQ ID NO: 127892

SEQ ID NO: 128230 - DNA, 601 bp, Human; identical to SEQ ID NO: 127893

SEQ ID NO: 128231 - DNA, 601 bp, Human; identical to SEQ ID NO: 127894

SEQ ID NO: 128232 - DNA, 601 bp, Human; identical to SEQ ID NO: 127895

SEQ ID NO: 128233 - DNA, 601 bp, Human; identical to SEQ ID NO: 127896

SEQ ID NO: 128234 - DNA, 601 bp, Human; identical to SEQ ID NO: 127897

SEQ ID NO: 128235 - DNA, 601 bp, Human; identical to SEQ ID NO: 127898

SEQ ID NO: 128236 - DNA, 601 bp, Human; identical to SEQ ID NO: 127899

SEQ ID NO: 128237 - DNA, 601 bp, Human; identical to SEQ ID NO: 127900

SEQ ID NO: 128238 - DNA, 601 bp, Human; identical to SEQ ID NO: 127901

SEQ ID NO: 128239 - DNA, 601 bp, Human
ttggatacaattttgccaaaagagataaatattcaataaaattactttaagtctttcctaggactctaggagagtcaggaatgccacgttgattctccagtattggatggtagaaagtgtgaccttggagcttgggtggacaagaggagctgaatgtgctaatgaaggcattgttcagtgtcacaggcacataatcacttgtaagattttagaactaaaagcaacaatgaccatatccagtgcaaccttgactacgtaaaatgcagactgggagaggcagaactgctaggaggtcagaacgactctgaataaaaactggccagcattcaggccaggcgctgtggcacatgcctgtaatcccagcactttgggaggtggatcacttgaggttagcagcttgagaccagtctgggcaacctggtgaaacccctcgtctctactaaaaagataaaaattagctgggcatggcatcgcgcagctgtaatcccagctactcaggaggctgaggcacgagaatctcttgaacccaggaggcgaaggttgcagtgagctgagactgtgccgctacactccagcctgcacgacagagccagactccatc

SEQ ID NO: 128240 - DNA, 601 bp, Human
gttcaggaggccaagtgactttccaagtgaggggcatgagtagtaagcataaaagggaaacctagagtgaagaaaaaaacacacaaatcaggatcctgaagcacttctgctttggtttggagacgtttcatgatactggaattaacctttacagctgtcacacgcagttttagaggtatgaaattataatgaatgagcaaacagattactcataagagggctaattcagagaaaaaaaagaatcaactgctgacagattattgattttgccaataaaccatcagtgtttttctaatcttcrtgagcattttctcgaaaagcacaccacacactaaccccttaatatttttctacaaagcctagtgccataaagtctatggaaataaaaagtaggcggttagccaggcatggtgttgcacgcctgtagtcccagctacttgagaggctgagatgggagtgcagagccaagatcacactactgtactccagcctgggtgacagagaccctgtcccaaaaaacaggaaaaaaaaagtagccagttagataggagagtatttgagggtaaataaagtagctgggcatgatgtttgagcccaggtc

SEQ ID NO: 128241 - DNA, 601 bp, Human
tttctgagatactcgaccatccccactccatccttctgcacatcagcataacagacatccccagcttctcgcatgtgatccttcaggtcctgccagctgcctgacggaggaagtcctaggcatggagaacataagaaagcccacatccttcagctatgttaactgccctgttaagagccagcaatacctatggtcctttctccatgatcacttaaatcctgagggtccccaaatcataaaccttgataagggacatgaaatcagaaaagagcactgaagtatgtgtggtaaatgaaccacyttgagaagctggttttaagttcatcttccagagaccaggccttttcaacagagcaagaagtccatcccattacaggtttagtatctttgagaattcatagcctctttctttgtcctttaaaatcaatgccaaactcctaatactttgagttccaattttttccattatgaaatttaacagtaccaattatttattgcttgacagggtttcacaggacatgggaattttgaaaccagacatgaaataaccaaagagtagctgaaggtaacaacacaacaacaaaaaatctaaagtttgttt

SEQ ID NO: 128242 - DNA, 601 bp, Human
tggagtgatttgagtacaagctcctcaacagaaggcaaggacccacctcatgagagcggaatttggtgtcatccagtttacgcagggcatattccatgtcttcttttctgagatactcgaccatccccactccatccttctgcacatcagcataacagacatccccagcttctcgcatgtgatccttcaggtcctgccagctgcctgacggaggaagtcctaggcatggagaacataagaaagcccacatccttcagctatgttaactgccctgttaagagccagcaatacctatggtccyttctccatgatcacttaaatcctgagggtccccaaatcataaaccttgataagggacatgaaatcagaaaagagcactgaagtatgtgtggtaaatgaaccaccttgagaagctggttttaagttcatcttccagagaccaggccttttcaacagagcaagaagtccatcccattacaggtttagtatctttgagaattcatagcctctttctttgtcctttaaaatcaatgccaaactcctaatactttgagttccaattttttccattatgaaatttaacagtaccaattatttattg

SEQ ID NO: 128243 - DNA, 601 bp, Human
ggcaggacaggataaccagaaaaaaacaatgtccaactggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagaccgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatg

SEQ ID NO: 128244 - DNA, 601 bp, Human
ccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactgggctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactgtctctaaaatcaaaaattagagaaatataaaaattataa

SEQ ID NO: 128245 - DNA, 601 bp, Human
atctgaattactgccattgacccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggagkcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagc

SEQ ID NO: 128246 - DNA, 601 bp, Human
aactatcaattactcagcaggccccaaggctcatccccctggttagtcaccagcacctaccaccttatgatgattaagataaccggatctggaattggatgagcctgggttcaaatcccagcactaccactaaacttccctgagctcaggtttccacatgtataaagtggagcgaaaacacctccctttctgaaaggttgtgatacagctcgtaaagtgctgagtacagtgcctgtctcccatgaagcgcacatgatcatgattagaccacagttgtggtcaaagcccccaccaagtacaytgagaacatgaacagaggaagagcaagcaatcgggttagaaaacacagtcagagtgcatctcagtgttgtgggaactctgtccaggaaactccggccagaacttgaacagagcgaactctgggccaaaccagcatctaaacagtaataagaaaagccaccaagcagccaccccaaagaacaaagtggagagaacacacagggaagggcagaacacgctgtgttgatatttttctgctcagagagctataaatttgtaacttattaagcagcacatggtgagtctgtcattggcaactatg

SEQ ID NO: 128247 - DNA, 601 bp, Human
gcgattctcctgcctcagcctcctgagtagctgagactacaggcacgcgccaccacgcccagctaatttttgtatttttagtagagattgggtttcaccacattggccaggctggtcttgaactcctgacctcaaaagatgcacccacttcagcctcccaaagtgctgggattacaggtgtgagccaccatgcccggcagattttgttattattaatgaaggcactgagactaggatgatccccggaaaggctgcaatgaggctggaagtttattcaacatctctggagcgaggtaaagaygcaagagaagcttcagagtcagatactccaagcaggatgactaaataggagaggagggctgctcagtggcccaccaataactctggccttccatcagcctctccagccaagggtacacccagtctcttcaatgcatgaccatcactagggaagctggaaaaaaggaatactgagatattccctcaaaagaccttgaacctatagtgacagggctttgggttccagtaggctgagcatttctccatcaagctatgtctgcccaggcagcagacagcttcacatatcagaaagtgtacccgc

SEQ ID NO: 128248 - DNA, 601 bp, Human
tatgagaaaaagttctgtaaacactgtaaaaaagaaaagtaccccctaggccagagtgcagtgatgcgatctcggcttactgcaatctctgcctcccgggttcaagcgattctcctgcctcagcctcctgagtagctgagactacaggcacgcgccaccacgcccagctaatttttgtatttttagtagagattgggtttcaccacattggccaggctggtcttgaactcctgacctcaaaagatgcacccacttcagcctcccaaagtgctgggattacaggtgtgagccaccatgcccsgcagattttgttattattaatgaaggcactgagactaggatgatccccggaaaggctgcaatgaggctggaagtttattcaacatctctggagcgaggtaaagacgcaagagaagcttcagagtcagatactccaagcaggatgactaaataggagaggagggctgctcagtggcccaccaataactctggccttccatcagcctctccagccaagggtacacccagtctcttcaatgcatgaccatcactagggaagctggaaaaaaggaatactgagatattccctcaaaagaccttg

SEQ ID NO: 128249 - DNA, 601 bp, Human
gcctgtagtcctagctactcgggaggctgagggaagaggaacacttgggcctgggaggcagaggctgcagaccctgtctccaaaaaaaagtgtacaaaacagttggctgcaagtcccgctcagcagccagaccacctggattcaaatcctagcactgccattcactagttgtagaacttgggcaagtgggctcacctctctgtgtctcagtttcctcacttataaaacaggtagtagtaatacgactactaataaaacctgcctcatatggccagcttgattcaagcaaacaatgcatgtraagtgcccagcacagtgcctgcacataataagagctcaataaatattatgagaaaaagttctgtaaacactgtaaaaaagaaaagtaccccctaggccagagtgcagtgatgcgatctcggcttactgcaatctctgcctcccgggttcaagcgattctcctgcctcagcctcctgagtagctgagactacaggcacgcgccaccacgcccagctaatttttgtatttttagtagagattgggtttcaccacattggccaggctggtcttgaactcctgacctcaaaagatgcacccact

SEQ ID NO: 128250 - DNA, 601 bp, Human
tcacctgaagtcgggagttcgagaccagcctgaccaacatggagaaactccgtctctactaaaaatacaaaattagctgggcatggtggctcatgcccccagctacttgggggactgaggcaggagaatcgcttgaacctgggaggtggaggttgtggtgagccgagatcatgccattgccctccagcctgggcaataagagtgaaactcaggaaaaaaaaaaaaaaagaacaaaagacagacaagaagctgcagagaacagggaaatgacagatgtggaagacaacagagaatagggtgsgtgcagaaaaatgttagtgtcctagaaacagaaaacagtcaaaccaatgggcaacccatatcagatgcagtattatgaacagaagtgtaaagaatgcaccaggcacaatggctcatgcctgtaatcccagcattttgggaggttgatgcaggcacattgcttgaggccaggtgttcaagaacagcctgggaaacatggtgaaaccctgtctccacaaaaaatttcaaaaattagcggggcgttacggcatatgcctgtagtcctagctactcgggaggctgagggaagaggaacacttgg

SEQ ID NO: 128251 - DNA, 601 bp, Human
gaaagaacaaaaaggccgggtgcagtggctcacgcctgtaatgccaacactttgggaggccgaggcgggtggatcacctgaagtcgggagttcgagaccagcctgaccaacatggagaaactccgtctctactaaaaatacaaaattagctgggcatggtggctcatgcccccagctacttgggggactgaggcaggagaatcgcttgaacctgggaggtggaggttgtggtgagccgagatcatgccattgccctccagcctgggcaataagagtgaaactcaggaaaaaaaaaaaaaaagaacaaaagacagacaagaagctgcagagaacagggaaatgacagatgtggaagacaacagagaatagggtgggtgcagaaaaatgttagtgtcctagaaacagaaaacagtcaaaccaatgggcaacccatatcagatgcagtattatgaacagaagtgtaaagaatgcaccaggcacaatggctcatgcctgtaatcccagcattttgggaggttgatgcaggcacattgcttgaggccaggtgttcaagaacagcctgggaaacatggtgaaaccctgtctccacaaaaaatttcaa

SEQ ID NO: 128252 - DNA, 601 bp, Human
ggctcacacctgtaatctcagcactttgggaggccgaggtgggtggatcacctgaggtcgggagtttgagaccagcctgaccagcctgaccaacatggagaaacctggtttctactaaaaataaaaaaattagccaggcgtggtggtgcatgcctgtaatcccagctactcgggagactgaggcagcagaatcgcttgaacccaggaggcagaggttgtagtgagctgagatggtgccactgcactccagcctgggcaacaagagcaaaactctgcctcaaaacaaacaaacaaaaaaaaacaaataaaactaagttgaggccaggtggggtagctcacacctgtaatcccagcactttgggaggctgaggcaggtggatcacctgaggtcaggagttgaagaccagcctaaacaatatggtgaaaccccacctctactaaaaatacaaaaattagccgggtgtggtggcatgcacccatagtcccagctactcaggaggctgagacaggagaattgcttaagcccaggaggcggaggttgcagtgagccaagatcgcgctgctgcactccagcctgggtgacagggcaagactctgcctc

SEQ ID NO: 128253 - DNA, 601 bp, Human
aagatcacaccattgcactccagcctgggtgacagagtaagactccgtctcaaaaaaaaaaaaaaaagtcttgctctgcatcccatcagcctagacaacccatctcaaactccaaccagagttcggcatctcacatgcttcaaccctggtctgattaatgtcatcatgctcaaataactcatgaggctgcctccacacctatggacacacactgtctctgggcctgtcttttttctgcacaggtcacagcactgtgctccccatttcccagatgatagtcagcagtcactgtcacctgagrcccccccagctactgtctctgctcacccagtcttcccaccacctgctcaatcacaggagaccagcagtcattcaggccaaccataggcaggcgcaggccagcacctaggcccaacaactccaagcccatcatggaaaagcagggtttccttacttttctccaacttttcattataaaaatgtctaagcacacagagaagttgagaggcccgggtactctcacttagattgaatggctgtcattgttttaccactttgtgtaaacgcatggcccttgtgctctctgccctttatgtgtata

SEQ ID NO: 128254 - DNA, 601 bp, Human
tttcatagcctgctttcaatagggtttttttttgttgttgttgttgtttttgagacggaatctcgctctgtcacccaggctggagtgcagtggcctgatcttggctcaccgcaacctccgcctcccaggttcaaggaattctcctgcctcagcctcccgagtagctgggattacaagcatgcgccaccacgcccagctaattttgtattttagtagagatggggtttctccatgttggtcaagctggtctcgaactcccaacttcaggcctcaggtgttccacctgcctcagcctcccaargctgggattacaggcatgagccaccgcgcctggcctcagtagggtttttatgttttagaagaggccaaagtctccaaggctcattcaaaacaatacacacagaccgggatccagaagagaatcggcctgaagctccctggagctccctggagggttccaccccccttgctccagctcacccagagttctacgattcaaaacagctggaaatgtgtgccctgctctccccaacaagaaaacagaacagaacatggctgtttctgccaagcgaattctgaataagctgcattccatttcatt

SEQ ID NO: 128255 - DNA, 601 bp, Human
tattagtgttagatgagcgattagtataaaccaagccaccaagccacctcctcccccaccacttcctcatgaaagccaccaaagaggctcaggggaaattaaaagtcatataaccaaaacccaacttaacaccaccagcccaagggtgtggccatttcacctccacagcagagttccaaacattctccaacccatggcgccatgaagagtcctaaatcacattcttccagaaagtaactgaagtcagattcttcccccaggcctagctaagcaaccaaacagggccaattgcactaagtgaccaccaaggccacgggaaatgcagccaacctaaagatgaagtggaagcttaaattcgaagagtgggccaggtgcaatggctcacgtctgtaatcccaacactttgggaggccgaggtgagcagatcacttgaggccaggagttcaagaccagcctggccaacatggcgaaaccccatctctactaaaaatacaaaaaattagctgggtgtgatggcaggtgcctgtgatcccagctactcgggaggctgaggcaggagaatcacttgaacccaggaggtggaggttgcaatgagctgaga

SEQ ID NO: 128256 - DNA, 601 bp, Human
atattagtgttagatgagcgattagtataaaccaagccaccaagccacctcctcccccaccacttcctcatgaaagccaccaaagaggctcaggggaaattaaaagtcatataaccaaaacccaacttaacaccaccagcccaagggtgtggccatttcacctccacagcagagttccaaacattctccaacccatggcgccatgaagagtcctaaatcacattcttccagaaagtaactgaagtcagattcttcccccaggcctagctaagcaaccaaacagggccaattgcactaagtccccaccaaggccacgggaaatgcagccaacctaaagatgaagtggaagcttaaattcgaagagtgggccaggtgcaatggctcacgtctgtaatcccaacactttgggaggccgaggtgagcagatcacttgaggccaggagttcaagaccagcctggccaacatggcgaaaccccatctctactaaaaatacaaaaaattagctgggtgtgatggcaggtgcctgtgatcccagctactcgggaggctgaggcaggagaatcacttgaacccaggaggtggaggttgcaatgagctgag

SEQ ID NO: 128257 - DNA, 601 bp, Human
ctttccggcttggctgcctccaaagaccagacaaaaagacttcaagtgccaacttccaaagagagagaagggggaggagttcttggaaagttcaggacacagcagaagaggccatttgaggtggtgaggcagggaagaaatgagaccacccagctatcccaacagctacctcacctcaaagacgcattgtgcctgatgaagctaagcaggggtgaagaaactgcacatccactgcttgggacagaggaccttccaagacaggcagcatgtgaccaggcaggctcaggagggctgccaagtygtgtctctgaggagtgactgcagtgttccaggcatcacgaccactcctccacacccaccccagaggagcccatcccactcagctgtcccagagcacatcagtgatgagaaactgccttagccggccagccgagccaggagtacacaggggaaatggcaaatccagaggaaaccaagtgcaggccattggacactcccatttccacctaaggaagaggaatgttcctggaaacagagggggcaaagctcggccaggactctctgagccacttcaaacctccaacagagcccagggtgggtc

SEQ ID NO: 128258 - DNA, 601 bp, Human
cacaggaagccatgacaaccgcctccaggtaacgatcttcttccccagcttctttccggcttggctgcctccaaagaccagacaaaaagacttcaagtgccaacttccaaagagagagaagggggaggagttcttggaaagttcaggacacagcagaagaggccatttgaggtggtgaggcagggaagaaatgagaccacccagctatcccaacagctacctcacctcaaagacgcattgtgcctgatgaagctaagcaggggtgaagaaactgcacatccactgcttgggacagaggacyttccaagacaggcagcatgtgaccaggcaggctcaggagggctgccaagtcgtgtctctgaggagtgactgcagtgttccaggcatcacgaccactcctccacacccaccccagaggagcccatcccactcagctgtcccagagcacatcagtgatgagaaactgccttagccggccagccgagccaggagtacacaggggaaatggcaaatccagaggaaaccaagtgcaggccattggacactcccatttccacctaaggaagaggaatgttcctggaaacagagggggcaaagctcg

SEQ ID NO: 128259 - DNA, 601 bp, Human
cccaaagcactgtgcacttctcctatgagaacacctcaagctggtaggaactgtctgcctaaggggccatgtctcacagcctaggaatagcacattgtgggtagggagtacgcctatattcatcttcatctgagcattgggcagagcctagcatataataggggctccatggatgataccaaacaaatcaacaaatgacctgcgccaagtcagtctgctgctgagatcagccttgccacttcagctcatgccacctcctggtcctccctaagagctcactgtatgcaaagcccggtgaggkagagcaacacaggagcacagggcccaagttgttcctactcttctatcccagaatgtcccatctactgtgatctagttgccaccacccctccccaaccagcaaaactcctaccctaaaataaacaaacaaaaaaatagctgggcatggtggccacatctgtaatcccagcactttgggaggctgaggtgggtggatcacaaggtcaggagttcaagaccagcctggccaagatggtgaaaccccatctctactaaaaatacaaaacttggtcgggcgcggtggctcacgcctgtaatccca

SEQ ID NO: 128260 - DNA, 601 bp, Human
ggggatgaggagctgtcccacccacaaagctgacatccctgattgccccaccagagcaagtgcatgcccagcactgcaagccataagcaactgcagagaaggtgctctgacaggtgtcagttaggtagtctgactctcccacagtggctccagagtcacctgttaagacactgggaccagaccatcagactgtaaacaagatctgggctaaaaagctgagaggctttgcaggacccaaccaaaacagcaatctctctccctggctttgaagccattcccaagttcaaagggtcaccaagcrgatgcatctggaggcccctgcattcgtggtgtgggaagctcagtgcacaagccaacaggaagaagggcactgctgatcctcccaggagtccagtccaaaagctggcatcgcagccccacagtgctcccaatgacgcaagtgccaagaaaggagtccagggatggcccttctgaagtctctgcctcctaactctgccagagcattcgccattggaacatcgacactaacccacccaggactgactccagaggccctgagtgtcaggcataacagtgcccacccactcagggtggcctgcac

SEQ ID NO: 128261 - DNA, 601 bp, Human
aggcaggagaatcgcttgaacccaggaggcggaggttgcagtgagccagtatcgtgccactgcactccaacctgggcaacagagtgagactccgtctcaaaaacaaaaacaaaattagccaggcgtggtggtgcatgcctgtaatcccagctactcaggaggctgagtgaggcaacggaattgcttgaacctgggaggcggaggttgcagtgacctgagatcacaccactgcactccagcctgggtgacagagcgagactctgtctcagataaataaataaataataaattaaattaaatwaaaaatctgagctaatctgaataaattgagagatttcacatgaaagccaggatttctggcttcccaggaacagtcagaagagctagctagcaacactggtctgcttggctaccttctttggaacaacatgaaatctagctcccttttttttttttttttggcccacttcatccattcacatgacctgcctggcctctgcaggtaagtgagtatgcaacaaaaatgtagcacaggttttgtcgctgaactacgtggtttcaggtccagctctgccacttgctagcatgacacctctttgag

SEQ ID NO: 128262 - DNA, 601 bp, Human
aggaatgccccggccactgtcctgaagagggcaaggccaatttctccggaggcccggagccttgccaactctccgcatggggaaatctgcctcttcctggacagggaggaagcagatggagctgcagagtcacgctgggaaaccacaatagaaaaaaaggagagaagatattttcctgaaacaaaaagcacccagggagacctctgggctttcagtctggctagtggagttcacgtgtaggtatatcaaggtgcaggggagagggatagggtgggaacagaactcaaatgagaccacgtcrtagttagcctgcaagaagcccactaactccaaagctgaggaagcaggccaagcagatgccaagcctcatgggtaaactgaacggaggtgcctgtgcccgggggttcatgcagcagagagggttccagggctccaaccaggcttggctggcctggcctccctccaccatgcccagctggctatgccagggattgatgggggagggggtacacacctcgcccctggtttggattttattgcaggagacactctggggctccgcaaatccagcccagcagagccagagggcaacagcagtacg

SEQ ID NO: 128263 - DNA, 601 bp, Human
tgagcccaggcgcctccaactcactgcctagcaaggacagaggcaagcgagggaagctgcagggccccaacgcctccacccccaccccatccctactgcctgccgggaagtcacagctgtctgagaggcctgtggctttgaacccagaatcgcaacaatagaaggaactgcccaagctccatggtagctcccagaggaacccaggagagagcagcctctgctcctgccacggaagctctgagcccagcagagtgccaaaaagggatccaaagacggggctgcgaggctagaaagcagctcrggagggggtgaggagtggaacaacccttcctgagcatctaccaggagcccagccttgcagccccatttgttgccagggattagaatgcagacacccagagccgccccataaggccccacgaggactgcgctgcctgactgcagagatcacccatgttcttcccaggatgccccacaaggagaggaatgatcgctttcagcagctgtccgtcctctgctcgtcaccactctccactcccacaacacacatccccagagcccccagaggaatccaaaaaggcgggcctgctgggttccgctc

SEQ ID NO: 128264 - DNA, 601 bp, Human
actaaaaatacaaaatttagttgagcatggtggtgcatgcctgtaatcccagcctcttgggaggctgaggcaggagaatggcttaaacccaggaggcagaagttgcagtgaacagagattgcgccactgcactccagcctgggcgacagagtaagactctgtctcaaaaaaacaaaacaaaaaaaacagataagattttgctcttggggactttggcaaacaattttaagcagcaccacaaagcccccactgtccacacataaaaccacccctgcccatatcacagatttggctggtctgstgtcgttgggagctaggatggtcacacagttctttggacaccctctgggcatcccacctgcatggcagtgtggtagagtggaaggaatgggccatctaacagtgaggaggatgggttcaaatccgccactcactagcctgggtgaccagtgactagataattctgggctttagtttactcaggcacctcatagcgcacagtgagtaatggatgaaaaagaatgtgagagccatcctggtggctgggataaaataaacgtaagcctcccactctgacacacaggagacactcagtcaatag

SEQ ID NO: 128265 - DNA, 601 bp, Human
ccaaactggactccccgcttccctttttgccagcgtgcctttcttcacaatactgaatgtgtcccaccactacctctatcatcattcacctggtttgagcctctcgcacaaggatatccatacccccaggggacagatggaagccaggggtacaggaagccacctcaggataaacccagaacactctgaggatcaaatgtactcaggggcaagaaatgtaaatcattgtcttaaaacaaacaaggctacattatggagtcaaatgcaaaatgcaagtgaaatcgtaagataaaaagagaggcttcaaggcctgcatggtggcttatgcttgtaatcccagcactttgggaggccgagacagggagattgcttgaggccaggagttcgaaaccatgttggcctggccaacatggtgaaacctcatctctactctactaaaaatacaaaatttagttgagcatggtggtgcatgcctgtaatcccagcctcttgggaggctgaggcaggagaatggcttaaacccaggaggcagaagttgcagtgaacagagattgcgccactgcactccagcctgggcgacagagtaagactctgtctcaaa

SEQ ID NO: 128266 - DNA, 601 bp, Human
agccaaactggactccccgcttccctttttgccagcgtgcctttcttcacaatactgaatgtgtcccaccactacctctatcatcattcacctggtttgagcctctcgcacaaggatatccatacccccaggggacagatggaagccaggggtacaggaagccacctcaggataaacccagaacactctgaggatcaaatgtactcaggggcaagaaatgtaaatcattgtcttaaaacaaacaaggctacattatggagtcaaatgcaaaatgcaagtgaaatcgtaagataaaaagagaggcttcaaggcctgcatggtggcttatgcttgtaatcccagcactttgggaggccgagacagggagattgcttgaggccaggagttcgaaaccatgttggcctggccaacatggtgaaacctcatctctactctactaaaaatacaaaatttagttgagcatggtggtgcatgcctgtaatcccagcctcttgggaggctgaggcaggagaatggcttaaacccaggaggcagaagttgcagtgaacagagattgcgccactgcactccagcctgggcgacagagtaagactctgtctca

SEQ ID NO: 128267 - DNA, 601 bp, Human
tgcttctccccctagactgcaggtcctctgtgggcaagaacatcctcctgctcctgaatccccacagcatggataccctcataggcctcctttttttttgaaatggagtcttgctctgtcaaccaggctggagtgcagtggcatgatctcagctcactgcagcctccacctcccgggttcaaatgatcctcctgcctcagtctcccaagtagctggaactacaggtacacaccacacctggctaatttttgtattttcttagtagagtcgaagtttcacattgttggacaggcttgtctcraactcctgacttcaagtgatccacccacctcggcattccaaagtgctgggattacaagcataagccactgtgcccggccctcacaggcctcttagaggggcttgaatgaatgtgtgcagagcaaggggtggagttataatactcacccactgttgccctctctgcctataaaacaaggtcagaaaccctggggatggcattctgttcttgaccctctcagaatatggccccaaactaaccttcactgcctccttggtccccctcactgcaacccatgtctccagccaaactggactcccc

SEQ ID NO: 128268 - DNA, 601 bp, Human
ctaaccagccagcaccttccccttttttcaggcagcaaggtcatttcccgaagtcagctctcgcttgcctgacttccccagttctcttttctaagtccctttaatagctcccacatttagctggtcactaagtcacatcaattcttccttcgcggggcctctccctgtcatcacttgcctccctttcctttcatcaccacagccaaccacttggactagcattcgaatccatgctcagtgcctacctgaacttgactgcagccccctgccctgggttctcccaatctaacgcttcctgcasacaccatcggcccgaacttcttggcacccagcctttttggggcatgcctcacacttcactcttgcttctccccctagactgcaggtcctctgtgggcaagaacatcctcctgctcctgaatccccacagcatggataccctcataggcctcctttttttttgaaatggagtcttgctctgtcaaccaggctggagtgcagtggcatgatctcagctcactgcagcctccacctcccgggttcaaatgatcctcctgcctcagtctcccaagtagctggaactacaggtacacaccacacc

SEQ ID NO: 128269 - DNA, 601 bp, Human
cagccccagcgccagggccccgtggtccctgcccacctttgccattctggactcctccaccagcagccccaggcagaactagaagaggtatagtcctgtggccctcaggcagcgccccaccttagcacgccttgcattctcgaggcctggcccaggagaggcccacgtaagaacaaggtattttccagccccttcacccaccttcttctgcaggccaatttcactcagctttcattgccccaggcagggagcggccagtgcagcttccttaggagctgacaagccaaaggaaggagcagcragcaccgccctgaaagctccagcaccagcagcaacgggctgccatagcacaggggccttccccgcagccctgggccagctgtccatccctgccatctgataggaaacccagactcccagagaaacaagtccctgtcctagggggtctggggatgcccagcctcatggcctgtctatcctgttgggtccagaactctggacaagggaggttcccaaccccctgatgaccacctgggcagccttggtagctctgagtgtcagagaagctgcggcctccttacagttgcccacgctcagggat

SEQ ID NO: 128270 - DNA, 601 bp, Human; identical to SEQ ID NO: 26134

SEQ ID NO: 128271 - DNA, 601 bp, Human; identical to SEQ ID NO: 26135

SEQ ID NO: 128272 - DNA, 601 bp, Human; identical to SEQ ID NO: 26136

SEQ ID NO: 128273 - DNA, 601 bp, Human; identical to SEQ ID NO: 26137

SEQ ID NO: 128274 - DNA, 601 bp, Human; identical to SEQ ID NO: 26138

SEQ ID NO: 128275 - DNA, 601 bp, Human; identical to SEQ ID NO: 26139

SEQ ID NO: 128276 - DNA, 601 bp, Human; identical to SEQ ID NO: 26140

SEQ ID NO: 128277 - DNA, 601 bp, Human; identical to SEQ ID NO: 36611

SEQ ID NO: 128278 - DNA, 601 bp, Human; identical to SEQ ID NO: 36612

SEQ ID NO: 128279 - DNA, 601 bp, Human; identical to SEQ ID NO: 36613

SEQ ID NO: 128280 - DNA, 601 bp, Human; identical to SEQ ID NO: 36614

SEQ ID NO: 128281 - DNA, 601 bp, Human; identical to SEQ ID NO: 36615

SEQ ID NO: 128282 - DNA, 601 bp, Human; identical to SEQ ID NO: 20564

SEQ ID NO: 128283 - DNA, 601 bp, Human; identical to SEQ ID NO: 20565

SEQ ID NO: 128284 - DNA, 601 bp, Human
tggagctagagcagtgatcagagctaggagccctcaagcagtgtgtgtgtgtggccaaagcacttttataattttggctgtcccatccccaggacccctctgtatatagtagtgtaacagcaaacagtgacaactcactatgtgccaggagctgtgagcaacactgcagaatctcacttaatactcacatcaaccccataaggcagatccaactatcattccatcttacagatgaggaaactgaaccacgcagggatataataattcagcaggaatatgccagaccctgtgcaaagccctktatccgacttacctcatttaaacctcacggcaatcccatgaggcaggttctgagaacgtcctcattttagatgggaagaaactgacgcttataaaggatactgatgataatgacaatagtgaacatttacttcgagcttactttaccgggtagggcgctacgcacttttcctactttatcccatcgaatcctcacaccacccagcaaggcacatccccacttctcagatgagggaactgaggctcaggacggcgaagcaacttgcccaaggtcagcgcgaggcaggtggtagtcctgaga

SEQ ID NO: 128285 - DNA, 601 bp, Human
agggtgaggctctcctgggcaggcagacgctgctcagcctgggcctgcagggctcatgctcagggccacttcctccttgctccgccgtgaggcttcctgctgagctcaaggagagcccgagtcccgggttgggtccttcacggcgctgtgcccaacaccagcaccccactggcctcgccgcctcctctgcttcctcctggagccttctgggtccagcttactcagctaaaagcttgagtctgggagttcctctaggacagagccctcgcctcacccgccctgtgcattcacagtgctgtargccaggcccagcacttagtaggtgccaaccaaacactgcttaatgaatttctgcctaaacgaacgcccgccacactgacagctctgctatccagcgctcccactgcagcacagcaggcgcctaagcaggggtttccaaacttctgcagggcagcagaatccttttcttcatccaagctttacccaaatcccatgtgtaaaacagctctctctgcaatgacacagcagtatcccctccagcttggcctctccaggtccccatactgtccccaggcgtctcggcagagcagttaaaagccac

SEQ ID NO: 128286 - DNA, 601 bp, Human
caaggcaggcagaaagtggcgaggccagatcttggacctgtgtgccacttccaagaacgtggactttctctcgtgtgtgctggggaggcaccaaagggttttaatcagtggcatgagctgctgcattttaaatagctctcttgcagcatctgtgggaaaaatggattttttttggtgggggggggacagcgtctcattctgtcgcccaggctggagtgaagtgggattgcacccttgaccttcccccagggtctgataatcctcccacctcagcctcctgagtagctgggactacaggcaygcgccaccacgcccggctaatttttgtgtttttagtacagacggggtttcaccatgttgcccaggctggtctcaaactcctgacctcaagtgatccgcctgcctcagcctcccaaagtgctgggattacaggcacaagccaccgtgcccggcctgaaagatggatttgaggagaatttctagccggtgtaattgcccagtccagctttccaaagcctgacactaggaagagcacagcttctcactccatttggggcttatgctataacagtgcaggagacaccacacacacacacaatta

SEQ ID NO: 128287 - DNA, 601 bp, Human
tcccagaggcaggccctccaggaaacgagcgcagagagcttcggcaacttgcctaaggacacacagcccaacagctccaaatcggccccttcagaccctgctctttcctaaaacctgctccactaacaacccaataaccaggagccgctccgaaggacactgcccatctgcgcaggagcccagcttccccccggcctgcagctcagccacaaaggtgggcaaccggtgggcggccggatttcccaggaacagctttaagggtagggaagggcctgctgacatgcaccgtgttcgtctctatacagcgtcacttccaaggcatcagtgcaggtgacgggagcctgcacaggccaactccagctgccataactgacacctaccaagaggaattgtcagcgactaagtcctgggtgggcaaggcacttcgcaaccccctagcgaggcaaatgctattctgctctctctgtaaggtgacggcacagtgggccggagggtcggctgactctccaaggagatagaacatggccactgtccggccagactccagccagggtgctcagcgactcccccacagcacccccctcacatcttcaggaccagg

SEQ ID NO: 128288 - DNA, 601 bp, Human
tgcccagtcgatgcagggcctcggcagactcagggccaaccctgagtgcccccaacctctgccccactgagttaggaggcttcatcctccctgggcctgttttcctgtccataaaatggagatagtcacaggtctctctaccgggattaaccaaaataaagcagctgaaatcctagcgacaggaccaacccagagcaaggattcatgaggtcagcgcccagaccagccaacggcatgagggcttgcctcgcctgggcctgcagccccaggctgcccaaagcactgatgccagccctgccccagtgtcctccgcagattctcactggcagctgccaagacatgcaggccacagagccctcgctcacagggctcatcaacggtcaccacacagcaccacacccgggcgaccccgggactgggagctcccagggattccgggcatcacgggccacagcacaaatgtgctcagcatagggtgaacccagtgacaagccctccgccttggctccagccccaggagctgctcgcccagcacacctgtccctctccagcagccctgctctcccccatactcccagccatccatgggggcgctgcaccc

SEQ ID NO: 128289 - DNA, 601 bp, Human
ggcagcttaggggcagccctgagcatcttccctgatgctgcagagccagagctcctgcccagccctgggacaaagcccaacctgcccctgccaccgcccctgccccatccttgctccatcctcaacacgaccgctgggatctcttcccagggcttcattctgcccacagctttgcttccagggcagcgtcgctccttggcttcggggtagctgtgacgatcaagctctcttggcactgggcccaagaactagctctggccttggcagctgctgctgagagcgccgggtcagcacatggcayggtgtgtcagacgccttccagagcgagggcgcgccggagccacaggaacaggcgactgtcccctgccagcagaggaagcccaaggagcggatggctctgcagactctcctttgctgaagatgatcagagatgccaagaaacgcctgcagccatggccccggcgcacagcccccgcggctccctgggcgcctctgcctcatccggggcccaggaaaggggctttatctgagagcagagaatttgtctggggatgaagtcaggggctcagagctctggctaggaggaaccggagcaccgacg

SEQ ID NO: 128290 - DNA, 601 bp, Human
tgtgcggcagcatgtcaaccccgacaggagtcacccccttgccgggacccacctgcccacgtcaggacactgacccggaaaaggtgagggtggccctggagcctgggctctcactcagcctcggcagatgcccccgagccacaacaggccagcaggagaggctactgcggcagcactgactccccctgcccgcccggggcaccaacagggcgggagggccagcccctgggcagcagagcaggtctgaggagtcacctcctgctgttcagagtctgctgcaggcttgaaacatctttgaagktcttgctttattttgggaaatcaggcagtttttgtatttgacatcatgttatcactgtctttgaacattcaaaaaaatatttgctcctcaaacctgttttagagaacctttccaagaagccacaccatcatgacgccctggcaaagtctgtgcccctcccctggggcaggtaggcacctcccttcctgctactcttggctcatctgtgcaggtggcaggaaaagcatggaagccacacaagcatccagggatggctggggagagggcgcccagcaaagccatcaccccaaacatgcagag

SEQ ID NO: 128291 - DNA, 601 bp, Human
tcaaacgaaggcagagtcagcgcagccctgaggggcgcagccggctgcctctctcccacccaaccccgacccggccctgagtgcagcctcacctaatattcggcacacatcatcacagttctggttgatttcgtgaagccaccgcttgacgttgacaaaggactcggcactggtgacgtcgtaaaccacaatgaccccgtgggtcccccgataatacctgcagggccagagtgtgcggcagcatgtcaaccccgacaggagtcacccccttgccgggacccacctgcccacgtcaggacastgacccggaaaaggtgagggtggccctggagcctgggctctcactcagcctcggcagatgcccccgagccacaacaggccagcaggagaggctactgcggcagcactgactccccctgcccgcccggggcaccaacagggcgggagggccagcccctgggcagcagagcaggtctgaggagtcacctcctgctgttcagagtctgctgcaggcttgaaacatctttgaagttcttgctttattttgggaaatcaggcagtttttgtatttgacatcatgttatcactgtctttgaacatt

SEQ ID NO: 128292 - DNA, 601 bp, Human
accattctcctgcctcagcctcccgagtagctgggactacaggcgcccaccaccacgcccggctaatttttttgtatttttagtagagacagggttccaccatgttagccaggatggtctcgatctcctgacctcgtgatccgcccgcctcggcctcccaaagcactgagattacaggcgtgagccggcgcgcccggcccagctggaatcttatgacatgacagatgaaagtgcccctgctgttcacggacataggtgacccggggtctgcctgctccacgccacttcatggcatgtgggkcccagagaggtgaagtcaccgcccaaggtcataccagccttgcccacaggcccaggtggatgggccagcatcaggacaccagcctgacttacaaaggagcctgtgcccgctgctgtgtggcccctgtgccctgaagcagtgggatcctcgacttccacaggcctctgggctccacacagcacaaggcggccaatgaggcagaggactggagtggaaactgtgcttggctttggtgtgggacagaggtttactcagtctcttactagccaggtggtggtccttgagttacttcaacacttg

SEQ ID NO: 128293 - DNA, 601 bp, Human
gatgcacttattcacatttcaaatttgtccctaggattaatagcaatccctccaaatacatggttgataatgagaaaggattaatttaattggacataattctgagccctccaacataattatctatttgtatggactttggttaaaataaactacagaccagaataatcaatcaacacgtatttaattccatcaaagaatgagttcttctaccaaatagaaaattgtaactccctgaagtcaacagtcttgtctttcaagcctttctttttttttttcacctaaagcaagtaatcatatrtacaggagcacgtggctctaggatccagacccagacaagggagtacatttctgatctacttactaagccctttcctctttactcaaaactcctttgacatcctttgaattttacctttataataattaaacatgatcgtaatatgctaaacctatttttaaaaccattttaatctattgttgacctttcccctaagtttctattctgttcgtgtgacttaaataagaccttttgttttaataacaggagggtgtgttcatataaaaatcatggtaatttccactgagatcaactaaaaat

SEQ ID NO: 128294 - DNA, 601 bp, Human
ttagagggaaacaatatttttctccataacaaggatgcacttattcacatttcaaatttgtccctaggattaatagcaatccctccaaatacatggttgataatgagaaaggattaatttaattggacataattctgagccctccaacataattatctatttgtatggactttggttaaaataaactacagaccagaataatcaatcaacacgtatttaattccatcaaagaatgagttcttctaccaaatagaaaattgtaactccctgaagtcaacagtcttgtctttcaagcctttctttttttttttcacctaaagcaagtaatcatatgtacaggagcacgtggctctaggatccagacccagacaagggagtacatttctgatctacttactaagccctttcctctttactcaaaactcctttgacatcctttgaattttacctttataataattaaacatgatcgtaatatgctaaacctatttttaaaaccattttaatctattgttgacctttcccctaagtttctattctgttcgtgtgacttaaataagaccttttgttttaataacaggagggtgtgttcatataaaaa

SEQ ID NO: 128295 - DNA, 601 bp, Human
cacatctgaacgaatgccttgggagaaaaaggaacacggctagcaagccaccaaatcattttcccagtttgatgcccatccttctggtaattccatttggaaatgtactaagcctggattgacagatcatgacccacactgaaccacaggggtggttattttcaaggctgctttgtagatgggtatgggagtgggggaggaggcagattatggcaaaacagaaagggaggccactaaagtttatcacaaggcagataatctgccacaaatgaagctactactctgttccctcacgggaagrgaggtctaaaccctggggtggatagcaggttggccagggatctgatgcctccccacccgaggcctgggaaacctgagggtaggcagatgtcctgaagatccaggaataccccaggacctttgaaccccatgtatggagggtctccatcccacaggacaagtccaccaccaggcggcccactagaaggcggcaggggagcaaagggaggccatgggcagcaaggagacagaggctgaagagaccccccagatttggcgagaggagccagtaaagctaggtgaaggggaaggaggccagcag

SEQ ID NO: 128296 - DNA, 601 bp, Human
acactgcacatctgaacgaatgccttgggagaaaaaggaacacggctagcaagccaccaaatcattttcccagtttgatgcccatccttctggtaattccatttggaaatgtactaagcctggattgacagatcatgacccacactgaaccacaggggtggttattttcaaggctgctttgtagatgggtatgggagtgggggaggaggcagattatggcaaaacagaaagggaggccactaaagtttatcacaaggcagataatctgccacaaatgaagctactactctgttccctcackggaagagaggtctaaaccctggggtggatagcaggttggccagggatctgatgcctccccacccgaggcctgggaaacctgagggtaggcagatgtcctgaagatccaggaataccccaggacctttgaaccccatgtatggagggtctccatcccacaggacaagtccaccaccaggcggcccactagaaggcggcaggggagcaaagggaggccatgggcagcaaggagacagaggctgaagagaccccccagatttggcgagaggagccagtaaagctaggtgaaggggaaggaggc

SEQ ID NO: 128297 - DNA, 601 bp, Human
actcccctcaaagaagcatccttcgtttcagggcagataatcatcccattctgcattgaagctgtgaaggcctcttccctcagtcacacggctctgattccagttatccagtgtgttcaccaaatgcaatacctgccattccccactgttcctgacaataactagaggaaaaaagcccaatgaaagccactgggtgtggcaggaggggcaaaccacagaccagccagaatctggtccaaagcccagaaacatcttttctgaagcccaagttcctgggatgaccaaatctcgaccagtgggycaggtaaatggcatcccctgggtctgccaacactgcacatctgaacgaatgccttgggagaaaaaggaacacggctagcaagccaccaaatcattttcccagtttgatgcccatccttctggtaattccatttggaaatgtactaagcctggattgacagatcatgacccacactgaaccacaggggtggttattttcaaggctgctttgtagatgggtatgggagtgggggaggaggcagattatggcaaaacagaaagggaggccactaaagtttatcacaaggcagataatctgcca

SEQ ID NO: 128298 - DNA, 601 bp, Human
gtcctataaagtaggcactagaaggcaattattatgcaaacaatatgaaaaagaatttaaatgtggttccgaggaatatctcagaaaagacactgaccccgtaagtggaacccactctggggctctgctctttctgccagtagggatcatgatgtctcctttgaccccacagcgtagaagccccataacctcatgttgcagaggccccataccgagcagaggccactccctgagtcaccactgctagatggtttctacaacgcagaactcactgtgcaggacacggcagtgtgggatccacttttaaagaaacaggaaagcagctggttgccctcacagccaagaatccgatctgaacaagtattctgaagaaagcactgcagtaggaatatggaaagctaggaaacaaaattgccatgccctctgtgcccccagaaaagggaggggggcaaggggacaatcagaaaaaaatggaaagacaatgtagccagacatagtcctaccagaagaagggacatcctctcccacctccaaataaacccccaggtttcctcgcgcttgatttttggttgccacggtcagaaatttttggttgccgtgg

SEQ ID NO: 128299 - DNA, 601 bp, Human
tgcaccccatgctcagggagacatcaggattccaaagagagatggcttcaagtccatccaggcagtcagagccaaaacagcccagagactattgttccttccctcagacctgggaccagatgggatggtgaacctgtcagcagatgcctcagaggcccgcatccctcctccagcaccctgggactatgtctgccccttctaatttagaaacccacccaaggaaagagcacaacattttaatgccttggtaaaatgagagagcgaaattaagttgttgtaaaaattatttttctcagggctrggctaagtggctcacgaccataaacctagcactttagggaggcgaggcaggtggatcacttgaggccaggagtttgagaccagcctgggcaacataatgagatcccttctctaccaaaaaataaaaaataaaaattagccgggtgtggtggtacacacctatggttccaggtacctcagaggctgaggtgggaggatcgcttgatcccaggaggtggaggctaatacaagctgtgactgcaccactgcactccagcctgggtgacagagtgtgaccctatctcaaaatatatatatattt

SEQ ID NO: 128300 - DNA, 601 bp, Human
ggagacatcctatcctacagacccaagcacgggatgagtgaggtgggaaacacggcccagagtttcagcttttcagctttgctttttctaaaacccaagggcttcggagtaatttgaacaacatgtttgggatgactgtagccagggcagtcactcccgtcctgccccccaccaaacacacacacatacatatacacatacacatacacatacacataaacatacacatacccacacacagcaaacactaagaaaggggctgagagctctgtttcccaggagtcctagaagtcactgagcrcaaggtgcatgggtctgagtcctaagcaaacctgcaccccatgctcagggagacatcaggattccaaagagagatggcttcaagtccatccaggcagtcagagccaaaacagcccagagactattgttccttccctcagacctgggaccagatgggatggtgaacctgtcagcagatgcctcagaggcccgcatccctcctccagcaccctgggactatgtctgccccttctaatttagaaacccacccaaggaaagagcacaacattttaatgccttggtaaaatgagagagcgaaatt

SEQ ID NO: 128301 - DNA, 601 bp, Human
cagccagaaacagagggacgcaggcagatgggcttcagatctgtctgcctcccactcagtgtacacagggcaggccaggccaggcctatcccgagacaggctggagtccaggtacaggcagacatctgggttccaatcttcactctgccactgactgcctacctgtgtgcccgtgggccacctgccttcccctctccccatcagtcacaccagaagggccgatcccactgggtggttaggaagattcaaatgaaacatagataaagcgcagagtacatggtgagcactaaataagtgcttrcaatgattgatcttacctagccccagggcccctcccttccttcctacttggcctaacagactttggctaatggcactcagtaagcagacaagatgcagagaaggacacttcgaacacgtccataacagatcaactccagccactttgtggggaggatgagcccctgccttctcactgctgcccccaggtgggtgtcgcccaccacccctgtgctgtatggagacatcctatcctacagacccaagcacgggatgagtgaggtgggaaacacggcccagagtttcagcttttcagctttgc

SEQ ID NO: 128302 - DNA, 601 bp, Human
cgtggctggatggtgataaatcaaacaaggctccattgtggtctgggcaggaggcattgcatccagccaaaggctggtgatgtaaatgccaaactactgacccagaaagaatgcagcccagcctccgtcacacacaccggctcctgacactggccacgtcccagcgcagctgccccaaggaccccagggctccagctgtgccaggtgcctggacttgggagggggaagacccactttcagagacagcagagggaaatcagggcaaagagaggggaggcagggtgccctccagcgttggggygggtgaccggtgccagcaccacctggactcagccagaaacagagggacgcaggcagatgggcttcagatctgtctgcctcccactcagtgtacacagggcaggccaggccaggcctatcccgagacaggctggagtccaggtacaggcagacatctgggttccaatcttcactctgccactgactgcctacctgtgtgcccgtgggccacctgccttcccctctccccatcagtcacaccagaagggccgatcccactgggtggttaggaagattcaaatgaaacatagataaagcgcag

SEQ ID NO: 128303 - DNA, 601 bp, Human
ctggcctcaagtgatctgtttgcctcagcctcccaaagtgctgggattacaggcgtgagccaccatgcctggcctctgcaacttttctttaagtttgaaatgttatccaaaaactgctgaaaaagaaaaggggaaaaggagaagggcaaaagggatgagggaagagttctcctaactctaactgccagtctttcccaggggccttcactgggtcccagaaactgcaccctaacgcccccagctcctagaccaggcctcatcccaagggagggcaggaggtgtccctgacactgtggaaaarctgcgggccaggaagactctcccaagtcactttggggaagacgggcccttgctgcaggccctggtgtggacagctcctgccccagcctctctgagagtgttaaagatgcatcctctaaggaaagggggcacctccgcaagatattgtagaaatcagcaaagccaagccaagggcaggatgacagcggccactggccttaagaaggatggaacacagaaaaggaagctgactttcccctacgaacagtctctgatttccacaagaccccctgcaaaggggtctccccaggtggagatggag

SEQ ID NO: 128304 - DNA, 601 bp, Human
cctgcaacctccgcctcccgggttcaagtgattcctgtgtctcagcctcccgagtagctgcaactataggcatgcgccaccaacaccaggctaacttttgtatttttcgtagacatgagtttcaccatgttggccagggctggtctcaaactcctggcctcaagtgatctgtttgcctcagcctcccaaagtgctgggattacaggcgtgagccaccatgcctggcctctgcaacttttctttaagtttgaaatgttatccaaaaactgctgaaaaagaaaaggggaaaaggagaagggcraaagggatgagggaagagttctcctaactctaactgccagtctttcccaggggccttcactgggtcccagaaactgcaccctaacgcccccagctcctagaccaggcctcatcccaagggagggcaggaggtgtccctgacactgtggaaaagctgcgggccaggaagactctcccaagtcactttggggaagacgggcccttgctgcaggccctggtgtggacagctcctgccccagcctctctgagagtgttaaagatgcatcctctaaggaaagggggcacctccgcaagatattgt

SEQ ID NO: 128305 - DNA, 601 bp, Human
aaatggttcagaaaaaaatgtatgtgtctgtgtgcatgtgagtttgtgtggggtggagagagaatagaaggaggcaaaacataacccacctgtgcatctgagagacggtacccaggagttccttgcactcctgcaaattttcttttcttttctttcttttttttttttttgagacagtatctcactctgttacccaggctggagtgcagtggtgtgatctcggctccctgcaacctccgcctcccgggttcaagtgattcctgtgtctcagcctcccgagtagctgcaactataggcatgygccaccaacaccaggctaacttttgtatttttcgtagacatgagtttcaccatgttggccagggctggtctcaaactcctggcctcaagtgatctgtttgcctcagcctcccaaagtgctgggattacaggcgtgagccaccatgcctggcctctgcaacttttctttaagtttgaaatgttatccaaaaactgctgaaaaagaaaaggggaaaaggagaagggcaaaagggatgagggaagagttctcctaactctaactgccagtctttcccaggggccttcactgggtcccagaaac

SEQ ID NO: 128306 - DNA, 601 bp, Human
ctagatcgcagggttgtattaatgttaaatttcctgactttgctattgtaccatggttatgtgagagaagagccttgttcttaggaaatatacactgaagtatagagggcaaataaaatggcatgacgtcttcagctgactctcaaatggttcagaaaaaaatgtatgtgtctgtgtgcatgtgagtttgtgtggggtggagagagaatagaaggaggcaaaacataacccacctgtgcatctgagagacggtacccaggagttccttgcactcctgcaaattttcttttcttttctttcttttttttttttttgagacagtatctcactctgttacccaggctggagtgcagtggtgtgatctcggctccctgcaacctccgcctcccgggttcaagtgattcctgtgtctcagcctcccgagtagctgcaactataggcatgcgccaccaacaccaggctaacttttgtatttttcgtagacatgagtttcaccatgttggccagggctggtctcaaactcctggcctcaagtgatctgtttgcctcagcctcccaaagtgctgggattacaggcgtgagccaccatgcctggcctctg

SEQ ID NO: 128307 - DNA, 601 bp, Human
cagagctgaaggagctgagaaagtctttccaccacctttctggtcgatcactcagcctctgagctggaattatgaatgggttttattttctccttcttttaattttctgtagtttccaaattttccacaacaaacattctaacttttagaaacactttttcttaaaaaggcttatgaggtagaaaatcacacctcttttgaaagaacccccacactgcaaaactccttccccaaaaatacttagctataaaggacattatgtggacgactgcaagtcaaatatggactgtggcctagatcrcagggttgtattaatgttaaatttcctgactttgctattgtaccatggttatgtgagagaagagccttgttcttaggaaatatacactgaagtatagagggcaaataaaatggcatgacgtcttcagctgactctcaaatggttcagaaaaaaatgtatgtgtctgtgtgcatgtgagtttgtgtggggtggagagagaatagaaggaggcaaaacataacccacctgtgcatctgagagacggtacccaggagttccttgcactcctgcaaattttcttttcttttctttctttttttt

SEQ ID NO: 128308 - DNA, 601 bp, Human
ttccagaaaccagactcgcttagcaaagacccgttctgggccaggaaaggggagagccactctcagttccagctgttatggcgaagggaccacctaagcggacaaagcagggaagcgagatccaaacttcactacctgcaccagttttaaaacctttccctaggaacttttgagaagcacagtcattggcaaacagcaaacttcacatggtaaaatttcacattttatttcttccgtagcccactggtaggggccaagaggctcattaaaaggcaagtctaacaaccacatgaagcacccragagctcactgatatggggccagtgctgtttccctcaatcacgctccaggccccatccttaacctctgccaagtccaggaagcaaggggtatagaccagacaagagtgggcctgcaacatttcttttcaagtctcaaacaagttctggatatttattaacgatctccacccttccccacctggaggatatgcaccacaaaggcaccaccaaggctggttaagtctgcctgctcggtgggcacctgcccaaggggtgggcaggagcatgaaagaccgtcagctccagacaggggccggctc

SEQ ID NO: 128309 - DNA, 601 bp, Human
aatttgtaccaaagtgcaaaatggggtatgtatgtgtgccaaagaacaaaatctaccagaactgagctgctagggcaaaattacaacagaaacttaaaataatatattgtcccatccacctgccaaaacattagctcaaagacattcctcctttaaatacagttttactaattataagaatagtcattcaataaatatttcttgagcactattttaggtgccacaaacactgcagtgagaaaaacaaagtccaatttttccagtcttttctttctgtgcaaatacatatatctcattaagmtaacacggaacatgggaaattgcacccagatggtttcacttttaacattaaagtttctcccacaaaatcaaatgttctttgaaaacgccattcttactggctacatagtattctaacatggaaatggtatcatgatttactgaaagacactcccaaatgcttaccacaagataaaaacacaaaggagagacatcattaaatagaacgttagacctagattcagagccttaaggaaaaagaagaaaaaaaaggaaaatacaatcttacaaatctcagagaccccactattttcctccacag

SEQ ID NO: 128310 - DNA, 601 bp, Human
aaaagtccatccaaccttttcaagaagaactatttaatggtatggctgctattgttaatatagtttcaataccgttcgatattaacccataagatttagtcaaaaaataacatttctatgagtatcttttctcactcttcttccccaaaatccttaactctttcagacaggttcttcgtcgcatcacgctgaataaaataaactcaaagaaaatcagagcactgaaattaacaaatgtatggcccatttctaaaaactcacatacagcctgaccaggccacctttgggacaccactgtgtsaggttaacgaaggacagataccccagtatgcaaaagcaaaccacactggggaattcacacaggtctgccctgaaaacctactcactttcttgggcatcatcacagagaataatgtccccttcagtcagaaactcctaaatcaccacaaaaagaaaccttgactcttcaactttctttgccctaactggtctggatggagaattgactcccatcccctagtgccagcagtgaacatgaaattcaggacaatgtggtggagttgcaggtgaggtgtggctcatatgtctaaacctagtgtgt

SEQ ID NO: 128311 - DNA, 601 bp, Human
gatttacaattgttttgtgaattatatacacagacttaaagacatttattttctaagaaaaaaaaagaaaaaacattcaagcatttcttaagcaaaagtccatccaaccttttcaagaagaactatttaatggtatggctgctattgttaatatagtttcaataccgttcgatattaacccataagatttagtcaaaaaataacatttctatgagtatcttttctcactcttcttccccaaaatccttaactctttcagacaggttcttcgtcgcatcacgctgaataaaataaactcaargaaaatcagagcactgaaattaacaaatgtatggcccatttctaaaaactcacatacagcctgaccaggccacctttgggacaccactgtgtcaggttaacgaaggacagataccccagtatgcaaaagcaaaccacactggggaattcacacaggtctgccctgaaaacctactcactttcttgggcatcatcacagagaataatgtccccttcagtcagaaactcctaaatcaccacaaaaagaaaccttgactcttcaactttctttgccctaactggtctggatggagaattgact

SEQ ID NO: 128312 - DNA, 601 bp, Human
agaaacttcccaagaacaaggacagacatttgcacattgtttcaataaatgaggccatttatcttgttctagttctgttatgtcattgtacctttgttaggcagagtcaattcccttgatttacaattgttttgtgaattatatacacagacttaaagacatttattttctaagaaaaaaaaagaaaaaacattcaagcatttcttaagcaaaagtccatccaaccttttcaagaagaactatttaatggtatggctgctattgttaatatagtttcaataccgttcgatattaacccatmagatttagtcaaaaaataacatttctatgagtatcttttctcactcttcttccccaaaatccttaactctttcagacaggttcttcgtcgcatcacgctgaataaaataaactcaaagaaaatcagagcactgaaattaacaaatgtatggcccatttctaaaaactcacatacagcctgaccaggccacctttgggacaccactgtgtcaggttaacgaaggacagataccccagtatgcaaaagcaaaccacactggggaattcacacaggtctgccctgaaaacctactcactttct

SEQ ID NO: 128313 - DNA, 601 bp, Human
tttcaaacgttaacatatataacagcatcagatcaagttcatgaggtttcttctcaaataccaacaatggtggtggtaatatttgtaactttttttttcttttttttttttgagacggagtctcactctgttgcccaggctggagtgcaatggcacgatctcgtctcactgcaacctccacctcctgggcttaagtgattctcctgcctcaatctccctagtagctgggacccagccctctgctaggactacagctactcgggagctgtactgcgccaccatgcccagctaattttttgtrtttttagtagagacggggtttcaccatgttggccaggctggtctcaaactcctgacctcaggtgatctgcctgcctcggcctcccaaagtgctgggattacaggtatgagccaccacacctggccaatatttgtaacttctatatgaatttttaagagtactgtaaagtaagcactctgagttctcacaacaaatttatttttattgagaagcatagtaaataaaagaaacttcccaagaacaaggacagacatttgcacattgtttcaataaatgaggccatttatcttgttctagttc

SEQ ID NO: 128314 - DNA, 601 bp, Human
tccagcagttttggaggtgcttgctactccaagtgaccctgagagctggttagaaatgcagtctctcagaccccctccctgagctcccaaatcagaatgtgcatttcaggagatccccaggggaggatttgtatgcacgtgtggtctagacagtttaaagatacccacagtatgaccttaggatatgaaaggcactattacattatgccaagtacttaacttgcacactcactgagatacgttccttctatccttactgcccactcctactgccacttctgcccaatccatatgaccttasctacctacacgctctttagatagcaatgaaggagtaacagtcataatgaacaggactgttacaaaatgcacccaatgtacacaactacaatggaaatgtttcctgctttgtgtgctacatttccagaaacaatacgctccagttagtcttatccccaggtttaacttttcaactttttattttacacagcttgcatctttaggtgcaggtccctcattaggtctagacctggcagcgatgtggccttcaggccccaccccagaactgtaaaggagcccacacccgtgcccgcatgcacag

SEQ ID NO: 128315 - DNA, 601 bp, Human
tcattttgagcatccacttcctagcaggcactgctcttggtacaggaggcacaaagacacatgcatcccagaccctcagggagatgtggtctaatgggcagatcaggtctccctgcagttgttccaggttccagcagttttggaggtgcttgctactccaagtgaccctgagagctggttagaaatgcagtctctcagaccccctccctgagctcccaaatcagaatgtgcatttcaggagatccccaggggaggatttgtatgcacgtgtggtctagacagtttaaagatacccacagtwtgaccttaggatatgaaaggcactattacattatgccaagtacttaacttgcacactcactgagatacgttccttctatccttactgcccactcctactgccacttctgcccaatccatatgaccttacctacctacacgctctttagatagcaatgaaggagtaacagtcataatgaacaggactgttacaaaatgcacccaatgtacacaactacaatggaaatgtttcctgctttgtgtgctacatttccagaaacaatacgctccagttagtcttatccccaggtttaacttttca

SEQ ID NO: 128316 - DNA, 601 bp, Human
taaacaatcaagacatgtctccttacctgattgattttccctctccagcaaggtgatgagtgctataaagcagagagactattcctgggcccaactgcgaagtttcacccatggaatatgttgttaatcttaacgcctgctgaggcaaatgaataatatgccagtttctagagactgaaggtgattaaaagctaccctctacattcctgcaagaggtaccatacaaacgaaatcagatttccccaaagaagcaatgccatgatgggattttcaacaaggcaatacacacacggctcaaaawttcaaaagctacccaaagtcacagggtaaactgcaagtgccctctatcccctgaaccccacattcccaccaccgccagagcctcccggagaagagccagccttggctcacattttacagaagtgatctcaagttctgagttttaaagaaaaatgtaaatgacatgtttctatgctatttaacagaaataggatatttctaatgaactgtttagccttctaagggagtttatgaattaatgaaccaggcaacagagaaaaataaaaatcacatacaactgagcttaagaacgttccattcc

SEQ ID NO: 128317 - DNA, 601 bp, Human
catgcccagacaatacataaacacatgcggagaacacactttcaatggctggcagagcctcctccttcataggcctttttcacacctggaaacaagtcttaatttcctcacgtggctgcttcactaaacaatcaagacatgtctccttacctgattgattttccctctccagcaaggtgatgagtgctataaagcagagagactattcctgggcccaactgcgaagtttcacccatggaatatgttgttaatcttaacgcctgctgaggcaaatgaataatatgccagtttctagagactaaaggtgattaaaagctaccctctacattcctgcaagaggtaccatacaaacgaaatcagatttccccaaagaagcaatgccatgatgggattttcaacaaggcaatacacacacggctcaaaaattcaaaagctacccaaagtcacagggtaaactgcaagtgccctctatcccctgaaccccacattcccaccaccgccagagcctcccggagaagagccagccttggctcacattttacagaagtgatctcaagttctgagttttaaagaaaaatgtaaatgacatgtttctatgcta

SEQ ID NO: 128318 - DNA, 601 bp, Human
tcatgcccagacaatacataaacacatgcggagaacacactttcaatggctggcagagcctcctccttcataggcctttttcacacctggaaacaagtcttaatttcctcacgtggctgcttcactaaacaatcaagacatgtctccttacctgattgattttccctctccagcaaggtgatgagtgctataaagcagagagactattcctgggcccaactgcgaagtttcacccatggaatatgttgttaatcttaacgcctgctgaggcaaatgaataatatgccagtttctagagacggaaggtgattaaaagctaccctctacattcctgcaagaggtaccatacaaacgaaatcagatttccccaaagaagcaatgccatgatgggattttcaacaaggcaatacacacacggctcaaaaattcaaaagctacccaaagtcacagggtaaactgcaagtgccctctatcccctgaaccccacattcccaccaccgccagagcctcccggagaagagccagccttggctcacattttacagaagtgatctcaagttctgagttttaaagaaaaatgtaaatgacatgtttctatgct

SEQ ID NO: 128319 - DNA, 601 bp, Human
cttcatgcccagacaatacataaacacatgcggagaacacactttcaatggctggcagagcctcctccttcataggcctttttcacacctggaaacaagtcttaatttcctcacgtggctgcttcactaaacaatcaagacatgtctccttacctgattgattttccctctccagcaaggtgatgagtgctataaagcagagagactattcctgggcccaactgcgaagtttcacccatggaatatgttgttaatcttaacgcctgctgaggcaaatgaataatatgccagtttctagagactgaaggtgattaaaagctaccctctacattcctgcaagaggtaccatacaaacgaaatcagatttccccaaagaagcaatgccatgatgggattttcaacaaggcaatacacacacggctcaaaaattcaaaagctacccaaagtcacagggtaaactgcaagtgccctctatcccctgaaccccacattcccaccaccgccagagcctcccggagaagagccagccttggctcacattttacagaagtgatctcaagttctgagttttaaagaaaaatgtaaatgacatgtttctatg

SEQ ID NO: 128320 - DNA, 601 bp, Human
tcttcatgcccagacaatacataaacacatgcggagaacacactttcaatggctggcagagcctcctccttcataggcctttttcacacctggaaacaagtcttaatttcctcacgtggctgcttcactaaacaatcaagacatgtctccttacctgattgattttccctctccagcaaggtgatgagtgctataaagcagagagactattcctgggcccaactgcgaagtttcacccatggaatatgttgttaatcttaacgcctgctgaggcaaatgaataatatgccagtttctagacactgaaggtgattaaaagctaccctctacattcctgcaagaggtaccatacaaacgaaatcagatttccccaaagaagcaatgccatgatgggattttcaacaaggcaatacacacacggctcaaaaattcaaaagctacccaaagtcacagggtaaactgcaagtgccctctatcccctgaaccccacattcccaccaccgccagagcctcccggagaagagccagccttggctcacattttacagaagtgatctcaagttctgagttttaaagaaaaatgtaaatgacatgtttctat

SEQ ID NO: 128321 - DNA, 601 bp, Human
ccctcttcatgcccagacaatacataaacacatgcggagaacacactttcaatggctggcagagcctcctccttcataggcctttttcacacctggaaacaagtcttaatttcctcacgtggctgcttcactaaacaatcaagacatgtctccttacctgattgattttccctctccagcaaggtgatgagtgctataaagcagagagactattcctgggcccaactgcgaagtttcacccatggaatatgttgttaatcttaacgcctgctgaggcaaatgaataatatgccagtttctggagactgaaggtgattaaaagctaccctctacattcctgcaagaggtaccatacaaacgaaatcagatttccccaaagaagcaatgccatgatgggattttcaacaaggcaatacacacacggctcaaaaattcaaaagctacccaaagtcacagggtaaactgcaagtgccctctatcccctgaaccccacattcccaccaccgccagagcctcccggagaagagccagccttggctcacattttacagaagtgatctcaagttctgagttttaaagaaaaatgtaaatgacatgtttc

SEQ ID NO: 128322 - DNA, 601 bp, Human
tctcaggcttcctccctggtgagatagtatggaactgaaacttctcatggcctatcccgacattccaaactccacctgaggcgccccgcacaacaggacaccacggccagggatctgacaccaggaaacggctgcccctgtcatgaatggataagcatccactagcaatttttttttttttttgagatggagtctcactctgttgcccagactggaatgcagtgttgcaatcttggttcactgcaacctccgcctcctgagttcaagcgattctcttgcctcagcctcccgagtagctggkactacaggcacacaccaccatgcctggctaatttttttatatttttattagagacagggttttgccatattggccaggctagtctcaaactcctgacctcaggtgatccacccgcctcagccttccaaagtgccactgcacctggccagcatccactagcttttcatcagaccatgaaatgtttggtccacgactgctcactctttccagagctgcactggaaatacactattctgaacggcccaagttcctccggagtattcctctgatggggcacaaacctggtggaccacaagcatg

SEQ ID NO: 128323 - DNA, 601 bp, Human
caacacagagcttcggccagactctgctgtggaaatgcttcatcctcaattcaagctgggtctctttcctttgatgaagcctgtatatattttgatgtgtatggctcactaatccttttgaaaaataacttctctcaggcttcctccctggtgagatagtatggaactgaaacttctcatggcctatcccgacattccaaactccacctgaggcgccccgcacaacaggacaccacggccagggatctgacaccaggaaacggctgcccctgtcatgaatggataagcatccactagcaatttttttttttttttgagatggagtctcactctgttgcccagactggaatgcagtgttgcaatcttggttcactgcaacctccgcctcctgagttcaagcgattctcttgcctcagcctcccgagtagctgggactacaggcacacaccaccatgcctggctaatttttttatatttttattagagacagggttttgccatattggccaggctagtctcaaactcctgacctcaggtgatccacccgcctcagccttccaaagtgccactgcacctggccagcatccactagcttttcatc

SEQ ID NO: 128324 - DNA, 601 bp, Human
tgagagctccaaacccactaaggatccaccaatgctggaaaagtgatccctcaataccccggctccctgtcacagcctgtcaaaagccacagactttaatgagtcctcttgttctcagacccaaggcctctttccacagccctgcccttctctccgcaggcggggcctggcagcaggcaagaactctcgctctcacacatctttcaatattgcctttttcttcattccgctggggaaaagtatgtccctcaggagggcagaagagaaacagatacaagtggtgccaccatgaagggttttstacaagaaacctttcaggcagcagacagctctctctagatatctcaacacagagcttcggccagactctgctgtggaaatgcttcatcctcaattcaagctgggtctctttcctttgatgaagcctgtatatattttgatgtgtatggctcactaatccttttgaaaaataacttctctcaggcttcctccctggtgagatagtatggaactgaaacttctcatggcctatcccgacattccaaactccacctgaggcgccccgcacaacaggacaccacggccagggatctgacaccag

SEQ ID NO: 128325 - DNA, 601 bp, Human
tatttctccctggagaggacacggcaagctactggttcaaccgggcaccccgggtagctcttgcccggtgccttttcactgggtactctgagagctccaaacccactaaggatccaccaatgctggaaaagtgatccctcaataccccggctccctgtcacagcctgtcaaaagccacagactttaatgagtcctcttgttctcagacccaaggcctctttccacagccctgcccttctctccgcaggcggggcctggcagcaggcaagaactctcgctctcacacatctttcaatattgsctttttcttcattccgctggggaaaagtatgtccctcaggagggcagaagagaaacagatacaagtggtgccaccatgaagggttttctacaagaaacctttcaggcagcagacagctctctctagatatctcaacacagagcttcggccagactctgctgtggaaatgcttcatcctcaattcaagctgggtctctttcctttgatgaagcctgtatatattttgatgtgtatggctcactaatccttttgaaaaataacttctctcaggcttcctccctggtgagatagtatggaact

SEQ ID NO: 128326 - DNA, 601 bp, Human
agtgtagataagaataccctgtcatcggcaggatcacatctgctaaggcaaacctaaaggaccttgggcaaacgttgtgaggcccaagaaaggtgccgagtgtccaccgtctgtccccagctgagtctacccagagcccagccgtggttcaaaagccctggaagggctgcagagaggaatgcaaatctggcacaatctgccctgaactatttctccctggagaggacacggcaagctactggttcaaccgggcaccccgggtagctcttgcccggtgccttttcactgggtactctgagarctccaaacccactaaggatccaccaatgctggaaaagtgatccctcaataccccggctccctgtcacagcctgtcaaaagccacagactttaatgagtcctcttgttctcagacccaaggcctctttccacagccctgcccttctctccgcaggcggggcctggcagcaggcaagaactctcgctctcacacatctttcaatattgcctttttcttcattccgctggggaaaagtatgtccctcaggagggcagaagagaaacagatacaagtggtgccaccatgaagggttttctacaa

SEQ ID NO: 128327 - DNA, 601 bp, Human
ttggacggccaagatcacaagaaataatatcttggtcaaccttagtcgtctctggccgagtgtcctgtctttggaggagctcacaaagcaggctttgtgggctggcatgtcccatgacagcatttgcaaaagatttgtgatcaccccaagcaccgctagcccccgcgtgctgggcaaccaaggagaaccacgttcttctggagcccgagaccctctcctcctccactccctctgcttgggtcagtttgtcaccagctgtggaaagtcctgtttgcttttcatttgttctaaaacatttgcwagttctgagaaggaacacgtgctgacttctagagctggtcactaagtccgtggttctccttgctgtggcctgtggcatttgagactctgagggcatttcttactctcattttcgggatctttcagtcaaccctcttaggaagtccttgccatccccaaacaaaagccaagccttcttaggggctggcaaatgagatttcccctctcctgtagcacaacccttatcagatttctgtccggagagcagatatttaagacatctgaacttgggctgcacaactgaagttttttttttgttttt

SEQ ID NO: 128328 - DNA, 601 bp, Human
ggtacagtgaactcaatggtcggatggggcaggggcttcctctccctgcacctcagtagccaccttctctcccagccactttgttggtgaagacgtctggggcttttctccacacctcaagctggtggccaggctggcatccagctctgactctgaactcccacccaactaggtcagggttagccagagccaggcgccagattcagcaggctcccacagttggagccaaatacacgagtcagctccaagtacctcgctggtgagggggttggtgaggctgtggaggaagctggatgcccastgtaggagaagtgacactaactgaagagtggcagtgtcttctgggcgtgtggctctgggaagtcccaagtaaagggggacaggtggaaaacacacactggagagaacagggaaatctgaaatttgtctccaagagagttgtgtccacgctggggctgcaacttgctttgcaatgacgtgcagaatgcaagccaggcagctctgacgggcctcttggccaccaagttgtcctgctcctcactgaaatgccacatagcctgtacttggacggccaagatcacaagaaataatatcttggtca

SEQ ID NO: 128329 - DNA, 601 bp, Human
attgcttcaacccaggaggtcaaggctgcagtgagctgtgatcacgccactgcacttcagcctgggtatcagtatgagatcctgttttttaaaaaaaaaaaaaaaaaaaaaaaaaggaaagaaaacaaaagaaatttaaagcttcctgcaggtaggaagaaccacacaaactatattcagataagactgaacaattttctaacagcagagaactagctaatgcaactgacatggtgttgaaattgggaatcagttacttgcattgtatcactgtttctcagggtcatacactctccctacrttccaaaggctgacaccaatagtaccaagttcaaatcaaacctatacttggtggagctgcagaaagtgagagaaggaggggacaggacaggatgtctgggccatcccgatggtccacttggtctgttcatttgctgagcggccttgttccgtgagtgccctgtgggcttccaggacaacagatgcaccatctctagtgccatttgaaactaaatgaaagaatgaggaggaaaaaaaaaaggaaactggtatctgctgcccaactgataaatgcgcagctctgtactgagaattggccaac

SEQ ID NO: 128330 - DNA, 601 bp, Human
atcaagaaatttaggccacgtgtggtagctcatgcctataatcctagcactctcggaggctgaaataggaggatcccttgaggccaggagtttgagaatagcttggagaacatagcaaagctctgtctctacaaaaactattctaaaaaattaaccaggtgtggtggagtgcacctgtagtcccagttattcaggaagctgaggcaggaggattgcttcaacccaggaggtcaaggctgcagtgagctgtgatcacgccactgcacttcagcctgggtatcagtatgagatcctgtttttwaaaaaaaaaaaaaaaaaaaaaaaaaggaaagaaaacaaaagaaatttaaagcttcctgcaggtaggaagaaccacacaaactatattcagataagactgaacaattttctaacagcagagaactagctaatgcaactgacatggtgttgaaattgggaatcagttacttgcattgtatcactgtttctcagggtcatacactctccctacattccaaaggctgacaccaatagtaccaagttcaaatcaaacctatacttggtggagctgcagaaagtgagagaaggaggggacaggaca

SEQ ID NO: 128331 - DNA, 601 bp, Human
atttgcagcacaaatcacaagtatctgtcctgggcccaaaccaaacaaatgaacaaaaacacctgttctacctaatgaagcatatgctaagattcacaaaaataaagcagagaagaaaagctaccacctcctaaactcaagctaatcttgttcagaaggcactttttctaggcccctttgtgttaccgttgcaactgttctttagttacaggagcatttaatcaaacaaacacctaagaacaccatgattttcttatttatatataaaggtattattctacccggtgccaatttctcttgmtctgtgctggaagaatgcccaggcagatcttctcaaaacagtaaactcaaacaacaaaaaaagaagaagacatagttttaaaagccgagtgctgtatactgcctctaacttatgataaatccccagtatattttgaatttttaaagagaaacctttacttgttttgcttctgtaaactttcctttgtgctaaaggactcaactttagaatttacaaacttaaataagagtctgaactaaagatgtatttagctcttggatatgctattaagtattacttgccataaaacaaatgtgccat

SEQ ID NO: 128332 - DNA, 601 bp, Human
agggtaaaccttaacatttcgtagcactcactggagcagctaatgcttttttttttttttttttttgagacggagtcttgctctgtcaccaggcttgagtgcagtggtgcgatctcggctcactgcaagctccgcctcctgggttcacgccattcccctgcctcagcctcccaagtagctgggactacaggtgcgcgccaccatgactggctaatttttttgtatttcagtatagacggggtttcaccatgttggccaggatggtctcgatctcctgacctcgtgatccacctgcctcggsctcccaaagtgctgggattaccggcatgagccaccgtgcgtggccagagcagctaatacttctttactttttaaccagtctgtcagcagaggattatttgcagcacaaatcacaagtatctgtcctgggcccaaaccaaacaaatgaacaaaaacacctgttctacctaatgaagcatatgctaagattcacaaaaataaagcagagaagaaaagctaccacctcctaaactcaagctaatcttgttcagaaggcactttttctaggcccctttgtgttaccgttgcaactgttctttag

SEQ ID NO: 128333 - DNA, 601 bp, Human
cacccaatacctgtggaacaaatgaatacatgaatggaggctgtcttctcaaagagcctgttttgaaatttgaaatcttacataaaaatggaaagccaaggtctagggtaaaccttaacatttcgtagcactcactggagcagctaatgcttttttttttttttttttttgagacggagtcttgctctgtcaccaggcttgagtgcagtggtgcgatctcggctcactgcaagctccgcctcctgggttcacgccattcccctgcctcagcctcccaagtagctgggactacaggtgcgcrccaccatgactggctaatttttttgtatttcagtatagacggggtttcaccatgttggccaggatggtctcgatctcctgacctcgtgatccacctgcctcggcctcccaaagtgctgggattaccggcatgagccaccgtgcgtggccagagcagctaatacttctttactttttaaccagtctgtcagcagaggattatttgcagcacaaatcacaagtatctgtcctgggcccaaaccaaacaaatgaacaaaaacacctgttctacctaatgaagcatatgctaagattcacaaaa

SEQ ID NO: 128334 - DNA, 601 bp, Human
actcatctgtgggagttatggcccataagggcaagaacctgggaaagtcagtgccagcacctgtaggagctcacccaatacctgtggaacaaatgaatacatgaatggaggctgtcttctcaaagagcctgttttgaaatttgaaatcttacataaaaatggaaagccaaggtctagggtaaaccttaacatttcgtagcactcactggagcagctaatgcttttttttttttttttttttgagacggagtcttgctctgtcaccaggcttgagtgcagtggtgcgatctcggctcactgmaagctccgcctcctgggttcacgccattcccctgcctcagcctcccaagtagctgggactacaggtgcgcgccaccatgactggctaatttttttgtatttcagtatagacggggtttcaccatgttggccaggatggtctcgatctcctgacctcgtgatccacctgcctcggcctcccaaagtgctgggattaccggcatgagccaccgtgcgtggccagagcagctaatacttctttactttttaaccagtctgtcagcagaggattatttgcagcacaaatcacaagtatctgtcc

SEQ ID NO: 128335 - DNA, 601 bp, Human
tgacattctctttcattcacttaatcattaaaaaacagggttcttgaccaactgcctgtgttatcactctagctgtgggagatgccttgcaacttccagaaaggcctacagagctccccattcagagctgaaagtacattttttattaattttcaccaaatatcactgacgcttaatgttgcctagtgctcacgtgaacaagaacacgaactcatctgtgggagttatggcccataagggcaagaacctgggaaagtcagtgccagcacctgtaggagctcacccaatacctgtggaacamatgaatacatgaatggaggctgtcttctcaaagagcctgttttgaaatttgaaatcttacataaaaatggaaagccaaggtctagggtaaaccttaacatttcgtagcactcactggagcagctaatgcttttttttttttttttttttgagacggagtcttgctctgtcaccaggcttgagtgcagtggtgcgatctcggctcactgcaagctccgcctcctgggttcacgccattcccctgcctcagcctcccaagtagctgggactacaggtgcgcgccaccatgactggctaattt

SEQ ID NO: 128336 - DNA, 601 bp, Human
tagtaggagcttagtttacaaagggatgaagatagatggtaagagtgtgacattctctttcattcacttaatcattaaaaaacagggttcttgaccaactgcctgtgttatcactctagctgtgggagatgccttgcaacttccagaaaggcctacagagctccccattcagagctgaaagtacattttttattaattttcaccaaatatcactgacgcttaatgttgcctagtgctcacgtgaacaagaacacgaactcatctgtgggagttatggcccataagggcaagaacctgggaragtcagtgccagcacctgtaggagctcacccaatacctgtggaacaaatgaatacatgaatggaggctgtcttctcaaagagcctgttttgaaatttgaaatcttacataaaaatggaaagccaaggtctagggtaaaccttaacatttcgtagcactcactggagcagctaatgcttttttttttttttttttttgagacggagtcttgctctgtcaccaggcttgagtgcagtggtgcgatctcggctcactgcaagctccgcctcctgggttcacgccattcccctgcctcagcctc

SEQ ID NO: 128337 - DNA, 601 bp, Human
tggtgatgacatatatctgataaaatatttatattcctaaatgacagtcaaaatatcctcggatcaaaaagcagtcttgccacatgtcctgtgtccaacagaacagatagaactatctggcaagcaggtggggctgtgagaatctgaaacgaggaacttggatgtggagcacacccagaggcacgtgttgccgggagtgagatccctgggagaaaagaaggcagctgttaccagaatcgcggggaacaccacactctggcagctgaaggaggaagtagcacacagatgatggggaggtgcrattctagagtccaaaggcagacggacttctctaaagccagagagtgtctgactctgtgtgtctgccttaaggcccacatcgtcccctttcaaagtgcaccaggagccacaaaagacaatgtgactggatggtaacttagcaaagagctgtcagatcaaatacaggactgcccagttaaatctaaatttcatgtgaatgaccaataattggttaatgtaagtatgccccaaatatatcacaatgatgtcccaaatattgccaacaaataatcttttagtataaaaaagttatactaaaaaa

SEQ ID NO: 128338 - DNA, 601 bp, Human
gcattttttgttttgctcatcccctccaacctgcttgtattaagcagcctcacttcctgccttttaacttacatttctgtccacctatcatccactcttctttgttgacctttgcgtgtacagtgttgcttcaaaaaccttcaaaggaaaggtcaaagtgaaatgtcacaagggaagcaggcctgatggccagtggccaaggaggcaccaatgcccaggtctgaggctgcctgtggcatgcatgacactgccccaaaacgcaggtggtgagggtgcagcggccgcctgtgggtcccaagcrcgactccaagtgcgacacgctgtctaggccatctggtcccacaccaagtcacatctgtgcccagagaagcccagtggaccagtgcgggccccccagccctcagggcagagccaggacgcttcacacaagagtcactcattggattttctactccacgcacacgctgtcaataatggcaggcgccacctaaaggggcaggtgccagtgtaatttaacaggggagaaaaagtacagaggccacccaggaggatgctggaaagacagagggtggggagtgggaagaaacactcaggacccgcg

SEQ ID NO: 128339 - DNA, 601 bp, Human
caaagcccagttatttgttttgcaaactgtgtatacattgaatggaaatgtttgttttccatatcccgctttacgtctctaaagacaaatgattaaagaatcatttcaagggcattttttgttttgctcatcccctccaacctgcttgtattaagcagcctcacttcctgccttttaacttacatttctgtccacctatcatccactcttctttgttgacctttgcgtgtacagtgttgcttcaaaaaccttcaaaggaaaggtcaaagtgaaatgtcacaagggaagcaggcctgatggycagtggccaaggaggcaccaatgcccaggtctgaggctgcctgtggcatgcatgacactgccccaaaacgcaggtggtgagggtgcagcggccgcctgtgggtcccaagcgcgactccaagtgcgacacgctgtctaggccatctggtcccacaccaagtcacatctgtgcccagagaagcccagtggaccagtgcgggccccccagccctcagggcagagccaggacgcttcacacaagagtcactcattggattttctactccacgcacacgctgtcaataatggcaggcgccaccta

SEQ ID NO: 128340 - DNA, 601 bp, Human
tttgatgtatttccatctgccctgattcagatggtggaagacttgagggctgttgcccagaaatattaaaattgacttaaaactattacaaacataaacaaaatgggaaaattataaaaacataacataatgacattttatggccgattttaattttaaaacatttaaacatgtaaaggtcccaggctctatagcatcaaccaccaaagcccttggcggtgcctgaatgcagggtggtgaagagctggccatggctgtggcctttctagatcgcaatgaagtgaccatcagacatctgccggggggtcctcactcatggatagtcccgctcacccagaggcctttccatctcagtttggcttttgggccaaatttggaagcattacacttcattaaggaaatgaaaggcttttgctttacctattccaccagaggggcggcttctccaatttcttccactctgaactcaggcggaaaaggattgcccagtccagagccgctttcctccttccaggaggtctggacactcacaaagcccagttatttgttttgcaaactgtgtatacattgaatggaaatgtttgttttccatatcccgctt

SEQ ID NO: 128341 - DNA, 601 bp, Human
acgacgatgtattactctcataaatggagcaccaccaaaattacctggaatcaggtcttaaaactcacatccaccactcagcctgcgagagccaactgtttcctggagggccccgcgtagctacaactatgggtagtgaactcttaaggtgctagtcatctatttttcctaatacacattagaactcacataccattaaaataaaaacgcatgtgcattccctaaaatcaccttgcacacagcagtgcacaaagcacacaggggagtgacgatctagtccaggagctgacacacaatggckcttcgcccacttttgtattgaccatgaattatgaatgatttttatttgtaaaagattgtgtttttaaagaaggggaaggagaaaaaagagaaagaagaaaaaggagatgatgatcatgagactgagaccttgtgtggccgcaaagcctaaaatatgtgctacctggccctgtagaccacttgcttgataagccctgatcaagtccgtccctttattttaccacagggcaactcaagtcctaatacaccaagtgactcagacgcgcctgaacacaggtctccaggcttctaagcaagcgaa

SEQ ID NO: 128342 - DNA, 601 bp, Human
agttgccgttggtaagaggctctccactctacttgcacaagctatttattacatgtaaccgtcattctgctttgagagtttcacgagggtgaaattagctcctatttgataaactctccctacaactgccgcctcatcttctggtgttctgttacattgcaaatacaagctcctgttttaatacgcagcttaaatatttcatggtgacagggcgcagaataataaaaatggggcaggttgcagcattttttggtttaaataatgccatacacgtggtttttaagcttttaggtcaaaacagggtgtgggggaagggaagccctctcactctgtggatacctatggtccaggatctcaaaaagaatagggtggcttacataggtaagcagaagagtaaaagctcatcaggcagtcaaaatggaacagtctgttagcccagcccagtatttcctaaggccatcagggctcactaccagggcaaaaaagtcatccgggaggataggaaaagacatgcccaactcagtgagtgggagacaaattttgggatgcttcccacactgaatgttcggaatgctcaaagggcttggccgcagccttttct

SEQ ID NO: 128343 - DNA, 601 bp, Human
gataaacgaaatgtggtacatccagacaaaggaatattattcagccataaaaagcaatgacattctgacatatgctgcaacacggatgaaccttgaaaacacgatgctaagtgaaagaagccagacataaagggtcacattccgtgtcatgccacttatatgaaatgtccaggatagagataaaaaggaaataagtggttgtgtacggcttggctacgggtggggaatgactgttaatgggtacgagtttccttttaggggtgacgaaaatattccagaattagggcgatggctgcataaycctgtgaatttgctaaaaatcactgaatttatactttcaataggtgagctttatactatgtaaatcagatttataaaactattttttgtaaaaaaagtcaagaggagccctatccaaagggaccccagtatagttttcccactaaccatgacaggcagatttgaacttgaacttctattcaagttcggttgctaaggcagcactttctcccacatactttaattctgcttcaagtcaaaactctaccaccccactcccctagaaatcaatcatcatggctccagttgccgttggtaagag

SEQ ID NO: 128344 - DNA, 601 bp, Human
aaacgtccatcgactgctgaatggataaacgaaatgtggtacatccagacaaaggaatattattcagccataaaaagcaatgacattctgacatatgctgcaacacggatgaaccttgaaaacacgatgctaagtgaaagaagccagacataaagggtcacattccgtgtcatgccacttatatgaaatgtccaggatagagataaaaaggaaataagtggttgtgtacggcttggctacgggtggggaatgactgttaatgggtacgagtttccttttaggggtgacgaaaatattccaraattagggcgatggctgcataatcctgtgaatttgctaaaaatcactgaatttatactttcaataggtgagctttatactatgtaaatcagatttataaaactattttttgtaaaaaaagtcaagaggagccctatccaaagggaccccagtatagttttcccactaaccatgacaggcagatttgaacttgaacttctattcaagttcggttgctaaggcagcactttctcccacatactttaattctgcttcaagtcaaaactctaccaccccactcccctagaaatcaatcatcatg

SEQ ID NO: 128345 - DNA, 601 bp, Human
ttattcataataggcaaaaagcagaaacaacccaaacgtccatcgactgctgaatggataaacgaaatgtggtacatccagacaaaggaatattattcagccataaaaagcaatgacattctgacatatgctgcaacacggatgaaccttgaaaacacgatgctaagtgaaagaagccagacataaagggtcacattccgtgtcatgccacttatatgaaatgtccaggatagagataaaaaggaaataagtggttgtgtacggcttggctacgggtggggaatgactgttaatgggtacragtttccttttaggggtgacgaaaatattccagaattagggcgatggctgcataatcctgtgaatttgctaaaaatcactgaatttatactttcaataggtgagctttatactatgtaaatcagatttataaaactattttttgtaaaaaaagtcaagaggagccctatccaaagggaccccagtatagttttcccactaaccatgacaggcagatttgaacttgaacttctattcaagttcggttgctaaggcagcactttctcccacatactttaattctgcttcaagtcaaaactct

SEQ ID NO: 128346 - DNA, 601 bp, Human
gcacttttcaaaagaaatacattcttagataatttctttgaataaatgacatgcttccagaaatactttccctccattacattctgttcttcaactgcactggcttgtagctggcattctgaaatttctctgccaaatagctaataaactacacaaagagataaatgcagccagggggagctgctatttaaagaaatcctctagtttaagtgaagaattgtttgatgtgtgaataatcagctcttaattaatggtttgtcaatatttttaaagaattatctaattaatgagctaactgggmagactgtggcatccatcctgaattaggatattgatgtttctgtctgccagtgacttaacccaaaagagtataaaatacagacctttccagtgaggaggtgactatgttactgagaagataagagagctgctcatgaagatgcatgagtacaatacaaacaatacaaatacaatacagcagggtaatctcaagatggccagcagagagagaaaggaggcctggggagtacttcagggcagggccaacagacccagcaggcgttcccagaacagggcctggaggagcacaaagggttcaagg

SEQ ID NO: 128347 - DNA, 601 bp, Human
tcacagaattatttaagaaaataaatagagattacatatataaatatattaagcacttttcaaaagaaatacattcttagataatttctttgaataaatgacatgcttccagaaatactttccctccattacattctgttcttcaactgcactggcttgtagctggcattctgaaatttctctgccaaatagctaataaactacacaaagagataaatgcagccagggggagctgctatttaaagaaatcctctagtttaagtgaagaattgtttgatgtgtgaataatcagctcttaatyaatggtttgtcaatatttttaaagaattatctaattaatgagctaactgggcagactgtggcatccatcctgaattaggatattgatgtttctgtctgccagtgacttaacccaaaagagtataaaatacagacctttccagtgaggaggtgactatgttactgagaagataagagagctgctcatgaagatgcatgagtacaatacaaacaatacaaatacaatacagcagggtaatctcaagatggccagcagagagagaaaggaggcctggggagtacttcagggcagggccaacag

SEQ ID NO: 128348 - DNA, 601 bp, Human
aattgtaatattaaaaattacaaatattgtctgcaaaataggcacaaacatatttacaggaaagcgaaactctgtcatcacgcccctggagaacaccctcgatgtccctgaaccagataggagaataactaagaagaaacaggggaagaacagcagtaaaggatgaaaagacgtaggagacgaagacaagtttcccatcgcaatgaatccaggctctggtttctaagagtgaaactgacagcttgtccaactgttggggatgccttcgccctgcaggcagcatggagaagatgggcagctygaagagacgggactgccagcactaccctgtgctgtccatgggtctcccagcacatgcagggatacccatccccactttatggatgagatgctgatgctcaggaaaggtagctcaactctgaaactaaggcaccactgccaatttattaaaaagtcctcctgtcacaaaaaagacagggttttggtgctcctgggggaaggccatctttagccggtgagaggcagttttcaccatggggagggcagcttctctccaagtgatgctctgccggccaatgagaatttaaaaacaccaagtcct

SEQ ID NO: 128349 - DNA, 601 bp, Human
tgggggtgactctgtccctgaaggacatctgacaatgtctggagacattttaggttgtcgcaattgaaggatggtggtcaactagcaggcagaggctaaggatacagctaaatcctaccatgcacagggcagttccctcaacaaagaatgatccatgatgtgccaaggtagagaaagcctgccttaccgtgtgcaacggtggacggcaaaatgttctacaaatttacttaagtgggttttttgatgtttcactatttaaattgtaatattaaaaattacaaatattgtctgcaaaataggcacaaacatatttacaggaaagcgaaactctgtcatcacgcccctggagaacaccctcgatgtccctgaaccagataggagaataactaagaagaaacaggggaagaacagcagtaaaggatgaaaagacgtaggagacgaagacaagtttcccatcgcaatgaatccaggctctggtttctaagagtgaaactgacagcttgtccaactgttggggatgccttcgccctgcaggcagcatggagaagatgggcagcttgaagagacgggactgccagcactaccctgtgctgtccatggg

SEQ ID NO: 128350 - DNA, 601 bp, Human
aatatttgtggttctataatacttacaaatgctaaaggaaatgtggtcaaggaagaaacagtaagatatttatcctacctccagcccttcaataattaaaattactccagctcattttgcacccaggaaaagaccatttggctcaaaattgcatgattcatccttcctttgagatgcaaaatactctgagaaaaggctacaaactccttctgtgctgtgcactgcaaaaggctagagaaagccattctaaccaactggtgtaaatctaatgatggctccaaaaggggcaacgagagaggcygggaggacagagtcgggggctgcagtgcagtggctctcaactgggggtgactctgtccctgaaggacatctgacaatgtctggagacattttaggttgtcgcaattgaaggatggtggtcaactagcaggcagaggctaaggatacagctaaatcctaccatgcacagggcagttccctcaacaaagaatgatccatgatgtgccaaggtagagaaagcctgccttaccgtgtgcaacggtggacggcaaaatgttctacaaatttacttaagtgggttttttgatgtttcactatttaa

SEQ ID NO: 128351 - DNA, 601 bp, Human
ctggccaactaacatatgcattacctcgcacagttatcattgttgtggtattctcctaatttctaatatctgtcatggttccactgttatttggaacctataccagttcctgtccaatccctgaggcagcaataaaatgtaaacgcaaaagctgttgaaaagaccacacaatctatataatatttgtggttctataatacttacaaatgctaaaggaaatgtggtcaaggaagaaacagtaagatatttatcctacctccagcccttcaataattaaaattactccagctcattttgcacycaggaaaagaccatttggctcaaaattgcatgattcatccttcctttgagatgcaaaatactctgagaaaaggctacaaactccttctgtgctgtgcactgcaaaaggctagagaaagccattctaaccaactggtgtaaatctaatgatggctccaaaaggggcaacgagagaggccgggaggacagagtcgggggctgcagtgcagtggctctcaactgggggtgactctgtccctgaaggacatctgacaatgtctggagacattttaggttgtcgcaattgaaggatggtggtcaa

SEQ ID NO: 128352 - DNA, 601 bp, Human
aaatcccaaatccgaaatgctcctggttccaagcattttggataaggtatcctcaaccggtacactgtgaaatgactgaacctggccaactaacatatgcattacctcgcacagttatcattgttgtggtattctcctaatttctaatatctgtcatggttccactgttatttggaacctataccagttcctgtccaatccctgaggcagcaataaaatgtaaacgcaaaagctgttgaaaagaccacacaatctatataatatttgtggttctataatacttacaaatgctaaaggaaaygtggtcaaggaagaaacagtaagatatttatcctacctccagcccttcaataattaaaattactccagctcattttgcacccaggaaaagaccatttggctcaaaattgcatgattcatccttcctttgagatgcaaaatactctgagaaaaggctacaaactccttctgtgctgtgcactgcaaaaggctagagaaagccattctaaccaactggtgtaaatctaatgatggctccaaaaggggcaacgagagaggccgggaggacagagtcgggggctgcagtgcagtggctctcaac

SEQ ID NO: 128353 - DNA, 601 bp, Human
atgggccccacacatggcaccaccggactgcatcaatggctgaccatcccagcggctgttctgcagacacactgaaagctgcaattcccaaagggttttctggaccacagaaacgggggcatcccctctgtccttgagccttccagtcctgaaagtccaaatcttagatttatccagactcttgttaactgcagtaatacagagtaatggcaaggctcacaaatggatggtactagaaaccaaaactgtcaagtatcacgttcccctgcattcctgacggacccacacttcctgacttccrtagttccatcccagcatagcatattctcagcctgccagtttcccaatgatcacgccctgtccttcacctgatgacagtgaatgttccagctgttactcaacagttcccaggcaaactcatagaatggattcgtctccacgtgagaatgtcaatagttcttcccctactttctttaagattatttcattttatatttcacattgacagacaaaattgtatgtatttactatgtacaacatcatattttaaagtgtatacacaggttgggtgtctctgatccaaaaatccaaaatctgaaat

SEQ ID NO: 128354 - DNA, 601 bp, Human
tgtggaacagcccaggcagctcccgaggggatatgtcgggggtgtcagagtgttgtaaaaagagggggtttctagtctgaaaaggcaaactacaattagtttaatttatcctttgacataaatattgtcttgaaatttccatgagttttttgttaaaagcattgggctaagagactgaaataacttttctgttcaaggagagtgatggaggacagaaatcaaaacctaatgtgcacaataaagacctcagcgtccctggaaccacaagggcaggccccaggcatcaccgaagaatccagarctgccctctgaggctctcgaggtctgaggcccttctgccccttttgtgatgggccccacacatggcaccaccggactgcatcaatggctgaccatcccagcggctgttctgcagacacactgaaagctgcaattcccaaagggttttctggaccacagaaacgggggcatcccctctgtccttgagccttccagtcctgaaagtccaaatcttagatttatccagactcttgttaactgcagtaatacagagtaatggcaaggctcacaaatggatggtactagaaaccaaaactgtcaa

SEQ ID NO: 128355 - DNA, 601 bp, Human
tcatgaccatcgtgataagcaagctatagccaccatgacaactgacctctacatatgtcaataagtaactgctaagaattacattgtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggmggagcttgcagtgagccgagatcccgccactgcactccagcctgggcgacagagcgagactccgtctcaaaaaaaaaaaaaaaaaaaaaaaagaattacattgtgttaccaaactgtaatgccatgatcacaccagtggaactgaacattaattcaatagtatttaaaacacagtccacaaccaaatgtccctaactgtcagttactgctatttcttgatgctctatcatgtaccatgagagcaccgagaaccatgaaggttgataaagtcaggctcacagcccaccagggacacagcat

SEQ ID NO: 128356 - DNA, 601 bp, Human
tgaaaatgtcaaacctacagaagttgaatgaatacttactctttatctacacttcccaatatttaatgttttgccatatttgctttatccctctttagacaaatatatgctttcctcatgaccatcgtgataagcaagctatagccaccatgacaactgacctctacatatgtcaataagtaactgctaagaattacattgtgggccgggcgcggtggctcacgcctgtaatcccagcactttgggaggccgaggcgggcggatcacgaggtcaggagatcgagaccatcccggctaaaayggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaattacattgtgttaccaaactgtaatgccatgatcacaccagtggaactgaacattaattcaatagtatttaaaacacagtccacaaccaa

SEQ ID NO: 128357 - DNA, 601 bp, Human
ttcagggagaagatggggagccagaatagatgccctccgcaccagagattccaccgctttacctctgaaactgactctcatatttcaaagaggaagatagaaaagcgtcacaccggcaatttccacaaatctagggcatagtcgtaggcatgcaaaagctctgaggccccggtcaggcgccatgaaggggaacgagtccgctcctgacactggtattgaccagcaaggccagcaggggcagaaaaccttagctggtgtcttctgaaaacacttggactccaattcgtacaatcgagaattkagtgatggagttctatgggtactattaacagctgccatggcagcacaaagcatacacgtgcccgtaacaccaagagtctcagcatgggcagaaggttatcctaaatctgggatgcaggaccttgttgccttggaatggaatcgtgctggccagtgactgggagtacctggtatgaacgcagcctgaggacacgctacgaagaacctcatagatgcatggcatataaagtcctttgttttctaaatcttaccatttacactctgcacagattcttgcactcacccaggagctgaagaggtt

SEQ ID NO: 128358 - DNA, 601 bp, Human
tacaaggaaggtttcagaatcctgaaaggcaaggaagagccatcagatatgttcagtttcaacctcagaatctctaagtctgtggctggtacagtgaaaacggattcagctcagccctgcagcgggaagcacatgccaccttaacagcaactgaagacagggttgacggcaaaggggcccaccatggggcatcatcgggggaattcagggagaagatggggagccagaatagatgccctccgcaccagagattccaccgctttacctctgaaactgactctcatatttcaaagaggaagayagaaaagcgtcacaccggcaatttccacaaatctagggcatagtcgtaggcatgcaaaagctctgaggccccggtcaggcgccatgaaggggaacgagtccgctcctgacactggtattgaccagcaaggccagcaggggcagaaaaccttagctggtgtcttctgaaaacacttggactccaattcgtacaatcgagaatttagtgatggagttctatgggtactattaacagctgccatggcagcacaaagcatacacgtgcccgtaacaccaagagtctcagcatgggcagaaggtt

SEQ ID NO: 128359 - DNA, 601 bp, Human
acccaaatagaagaatcagataaaaatgaagctactcatatttaaagagagttaggggacagacagcctcactggccagccttgaccgcccccctgccccacttggctcttatgcccacttggaattaactctcaagctgcaaggaacagcctgaaataccactgccctagagcagatggttacagcacctaaaccaagaacgagttacagcagaattcctaagtaaaagggagagaaagaggagtaaggagaagagtgagaagaatgggagcaagatgaaaagttctggggcaggaagaraactggaagcagcccttgaccttgagaagtgcaaagactccaagagtcacagagagaaacatggcaggacgcatcacagccgctgtgctgcaagccagtgcccaggagctgggtggcacacagagcacgagacacagcgcccaatgtccatgccaggaatgatgagggacagctccaggctgatccttccccagagcctaccctggtgaccaggcctcagggacggaaggcctggccagccgtaggatatgaagagttctgtctgaaggaaatgcaggaatttaaggaacacactaaagt

SEQ ID NO: 128360 - DNA, 601 bp, Human
tgtggcaactatgttaccatctggcacctggcctgattctcttcaacaggaaaagatgacatcatggcggtgcccagtaagccataaattcccccaattcagacagggttcaagacttgtgccccaacaccacccaagggcttcccctcacaccttgataatgcactgcccagcccaagaagcggaagactctgacttaggctattcactcaggtgtcaacgcccagccccagtgttaggtaacaccagaagatgttctaaaatagtctgttaagacagcagaaacacatctgactggggyggcgcggggaagaatgcagaatgaactcactctaatttaagtcatgctactaattaagcacctaaacagggaaggaaagaaaagggtgctcaaggctcacataccccaacacacagtggcttctggcctgtgcagaatgtcctcccacttccctgctggccagcagctaattttacccaccgcctttgggaaggtgcacctggtaattctgcacctttgtttctgacatttacaaggtagtagcagcctcataaacaaggtgcttacttatagcctaatcctccccaggaacttgaagct

SEQ ID NO: 128361 - DNA, 601 bp, Human
ttgctaatcctcttgtaagaataagagcgcggagtgtagctggcagattatattgcctgctgtcacgtaacttgtaatagtgaagccaggatttgaacccaggtcatctaattcctgaaaccctattccctgccaggtgccaaactgactcaactttgaccaagctcattctccctgctgcctgataattcttactttatttgttaccctgtctgaaatcctacaaatataaaagagtcatgagttaagtgacaacctcttcttaaatgtgatacccctgtaaaaatgaagcccattattwttcatgccgtggagtgaatcaacgtaatccatccacttcccatccagccagctgctagccaagacccgctggctgtgaggtaacaggaactttatctgggactgaggaaaagtgggtaattttggctgcaggacccaaccggggcttcggcggaaagttgtggaaaggatacagatagcagaggcctggaaagggtatgtggaaggaagtggcagataaagcagatggattacgtgttacattagagaaaaagtgtcaaaacaacattatagcaatccttaaaaaaaattataacataaa

SEQ ID NO: 128362 - DNA, 601 bp, Human
cgagtcacaattgctaatcctcttgtaagaataagagcgcggagtgtagctggcagattatattgcctgctgtcacgtaacttgtaatagtgaagccaggatttgaacccaggtcatctaattcctgaaaccctattccctgccaggtgccaaactgactcaactttgaccaagctcattctccctgctgcctgataattcttactttatttgttaccctgtctgaaatcctacaaatataaaagagtcatgagttaagtgacaacctcttcttaaatgtgatacccctgtaaaaatgaakcccattattattcatgccgtggagtgaatcaacgtaatccatccacttcccatccagccagctgctagccaagacccgctggctgtgaggtaacaggaactttatctgggactgaggaaaagtgggtaattttggctgcaggacccaaccggggcttcggcggaaagttgtggaaaggatacagatagcagaggcctggaaagggtatgtggaaggaagtggcagataaagcagatggattacgtgttacattagagaaaaagtgtcaaaacaacattatagcaatccttaaaaaaaatt

SEQ ID NO: 128363 - DNA, 601 bp, Human
cttacagcaaaagcaacattacatggagaggggtgcggaaggaggcagggatcagaggttccccaggaggagggagaagggtggggaggaggcagggatcagaggttccgcaggaggagggagaggggtggggaggaggcagggatcacaggttccgcaggaggaggaagaggggtggggaggaggcagggatcagaggttctacaggaggagggagggggtggagaggaggcaaggatcagaggttctgcaggaggacagagtgggggagaggcggggacatgcggggaggagaggacaygaggctctaccacaggtgccattccttgggctgagcagccaccaactgcagaacagcttccaggcacagtggggaagttgcccagccaagaacaactgccaacagaggccccagtgcaggcatggcaaagaccacagcatcgggcctcagccaggttaaagcaacatgggagcgccgggatcccacccactcacaccacgaagaggcccaaacaaataaacaaataacccacaggccgaaagtagacaatgctgtctcaggaaggaacccagtgcgatctttacagcgtgaatctgttgc

SEQ ID NO: 128364 - DNA, 601 bp, Human
cccaccactctaagtcttacagcaaaagcaacattacatggagaggggtgcggaaggaggcagggatcagaggttccccaggaggagggagaagggtggggaggaggcagggatcagaggttccgcaggaggagggagaggggtggggaggaggcagggatcacaggttccgcaggaggaggaagaggggtggggaggaggcagggatcagaggttctacaggaggagggagggggtggagaggaggcaaggatcagaggttctgcaggaggacagagtgggggagaggcggggacatgcrgggaggagaggacatgaggctctaccacaggtgccattccttgggctgagcagccaccaactgcagaacagcttccaggcacagtggggaagttgcccagccaagaacaactgccaacagaggccccagtgcaggcatggcaaagaccacagcatcgggcctcagccaggttaaagcaacatgggagcgccgggatcccacccactcacaccacgaagaggcccaaacaaataaacaaataacccacaggccgaaagtagacaatgctgtctcaggaaggaacccagtgcgatctttaca

SEQ ID NO: 128365 - DNA, 601 bp, Human
aggccttggttacaaagacactttacactcttctaaaatccacaagctgcaggcaatgtgactgctcaagtctggcacaagggggcccaagggccagggtgatgactcaaccaggggtttcagtccttcaggcctccctgacttcacaatcagaaagcctgagagccctgcctccccgccacgcgcttctgcctactgactcaacagggctgatggcagaagttcccagggacctctgaggtcccatagacaaagtttacagcccaccactctaagtcttacagcaaaagcaacattacayggagaggggtgcggaaggaggcagggatcagaggttccccaggaggagggagaagggtggggaggaggcagggatcagaggttccgcaggaggagggagaggggtggggaggaggcagggatcacaggttccgcaggaggaggaagaggggtggggaggaggcagggatcagaggttctacaggaggagggagggggtggagaggaggcaaggatcagaggttctgcaggaggacagagtgggggagaggcggggacatgcggggaggagaggacatgaggctctaccacaggtgccatt

SEQ ID NO: 128366 - DNA, 601 bp, Human
gggggaaaaaaggtggccttccatcaagaagtacagaggcacagagccatttgggcacttccatatatcgagctggaggccttggttacaaagacactttacactcttctaaaatccacaagctgcaggcaatgtgactgctcaagtctggcacaagggggcccaagggccagggtgatgactcaaccaggggtttcagtccttcaggcctccctgacttcacaatcagaaagcctgagagccctgcctccccgccacgcgcttctgcctactgactcaacagggctgatggcagaagttmccagggacctctgaggtcccatagacaaagtttacagcccaccactctaagtcttacagcaaaagcaacattacatggagaggggtgcggaaggaggcagggatcagaggttccccaggaggagggagaagggtggggaggaggcagggatcagaggttccgcaggaggagggagaggggtggggaggaggcagggatcacaggttccgcaggaggaggaagaggggtggggaggaggcagggatcagaggttctacaggaggagggagggggtggagaggaggcaaggatcagaggttc

SEQ ID NO: 128367 - DNA, 601 bp, Human
acatcatctctacaaaaaatttaaaattagctgggcactgtggtatgcatctgtggtcccagctactcaggaggctgagccaggaggatggcttgagcccaggaaatcaagactgcagtgaaccgtgatcacacaccgcactccagcactccagacagagggagaccctgtttcaaaaaaaaaaaaaaagactaaatgagctccacgaccataagaaaattgaattggagagagtaaatcaaagaatcctcatactcaaaagtatgaggatgggaagggtggttcaaaattatgcagcttaaaaaaaaaaccaatcgtccacttgtgcagtgagcggcagagaaagaaacaacggcacagtgcaaggccccagtctcactgggcagcggctctgcctacaatgaaatatgacttctgagcttggactcttttaaaggccctggggtctacatctggctgactccaggcagctagtgacacgctaaggatataactaaattccacccaaagtgactgatcccatgcctgttatgtgcaaagcactgtgacaactggggtttaagagaaatgggcaaacccccagtccttattcttggaaagc

SEQ ID NO: 128368 - DNA, 601 bp, Human
aaggcagaggttacagtgagccgagatcacgccattgcactccagcctgggtgacaacagcgaaatctgtctcaaaaaaaaagactacgtgggctcattcgaaaccagcctgggccacatggcaagacatcatctctacaaaaaatttaaaattagctgggcactgtggtatgcatctgtggtcccagctactcaggaggctgagccaggaggatggcttgagcccaggaaatcaagactgcagtgaaccgtgatcacacaccgcactccagcactccagacagagggagaccctgtttcaaaaaaaaaaaaaaagactaaatgagctccacgaccataagaaaattgaattggagagagtaaatcaaagaatcctcatactcaaaagtatgaggatgggaagggtggttcaaaattatgcagcttaaaaaaaaaaccaatcgtccacttgtgcagtgagcggcagagaaagaaacaacggcacagtgcaaggccccagtctcactgggcagcggctctgcctacaatgaaatatgacttctgagcttggactcttttaaaggccctggggtctacatctggctgactccaggcagctagt

SEQ ID NO: 128369 - DNA, 601 bp, Human
taaagactacatgaactcggccaggcgcggtggctcacacctgtaatcccagcactttgggaggccgaggtgggtggatcacctgaggtcaagagttggagaccagcctggccaacatggtgaaacaccatctctactaaaaatacaaaaattagctgggcgtggtggcaggcgcctgtaatcccagctacccgggaggctgaggcaggagaattgcttgaacctggaaggcagaggttacagtgagccgagatcacgccattgcactccagcctgggtgacaacagcgaaatctgtctcaaaaaaaaagactacgtgggctcattcgaaaccagcctgggccacatggcaagacatcatctctacaaaaaatttaaaattagctgggcactgtggtatgcatctgtggtcccagctactcaggaggctgagccaggaggatggcttgagcccaggaaatcaagactgcagtgaaccgtgatcacacaccgcactccagcactccagacagagggagaccctgtttcaaaaaaaaaaaaaaagactaaatgagctccacgaccataagaaaattgaattggagagagtaaatcaaagaatc

SEQ ID NO: 128370 - DNA, 601 bp, Human
tacattttgaaaaacaagtcagatcagatgggactagcggacactaaggatggagacggaaggaggtaggcatggtgttataaaaaaagaggtaaggaagagacagaactgaacacggtcttgagaaggagcaatggaggtcccttaacaggcagaaagagactcagaacagaaaaggaaattaaccgtggtcagtgcctaagaccatcagaggacaggtcataactgacctaacagggactcattaatcccaggtgaactgagtctggtacaatggtagaccacagtctttctcctgtcrtcagaagccactgccaatttgggcgtgaggggcagggagcagataggaggattgatcttaacaagtttagtacatagcaaagggaaaacccctattcataaacattcaattcacgtacaatgtatagaagactgacaaatagagactagcataactgggaaaatcatgagtaacatgctcactaatgttgaatacagtttaacatcattctggatgttaacatgatgtcactaagagaagtggaaaaaatgagaaaaacccttcccgtccaagagtaggaaaaattatgaataacttgta

SEQ ID NO: 128371 - DNA, 601 bp, Human
aggaatttatacaacagttgatgcctccttttatttgagggtttgatggaaatcttgcaagcccaagggtctcggatccctcttgctccctgtcatttattatcaaagaacacttacctgaggggtatcctcagaaaagcacgtttcccacaggaattctaactctgcattctattctagtaaccactacataacaccaggagtaaaatgacccaatgagtcagaatttgagataaagactctcttatgttctattttaaagatttctgatacaagtgacagggtgaatggtgtgacgttytcaccttgaatttaacggatcattccaccactgatacattccagcttaatggcttccctgggggccaggaggagtcaaaagcaagctgttatacgacactcggaaatgcccttctttcaagaaaatcttcatcttgggatctttaagaagccaatgcttttagcttcccctttcagtggccttcagaatggccaggccccagtcgacccctttctccaggcacctggtgggagccatccagagggaaatctttcaccctcgcaggagaaagactgtggtctacgtttgtatcaggctaag

SEQ ID NO: 128372 - DNA, 601 bp, Human
acagggtgtgaaagctcttgtttcggatctggctgggaaatgtggctaggggatgcacagacagtgcctgcctgctcccaacctctcccagatgtcacttctgctcaagaataagcagattctctccataaaacactaaaggccaagtgcaagggagagacaaagctactcaatagcattttctttcctaggcctcacaggataacataacctaagcgcgcccagaaggtgagaaggggtcgccctgcctttctctgtcctgggcttttcaggagggctatttcctttttgcactcctttctcaaaaacgtgctgttgtcctaggcagaaccaaagccacaagaggaaccaaacggattcttggcaaggagcgcaccagagcccagacacactccagttaacatagttctgggcctctgtagaacggaaggcgaatgtgagccggctgctcgcataagaggacaaatgacgtccatggaggtgcgcagatgcaaagcctatgtgcacacatgcacgtatgtcaccacagcacagatcactgctgccagttgagaacccaaagaaccaagcaacttatgctggggggacctctgaaccccct

SEQ ID NO: 128373 - DNA, 601 bp, Human
gcacagatatgctatcgtcatgacttttggctactaaggtacacacaaaaaatcaccaatcgttcatgttgatcatcagttggtatttattgacctaacttggctgcaattaaatcaattgagataacaagtctagaaaagtccgtgcctaacgacttgaacacttccctgcctgcccacacctttgcaccctcagctgccgggcgggcgcagtgcagcagggcctccccacactgcagctcagggcccctcagcaatggtcgcatcactgatcagctccaggtcgtgcagcaactggggrtggtgcctgctctgttttatctgacaggccaaaggaagagaataatctcaagactcataaaattttgagctagaatggggaataaaaatcatctgatcctatccctttgttacatagatggggaaaacagctcagagagccaaatgtcaaacagggtcacaggctctgcaggcgcagtcctcctctggagttccggcagtatcacaggtaggaaggaaatgatatcatggtttagcaagtggggcaaagtggggaggaaatgaggagggagcgctgcttgtggaacagtgatggagtggg

SEQ ID NO: 128374 - DNA, 601 bp, Human
tgggacagaaaaaggacacctggggaaaatgagggaaacctgaatcaaatatggatgtcagttagtgacagcacatcaatattgattgtaaccaacgtacccaccaaagtaagatacgcgttcctaatgggaaatggtgaggggcacatgcaagctctgtactcttcacaattcttctataaatctaacactatcctaaaacagagtttattttaaaaatctaagacaaaacaacagcatgtgcacagatatgctatcgtcatgacttttggctactaaggtacacacaaaaaatcaccartcgttcatgttgatcatcagttggtatttattgacctaacttggctgcaattaaatcaattgagataacaagtctagaaaagtccgtgcctaacgacttgaacacttccctgcctgcccacacctttgcaccctcagctgccgggcgggcgcagtgcagcagggcctccccacactgcagctcagggcccctcagcaatggtcgcatcactgatcagctccaggtcgtgcagcaactggggatggtgcctgctctgttttatctgacaggccaaaggaagagaataatctcaagactcat

SEQ ID NO: 128375 - DNA, 601 bp, Human
gttcagagctgttgaaaaagaacaaagatgtttcctgattgctcctcatttcacccattactctaatcttatcacattatggaaacacagacagtgatcaggtccttcataatcatttcctgctaaaacgctttaattcgtagaattccaccatcaattgtcagaagcacgcagacttctccagtttcaccagcacatacagaattaacccagcaggccaacagatacagatgacttcatttcgaggtctctgagcttccacatttgtagcaggtcctcttaatggagactcttccatggrtggaaattatgcagtagaggaaacacacattaatgacattgttcctacactcagtcatcagataatacaccaggaaaaacaaggtgttagttcaagtatgctgtaatagaaagcaaaccaaaccatatcttaatttcattactaaattaaattattaaattattaaaactcagaggccctgaatggcaataacaatgtttttctagatctttctaggatcccctgagggtaaggagcaagttgttttcacttttaaggtaacacagaggtaggtcgaagcagaaaaatgttgagttatta

SEQ ID NO: 128376 - DNA, 601 bp, Human
gatacactgtagaaaaatacacatttaaattcacaaaaatgttaaccatagttgtatctgtagacagtaaacttctgaacacagagtgtcttatgccttcatgggatccctagtatctagcacaatgcccagcccagagcaggtactcaatgaacatttattaaaagaatgaatgaatgaatgagagaattagtttctccatgttgtcaggcagggtatttctactttcttcttcatgcttttctttattttcccaatttttctctatcagtgatgcatttattctagtaatttaaaaacmtactaaaagaaactaaatacttctaaatgaatcagaaacatcctattaattctgtgcctctcgtgttaacaagaatgacctccctgtggggcatccacccacactttggaggtgggaacaaacagaaaagtggtagagggcacgagctccggacccctgggacctaccgatgatgtaggagaggattaagttccagccggtgatgaaggcccagagctctccaacggtgacatagctgtagaggtaagctgagcccgtcttggggacccgagcaccaaactcgccatagcacaggccagc

SEQ ID NO: 128377 - DNA, 601 bp, Human
tatattgttttataaagagatacactgtagaaaaatacacatttaaattcacaaaaatgttaaccatagttgtatctgtagacagtaaacttctgaacacagagtgtcttatgccttcatgggatccctagtatctagcacaatgcccagcccagagcaggtactcaatgaacatttattaaaagaatgaatgaatgaatgagagaattagtttctccatgttgtcaggcagggtatttctactttcttcttcatgcttttctttattttcccaatttttctctatcagtgatgcatttaytctagtaatttaaaaacatactaaaagaaactaaatacttctaaatgaatcagaaacatcctattaattctgtgcctctcgtgttaacaagaatgacctccctgtggggcatccacccacactttggaggtgggaacaaacagaaaagtggtagagggcacgagctccggacccctgggacctaccgatgatgtaggagaggattaagttccagccggtgatgaaggcccagagctctccaacggtgacatagctgtagaggtaagctgagcccgtcttggggacccgagcaccaaactc

SEQ ID NO: 128378 - DNA, 601 bp, Human
ccactgacagccattctgctccttagacagttttaaggaaaagaatcatggctaagcccaaagacataaagtaattaactgttaataacaacagcaacaacataatggaaacaatctgaacatcccataaagacaccaatacattacgctgtgtatataaatctatacaatggtaggcaagcattagaaatgttactgtggaaaaatagctaatgatatgagaaatgtttactatatattgttttataaagagatacactgtagaaaaatacacatttaaattcacaaaaatgttaaccayagttgtatctgtagacagtaaacttctgaacacagagtgtcttatgccttcatgggatccctagtatctagcacaatgcccagcccagagcaggtactcaatgaacatttattaaaagaatgaatgaatgaatgagagaattagtttctccatgttgtcaggcagggtatttctactttcttcttcatgcttttctttattttcccaatttttctctatcagtgatgcatttattctagtaatttaaaaacatactaaaagaaactaaatacttctaaatgaatcagaaacatcctatta

SEQ ID NO: 128379 - DNA, 601 bp, Human
tttgctttccaaatggtcatccactgagtcaaaagaacttttattcccaggacactcacacaaaaagcctgcagtgcagacaaaatcttattccacaaacagctaggctaaacacctaagattctcttttaatgaaatggcacacaattcaacagctatgaagcaggccggccctatctgaatctataagaagcaatgaagacaggaacaaataaagatgcctgcatgcagtacaaaaacaaaacaaaaagaaatgggggttatggttaaagagataagtaaagaaaggaacttaacaggmgcctctcaccaaacctttgcccatcactctgacccgatctctttttaagtgtgggctttacctgtcaagatgagaattatgatcactgcgaatatgtcggggttttcagccagcacgccgggggcgttcagagtcatgtgtgtccgtgagaactccccgatgggtctgcctatcagctcgtcgaaggtggcgctccaggccctcgctacgcttgaagtacctgccacaaagcacacacaacagaggagatgtgaggacaactgttagccaggtatttgtagtggagctccatgttgataa

SEQ ID NO: 128380 - DNA, 601 bp, Human
gatgcatgtttctgccagctggaccagaaatactgctgagaccagcctgagtgaagttatttcaattatgtggtgtgtaaaataaggcatgtcatttttaaaactcatccaagattttctaaccccaaatgagaatttatctgcatttcagcttcatgtttatggagccccacagagcaaaactcgcgctgcactggccaagacacgcacaaatgtcactagcaagaagttgccatcagctgtgttcaggcagtctctgggatttttcaaattctgtaaccacaactctgtcatgaaactkatttactgaaagggtgttttgatggttgttaggtgtaaaaaccatccaagtcatcttcagacgccccaggcacacattagtgttccagacggagctcattcctccacattttcctggctgatgaatgacagttttgctttccaaatggtcatccactgagtcaaaagaacttttattcccaggacactcacacaaaaagcctgcagtgcagacaaaatcttattccacaaacagctaggctaaacacctaagattctcttttaatgaaatggcacacaattcaacagctatgaagcaggc

SEQ ID NO: 128381 - DNA, 601 bp, Human
aagcaggcagatcttttgaggtcaggagttccagaccagcctggccaatatggcaaaaccttacctctactaaaaatataaaagattaactgggtgtggtggtgcgtgtctgtaatcgcagctactggggaggctgaggtgtgagaatcgcttgaacccaggaggcagaggttgcagtgagccaagatcgcgcaactgcactccagcctgggtgacagaacaagactctgtctcaaatataaaataaaataaaataaaataaaaactgctgtacttttgagattgaattataaagtacagwtgttagaagagaattgtgtaattaatcacagggagaacacctcaacaaacaacaatatattgtttctttagtgtccctccctctcaggtttattaaaatgaaatctcactagtgcagacttactttctgatgcatgtttctgccagctggaccagaaatactgctgagaccagcctgagtgaagttatttcaattatgtggtgtgtaaaataaggcatgtcatttttaaaactcatccaagattttctaaccccaaatgagaatttatctgcatttcagcttcatgtttatggagcccca

SEQ ID NO: 128382 - DNA, 601 bp, Human
gagaccactgctctgccatggacgcctctcatcgttttaaaataaaaattggctaggtgcggtcgctcacgcctgtaatcccaatactttgggaagcaggcagatcttttgaggtcaggagttccagaccagcctggccaatatggcaaaaccttacctctactaaaaatataaaagattaactgggtgtggtggtgcgtgtctgtaatcgcagctactggggaggctgaggtgtgagaatcgcttgaacccaggaggcagaggttgcagtgagccaagatcgcgcaactgcactccagcmtgggtgacagaacaagactctgtctcaaatataaaataaaataaaataaaataaaaactgctgtacttttgagattgaattataaagtacagatgttagaagagaattgtgtaattaatcacagggagaacacctcaacaaacaacaatatattgtttctttagtgtccctccctctcaggtttattaaaatgaaatctcactagtgcagacttactttctgatgcatgtttctgccagctggaccagaaatactgctgagaccagcctgagtgaagttatttcaattatgtggtgtgta

SEQ ID NO: 128383 - DNA, 601 bp, Human
ttttaaccgatcctttcacaaatcctgacaccattatgaagcccaggaccaggacgttaatacaagtgaatattttgttgaccatggccgactctttcacaccaagagttaaaagtcctgaaaaagtgcatagacacaaaactttgtctgagtgttaaccacaaactgggaaggtccttcctggatggggataagaaggcgactgaaaaagaatccaagtgcatcgagcctctgcagacctctgtgagcctctgggaatggggtggattaattatctttctgggggcggggatcaggggtytaaatcaccaaggttgtgggtgcttcccaggccctcctaggtgacctccagatacccttgggaactgagaagcccacccaaggggcacccgagaactgcagagatctggagcatgagcccctctcatagggaggggaaagcctggacccgcacaccaagccgctccctctcactaaaaggatgcgttgctgggaaacaacctctaggaacaattccaggaagaaagactttgcatagtttcctgggagaatggacatttttcagaagaggaaattattctggttgactttgggatgttag

SEQ ID NO: 128384 - DNA, 601 bp, Human
cagtttttaaccgatcctttcacaaatcctgacaccattatgaagcccaggaccaggacgttaatacaagtgaatattttgttgaccatggccgactctttcacaccaagagttaaaagtcctgaaaaagtgcatagacacaaaactttgtctgagtgttaaccacaaactgggaaggtccttcctggatggggataagaaggcgactgaaaaagaatccaagtgcatcgagcctctgcagacctctgtgagcctctgggaatggggtggattaattatctttctgggggcggggatcagsggtttaaatcaccaaggttgtgggtgcttcccaggccctcctaggtgacctccagatacccttgggaactgagaagcccacccaaggggcacccgagaactgcagagatctggagcatgagcccctctcatagggaggggaaagcctggacccgcacaccaagccgctccctctcactaaaaggatgcgttgctgggaaacaacctctaggaacaattccaggaagaaagactttgcatagtttcctgggagaatggacatttttcagaagaggaaattattctggttgactttgggatg

SEQ ID NO: 128385 - DNA, 601 bp, Human
gagggggtctctttatcatagcagtttcaaccttcagtcttaatgaagaatcacacacaaaatccaagtccccattgtccatcctgagacctaaagaattacatggagatctgacaacaaagataaaaaagatatgactgtttggcttttttttcctaggttatctgagctttcaatgagggctgggcgagagacctgagatggcacagggtggagctgtcacctccagttccggatgtctgtgtcagagacatgagggtgatggggccactgtcgccagggcttgagcagcacaagtcaratgtcggcgaaagactattgtgctcacattctgacacttcagtcattctgaaaaccttcaaaaatagtttcacctatttctcttccctctacattattaatctaataggaaggtatttaaaggtgaagtgaggtcaccacggcactgcagagaaaaatcttttctgaacacaaaattccaaagttggccatcaaacagaatctggggaaagagggatcatttaatgagtctgacaagaatcctgaatgatacacaatttggaattagggtgatgattttcttttcctcagtctttcttgt

SEQ ID NO: 128386 - DNA, 601 bp, Human
aaaaaaaagaaagaaagttgcttagatattttaacaacataatagagcatgccaaggaggctccagtcctgcagaactccacctcctaacatggccgatcccctgccgtccctgtggtcagggggctgggccctggcagtgaggccgtcagatgtagctaagggggccccacctatgatcagggattggggcaacaaatgctgctttgtctgggggccggtacagctagctcatcattactagggtaccagcatgaggatgaccagtgaaagtaaataccattggctggcacaatctcttyataaaaataataaaattaaatctcgattggcaaccagttaacaagaggtgccctatatatttcattcctgacctataactagcaaccggtcgaatatgctctgagttttcaaaggctacacgttacttcaacacatatttggaattggcttcactccaccctagattaatggacacccataaatttggcataaatatgactctgaaatgctcgggatgacatattcaaaggcctcagttctccataacagagtttaggaaagcagttttattagaactgctaaccacaaaatattagtgt

SEQ ID NO: 128387 - DNA, 601 bp, Human
gaggcgcaaaccaaaacgtagagatatttactaagggtctctttctatgtaatcaataattaaccttttacatgcgtgtggcagttgtgttcactcatcatctggcaactcacatgtgaaagagaggggctgccaagagccctcacccagcaaatgtcgccccgagacaaagtgagcttgagtcctggtctcagctcagcgctccctgccctgcagcctttgaccagcccttctgtgttccactcagctggtcgctcagaagcagcaaagacaatgcctggcatagaaaggggtcaggccsgagggtctcccactgcatcagtggtgaacttcctgcagcagggctccgccaccctcacaccagccaccctgacatcaactgttagttgtgctcaaaagccacactcccctgttcttctacgtggtaatggaaactttaattatttcagctggacatatgagccttaagaatcaggactgtgtgtttcccagagtcactagctgcaaggagtagccatctggctaagttctgatggaggatgtttgagcagaagtggtgtctgcatctgctgagaaatgtccaggagacgaagtggggagg

SEQ ID NO: 128388 - DNA, 601 bp, Human
ttaaagcgttatgaaccacgtagtattttaccaactcaaaaagttaaattccacctttaagaaaagattgggtgttactgatgccagtggcagagtatcaacacaaaataaccacagaatccattctacagaggcgcaaaccaaaacgtagagatatttactaagggtctctttctatgtaatcaataattaaccttttacatgcgtgtggcagttgtgttcactcatcatctggcaactcacatgtgaaagagaggggctgccaagagccctcacccagcaaatgtcgccccgagacaargtgagcttgagtcctggtctcagctcagcgctccctgccctgcagcctttgaccagcccttctgtgttccactcagctggtcgctcagaagcagcaaagacaatgcctggcatagaaaggggtcaggcccgagggtctcccactgcatcagtggtgaacttcctgcagcagggctccgccaccctcacaccagccaccctgacatcaactgttagttgtgctcaaaagccacactcccctgttcttctacgtggtaatggaaactttaattatttcagctggacatatgagccttaagaa

SEQ ID NO: 128389 - DNA, 601 bp, Human
aggaggacccacagccgacttcaggaggacccgggtgccgggaccctgggcaaccataacaatgaacaagggcctgattaaaaaaaaaaaaaaaaatctgcagggcatgctagtaagcaagaatgcaaggtgcagaacaatatatacggagtgccgcgttttgtgtaagaaaacagaaataaaatatacatatttacatttgcttgtgcttacacagggagaaactggaagcttacacacacacacacaattagaaagtttacctgtgggggtgggagatgaggtggatgaagaaaggaaygcattgtaaatcttttttaaagcgttatgaaccacgtagtattttaccaactcaaaaagttaaattccacctttaagaaaagattgggtgttactgatgccagtggcagagtatcaacacaaaataaccacagaatccattctacagaggcgcaaaccaaaacgtagagatatttactaagggtctctttctatgtaatcaataattaaccttttacatgcgtgtggcagttgtgttcactcatcatctggcaactcacatgtgaaagagaggggctgccaagagccctcacccagcaaa

SEQ ID NO: 128390 - DNA, 601 bp, Human
taaaaaataaataaataaatgaatgctatcatggatagatgagctttaggcaaccatgaggcagaggcacctagaaaggtcctgaaacctccatttcagggcaagtggaaagtgcagggaactgcatacatgattaaatcccagaaagagatgaactcacagaaggggactaagaagggctggaatgtgtcttcctcacgcagacaggtaaagcacacacaacaataaaagcatggagagaaggaagcaagggcgatgggtgagcgcaaagcgaggaggcaaaacaaaaggcatcctcccyggctcctcaggacagttgcagaagagactggataatcctccaggttacagaatgggggtgaaggcacgtgctgtgctgcgccaactccagagctgtgtgcaaccgtgagcatccgtaaacttccctgctgactgtgaccctgccacacctgctcctcgtactgcgccgctacacctgacctcaggaggacccacagccgacttcaggaggacccgggtgccgggaccctgggcaaccataacaatgaacaagggcctgattaaaaaaaaaaaaaaaaatctgcagggcatgctagtaagc

SEQ ID NO: 128391 - DNA, 601 bp, Human
atcatcacagctctcagttacagaaactgccatgaagacgctggaagtacatgcatgagaaagctcatgtagatgtggggtttactgtggtcccataaacagtaacgagaggaaacccccagaaatgtacaagtgatggacgcaggaaaaactgtggccaaacaaaattttagtttgttgtgttagagtatgactaaaactagcaacccaagttcaaaaccaagcagcccaggacagacaagtcagcagggccgcgggacagcaaagggctggagtggagctgtgcccacctcatccaaaycccctcgcctctcaggccagaggccccgccggccacccactcccaccctggcaaacggcttctgttactcagtggcctatgctgaagacaaagcaggtgacaaccaaatggctcaagagggggaggatgaggccaagggaggaggggaactcaagagtcaaaatggcttctgtgggccccactttggtgccctgtggcggccagggtgacagacgggcagtgaaaagcccccagatccccactcagctcctatgacatcaagagctaccaacatggccttgcgttaaaataaatgcatgc

SEQ ID NO: 128392 - DNA, 601 bp, Human
attcctagaggatcatcacagctctcagttacagaaactgccatgaagacgctggaagtacatgcatgagaaagctcatgtagatgtggggtttactgtggtcccataaacagtaacgagaggaaacccccagaaatgtacaagtgatggacgcaggaaaaactgtggccaaacaaaattttagtttgttgtgttagagtatgactaaaactagcaacccaagttcaaaaccaagcagcccaggacagacaagtcagcagggccgcgggacagcaaagggctggagtggagctgtgcccamctcatccaaaccccctcgcctctcaggccagaggccccgccggccacccactcccaccctggcaaacggcttctgttactcagtggcctatgctgaagacaaagcaggtgacaaccaaatggctcaagagggggaggatgaggccaagggaggaggggaactcaagagtcaaaatggcttctgtgggccccactttggtgccctgtggcggccagggtgacagacgggcagtgaaaagcccccagatccccactcagctcctatgacatcaagagctaccaacatggccttgcgttaaaa

SEQ ID NO: 128393 - DNA, 601 bp, Human
ccaactactttctaatggggattaagccttactaattcctagaggatcatcacagctctcagttacagaaactgccatgaagacgctggaagtacatgcatgagaaagctcatgtagatgtggggtttactgtggtcccataaacagtaacgagaggaaacccccagaaatgtacaagtgatggacgcaggaaaaactgtggccaaacaaaattttagtttgttgtgttagagtatgactaaaactagcaacccaagttcaaaaccaagcagcccaggacagacaagtcagcagggccgcrggacagcaaagggctggagtggagctgtgcccacctcatccaaaccccctcgcctctcaggccagaggccccgccggccacccactcccaccctggcaaacggcttctgttactcagtggcctatgctgaagacaaagcaggtgacaaccaaatggctcaagagggggaggatgaggccaagggaggaggggaactcaagagtcaaaatggcttctgtgggccccactttggtgccctgtggcggccagggtgacagacgggcagtgaaaagcccccagatccccactcagctcctatga

SEQ ID NO: 128394 - DNA, 601 bp, Human
ggaggggctcagcacatctttgctacactgatgaacgcaaaagcaaaataagcacagtttacaaactcaggagtccagaagaagcaggctgcttaaacattcagaaaacagtcccataaatctgacacctgtgccgagacacggtgcccaggttcagtgtggcgctatggcccctcccagggccctgtcgggggtccttcaagcccttgttccctgatgtacaaagccctggcctgtccccccacatgctgtgttctgggggtgcaccatgcagtcagtgcaggcggcttccctggccacygtcccctggtcaggaggcacatagcccctgctggtcaccaagtaaccctaagctttctgcatccaaccctctgctgccacccgaaaagcaattgcactccttgtggttcaagaagggcagtccctactcccacacctttgccagccccagggccgcaggctttctgtcctgtgccagggtcccactggctggcctggagcccaagaggacgctcaccacccacctctgttgcccccactcaaccatattgacagccacccagctgcacaggacaacctgccctaaaccttgtcagcatga

SEQ ID NO: 128395 - DNA, 601 bp, Human
cccgacaggacaccagagaacccgaagggcatgaatccaccaacaccgggcttcccttcttttgtgtcactagaaaaaagagccgcaaacaaatgtcacgtcactcgctgcgcagtctggcgtaaggagctgtgctcatctcctgatatgagcggaacctggcagtcagccctccctgttaccgctgccaggccctgggcttcagacgctgagtccagccactgcatgctaactccgtgtgtgcaggcctccctgctgttcgtggcccagggtcacaagggtgcagagtatcgccccttcyagaagcatcttctaaacaatgactagggtagggagacgtggggactatgaggcaggggtccaacaggaaatgggggagaaaccagccacgcggccagtcccacacccttctccccagggcccctcggaggaaggatgcagagccgccagccagtcctaccccgggtcccatatttaccagtaactcaatctcaaaacaaacaattccagagaaactaaggctaaaataaaagtctttgtcagcaaaggcattccttaactgcctgtatgcacaaggtggagtccaggagggcgcagcttt

SEQ ID NO: 128396 - DNA, 601 bp, Human
tcgctgcccccgacaggacaccagagaacccgaagggcatgaatccaccaacaccgggcttcccttcttttgtgtcactagaaaaaagagccgcaaacaaatgtcacgtcactcgctgcgcagtctggcgtaaggagctgtgctcatctcctgatatgagcggaacctggcagtcagccctccctgttaccgctgccaggccctgggcttcagacgctgagtccagccactgcatgctaactccgtgtgtgcaggcctccctgctgttcgtggcccagggtcacaagggtgcagagtatcrccccttccagaagcatcttctaaacaatgactagggtagggagacgtggggactatgaggcaggggtccaacaggaaatgggggagaaaccagccacgcggccagtcccacacccttctccccagggcccctcggaggaaggatgcagagccgccagccagtcctaccccgggtcccatatttaccagtaactcaatctcaaaacaaacaattccagagaaactaaggctaaaataaaagtctttgtcagcaaaggcattccttaactgcctgtatgcacaaggtggagtccaggagggc

SEQ ID NO: 128397 - DNA, 601 bp, Human
ggctcactgaagcctggcctattcagtccgccaggatgacaatgttgtgaatggcctcactcctcccggaagacgctcagatatgaaatcaggccacagccacacagctatgatcccattctaacagcggaaccttagccttattcaagatccagctttcatcaggtgttgacagttggggatgtgataatggtttgggggtgggagggcttggcaggaagctacaaatctacatgttgctcatgtgtgaaagagcggcgactggaccgtgccagcaaggagggaaatggcaagcattggyttgtttgcccggggtgcaggaggacccgggaccgcagtggctggcggacatacctgtggtggcgatgcagtcaaagcccacgaaggcatagaagcaagtcgctgcccccgacaggacaccagagaacccgaagggcatgaatccaccaacaccgggcttcccttcttttgtgtcactagaaaaaagagccgcaaacaaatgtcacgtcactcgctgcgcagtctggcgtaaggagctgtgctcatctcctgatatgagcggaacctggcagtcagccctccctgttaccgctgccaggcc

SEQ ID NO: 128398 - DNA, 601 bp, Human
cgattggtgaaaatgtttctcattaaaaggcacttattcccttcatcaaagtagcttctgcatgacagccaaactgagggccaaaatatggtgttcaaacagcgggcctgttccagtggccagatttagggacagagaaccagtcccttgctaagcagatgatgctgaaaagccagcctcaggttcttctcaataacacaactcttgggatgatgaatactggccaacaagggaaaagccacatgatcaaagctgggttgggtactgggtctatttcaagggtaaagaatgctggcagccratgtgtgtctcgcatggctgtacctggcctgctatagcctaacccctgctggtggttccacccctaggagcagccaccacagaaaggcctctcacctggcggaaagagcgcagagggagcccacggccactgcgtacttggcaccttcccagcccacgtgcttaaaggcgtcgggcagggggctgttattgtccaggcagaagtagggcatcatgagcgtgagggcagccgacaccccaaagtaggcgatgaagcagatcaagagggacgccacgatccccacggggatggccttctgtg

SEQ ID NO: 128399 - DNA, 601 bp, Human
tgaagatttccctgtggtaaatcaatatttaccaaatagctctgtttatacaggctaagaggaaatacgattggtgaaaatgtttctcattaaaaggcacttattcccttcatcaaagtagcttctgcatgacagccaaactgagggccaaaatatggtgttcaaacagcgggcctgttccagtggccagatttagggacagagaaccagtcccttgctaagcagatgatgctgaaaagccagcctcaggttcttctcaataacacaactcttgggatgatgaatactggccaacaagggraaagccacatgatcaaagctgggttgggtactgggtctatttcaagggtaaagaatgctggcagccaatgtgtgtctcgcatggctgtacctggcctgctatagcctaacccctgctggtggttccacccctaggagcagccaccacagaaaggcctctcacctggcggaaagagcgcagagggagcccacggccactgcgtacttggcaccttcccagcccacgtgcttaaaggcgtcgggcagggggctgttattgtccaggcagaagtagggcatcatgagcgtgagggcagccgac

SEQ ID NO: 128400 - DNA, 601 bp, Human
aagagcacacactgtgaataaggattaaggtaaagaatagggaacatctatctaacatacactagcatgagacccagtacagtctttacagatggaaaactgtatttattcctgcaattatttctagctgaatcaaacagaaaatacaagcatcactgcattcatgaagatttccctgtggtaaatcaatatttaccaaatagctctgtttatacaggctaagaggaaatacgattggtgaaaatgtttctcattaaaaggcacttattcccttcatcaaagtagcttctgcatgacagcyaaactgagggccaaaatatggtgttcaaacagcgggcctgttccagtggccagatttagggacagagaaccagtcccttgctaagcagatgatgctgaaaagccagcctcaggttcttctcaataacacaactcttgggatgatgaatactggccaacaagggaaaagccacatgatcaaagctgggttgggtactgggtctatttcaagggtaaagaatgctggcagccaatgtgtgtctcgcatggctgtacctggcctgctatagcctaacccctgctggtggttccacccctagga

SEQ ID NO: 128401 - DNA, 601 bp, Human
aaacaaaaagtatctaacagggaggagaggactcacagcctaccagggattcagcattatcttcgagaaagctgctgactggatgtgcgtcattctgttatgaaatctgaaacaagggagacccccaggggaagccaggatcttggacgtgctggcagcagcatcacatacctatcagcatccacacagcaaaccggacccaggtgccctggtccagctgcatcatgagatagacgttcacgaagatgctcaggatggggagcactggcaggaagggaacctgaagagacaggaggtggcytcaatccatggcagtggcgccggttccaatagttcagtaaaactgtctagtaaaggcagcacaactgagagtgacagggaccgtcgggcgagtgtggggaagagagagggagtgcccacccccactcccacaccccacacacagcccgcacccaaacacacacacaaacacacccaagggtacatcttagtaggtggggatttgattctaagctctgaatggccaaatgaactccattctcatttttctctgttgcgattctcctgctaaagaaaggactagaagacggacctccacttt

SEQ ID NO: 128402 - DNA, 601 bp, Human
agggcggtcccacagcaaaccctctcaggcggcctgcccctgcctggcatgagcccgcagccagcggcccctgtgacctttccacatctggagcagctgccacacgaaggccactgtctgcttcgacatctggcaaagccctacgttcctctggacggccttatgctgcggtgtttcctgagcagacagagcagctgggccagggccaccagaggccatcgggtccttcagcttagccccctgatgcccccggaggccacgagagtatcgagaatgtgcactatggagatggggtttcccrcaggtgctggaggtctccaggctctcagcctggacagtcccactgcccatttctccacataactgagcgtcagactgcaggagacactgagccccaggaatggacttcacataggagtccacagcctgttcctgcacacgggactccagggtgggtccaggacctatgcttcttaccacctgcccaggggctggggccaccttgtgtggctgacacaggaaaacaggccttaaagcaaggactcagccacccacagcccaggaaaggagctcaggctcctgcacacagggactttgacag

SEQ ID NO: 128403 - DNA, 601 bp, Human
atgaagtagtatctggaacatatgaggagttcaacaaatatctgattgaaatatatacctagttcggaatggcaacaataacttactcatgtatttttccttttcaaatatcttccttcctccattatgtgaggaatattatgacaaatatttccccaaattatttcccattcacaattttctctctaagttaaaccttaccaagagacacaaatgagttacctgcccctagatggggtgggaaagaaagctagtcagcaaacagtcctctgatctcgatatttctactgctccttatttyggactttcttctccttcccacactattaacacatctactactttccccaaacctgtgtttagagaaacacaggtttgtgcactgatttccccaaacctcttctagaagatggtctcaccagtagttagggttattgtacttgtctttctttccccagtgtcccaaagtaagttccaaggaacaacatatcctaggggagttaactgagttagcaaacaatgaaaaaggatcacataaattcaggaagaacttcattaaacaaaattgagcaggtgtctttcttggaggacttttcagaat

SEQ ID NO: 128404 - DNA, 601 bp, Human
aggttgttactatcaccctcaccccactagaatgtgtgttctatgaaagcatgtttggttcactgctgtatacccagcaatgaagtagtatctggaacatatgaggagttcaacaaatatctgattgaaatatatacctagttcggaatggcaacaataacttactcatgtatttttccttttcaaatatcttccttcctccattatgtgaggaatattatgacaaatatttccccaaattatttcccattcacaattttctctctaagttaaaccttaccaagagacacaaatgagttayctgcccctagatggggtgggaaagaaagctagtcagcaaacagtcctctgatctcgatatttctactgctccttatttcggactttcttctccttcccacactattaacacatctactactttccccaaacctgtgtttagagaaacacaggtttgtgcactgatttccccaaacctcttctagaagatggtctcaccagtagttagggttattgtacttgtctttctttccccagtgtcccaaagtaagttccaaggaacaacatatcctaggggagttaactgagttagcaaacaatg

SEQ ID NO: 128405 - DNA, 601 bp, Human
atatttaaacaaatgacacactgttaaaatgctaggtaggaagacaacatagatatatagaaaatgcacatgaaatattgatgagagaacagaaaatcatgacaattacacaataagtacttttatatacttacatatgaagtcactgagatttacaactagttattttaagataaagtcttattggtaatttcacataacataacattttaataagattttgttcttgtatcaattcttaaaatgatttgaaatgttacaaaatattaatataaaaagcaaatgagagtagttttaaacrgttaggcatagaagcacaataaaagctaacctatcctgaatccctgggaggtgttacagggcacattaaatttccaaatggcttaaattactgacactttactttaaaattaaatcttagaagatacatacacacgaatttgcctgacttcttaagcagaaaagagaattaaaattatattgtacacgacagatttggggatcccatgatgaacacatgaatatttaccctggagattcactgaaatgtacatggcaatattttcctgtattgctgttatttctatgtctgttcagtata

SEQ ID NO: 128406 - DNA, 601 bp, Human
gaatttttatgtctttgtttttcactcttagaacagaaaaaaaaaatgcaaaggaaagatgaagtgataaaacactgatcaaaaccaataaatctaaagacagcaaattctctgtcttgtcctcctcagtgctctgttgtttatttgtacctagcacaggtatactatgtatggcaaccttgccttaaggaacagtcatgaatgaccacactctaatccaacaatcaaaatcttaagagtttattttaaacagttctgcatatataacaaacactaaacaaactctgcaagggattaattwaaaaaaaaaatctgtgcagcaaaacttaaatgtaacatgtccccaaactcaaaaatatttaaacaaatgacacactgttaaaatgctaggtaggaagacaacatagatatatagaaaatgcacatgaaatattgatgagagaacagaaaatcatgacaattacacaataagtacttttatatacttacatatgaagtcactgagatttacaactagttattttaagataaagtcttattggtaatttcacataacataacattttaataagattttgttcttgtatcaattcttaaaatg

SEQ ID NO: 128407 - DNA, 601 bp, Human
tttccctcatttctgcaacatagtggtcatttgtaaggatacatcaagagttgtaaactaaatgtgtatttgtatttcagcttaccctctgattatttttaaactgtttgaattgagttaaaatgtctttataaatcaagaatgttttcataaatcaatgctgacagagattctgagggtttgaaaagaaggagaaagaaggagaatccggtaggaaattaacgtaaatgggtcaaaaaaaggaatggaaatactgtggtaattttttaaaataaaaaattcagggccaggcccagtagcytacacctgtataatccctggactttggaaggttgaggcgggcggatcacgagatcaggagttcaagaccagcctggccaacatggtgaaaccccgtctctactaaaaatacaaaaattagccaggcatgctggcatgtgcctgtaatcccagctacctgggaggctgaggcaggagaatcacttgaactcgagaggcggagatggccgtgagccgacatggcaccaccgcactccagcctgggcatctttaaaaacaaaacaaaaaacaaaacaaaaaaacaaacaattcaggataaaaa

SEQ ID NO: 128408 - DNA, 601 bp, Human
gtttaaaaattaggcagggtggtgcatgcatgtagtcccagctacttgggaggccaaggcaggaggatcacttgagctcacaaggtgatagctgcagtgagctaggctcatgccactgcctgagcaacagaacgagaccctgtctcaaaacagaacaaaaacaaaaaaaaattcacaatagctcaccacaaaataaaattcttaagtatgaacttaacaaaacacatataaaatatatactgaaagaaatgctgataaaaagatcaaagaactaaaaaacaataaatatatcaagttcatygactgaaagtataaaaacaataaagatttccccaaaattatctgcagatttaatccactgccaatcaaaattctagcaggattttctgcacataaacagattctaacatttgttaggaaaggcaatgtaactaggatagacaaaacaattctaataaagaagaataacttgggagaaatccctatctccaattttaagaattttaaattataataatcaaaacaatgtagtgttaaagacagaaacacagatcaatggaatagagtccagacacagacccacagaactatagatgattaa

SEQ ID NO: 128409 - DNA, 601 bp, Human
agaaataggctaaacaggccaggcgcggtggctcacacctgtaattccagcactttgggaggctgaggtgggtggatcacgaggtcaggagatcgagaccatcctggctaacacggtgaaaccccatctctactaaaaatacaaaaaattagctgggcgtggtggcgggcgcctatagtcccagctactcgggaggctgatgcaggagaatggcgtgaacccgggagccgcagcttgcagtgagccgagatggtgccactgcattccagcctaggcagcagagccagactccgtctcaagaaaaaaaaaaaaaaaaaaaggctaaagaagaaaaaaatcacatgatcatttcaattgatacagaaaaatcatttgacaaaattcagcatccattcatgattttaaaaactcagtaacctagcaatagaggagaatgataaacagtagctacacaaaaccaagagctggttgggtgaggaaaccctctcatcatttctactcaactttgtactgaacatcccagacagtgtaaataagtaaataaaggtatataggttagagagaaatacaacagttcttattcacagattacatgattatt

SEQ ID NO: 128410 - DNA, 601 bp, Human
tggtcagaagtgcttgtggtctggaaactctcaagcattagctggtatctgaagtgaaaacagttttgccaaggactatgcctttaacctgtgaaatacgactcaactccagaaccaaattatgatgtagttagcatcagaactgcactgaacaaaggcagtatagaaaaatgcagacaaatatcactcatgaatatagacgcaaaaatcatcaaatactaactagaatccagcaaggtataaaaagaattaaataccatgacccactggggtttattctaaagacacagaactaatattwaaaaaaaaaaaaaaaaaaaggttgggagcggtggcttacacctgtaatcccagcactttgggaggctgaagcaggtggatcacctgaggtcgggagttcgagaccagcccaacatggtgaaactattaaaaatataaaaattagccaggcacggtggcacttgcctgtagtcccagctactcgggaggctgaggcacaagaattgcttgaaccagggaaacagagcttgcagtgaactgcgattgtgccactgtactccagcctgggtgacagagcaagactctgtctcaaaaaaaaaaa

SEQ ID NO: 128411 - DNA, 601 bp, Human
taaagcattctgacgacacaaaagctttgcgtctgaggcccttccaaactcatcctatagttctcttcttttgaatcatcctaatttgtgtcctttataacaaaaccacaatcctgaaatagcactttcctgagttctgtgagttgctctacgtaaccggaggagataacaggaacccctgaatttgtagccagttggtcagaagtgcttgtggtctggaaactctcaagcattagctggtatctgaagtgaaaacagttttgccaaggactatgcctttaacctgtgaaatacgactcarctccagaaccaaattatgatgtagttagcatcagaactgcactgaacaaaggcagtatagaaaaatgcagacaaatatcactcatgaatatagacgcaaaaatcatcaaatactaactagaatccagcaaggtataaaaagaattaaataccatgacccactggggtttattctaaagacacagaactaatatttaaaaaaaaaaaaaaaaaaaggttgggagcggtggcttacacctgtaatcccagcactttgggaggctgaagcaggtggatcacctgaggtcgggagttcgagacc

SEQ ID NO: 128412 - DNA, 601 bp, Human
tgggctttgaaccacatgatctcagccccacctccaaggaggggagggggctgcagttcagattcaatcatgtgaccaatgactcactcaataattcctgtgtaataacaccccaacaaaaaccctggacacccaaagcttgggtaagctttcctggttagtgatacacatcaatgagctgagagggtaaagcattctgacgacacaaaagctttgcgtctgaggcccttccaaactcatcctatagttctcttcttttgaatcatcctaatttgtgtcctttataacaaaaccacaatcytgaaatagcactttcctgagttctgtgagttgctctacgtaaccggaggagataacaggaacccctgaatttgtagccagttggtcagaagtgcttgtggtctggaaactctcaagcattagctggtatctgaagtgaaaacagttttgccaaggactatgcctttaacctgtgaaatacgactcaactccagaaccaaattatgatgtagttagcatcagaactgcactgaacaaaggcagtatagaaaaatgcagacaaatatcactcatgaatatagacgcaaaaatcatcaaatac

SEQ ID NO: 128413 - DNA, 601 bp, Human
aggagcatctttattattcatgatgaaccccttggacagtttcaggatagggattagtgaaagaccaactatgtgagtaaagtttgggctttgaaccacatgatctcagccccacctccaaggaggggagggggctgcagttcagattcaatcatgtgaccaatgactcactcaataattcctgtgtaataacaccccaacaaaaaccctggacacccaaagcttgggtaagctttcctggttagtgatacacatcaatgagctgagagggtaaagcattctgacgacacaaaagctttgygtctgaggcccttccaaactcatcctatagttctcttcttttgaatcatcctaatttgtgtcctttataacaaaaccacaatcctgaaatagcactttcctgagttctgtgagttgctctacgtaaccggaggagataacaggaacccctgaatttgtagccagttggtcagaagtgcttgtggtctggaaactctcaagcattagctggtatctgaagtgaaaacagttttgccaaggactatgcctttaacctgtgaaatacgactcaactccagaaccaaattatgatgtagttagc

SEQ ID NO: 128414 - DNA, 601 bp, Human
ctgttgtataattaagaatctggttggtctttgtccctggttcagggagggagcctctaaacccttgacacttcctgacaggagcatctttattattcatgatgaaccccttggacagtttcaggatagggattagtgaaagaccaactatgtgagtaaagtttgggctttgaaccacatgatctcagccccacctccaaggaggggagggggctgcagttcagattcaatcatgtgaccaatgactcactcaataattcctgtgtaataacaccccaacaaaaaccctggacacccaaascttgggtaagctttcctggttagtgatacacatcaatgagctgagagggtaaagcattctgacgacacaaaagctttgcgtctgaggcccttccaaactcatcctatagttctcttcttttgaatcatcctaatttgtgtcctttataacaaaaccacaatcctgaaatagcactttcctgagttctgtgagttgctctacgtaaccggaggagataacaggaacccctgaatttgtagccagttggtcagaagtgcttgtggtctggaaactctcaagcattagctggtatctgaagtg

SEQ ID NO: 128415 - DNA, 601 bp, Human
aagtaaacagatggaaaaagatatcaaaagaaagcaggcgtggctgtattaatatcagataaagtagaactgaaaacaaaaaatgaccagaacaaaagacattacacaatgatagaagggtcaaatacatcaagaatacatagtaatcctaaatgtgtatataacaaagagcttcaaaataacatgaaattgaaatggatagaactaaaaggagaaacagacaaatctgctattttagctgaagaagtaaacatccctcttacaacaatacaactactagacaaaaaaaatcactaaggayacagaactgaacaccaccatcaatcggcagggtataaatttatagaatactccactcagtaacagacacacattattttaaaatgtccatggaacattcaccaagacagtccatattttgggccataaaacaaatctcaacaaagttagaagaactgagatcatacagagtgtgttctttttttccgagtaaagtgaaagcaagtttattaagaaagtaaggaataaaagaatggttactccacaggcagagcagcccagagtgtgttctctaccaaaatgaaataaaaataggaatcat

SEQ ID NO: 128416 - DNA, 601 bp, Human
aaactagtgtgatttttgcgggatgctgacaggcctagttttgtcatattaccagggttggttttctggttccttctcatttgggtagcctcggtcagaagaaaggtctagggctgaaggctgttgttcagatttttctgtcccacagggtgttcccttgatgcagtactctcccccttttcccatggatgtggcttcctgtgagccgaactgcagtgattgttgtctctcttctgggtctagccacccagcgagtctacccagctccaggcttggtactgaggcttgtctgaacaaagtyctgtgatcagccatggataccagtgccagttctggtagaggtggcggagggtgcaatggactccgtgaaattcttagctttgatggtttaacgctctatttttgtgctggttggcctcctgccaggagtggtgctttccagaaagcatcagctgtagtagtgtggagagggacctgcagtagacagggccctagaactcccaagattatacacctcaccctttgttttacactatcagggtgggtagggaaggaccatcaggtggaggcagggctaggtgggtctgagctcagactcttc

SEQ ID NO: 128417 - DNA, 601 bp, Human
tggcacaacatttccaagaggtgaaagaaaagatctgtcacccagagttatatagataatctgtgaaaaatcctaaaggaataaaggtaaaatcaagatcttctcagatgaaggataacaaaaaaaacaaacaaacctgtcaccacaagatctgtcctaaaagaataactaaagttcttcaaacacaaaggaaatcagaagttttgaaacaccgtgaagaatgggaagtgtaaaaatatggaaacatataacactattctcctcgagttttaaaaattgttacacatttaacacaaaaaayaaaacactgtcttatgtggttgctaatgtatgcagaaaaagtatttaagacaatactacagagagggaagataaaaggacctaaatggagctaaggtttttctacaggttactcaaactggtaaaatgctgacatcagtatactgtgaaaagctatgtatgaataatgtaatgcctagtacaaccaccaaaaatcaaatataaagagatacactcaaaactccagcagaacaatcaaaatggaattctaaaaatttttcaagaggtccacataaatgcatgaaaatggacaacaaaaaac

SEQ ID NO: 128418 - DNA, 601 bp, Human
aatagtgcccaggctggagtgcagtggcgtgatctcggctcgctacaacctacacctcccagccgcctgccttggcctcccaaagtgccgagattggagcctctgcccggccaccaccccatctgggaagtgaggagtgtctctgcctggccgcccatcgtctgggatgtgaggagcccctctgcctggctgcccagtctggaaagtgaggagcgcctcttcccggccaccatcacatctaggaagtgaggagcgtctctgcccggccgcccatcgtctgagatgtggggagcgcctctgccccgccgcccaatctgggatgtgaggagcgcctctgcccggccgcgaccccgtctgggaggtgaggagcgtctctgcccggctgccccatctgagaagtgaagagaccctgtgcctggcaaccaccccgtctgagaagtgaggagcccctccgcctggcagctgccccgtctgagaagtgaggagcctctccacccggcagccaccccatctgggaagtgaggagcctctccgcccggcagccaccccgtccaggagggaggtgggggggtcagctccccgcccgggagggaggttgggg

SEQ ID NO: 128419 - DNA, 601 bp, Human
atgaggaggactaaatgagaaagaaaagtctgattatagcgtatcacatttataatattgataataaacccatgtagaaacacagaatttcagttctaaaaggaatcttgctaaaccagtcctctatcttcccatatttcgagaggaaacccaagcccagagaagtgaagtggtttgccacatagtcaaaagctagtggccagagctgtgactaaccacaagacgctgaaatcttgtctgcaaaactggtctacaaaaactgtaaaattcaagttgcttctattacagaaatattttattrtcacttaacaaatttggtatcataataccttaaaaagcaatggcctttctatttgtccttaagtcaaagtgagtttttttagttattcaatattgtcctaaaaatgccaacactatcaaaaaacctagtaatttttccaaatatgaatcaaagtctttaagaaaagactctgaagcctatcttatggtatttcagaagtatctttatatacttatttatatgagaatctttttgtatttttaagtatgcttagagcagagtctggtggctcatgcctgtaatcccagcactttgggaagc

SEQ ID NO: 128420 - DNA, 601 bp, Human
cacaaaaagtaaactgaggaaaattcaacaaaataaattattagtatccttttaaaaatagcaagatcatgaaaaagataaggaaaagttgaggaactgtcacagactggagaagactaagacataagaactaaatgcatactgaacacaatgtgggatcctgggtcaaatcttaaaacattagtgggaaaattggtgaaattcaagcagggtctgtggtttagttaacagtattgtaccagtgttaattctgcttttgataattgtactatgtaggtatgtaagttaactgcattaagggaaccagggtgaagggtaaaagggattgctctgaaaaatttttgcaacttttctctacgtttaaaaagagttcaaaataagaagcttgatgttgatttttaatagtgaagacttatgcatttaaaaacaattctctagttgctgatctcttaacaatcaacctgaagcagttcaaagtataaggaatatcatgcccctttatcatacaggggaaaaaacgtatttcatcaatatggaaatatacttttttaaggcttaatgaataattttatttcagattagattaagtattttatagcta

SEQ ID NO: 128421 - DNA, 601 bp, Human
aaccaagtgatcaaggttaacatcaccaacattaaggtatatcaacatcatgaagtcctgacaaaatgcactgaaaaggacacaacattgtctcagagatattctggcaaaaaatgcacaacctcattctaatcacgagaaaacatcacaaaaagtaaactgaggaaaattcaacaaaataaattattagtatccttttaaaaatagcaagatcatgaaaaagataaggaaaagttgaggaactgtcacagactggagaagactaagacataagaactaaatgcatactgaacacaatgtrggatcctgggtcaaatcttaaaacattagtgggaaaattggtgaaattcaagcagggtctgtggtttagttaacagtattgtaccagtgttaattctgcttttgataattgtactatgtaggtatgtaagttaactgcattaagggaaccagggtgaagggtaaaagggattgctctgaaaaatttttgcaacttttctctacgtttaaaaagagttcaaaataagaagcttgatgttgatttttaatagtgaagacttatgcatttaaaaacaattctctagttgctgatctcttaaca

SEQ ID NO: 128422 - DNA, 601 bp, Human
ctacaaagaaatttcctaactcttctcagcagaattactttgtgcatggcatttttaggacacctatcacatattataccttatttatgctcacttgacttccaagtatgctaagatcacactaaaagcagtggctgtatctccatcatctttttaacctcaagtcctagcatggtgcctaagacacagtatgctcaatgaaggtttgctaaatgcatagatatataaacaaaaaaataaataaagtcccagctttattagagattagccctttgaatctgcccattataagctcacagtgaaagtgggggaaattttggcaagggcaggctagacaaatgtaaatcatttaagtggtatggattcactattagcttcagtactatgaatgcttagcttatcgaagtcatcctttttaaaacaaatagtaaagtactgtttttaaaagcatgcctctcagaaagctggggggaaaatgtaaaaaggcacgtattcatgccactactaagttttggaaaaggcatggtttaaaaaaaaaaaaatcaagagctgaaaacatattacagaaatccttcctcaaagtgaagtaaaaacacagact

SEQ ID NO: 128423 - DNA, 601 bp, Human
gccaaggtgggtggatcacctgaggtggggagttggagaccagcctggccaacatggtgaaaccccatctctactaaaaatacaaaaattagccaggcgtggtggcacacgcctgtaatcccagctactcgggaggctgaggcaggagaactgcttgaactcgggaggtagaggttgcaatgagctgagactgcaccaccgcactccaccctgggtgacagagcaagacgacgtctcaaaaaaaaaaagtaattaaagcttgtttcgattacttaggctcatcaatagtaagatcaacatkgtactctatggtgaggtccctgaagaagcatctgggccttccccagtactttctggcccttcctattttttcaccaacataatctacatatctaatgtaaaactaaatttaagaagctaaaaaagaattcattgtccaatttaatgtaaaaaacaaaaaaaacaaaaaaaaaacaaaatcaccaacaacagataactgccaatcgaacttctgaatagcctaagagaaactgatgaaatctgatgttctggatagcttgcacagtctattgcagagaaaaataggaattccactgggctt

SEQ ID NO: 128424 - DNA, 601 bp, Human
caccatttcttctacaatgttctgtacaatgtcttgtggcttttcctcacaatcatggttttctccgtcatataacacttcatttttagataatgctttaaaagaagaaaaattcaacagaacattattttaactttttggaagctttttactaaacatttatgatgaaaaaactcctaaatcatgaggaataaaagaaaaaaaatcaaatagataacatgaaattagaagcaattatatgctaaaccttcaaaatgtataccaaaacttaaatattttccaaattcaagtcaatttcaaagattcctttgacaagctattacattattacacttaactgaattttctagattagtcctttaagtaccaaaacttcaaaaactattttaaatgaaacatttctaacatgtcctacagatgcttacttatacttagtacacacattacactatcccttatcaaatatactgaatgtaagtaggctgggtgcagtggctcatgcctgtaatttcagcaacttgggaggccaaggtgggtggatcacctgaggtggggagttggagaccagcctggccaacatggtgaaaccccatctctacta

SEQ ID NO: 128425 - DNA, 601 bp, Human
tcgtacatggtaggtgcctacataacagcccccagtaaaaaccttgggacctgagtctctaatgagcttccctggtaaacacttcacaagttgaattaagagaatctgtatgacttcactgagagaagacatttggagcatgtacctgattttctccaggcttcaccccatatacctcttcctactgatgattctgctttgtactttttcactaataaatcatgcagtgagtacaactatatgctgggtcctgtgacggcttccagtgaaatcaccaaaccttggggtaatcttgaaggcytccgacacactttattctcttttccttacctacttaatcagttacaaagtcttcttgattcaatatacattatatcacttatccatatttttgtctccatttagacggtttctgtcctatccaggctttgaatactgtgctggtatcctactgggaattcttatttccagacttagcttcttaaagcatagttctggtcatttcatttctcagtgctaaaatcttccatattaacccatttgttctagaatcaaggccaaaatcctaaatgtggaatttgtaactttccattggttggct

SEQ ID NO: 128426 - DNA, 601 bp, Human
gtgctaaaaccattgagtgggccaggtgtgtggttcacatctgtaatcccagcaattagggaggctgaggtgggaggatcacttgaggccagttcaagcccagcctggacaacacaagcaagaccccatctctacaaaaaaatacaaaaactagccgggcgtggtggtgtgtaactgtagactcagatactcaggagactaaggcaggaggactgcgtgagcccaagagaccgagggtgcagtaagccaagactgtaccactataccccagcctgggtgacagagcaagaccttatcttgsggggaaaacaaaaaaaaacactgggtgaataaattttcatatcatctccaagtatcaaagtatcacctcagattggctattaatcacaaagtgaaaaatgttcctttacagagagctgataatcaccatcttaaccaaatgatccaaccctaccaccaacgggggtaacctgtcattatgtaccaatttatatgatgtggtattaagtactaatatcaccatgcagtatttttgccaaatatatttaatctaaactaatcatgtagatgacaatctcaatctactcatataggatggtaa

SEQ ID NO: 128427 - DNA, 601 bp, Human
atgaatgttaagaattagaaaattgctatattgcaacccaatatctgagtaaggcaaggatcatcaatgggtgctaaaaccattgagtgggccaggtgtgtggttcacatctgtaatcccagcaattagggaggctgaggtgggaggatcacttgaggccagttcaagcccagcctggacaacacaagcaagaccccatctctacaaaaaaatacaaaaactagccgggcgtggtggtgtgtaactgtagactcagatactcaggagactaaggcaggaggactgcgtgagcccaagagaycgagggtgcagtaagccaagactgtaccactataccccagcctgggtgacagagcaagaccttatcttggggggaaaacaaaaaaaaacactgggtgaataaattttcatatcatctccaagtatcaaagtatcacctcagattggctattaatcacaaagtgaaaaatgttcctttacagagagctgataatcaccatcttaaccaaatgatccaaccctaccaccaacgggggtaacctgtcattatgtaccaatttatatgatgtggtattaagtactaatatcaccatgcagtatt

SEQ ID NO: 128428 - DNA, 601 bp, Human
cttacatctcttatgtacaagcagacatgtacgcacaaccccctaacccccagagataaactaaaagctagtgaaactgattacctatagaaggaggatcagagaaggaaggagctgatggagttctccaagtaagccttttatgtaattttgactttgaatcatgtaaatattcttcatatttaaaaaaacgaaccaataaaataatacaagtaactttttcaaaacagtactctcactcatctttagtaggatatatttaaggatacatataattacagaaaaatcttgaactttatargtttgctgttagtaatggcatcttgttggggatctgggttttcaatgtaggaaacggaagatacaaatagaaagtacagaaagatgaggagcaaccttgtggtattggacgtgaagtagaactacaaataggaacttaagactaattgtatgtttccctctctatccactggaagggcctgcaagtaaggacatctcagcagctagcaacaagagcatcttgtaaccaattcttggtttctaagaacaactgcccactaaaaaggacaaagactcttcggagaactagctgattccaggg

SEQ ID NO: 128429 - DNA, 601 bp, Human
agtaagaatgtatatcacaccaatgtttataaaaagcaaaaacctgaaaataatctaaatgctagtattaacaggagattatttaaataaattatggcccagtgatataatgaaattcaaatggatgtgaatggatatagtttaatatgtgaaaaaggcagattatcaaactgtaagtacaatatattcccatttatcttaaacatatgtaatatatatgcaggcatgtgtgaaaaaaattatttaaaaaatcatgtacagcaaaacacaccataataagatcaaaagacttgggcgaatrataaactgagagaaagtatctgtaaaatatatcacagaatcctaatacataaaggattcttaaggggaaaaggataaaaatctgatggaaaaatgaacagaagacatgaataaatgactcactaaaagatatactaatgatcctacagatatgaaaagatgtttaatttcactcatagagaaatgcacattaaaaccaaactgagatacatttctcacctatcaggttggtaaaaactcaaaatcttttagtactaccagctgtggagagaaaggcactctcatacattaatggtaagag

SEQ ID NO: 128430 - DNA, 601 bp, Human
gtaattcaaaaaaagataagtagtccaatgatatttagttggaatatacaaaatggccaatgtttgacctataaaaataattgcctatattttgaccctggaaatagccaaatgcaaattaaaacaatacaataaataccatcattacagtgacattatagcactgtatacaaattttttaatattcatacaccttgatcaagctattccttctttataatttagccaaaagataagtgcaaaaagatgtctatagtaagaatgtatatcacaccaatgtttataaaaagcaaaaacctgraaataatctaaatgctagtattaacaggagattatttaaataaattatggcccagtgatataatgaaattcaaatggatgtgaatggatatagtttaatatgtgaaaaaggcagattatcaaactgtaagtacaatatattcccatttatcttaaacatatgtaatatatatgcaggcatgtgtgaaaaaaattatttaaaaaatcatgtacagcaaaacacaccataataagatcaaaagacttgggcgaataataaactgagagaaagtatctgtaaaatatatcacagaatcctaat

SEQ ID NO: 128431 - DNA, 601 bp, Human
aggaaaacctatttaatttattgcctatgactgaacacatgcaaagaataggccaacctgagagatatgattgttttaccacttgggttctaaaagacttcaaagcctagaatggcaaggtgctatgaggtaagagggaagatgcaaatcaaagagcttggggaaccatgccaatgtctatcaatagagctgaccacagccatgatcatctagactgtatttgatcactgcctgctaattaaagtagattatttgtttagtaggtctcctaacataacaagtaggccaggaaaggagagarcagcatctcagctaactgggaatgctgcaataaacacagaaggaaaaccaactaaggttctaggctcctactctctttctacttaattatttccaattaaagccattactgaatgatgccagcttaagattccctggcaagggttgggagagtgagaacaaatcaacaagtgtgaagatcttcctcagtgtagaatatataaaaagtgtacagcattcaccccaagcttgactttggtttgtgttgacaacatggtgaatgataaggggctacacagcccaagggccactagagccatac

SEQ ID NO: 128432 - DNA, 601 bp, Human
gctgataaactaaggagcatatcactggatcataaactttgaggaatcctagaaagtaggttgaaatcaaaggaaaacctatttaatttattgcctatgactgaacacatgcaaagaataggccaacctgagagatatgattgttttaccacttgggttctaaaagacttcaaagcctagaatggcaaggtgctatgaggtaagagggaagatgcaaatcaaagagcttggggaaccatgccaatgtctatcaatagagctgaccacagccatgatcatctagactgtatttgatcactgyctgctaattaaagtagattatttgtttagtaggtctcctaacataacaagtaggccaggaaaggagagagcagcatctcagctaactgggaatgctgcaataaacacagaaggaaaaccaactaaggttctaggctcctactctctttctacttaattatttccaattaaagccattactgaatgatgccagcttaagattccctggcaagggttgggagagtgagaacaaatcaacaagtgtgaagatcttcctcagtgtagaatatataaaaagtgtacagcattcaccccaagcttg

SEQ ID NO: 128433 - DNA, 601 bp, Human
gtactcaataagtggtagttattactaattttgttactaattgataacatgtctccaacttttgagtgacttgagtaatatgaaaggagtagcagcttctggttcccctacccagaagttgctttctcctctccaaattagaacaccctggaatagattaaactggataggctgggtgcagtggctcacacctgtaatcccagcactttgggaggccgaggcgggtggatcacgaggtcaggagttcgagactagcctggccaacatggtgaaacctcgtctctactaaaaatacaaaaawaagctgggcacggtggcgggtgcctataatcccagctactcgggaggctgaggcaggagaatcacttgaacctgagaggtcaaaaaaactggataattccgaagcaagttttgcattaataagtataacatgaaaaatatattcagtaataaaatacattatgaaaactgttacactgaaaacagacgctttcttaagaggacttttggagcttcaatatgctaatgtttgatgtgctaaataccactatagcttttatatattacatatgtagaaaatgcataggccaggcacggtggc

SEQ ID NO: 128434 - DNA, 601 bp, Human
ggtactcaataagtggtagttattactaattttgttactaattgataacatgtctccaacttttgagtgacttgagtaatatgaaaggagtagcagcttctggttcccctacccagaagttgctttctcctctccaaattagaacaccctggaatagattaaactggataggctgggtgcagtggctcacacctgtaatcccagcactttgggaggccgaggcgggtggatcacgaggtcaggagttcgagactagcctggccaacatggtgaaacctcgtctctactaaaaatacaaaamtaagctgggcacggtggcgggtgcctataatcccagctactcgggaggctgaggcaggagaatcacttgaacctgagaggtcaaaaaaactggataattccgaagcaagttttgcattaataagtataacatgaaaaatatattcagtaataaaatacattatgaaaactgttacactgaaaacagacgctttcttaagaggacttttggagcttcaatatgctaatgtttgatgtgctaaataccactatagcttttatatattacatatgtagaaaatgcataggccaggcacggtgg

SEQ ID NO: 128435 - DNA, 601 bp, Human
aaaaaggcagatcttttacacacaaaatatagggtaggaaggaggaaaagaacctgtcattaccatggtactgatttctttgcagccctgaacaaaggttaaggtgaagctccctaaatttctaaaagttttctcaccctacaacacaggttgagttacctgaaatgcttgggaccagaagtgttttgggtttcagatttttttggattttggactgtctgcattataccgaatgagcatcctaatcccaaaatccaaaatgtggaattctccaatgagcatttcctttgtgtatgacctytgagcgtcatcttggcactcaaaaagttttggatttggagcattttgaatttcagattagaaatattcagcccataccagaattatcttgtgaatatgtaataagaatgttcttattaaatgttaattcaattggtagatgggtgtggagaagatgtaaacatagatgagacctaccttaaagttggaaatgtaactatcaaaatatgaaggggaaaaaatcgctgtaatttatataaatgaaggaaaaaaaaccccaagtttcttatttccccaaactaaataaaaatcaggcagcatc

SEQ ID NO: 128436 - DNA, 601 bp, Human
gacagtcaagtcaagaaggtcttcaaacaaaatttcctaatatttggtttaaacccactaagtataaggcttgttaatttacatcattcctcataaaaatcctttgtaacattaaagatagcatcttttcaaaaccagatcactctttttttcaggaataaatgaacatactcctcaaaattcatattattttcctttgtgtccttttcattctcagcattttaaagaatttcttcttttctgtttctagcattctttcaaatcacaatttttacatttgatttggaaaaaagcatctgargctttaatggtcaataacatttttaaagcatggcaaaaatgcccttcagcaataataccaaattcttatctctttctcaaagtaggtcttcattgattcagaatgagatgttaaaactggtgatttttgaatgagactttttaaaattcaaaactgtcgattttttaatgagatttttgaatgttgatttctgacttagggtttgggtctaaaaagattttatgattttaggcttctgggactaaaggatgtttctccctgaactggtacaatctgacaaaattaaacaaatataacaaa

SEQ ID NO: 128437 - DNA, 601 bp, Human
aataaaataaaataaaaatacaaacttaaatagcttagcaacttattctaaataattctgtaatgaaaagctgaaaaagtagtttttggcttaaaatttttaaattttttcccaatcaatatactatggcatgcttctgatcactatctagtgttttaattatttgattttgcaaacacaattttcctcccattgaaactgatctcttaagcccaacagaccaaggacattgaacccaggcaacatttcaaatgcggaacacaccaaaatgctctagcagttggtttttttttttttcccmaaaaaaaaaaaaaaaaaaaaaaaaagtagcccaaatgctgctttcagtcacatttacactatatagtaaacttaattgcccttgatttccacctgaaaaattttatggttataagtgtcaagtaattcaagaagctacgtaaatctaataaggaattgttaatttcacgtaaatgggtatcacaaaaaaatactactttctctgaaataaaactggagccaataatattatggctcattattacacagtcatgtttctaagatggccattgtgctgagtcttcctttgaatctaagaata

SEQ ID NO: 128438 - DNA, 601 bp, Human
gcaatgaaagaatcttggatcgtagttcatgagacctaaaatgtaaaaaagaaggcatagtatatgaacaaggttggcattatagtaataacaggttgttccaaaaatatttccagatacacataatcataatttcataaactttgtaaatggagaggaagagaaaattctataacataaaaaaagtacagtacatgaacaacttaggcactaacaacaggtgctttcactgatgttcccctgaaccatatatttataatttcacaaactttttaaatttattattttgagacagagtctygctctgtcaccaaggctggagtgcagcgatctcagctcactgaaacctctgcctcccgggttcaagcgattctcctgtctcagcctcccaagtagctgggactacaggcacccaccaccacgcccagctaattttttgtatttttagtagagatggggtttcacggtgttagtcaagatggtcttgatctcctgacctcgtgatccacccacctcggcctcccaaagtgctgggattacaggcatgagccaccgcgcctggcccacaaactttttaaaaagaaaaaaaaattcacaaata

SEQ ID NO: 128439 - DNA, 601 bp, Human
aatttatcctttctaacaagctagtgaattatgagtcttgagttaggattaaatataaaattaacaaaaattaaaatataacctgtatatcaaacataatatgaaggtaaaaactgacaacataaaaatgagtatttcaaaaccatacaacatcacaaccaaaacaacatttcaacaaataacaaattgaaaaaagcattcattaaattggtaaaacataaagtactatttttaagttttatttgaagatgaaaacaaaaaatcagaaactggtacaccttaaaaaaaaaaaaaaaaaaaaccacataaagctgggcgcagtggctcacacctatgctcccagcactttgggaggcggacgcggacagatcacctgaggtcgggagtttgagaccaacctgaccaacatggagaaaccctgtctctactaaaaatacaaaattagccaggcgtggtggcacatgcctataatcccagctactcgggaagctaaggcaggagaatcgcttgaacccagcaggcggaggttgtgctgagtcggaatcgcaccattacactccagcctgggcaataagagggaaactccatctccaaaaaaaaa

SEQ ID NO: 128440 - DNA, 601 bp, Human
attactgctcattgacaatgcacctgatcaccttagagctctgatggagatgtgcgatgagattagtgttgttttcatgcctgctaacacaatatccattctgcagcccttggatgaaagagtgattttgtttttgcagaaatgcagtctcactatgctgtccaggttgatctcaaactcctgggctcaaatgatcctcccaccttggcttcccaaagctgggattacaggcatgagccaccgtgccctttcctcagaagtaactctgaatttcaagtcttttttttttttttttttttttaaagaaatggggaattgctacattgccgacgctgatcttgaactcctggtctcaggcctcatgagtagctgggattacaggcataagctaccatgccaggctaactttcaagtcgtaaaagctgccatgtagagagatactacttaaaagctgccatgtagagatactacttaaaagagatactacttaaaagctgccatgtagagagctgccttatagttgccatgtagagagatacttctgttgaatctgggcaaagtaagttgaaaaccttctggaaaggattcactgttctagatg

SEQ ID NO: 128441 - DNA, 601 bp, Human
aaagaacttaaggtaactcttaagatataattcctgtaaatttacatgaaagtacacagaaaaacaatcaagcaagtcatcagaagcttgcaaaaactatagagagtgtggtgttatgtgcccgtagtcccaactattcaggaggctggggaaggaggatggcacaagaccaggaattcaagtccagcctaggcaacatagcaaaatcctgtctcaaacaaaaacaaaagtacagaggaaccaaaactttcagaaaatgtaactgggatatatacacttatttacttcagattattctgcraacagatttttctaacatgtcagaaagggaggcaggagtgctttccctacaaatatgtaaaaatattaccatgaaagttttcaagtgtttaacgtatcatttaatggaataaaaccctactatcttataactttaaaaactcaagtcatggcactaaaaaaaaaaaatgaaagaaagaagcttttttacctaaagttcaggtgaatgcttaaaaaacacaccaggaataacaaaataaaagactacacactgctgccaataagaagtaaaggaagattaaaatcacctggaaattttaag

SEQ ID NO: 128442 - DNA, 601 bp, Human
atcttactgctagatcaccaaggtatcaagtctacacctgcacctcccagaccttacaatactatagcatctatgctatcatggagggacagactgcattgctagctgcttcagttgattaccactgggaattagttttccccagtccaacttgaagccatatcatggtcctggtttttaattcttttcctatggatcctttataaagtttgaaattcttttggggtttctaagaattttcactgctagcagcaacagaggaatcactaaaagatagaagattcctgctctaagtaatgcrtccagattggttggaggtggggggttggggagggatggacagagaatatctagaaacttcgaatataccagccattatgctaagtccagtcatatatattcttatttaatcctaacaatcctatgattagatattactttgtttgcaaaagcagaaattgaatctcggcgaactaaagtaacttacacataataaggaaaaaatacagaagaattcaaacccagaaatacttaaggtcaaagtctaataagctctgtttcttccctggtggaactccttccatttatgactaaaaaatgt

SEQ ID NO: 128443 - DNA, 601 bp, Human
ccatggctcgtgcctctagtcctagcattttgggaggccgaggtgagaggatcacctgaagcccggagtttgaaaccagcccgggcaacatactgaaataggaaaaaaacatagtgaaagcctgggacaggcttttactttagtaactttaatttaaaaaaaagttgagcccaagagttcaagactgcagtgacctatgaccatgccactgcactccagcctcaacaacagagtgagaccttgtctttaaaaaaatagaaaaaaaagaatgcatataattcaaatctaataattatctacyatgtattcttaataactgaaagtttcgtatttccaaaaagtgaaagtacagactttttttctatcagtcagaaagtatgataaatatatactcaacccggtcaacttggttacatggaatactcacggcagagataccattaataaaagaggatatgggcgggcgcagtagctcacacctgtaatcccagcactttgggacgccaaggcgggcagatcacatgaggtcaggagttcaagatcaacctggccaacatggtgaaaccctgtctctactaaaacaaacaaacaaacaaacaaa

SEQ ID NO: 128444 - DNA, 601 bp, Human
cattctgcttactgttacttacaagataaaatataaactctttaccctagcatttaaagcacttcccttcaacagtctagccaaaatgtgccatccctcaactatctaaaacttacctaccaagactcaatttgggttctcaatgaaaagttcctctccattgttctcatctgcctttgaactaagcatttacttagctaagtactactcaaatcagaattacgttcatacagttgcatataaattatttcaggtgtgttaatgttgccttcacaaccagataaagtttcctaaggttagsaatcaagtaatattcatttttgtactttcctaccttactcaaaattaagtccaaagcaggtgctctacaaacacttgacctgagtgaccaaacactcaataaatgcccttctgaatgcaaacataacagatgatatcatttaaacctgctgaactcaaattctattctaggaactgaatgatgtgaaaaagatgtaacccctgtcctcacagagttaataatttacaccaggagagacagatatgtttataatgaacttcaatgcaatgtaatgactacttcatggctgaaatgaactaa

SEQ ID NO: 128445 - DNA, 601 bp, Human
aaataaacgatgctaattaatatcagcagtaaaaatctacaattctttattttttgttttagaaaaagtatagaatagcatagataggtaaatcctaagattttccataaaggcattaagtatgctaaaactatttctcaacaagaaaaacagatattttaaatcaaattcttaaagcccagagcaatcatttctaaaaagaaaaacaccattcacagggttttctaatttaatattaaaaagtaataaataattgcttggaagggaaaaaggctcaatttgattacaaggacattctaarcaaaaaatatactacaaatgtaaacaaacaccatagttattcaaataccttattaaaatgatctccaataacttcccaaattcgagaccactgtaatcttattcttcccatgttgtaatatgatatttctactattttttgtagactaaacattcttgggtgtgtcgtggaaagtaattcatccatagacacagcacagagccaacggacaaaatccactgtaatataaatacattttttttttagctcaacattaaagttattttagccccaagccagttccgaagtagaataaatgcc

SEQ ID NO: 128446 - DNA, 601 bp, Human
aatatatttgacaaaacacttgattttatggtctttaactgtgagattgtgtttataaagaagagttaatttgattaaagtcaaaataaatccaaaattttaattacaaatatagattgttacctggttcttacatctaatttgcatctattgatgatacaggataactcaaagagaattgggaaccatcctctcacccacaccctgtcttcaggtgctacgttcatatcatcgcttgtgtattccttgaaagccttcaagaaaaaaggtagggttattaaaggcaaaacataacacccayacattcagtatactaacttctcaaaaaataatttaaatgcttcacaaataaccagtgagcaatttaataaaaaataatttataaaaaatggacactataactgcctacaattttagtatatgtgccactgaaataggcaaaacataactgcctataaagagctctggactagaatccaaaagttagcttcactttcaactgtcaccagctttctgcattattagccaggttaattcaggtttccatttttatcacttaaatggttatgataccagacagccacattaaccacactggtga

SEQ ID NO: 128447 - DNA, 601 bp, Human
aagaaagtcttccacaggagacgcctgtcagagttccaccactgatgctaaacccatagttccctccttgcaatggaacaaggctccctcgtcctccatctgctgagctccgtatctattcccttccactccaagtaactggatgctgcctctcatggctgggagtaagtggatatgggcaatcctgttttttccagggcccaaagtaaacacaaagatcaatcgtttccaaggatttttactgtggaaaatgtctttttttccttttcttttttttttttttttaaagccatacttaagtagttggtatagggaaaaataatacagtcatgtgccacgtaaggacatttcagtcaacaatgaactgcatataagacagtggtcccctaagattataatagagctataaagttccaattgtcttgtgacattgtagttgaggctttcactgattgtagggcaacactttactcacatgtttatggtgatactggtgtaaacaaacctactgcactgccagtcgtataatgataaacaattatgttaacaattaatgtatttactatactgcacctctcatcattatttgctagtgtactcc

SEQ ID NO: 128448 - DNA, 601 bp, Human
gtcacagttctcaagggcaattcagaatgatacttttctgtgaaatctaagttttaaccgttgacaatttgttaagaaagttaaaagttgtggggaacaaatctggtcagttggcgttagtttgctactttacagcctcctggctttaaaattcaaaggtattattgggagaacagtacaaatttgaaaagacctgtagattaaataagagtattgtttcaaggataattttttgattgttagggataagtgggcattgtgtttacaaattacttccaaagaattcagaaaattgtgtgtstgggaggcagggtagcaagataaaaagagggaggacagctggggttggtaaaaacaaatgtaaaatgacaacatttggagaaacctggtgtaatgattacttttgtgtcaatttggctaggacacaataccaatatcctatgtacttaagccagatacttaagtcgaaggagtaacaattaattcaattaaacactattccaggtgttcagctgaaggtattttatacatgtggttaacatctatagtcagctcactttttaaggaaattatcttcaataatctagatggtccttatcca

SEQ ID NO: 128449 - DNA, 601 bp, Human
gtggtgcttgtggtctgttatccacagaccttggttgaatagaatcatgaatatctacagacttctgtgatattgtatcctaataaataaaaaaaaaatcactgtaagtatggttaataaagtttatgggtgaaaatattttctaaaacgctattttaaaaaattatattatgtccctatgaaaatgatgttttacacattacagttataacacaatcagaaaattatttaaaattacctgtacatagagaaaagttgactttctgaccctcactgggctcaggtctgaaaccatccaacagcaacagataaaaatgcgaaacttcaaagtgtagagaaactggtcagcaatacccacaagtgttcatgaaatctaaacagacaccttttgcaggggtgaatttagaaaaggatcttctgtcacccatggacccagggactagaaaggtcaatgtgaaggtgactatctaggagtgtcgtatcatgaagagatgctggaccctggagtccaacagacctacacaagaattaggctccagtattatttatttatttacttttttgagatggagttttgctcttgttgcccaggctggagtgc

SEQ ID NO: 128450 - DNA, 601 bp, Human
aattgctggtgggaatgtaaaatggtgcagccactggctatagaaaattgcttggtggttcctcaagaagttaaacatagaattaccctatgagctagcaattccactcctaggtagataatgcaaaagaactgaaaacaggtattcaaatgatatttgtacacaacagtttgtagcagaactattcatgacaactacaggtgaaacaaatacaaacgtccatcatcagacaaatggataaacaaaatgtggtctatacattcagtggactattagtaataaaaaggaatgaattactgattatgctacaacatgatgcgtcttgaaaacactgtgagagaagacagacacaaaaggttgtattttgtatgattccatttatatgaaatatgcagaataggcaattcacaaacacagctaattagtggctgccaggggctggggaagaggagaagaagaagtggctgtataacagttatggggctggggggctccctttaggagtgatgaaaatgctttggatctagatagaggtggtggctgtgaatgtactaaatgccactgaattattattcacttgcatattgttatttctgttatg

SEQ ID NO: 128451 - DNA, 601 bp, Human
caaaaaaaacacttcatagaagacaacattgggggaaatgctcatgaccttggattttgacaatgacaccaaaggcatgactaacaaaaggaaacagaaaaattggacttcatcaaaatttaaaaacaggcaaaggacatgaacacaaatttctccaaataagatatacaaatggtcaacaagcatatgaaaagatggttaacaacactaatcattatggaagtgccagtcaaaaccacaatgaggtaaacttctcacccactagaatggttatcatttaacaacaacaaaaaaggcgctsgcaaagatgtggaaaaactggaattgctggtgggaatgtaaaatggtgcagccactggctatagaaaattgcttggtggttcctcaagaagttaaacatagaattaccctatgagctagcaattccactcctaggtagataatgcaaaagaactgaaaacaggtattcaaatgatatttgtacacaacagtttgtagcagaactattcatgacaactacaggtgaaacaaatacaaacgtccatcatcagacaaatggataaacaaaatgtggtctatacattcagtggactattagtaa

SEQ ID NO: 128452 - DNA, 601 bp, Human
attagccgggtgtggtggcgtgtgcctgtagtcccagctactcgggaggctgaggcagaagaatggcttgatcccgggaggcggaggttgcagtgagctgagatgacaccactgcactccagcctgggcaacagagccagattttatctttaaaaaaaaaaaaaaaaaaaaaaaagttaagctgaacacattacttcaaaagtaaccaaactgcaaagtaacaaaagtgccacccatgttcccctcatcagctatacacagtcacatccctctatcctgaacacatttgttcaacagggcrtttctgatagtccgccggcccatgtggacacactcacgggcgtgctccccttgtctgaccatgccagctaagtagctaagccaatgcagcagcgcaaggttagaaaagaggactcaactcctgagatgctgctgccacgcagcccaggggacccagaccacacggccacgcctccatctcagattctcaggggcagctttggcaggaagctttccaggaggcagacaactgcccaaagggagctgcctactagacagtcttggggcaatggcttcaatgctgggcgacttacaatccctg

SEQ ID NO: 128453 - DNA, 601 bp, Human
ttctgcagcccctcatcctcccagcactgttttgcaactcataattatatttctttcttttttcttttctttttttaagagatggggtctcactgtgttgcccaggctggaggggagtagtgtgatcatggctcactgcagcctcaaactcctgggctcaagtgatcctcccacttcagcctcccgagtagctgggattacaggtatgcgacaccatgccccgctaatttttaatttcttgtagagacagggtcttgctatgttggccagggtggtttcgaacttctggccccaagcaatmatcctgcctcagccacccgagtagccggaactacaggtgtgagtcaccacagctggctctattttttaaattaaaaaattaacaatgtcactttggtttataataaaagcttattttttgtttaaaatgtctaacttgttctagaacaaatatacctcacatcccaataaattcaccttcactctgagctctggccactcccagtaaacagagaagccattcaaatacacatgccaggttttgtgtgtgcgacttttacacatatttatttcctaatgaaaagacagcttttgtcatgcc

SEQ ID NO: 128454 - DNA, 601 bp, Human
gtcttacttcaaaagcctctgctggacctcctcccaggcactaacgcggctctcatccatgtacatccggaagagaatgcgcagcccacaggccaggctgctggtctcctgcttcagaaggttgggcttggatttgcctttgaatcctgcagaaaagggaagtttctgggattagtttgggaaggcatcttatgtaaaggtgaaacagcccgtatggaggcacattttgtttgtgctcagccatcagcatctgctgcttacaaaacggagccacagcagcctgatgtgaaggtgatttccrtgtccagaattccctccctattcaagctggggatatgagatataaaaaaacttgtggcctgggaaggtggaacccttcacatgaaactgcacttgaatccccaaagctgtggaaggggccatgtgctctgcctgcgccaggggcctcagataaacaggggcaacccccaggaggtgagaactgctctgtcagaggtctgatgggtccggtgtgtgtggacacaaggaggctctatcagctcagcaggaagaggcccagtggaatggtggcaaaaacttgggtagaaaaaaaggggaaaaa

SEQ ID NO: 128455 - DNA, 601 bp, Human
tggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggt

SEQ ID NO: 128456 - DNA, 601 bp, Human
aaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtrggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtct

SEQ ID NO: 128457 - DNA, 601 bp, Human
gggaggcagaggttgcaattagccaagatccaccactgcactccagactggcgacaaaggaactccgtctcaaaataacaataacaataattagctttcttttcttttttttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatcsgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgc

SEQ ID NO: 128458 - DNA, 601 bp, Human
ggtcctgtcatgttctgggcagtgtaccaaacagtttcacacacatcgtatcatttcactttcctagtcatcctttttcatagatatataaatggagctcaagggcttatgtaactgctccaagttgacacagctgggaagtagaagagcaagcattcctattcatgtctgtagctaccaagccctttctcgggtgtttacagtgaaagaggtggcaaggtggatagggataaactggagaggctacctcatctaaagaggtagccaacccacacccgctccagccacctggcaccatggrgagaacttgagcccaggatgacctgagcttccagtttgtcaagagaactataaatttgattttgattatgggaaatactcaatttttagatgttagcaaacagtttttttgtttgtttgtttttttttttaaattagggggctgagtgcagtggctcacacctgtgatcccagcactttggaggccgatgtaggtggatcgcttgatctcaggagttcaagaccagcctgggcaacctagtgagacgtcatctctataaaaaatacaaaaattagccaggcgtgctggcacgagcctgta

SEQ ID NO: 128459 - DNA, 601 bp, Human
ccaagttgacacagctgggaagtagaagagcaagcattcctattcatgtctgtagctaccaagccctttctcgggtgtttacagtgaaagaggtggcaaggtggatagggataaactggagaggctacctcatctaaagaggtagccaacccacacccgctccagccacctggcaccatggggagaacttgagcccaggatgacctgagcttccagtttgtcaagagaactataaatttgattttgattatgggaaatactcaatttttagatgttagcaaacagtttttttgtttgtttktttttttttttaaattagggggctgagtgcagtggctcacacctgtgatcccagcactttggaggccgatgtaggtggatcgcttgatctcaggagttcaagaccagcctgggcaacctagtgagacgtcatctctataaaaaatacaaaaattagccaggcgtgctggcacgagcctgtagtcccagttactcaggagactgagatgggaggatcacttgaggctgagaggtggaggttgtaaagagccaacatcgtgctgctgcactccagcctgggtgacagaataagacctggtct

SEQ ID NO: 128460 - DNA, 601 bp, Human
agctgggaagtagaagagcaagcattcctattcatgtctgtagctaccaagccctttctcgggtgtttacagtgaaagaggtggcaaggtggatagggataaactggagaggctacctcatctaaagaggtagccaacccacacccgctccagccacctggcaccatggggagaacttgagcccaggatgacctgagcttccagtttgtcaagagaactataaatttgattttgattatgggaaatactcaatttttagatgttagcaaacagtttttttgtttgtttgtttttttttttwaattagggggctgagtgcagtggctcacacctgtgatcccagcactttggaggccgatgtaggtggatcgcttgatctcaggagttcaagaccagcctgggcaacctagtgagacgtcatctctataaaaaatacaaaaattagccaggcgtgctggcacgagcctgtagtcccagttactcaggagactgagatgggaggatcacttgaggctgagaggtggaggttgtaaagagccaacatcgtgctgctgcactccagcctgggtgacagaataagacctggtctcaagaaaaaaaa

SEQ ID NO: 128461 - DNA, 601 bp, Human
tttgccaaattgtgtgatgaaaaccacaggactgattggaaaaaatgaaattagtgacactcaaaaactttgtcagtaacgtattaaaaaacagatagtgaatctaataaaacctgcaagtggttaaatacatagtgactataataaatatggtacttggtcgggcgcggcggctagtgcctataatcccagcactttgggaggccgaggtggacggatcacctgaggttgggagtttgagaccagcctgaccaacatggagaaatcccatctctactaaaaatacaaaaaattagcggggcatggtgacgcatacctgtaatcccagctactcgggaggctgaggcaggagaatgacttgaacctgggaggcggaggttgcagtgagccaagatcgtgccattgcactccagcctgggcaacaagagcgaaactccgtctcaaaaataaataagtaaatacggcactttacctagaaaaagccttgtagattctttgtggaggtaggtgtagggaggattgcgtctcatgagttactgtgagtggtggacatggggtgacctgaaatcaccagatggattgaatgtgactcataccatgt

SEQ ID NO: 128462 - DNA, 601 bp, Human
agcactttgggaggccgaggtggacggatcacctgaggttgggagtttgagaccagcctgaccaacatggagaaatcccatctctactaaaaatacaaaaaattagcggggcatggtgacgcatacctgtaatcccagctactcgggaggctgaggcaggagaatgacttgaacctgggaggcggaggttgcagtgagccaagatcgtgccattgcactccagcctgggcaacaagagcgaaactccgtctcaaaaataaataagtaaatacggcactttacctagaaaaagccttgtagwttctttgtggaggtaggtgtagggaggattgcgtctcatgagttactgtgagtggtggacatggggtgacctgaaatcaccagatggattgaatgtgactcataccatgtgcactgagtatccctgcatggatcacttcacctcagtgtttattcatggaagaaaccatgcataaacacaaaatttgcattatactcaaattatttactaacatatcaatcatgttcaaacaaattcatcttttcacaacaagcattatggcagctctgagtgtataggtaggctattgagggccttaaa

SEQ ID NO: 128463 - DNA, 601 bp, Human
caagaccctgtctcaaaaaaaaaaaaaaaaattctgagccttgaggtatgttatatactgccactaagagctgctgtccttgtctggaaccagtaacttctacttcccaacataccctgacctcatacttgccatacctcaaccacaatgactggagaagagcatacaagaaatgacatgctggttatctgtgtgtgctctggtacagcatgtgtcatccctgaacacaaaagggcaaaggaattactagtgttgccttggttttagttggtaattgaagacccctctcaatcacataacygtcatttcttaacagggaaaacagtttaggaaggaaacaaaaattgatagacatgagctgggcttggtggctcatgcctgaatcctagcactttgggaggccaaggcggcaggatcacttgagcccaggaatttgaggtcacctgggcaacaaaatgatactccatctccacaaaaaaattttctaaaaaattagctgggtgtggtggcacgcgcctgtggtctcagctacacagaaggccaaagcagaaggattgcttgggcccaggaggttgagactgcggtgagccatgctcatgcc

SEQ ID NO: 128464 - DNA, 601 bp, Human
tttacactgactgatattatttattcagagttcatggtctgcttcccccaatagaagtttagttctatgatggtgggacctttttttgttcacgtccctattcctagtacctagaacagtgtttgactcgtagtgggtgctcagtaaacatttaagtgattgaatcttttcttgcctatgtcattttattttgagccagccaacattgtcttattttccgtattgcagttagccaagctgttgtgttagactgtgtgagtttgttgtctcaaccttgaagttccatttcttttttttttttggagacggagtttcccttttgtcgctcaggctggagtgcagtggcgcaatctcagctcactgcaaactctgcctctgagttcaagcgattctcgtgtcttggcattccaagtagctgggactacaggcgcccatcaccacgcccagctaatttttgtatttttagtagagacagggtttcgccatgttgaccaggctggtcttgaactcctgacatcaggtgatcctcccacctcggcctcccagagtgttgggattacagacatgagccactgcgtccggctggagttccatttcaaaa

SEQ ID NO: 128465 - DNA, 601 bp, Human
gcctcttaggaagacagccccaagcaagcatctacagaagatcagaagctccagtttcccttccatgctggtgacaccatttatctgccaatggtgcctgcctctgctcccgccctttgtcctggtaaacccaacccatcctatcccttctctgaagccctcacctaccccagtaggcagatagacagtgctgcttgtgattctgattgccctttcctacagattaatcacttgttgcatactcatataattcactctttacaggcctgtcttccccatcagaatgtcagagcaaaaaccrtgtcttaccatctatctctgtattcctgtcttcttgctcagcaaggaaaggctctctacaaacttctgaacaaatgagtgaagcatgaacgtaacaaaagggccatagaatctgcttggcttccccatttgtcagtcttcttctgagcttaaaggaaaggcctagtcacaggctcttggtgccattgtctcctgatattagtgtcactcaaagggatagagaactcaaggaaatatactgcaaagaaaggaaaaacaatattatagaaggcactttaccacaactattcttaaaagaaaa

SEQ ID NO: 128466 - DNA, 601 bp, Human
ggttttgaatgtccttattaacaaagaaatgataaatgcataaggtgatggtcactctatctgatttgatcattatacaacgtggatatattgaaatatcaaattatgcctcataaatatggacatggacaattacaatgtatcagaaataaaaagagacaccaaagtaaaacaagattagaaaaatggactgtgtttaataaatgcattcctagaactgtgtttctagaaggctttgagtggctagcccaggtggaaccatatggtaatcctcttttgctgtgggcttcggcagtgacartccccatgcttctccctgtgactatcccgcttccccaggggaggtttcgggcccaggacgtgaatcagagaggggctaaatgcaggagtgagaccctctgtgccaaagccacacatgcacgtgtttgctatgtgccactcgtggcaggacaggggccctgagccgcatcacaagcccagatctccaggaataggacccaggtgtgttcaagtggacagtagagttcagccgtcacctgtgagctcctactgtatgttagaccatttgtatactaagagcactaaggtcatgccatctgcc

SEQ ID NO: 128467 - DNA, 601 bp, Human
actgcaggcttccgctgagtatgctgcatggttctgtcatcttttgcatagttttctaggaactctgaaaaccaatatatttcagtattgctgttgacgtttctgggaacaggaatccacaaaattcactggagaataaatggaaatgtattttttgagaaattagaaatatcaacctaatttctgcctggtgtgatgtttttattttatctaatgatactgctctttgcccaaagtgaataaataaatcactgacttggtgtgggactggcccacattgccaagctgtcctttttctcartgatgaatatttttactcagagcaatgactgaaatcagttttcttgtgaacacagctgtagctgcaaacacaatattcaactggatagcagtttgattagtagcatatctgaatattagtccctgaccttcatcagttttgtctttaaaaagctttcattttcttcagttgcttctaacatgcatatctgctcttacattagactgctaaaaggagagtttgctagcataatataaaattgacacccattaaacagtttgcagaagctattcagacttgagttggaaattagaagggttc

SEQ ID NO: 128468 - DNA, 601 bp, Human
cctgatgtaaaccaagtaatgaggaagtagtagcagcaagccacaactctaagagggtgacttggtaattgagaacactggcattgctgcaaccattagaaccagagcaaggcctgcaggcttcctcctcatctgttcacagtctcattcatgggtgtactcagggcattacagggcatcctcttttgggaaagagaagacaaaatttagagcccttgcctgtcatggagagctgccctgcatgccttggtcctcaggctgggccttgcaccttctgtctttgggcaggggccacatgcawgatgggagctgatggatcacgcatcgtgggcttagcttatcagcagcacacattctagaacagtggctctgactgcatggtcaaatgcagagaaagcgtaagcctgaaagtaaggcccagataaccttaaaaacagattaccaagggattcacagcaaccattctattgggccatccacacacagactgggaatgagaaccaagactccagaactggctagaactgggttcagagtctgacagtgctcttcgtagccacatgcttctttcctgcacttgtaaatttcttggtacacagtg

SEQ ID NO: 128469 - DNA, 601 bp, Human
caaaccatccccactatctagttttagaatattttcgtcacctcagaataaaccccaaaccctattatgtagtcactcctcctttccccctcttctcaaaccctaccaaccactaatctgctttctgactctatggttttgtcaactctgtacatttcatataaaggaaatcatacaatatatggtcttttgtggctggcttctttcacttagcatgatgtttctaagggtcatcatgatatagcatgtatcagtacttcattcctttttattgccaaataatgcacctctgtttttttttaaagacaagagtttcgctcttgtttccttggctagagtgcagtggtgccacctcggctcactgcaacttctgcctgctgagttcaagcaattctcctgcctcagcctcccgagtagctgggattacaggcatgtgccaccatacccagctaattttgtgtgttttgttttgagatggagtctcgctctgtcgcccaggctggagtgcaatcgtgcgatctcggcttactgcagcctccgcctcccgagttcaagcgattctcctgcctcagcctcctgagtagctgggattgcaggtgcg

SEQ ID NO: 128470 - DNA, 601 bp, Human
gctgggattacaggcatgagccactgcatccagcctctttttccatttttaaattgggttgtctttttattattgagttgttagcgttccttagacattctggctactaaaccattatcagacatgattcgcaaatattttctctcattctgtgagttgtccttttgttttatgggcttttactttcttgacaatttcttttgaagcacaacagttttaatgaagtctagtttatctgtttttgttctgtcattttgtcacatatctagatttgtgtaaataccaccacaccaagatacasaactgttaaatcactaaaaagatcttcctcgtgttgcccctttgtagtcacacttccctctcctcgaagctgtttttgaaccagcattataacttcattggcctgagagtcatttgcgtatctgtgttcatttttaatgtcagtattttttgtttaataggctgaaacaagccagggagctctgggcacactggcaaatgtagtgacctcccttgccaacctaagtgaatctttgaacaacggtgacacttcagaaatccagccagaggaccagtctgcaagtgagataactcggtacga

SEQ ID NO: 128471 - DNA, 601 bp, Human
aagatctaggtaccgtggaaagtgggtgggatttgaattaggtagaattctggttctaccacttactatatggatggtcttggaaaagttatttaacaactgtaagctcagcattcacatctgtaaaatggaagataatttttaactttggagggtacttgtgaaaaatagaaattgggcctaggtgcagtggctcacagctataatcccagcacttagagaagctgagacaagaggatcacttgatcccaggggtttgagaccagctgagacccatctctgaaaaagtaaataaataattgatagatagatagatagatagatagatagatagatagatagatagatatagatagaccccatctctgaaagagagaaagaaaaagagaaagagacaaagagaaaaggaaggaaggaaggaaggaaagagagaaaaggaaggaaaagagagaaagaaaagaaaagaaagaaattgtccatgaagttagataatacatagctcagtgcctaagatgatgtgtagataatacatacaagttttcattgtttgccggatgcagtggctcacgtgtgtaatcccagcactttgagaggccaaggc

SEQ ID NO: 128472 - DNA, 601 bp, Human
taccacttactatatggatggtcttggaaaagttatttaacaactgtaagctcagcattcacatctgtaaaatggaagataatttttaactttggagggtacttgtgaaaaatagaaattgggcctaggtgcagtggctcacagctataatcccagcacttagagaagctgagacaagaggatcacttgatcccaggggtttgagaccagctgagacccatctctgaaaaagtaaataaataatagatagatagatagatagatagatagatagatagatagatagatagatatagatagcccccatctctgaaagagagaaagaaaaagagaaagagacaaagagaaaaggaaggaaggaaggaaggaaagagagaaaaggaaggaaaagagagaaagaaaagaaaagaaagaaattgtccatgaagttagataatacatagctcagtgcctaagatgatgtgtagataatacatacaagttttcattgtttgccggatgcagtggctcacgtgtgtaatcccagcactttgagaggccaaggcaggtagatcacctgcagtcaatagtttgagaccagcctggccaacatagtgaaacc

SEQ ID NO: 128473 - DNA, 601 bp, Human
tgcctggctgccccatgggctcaggcaggcacttttgtctcttctctgtgtcatagaaaccctcatataaaatctacaacaagcaggcagccagccattgatcctgactgctctgccctctagagccacagaaagtagatcccttgaagagtgctgttaaggcctcatgggtgttccccgtgctgtcattcactggtctcactttttctacaggacactcagagggtacctgaagccctctcagtctctaggtctccagactgctgagtcctccttttcccccagtattttttttttttttaaacaaatacataggctgaagcgtagtgatgtgattgtggctcactgtaacctcaaactcctggtcttgaactcctgggctcaggtgatcctcctgcctcagcctcccaagtagctaggactataggcatgcaccaccatgcccatctaatttttatttttattttttgtagagatggtgtccttgatatgttgcccaagctggtctcaaacacttggcctcaagcaatcctcccacctcagcctcccaaagtgctcctgtcacatgagctgcttagctcttacttactgctaccttaag

SEQ ID NO: 128474 - DNA, 601 bp, Human
ttttgtctcttctctgtgtcatagaaaccctcatataaaatctacaacaagcaggcagccagccattgatcctgactgctctgccctctagagccacagaaagtagatcccttgaagagtgctgttaaggcctcatgggtgttccccgtgctgtcattcactggtctcactttttctacaggacactcagagggtacctgaagccctctcagtctctaggtctccagactgctgagtcctccttttcccccagtattttttttttttttaaacaaatacataggctgaagcgtagtgatgwgattgtggctcactgtaacctcaaactcctggtcttgaactcctgggctcaggtgatcctcctgcctcagcctcccaagtagctaggactataggcatgcaccaccatgcccatctaatttttatttttattttttgtagagatggtgtccttgatatgttgcccaagctggtctcaaacacttggcctcaagcaatcctcccacctcagcctcccaaagtgctcctgtcacatgagctgcttagctcttacttactgctaccttaagaccatctcccaaaatgcctgctagtccatgaa

SEQ ID NO: 128475 - DNA, 601 bp, Human
ctagtagttgacactattgtctttggggcaaacagacctggttgtcgggccataagaatagtgcttgtcagctgtgtggccttgtgcaagtcactttacctctctgagcctccagtttctcattgtagaatcctcgcgtgggtttcagatctataaagctcttaacccagtgcctggcatgcaagggactcagcagaaggcagtgtggttctgtgggtcaggtggtgtgggatgtgtcctgagtagttgttagaatggtcacctccctccatgattaaaggaaaggcagtcagaattgtcycattctccagggagaattagacaggtagtgactgctaaacaagtattaggagtttcattgttagctctttgggagaatggcctaccccttgctactatctggtaggtggtgtaacctcaggctttttttttttttttttttttttttaaataacaccacagtccacagttaatagtactgataggtacctgagattttttaaatgaggttaaaacattgttacccactgccctgagtgtactttttctagttgggtaatttggaacctcctccacagagtttctcagtccgggctagata

SEQ ID NO: 128476 - DNA, 601 bp, Human
tcttgagacaggtgagggaatgcaatttaggggtttctgagaataaggatgtattgttttgtgatgtgccaactttgctgactaactgagtagaagttagccagggcaaggctggaagcggccttagctggaccctcatcctccctgcttcagtctcggatccagcacaaagcctgcctcctgccctgcagggttgcagggcatgtttctgcccttcagaatctgtactcatctccgtcttttggtccccgtagcctctcatgaccttggctgcaggacctaagtaactgataccatctcytgggacagtcagtccaggatgctgaggcttttgaaggctgtaggtaatgatggtttggccatacctattaacatttttttattatttaaagaatgttttttaagagaatagttgatcattagaaggattttagttaaaacattcatagacttattcatagacttcatccttttcttgaagaatgatcctggatagcacttcaataaacacttgctgaattcacctgtttgggaaatgctgggacttagtgcctggatgccccacaaccttggagaaatgccaacacacaccacactcaga

SEQ ID NO: 128477 - DNA, 601 bp, Human
gatgctgtgtggcctgttctggggctaacactgtacatgaggcttgagttctcatggagattcctttgtccagaatagtttgaaaggtctgctcctctggtcagcatccattgaagaggcagtgctagagtacttgacagaaaagtgcttattgacagaaaattcttattgacagaaatcaaatctgacccctataaaggagtggatgagttatataaagtcattttaccctcagataaactaatggaaaaaagtttgtttgggtgcaaattagtggtattatttgtaattaatgtgcagyaaaaatatgtgtataaaaattaggaccgggcacggtggctcacgcctgtaatcccagcactttgggaggctgaggcgggtggatcaggaggtcacgagttcaagaccagcctggccaagatggtgaaaccccgtctctactaaaaatatttaaaaaaaaattagccaggcacggtggtaggcgcctgtaatcccagctactggggaggctgaggcaggagaatctcttgaacctggtagggtgggcagaggttgcagtgagctgagatcacgccactgcactccagcctgggtgacagag

SEQ ID NO: 128478 - DNA, 601 bp, Human
tctgctcctctggtcagcatccattgaagaggcagtgctagagtacttgacagaaaagtgcttattgacagaaaattcttattgacagaaatcaaatctgacccctataaaggagtggatgagttatataaagtcattttaccctcagataaactaatggaaaaaagtttgtttgggtgcaaattagtggtattatttgtaattaatgtgcagtaaaaatatgtgtataaaaattaggaccgggcacggtggctcacgcctgtaatcccagcactttgggaggctgaggcgggtggatcasgaggtcacgagttcaagaccagcctggccaagatggtgaaaccccgtctctactaaaaatatttaaaaaaaaattagccaggcacggtggtaggcgcctgtaatcccagctactggggaggctgaggcaggagaatctcttgaacctggtagggtgggcagaggttgcagtgagctgagatcacgccactgcactccagcctgggtgacagagtgagactccttctcaaaaaacaaaaaaaaaaacaacaaaaaaaaaccctttctcgtgcagctttaggcaggaaaattgttcagatct

SEQ ID NO: 128479 - DNA, 601 bp, Human
tctggtcagcatccattgaagaggcagtgctagagtacttgacagaaaagtgcttattgacagaaaattcttattgacagaaatcaaatctgacccctataaaggagtggatgagttatataaagtcattttaccctcagataaactaatggaaaaaagtttgtttgggtgcaaattagtggtattatttgtaattaatgtgcagtaaaaatatgtgtataaaaattaggaccgggcacggtggctcacgcctgtaatcccagcactttgggaggctgaggcgggtggatcaggaggtcamgagttcaagaccagcctggccaagatggtgaaaccccgtctctactaaaaatatttaaaaaaaaattagccaggcacggtggtaggcgcctgtaatcccagctactggggaggctgaggcaggagaatctcttgaacctggtagggtgggcagaggttgcagtgagctgagatcacgccactgcactccagcctgggtgacagagtgagactccttctcaaaaaacaaaaaaaaaaacaacaaaaaaaaaccctttctcgtgcagctttaggcaggaaaattgttcagatctgccaaagg

SEQ ID NO: 128480 - DNA, 601 bp, Human
tagtggtattatttgtaattaatgtgcagtaaaaatatgtgtataaaaattaggaccgggcacggtggctcacgcctgtaatcccagcactttgggaggctgaggcgggtggatcaggaggtcacgagttcaagaccagcctggccaagatggtgaaaccccgtctctactaaaaatatttaaaaaaaaattagccaggcacggtggtaggcgcctgtaatcccagctactggggaggctgaggcaggagaatctcttgaacctggtagggtgggcagaggttgcagtgagctgagatcaygccactgcactccagcctgggtgacagagtgagactccttctcaaaaaacaaaaaaaaaaacaacaaaaaaaaaccctttctcgtgcagctttaggcaggaaaattgttcagatctgccaaaggtcagaatgcattggcaggctttccagccaaggatggaagagtgctgctttcctatgacaacttctgacctaccagaagctacatgaatttctgagaccctttcaagtaaagtatttcctgtttccctccccaccatgtccccctaaaataaacattggaacaaaattgacagcctg

SEQ ID NO: 128481 - DNA, 601 bp, Human
atgcattggcaggctttccagccaaggatggaagagtgctgctttcctatgacaacttctgacctaccagaagctacatgaatttctgagaccctttcaagtaaagtatttcctgtttccctccccaccatgtccccctaaaataaacattggaacaaaattgacagcctgggaagacacacaggcccaccttcccgacatgtgtcctctgcacagacctcagtctccaggagccccatggaacacagatgcccctgggggctaccccttctggcccagtgcttctcaaatgattttgccycccagcagggtaaccagctcttagtctttcagcactaaaaccaggacagtcccagtcatttctctggtgtgactgggggtgtcttatggctggctggtcctgctggtagacaagagcctgcttctccttttggcgcacttctattgcccagatgtggcttttacaaaagcaagatccattttctactggaatcattgaagacttcatcatgaatctagaataacttcagcctcaatacatagagaatgggactgtcagggaatgcatccacacccagaatttatacatccagccaggtat

SEQ ID NO: 128482 - DNA, 601 bp, Human
tagaatgttctagaaaggaaaaaggaaaaagaaaactttttaaaaagcactatccaggggcagggcgtggtgactcacacctgtaattccaacactttgggacactgaggcagcaggattgtttgagcccaggagtttgaaaccaccctgggcaacatagtgagaccccatctctatgacaaaaaaatgaaaaattagtcaggtgcggtggtgtgcacctgtagtcccagttactcagaagtctgaggtgggagactcacttgagcctgggaggttgcggttgcagtgagctgtgatcacrtcactccactgcagcctggatgacagagcaagacactatctcaaaaaaacaaaaacaaaaaagcactgtccagatacctactattaacattttgcgtattcacttccagaaattttttatgtattgtaattgggatcataaaataccaaaggttttgtaaccttttttcatgtaatatacaataacaatacgtactcttcttcattttctatggttcctatttccctgctaatgaaaaggtagggtgtttccggtttgggctgtcacacatggcactgcagtagagtcctggcacatgct

SEQ ID NO: 128483 - DNA, 601 bp, Human
acttgctcacctgagatccagtcctggctggggaatggcctggtcacgtgggacacttgagatacacagtgttcagtggccctccagggcagcattgtggtgcaccctccaccccaagtttcttcaaaatgaaagctattttactgctttatttataatgctaaatgaacactggaaattagagcagtacaaaaaataagaaaaaatcacctcaaatcccaatacccagagcccaactgttagcgtggtgaacattttcccaatactttatatacacatctatacttgctgttttataatytccttttaaacttttattgagcaatatgtcatggatgtctttcctggtcagtaaatacaggtttgtattatcgttttttaaatgagtctctagcagttcatcatatgaagactcctactttagtctgtcctctgttgatgaatttccaggttttctcttggtggtgggggtgaggagagttggaataaacaagagtgaagggaacacatctgtacatacattttgtactcatttggttttttctcatgataaatttctataagaggaactgttgaaatcagaaaagagaggtgggtggat

SEQ ID NO: 128484 - DNA, 601 bp, Human
cagagatggggtttcaccatgttggccaggctggtcttgaactcctgacctcaggtgatccacctggcttggcctcccaatgtgctgggattacagttgtcagctaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcrggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggtgggtccctgccccaagggccctggcctgtcaggtgtgg

SEQ ID NO: 128485 - DNA, 601 bp, Human
ggtacaaactcgacttactgcaaccttcgtttcctgaattcaatagatcctcccacctcagcctccctggtagctgggactacaggtgtgcaccaccacgcctggctaatttttgcaattcttgtagagatgaggttttgccatgttgcccaggctggtctcaagctcctgggcccaagtagtcctcccgccttggcctcccaaagtgctgggaatacaggcatgagccactgtgcccagcgtgggagagatattctgagggagcagagattcatatctacaggcaactacccagcttgaraaaagggaagtgtcccacagaaagttccagccagaggggcctccacgataagagaacttatcttgagggtcatggtcatgtgttcagaggccaaaaattccctgtctctatgaactaagtgattcaccctaattaggtcaacaactgctgagataaaatgataacgaaatcacttgatttggccaaaacacgtccaacagtcaggtgggtgtgggtggtttcagtgactcacagttcaaatgaattaggtgcttctctcccaggaccaactgctcccccggggatgagaaggactgtggc

SEQ ID NO: 128486 - DNA, 601 bp, Human
aggtgggaggatgcttgaggccacgagtttgagaccagcctgggcaacatagtgagacttcatttctacactttttttttttaattacccagttgtggtggctcgcacctgtggtcccagttacttgggaggtggaggcgggcggattgcttatgccctggagttcacagcagcagtgagctgtgattgcaccactgcactccagcttgggcaacagaatgagaccctgtctctaaaaataaataactaaataactaaataaataatttttaaaaaataaagtgaaaagaaggcagaggcragaggatcacttccgctcaggagtttgacaccagcctgggcaacatggcgaaacaccgtctctacagaagaaaaacaaaaacaaaaattagccacgtgtggtggtacatgcctgtagtcccagctacttgggagtctgaggctggaggatcccttcagcctgagaagtcaaagctgtactggccgggcgcagtggctcatgcctgtaatcccagcacttccagaggctgaggccagtggatcacctgaggtcaggagttcaaaaccagcctggccaacatggtgaaaccccgtctctact

SEQ ID NO: 128487 - DNA, 601 bp, Human
agaccctgtctctaaaaataaataactaaataactaaataaataatttttaaaaaataaagtgaaaagaaggcagaggcgagaggatcacttccgctcaggagtttgacaccagcctgggcaacatggcgaaacaccgtctctacagaagaaaaacaaaaacaaaaattagccacgtgtggtggtacatgcctgtagtcccagctacttgggagtctgaggctggaggatcccttcagcctgagaagtcaaagctgtactggccgggcgcagtggctcatgcctgtaatcccagcacttcyagaggctgaggccagtggatcacctgaggtcaggagttcaaaaccagcctggccaacatggtgaaaccccgtctctactaaaaatacaaaaattagccggccatgatggcgagcacctgtaatcccagctactggggaggctgaagcaggagactcacttgaatccaggaggcgaaggttgcagtgagccgagattccgccattgcattccagcctgggcaacaagagcgaaactccttttcaaaaaaaaaaaaaaaaagctgtagtgagtcaagatcatgccactgcactccagcctgg

SEQ ID NO: 128488 - DNA, 601 bp, Human
gaccctgtctctaaaaataaataactaaataactaaataaataatttttaaaaaataaagtgaaaagaaggcagaggcgagaggatcacttccgctcaggagtttgacaccagcctgggcaacatggcgaaacaccgtctctacagaagaaaaacaaaaacaaaaattagccacgtgtggtggtacatgcctgtagtcccagctacttgggagtctgaggctggaggatcccttcagcctgagaagtcaaagctgtactggccgggcgcagtggctcatgcctgtaatcccagcacttccrgaggctgaggccagtggatcacctgaggtcaggagttcaaaaccagcctggccaacatggtgaaaccccgtctctactaaaaatacaaaaattagccggccatgatggcgagcacctgtaatcccagctactggggaggctgaagcaggagactcacttgaatccaggaggcgaaggttgcagtgagccgagattccgccattgcattccagcctgggcaacaagagcgaaactccttttcaaaaaaaaaaaaaaaaagctgtagtgagtcaagatcatgccactgcactccagcctggg

SEQ ID NO: 128489 - DNA, 601 bp, Human
cctccctgctagagaggataggcaaagcaaatccaaacttggagttttaacgttcaatttttgtgacactgacattgtcagtgatagggtggcattgttaatgatagagtgaagaaaggctattcactttttcttttttctttttctttttttttgagacggagtctcgctctgtcgcccaggctggagtgtagtgctgtgatctcggctcactgcaacctctgcctcccaggttcaagtgattctcctgcctcagcctcccgagtagctgggactacaggcgcccaccaccacgcccggmtaatgttttgtatttttagtagagacggggtttcaccgtgttagcgaggacggtctcgatctcctgacctcgtgatctgctcgcctcggcctcccaaagtgctgggattacaggtgtgagccactgcacccggccaattattcaccttttctttggattctcacagagcagatggacaggcttctctggtccattagaattcagataaggtcagaacaggattttcatgaccacagctaccagttgcaaagctgcttagctccacagggttgcgctgttgcagctacctgtgcccacctg

SEQ ID NO: 128490 - DNA, 601 bp, Human
ctctgccaggcacagtagaggttgcaaaatgaatctcataattgttctacatacttgccagtgcaaaaaaaaaaaattgttttaaggaaaaagaaatttaaaatttaaattaaaagaaaaagaatctcttatacatcctgtcccaaagagattgcagtccattggaggtcaaagacaaatacagagacatcaccagataacataaaaagaaagaaatgctgaaagagaagcatgacttgtcctttgactccatgaggagggagggtcaatctcctgctgaagggaacagggaaggcttccyggaagaagtggcagggcttggttgtcctttggtggacatttgcaataaaggggagggcattctggatggaggaaccagctgtctgcaaggacaggaagaaggagatgagtgccatatacacacacacacatatatatatatagagagagagagagagagagagagattaataattttatttgggctgggcttggtggctcacacctgtaatcccagcactttgggaggcagaggcaggcagatcactcgagctcaggagtttgagaccagcctggccaacatagcaaaaccccatctcta

SEQ ID NO: 128491 - DNA, 601 bp, Human
caaagagattgcagtccattggaggtcaaagacaaatacagagacatcaccagataacataaaaagaaagaaatgctgaaagagaagcatgacttgtcctttgactccatgaggagggagggtcaatctcctgctgaagggaacagggaaggcttcctggaagaagtggcagggcttggttgtcctttggtggacatttgcaataaaggggagggcattctggatggaggaaccagctgtctgcaaggacaggaagaaggagatgagtgccatatacacacacacacatatatatatatakagagagagagagagagagagagattaataattttatttgggctgggcttggtggctcacacctgtaatcccagcactttgggaggcagaggcaggcagatcactcgagctcaggagtttgagaccagcctggccaacatagcaaaaccccatctctactaaaaatacaaaaattagccaggtgtggtggcacatgcctgtagtcccagctacttaggaggccgaggcaggagaattgcttgaacccgagagacggaagctgcagtgagtccagatcgcacccctgcactctaacctgggc

SEQ ID NO: 128492 - DNA, 601 bp, Human
aaagagattgcagtccattggaggtcaaagacaaatacagagacatcaccagataacataaaaagaaagaaatgctgaaagagaagcatgacttgtcctttgactccatgaggagggagggtcaatctcctgctgaagggaacagggaaggcttcctggaagaagtggcagggcttggttgtcctttggtggacatttgcaataaaggggagggcattctggatggaggaaccagctgtctgcaaggacaggaagaaggagatgagtgccatatacacacacacacatatatatatatagtgagagagagagagagagagagattaataattttatttgggctgggcttggtggctcacacctgtaatcccagcactttgggaggcagaggcaggcagatcactcgagctcaggagtttgagaccagcctggccaacatagcaaaaccccatctctactaaaaatacaaaaattagccaggtgtggtggcacatgcctgtagtcccagctacttaggaggccgaggcaggagaattgcttgaacccgagagacggaagctgcagtgagtccagatcgcacccctgcactctaacctgggca

SEQ ID NO: 128493 - DNA, 601 bp, Human
aagagattgcagtccattggaggtcaaagacaaatacagagacatcaccagataacataaaaagaaagaaatgctgaaagagaagcatgacttgtcctttgactccatgaggagggagggtcaatctcctgctgaagggaacagggaaggcttcctggaagaagtggcagggcttggttgtcctttggtggacatttgcaataaaggggagggcattctggatggaggaaccagctgtctgcaaggacaggaagaaggagatgagtgccatatacacacacacacatatatatatatagakagagagagagagagagagagattaataattttatttgggctgggcttggtggctcacacctgtaatcccagcactttgggaggcagaggcaggcagatcactcgagctcaggagtttgagaccagcctggccaacatagcaaaaccccatctctactaaaaatacaaaaattagccaggtgtggtggcacatgcctgtagtcccagctacttaggaggccgaggcaggagaattgcttgaacccgagagacggaagctgcagtgagtccagatcgcacccctgcactctaacctgggcag

SEQ ID NO: 128494 - DNA, 601 bp, Human
agcccctggctatgtcctgtccctcccagactccattgcaggcctgggcaatctgaaaggacctccatttactgcggagaacttccaatgtgtcccccctagatcatggagcactgcatcaagcagaacaatgccattgacatctatgaagagtatttcaatgacgaggaggccatggaagtgatggaggaggacccttcagctaaaaccatcaatgtgttcaggtagcgccatagccaggcaggtgtctggccaccctccgtcacccccatgcatgggcgcctccaaaggcaactccttkccatcgctgcatgccctgggtgcagcactgtctgtgctctgagcttgataagtgacgtggtgataagtcacccagcagagaagtggccctgctctgggggcgggtctggttgatggaaagggagtacagactccagagaaagtgaaattgcccagctgcgtacaggtggggcatgttcctgcagggcagagtaagtacaagtaccaagcatgagcagctagcagcactgtgggcacacaggcccccgccgcggcctgcactcatgcaagtatatccatgaataactccagaggatagaag

SEQ ID NO: 128495 - DNA, 601 bp, Human
cccatgcatgggcgcctccaaaggcaactccttgccatcgctgcatgccctgggtgcagcactgtctgtgctctgagcttgataagtgacgtggtgataagtcacccagcagagaagtggccctgctctgggggcgggtctggttgatggaaagggagtacagactccagagaaagtgaaattgcccagctgcgtacaggtggggcatgttcctgcagggcagagtaagtacaagtaccaagcatgagcagctagcagcactgtgggcacacaggcccccgccgcggcctgcactcatgcragtatatccatgaataactccagaggatagaagtttgacaccagggattcatcccacaggttgtgtgtgtgtgtgtgtgtgaaatcaccgcaggcgtggatattcactgcagagggtgtatgccagccaaagactagaacaagctaagtccatccataggggactggttctagcagttctggcacacccacacgacggaatgccatgcacctggtaaagcgagcggggcagtctgggcatggtggctcacgcctgtaatcccagcactttgggaggccaaggcgggtgcatcacctgagg

SEQ ID NO: 128496 - DNA, 601 bp, Human
agggagtacagactccagagaaagtgaaattgcccagctgcgtacaggtggggcatgttcctgcagggcagagtaagtacaagtaccaagcatgagcagctagcagcactgtgggcacacaggcccccgccgcggcctgcactcatgcaagtatatccatgaataactccagaggatagaagtttgacaccagggattcatcccacaggttgtgtgtgtgtgtgtgtgtgaaatcaccgcaggcgtggatattcactgcagagggtgtatgccagccaaagactagaacaagctaagtccmtccataggggactggttctagcagttctggcacacccacacgacggaatgccatgcacctggtaaagcgagcggggcagtctgggcatggtggctcacgcctgtaatcccagcactttgggaggccaaggcgggtgcatcacctgaggtcaggagttcaagactagcctggccaacatggcaaaaccccgtctctactaaaaatacaaaaattaactgggtgtggtggcacatgcctgtaatcccagctactcaggatgctgaggcaggagaatcacttgaacccgggaggcggaggttg

SEQ ID NO: 128497 - DNA, 601 bp, Human
ggcatggtggctcacgcctgtaatcccagcactttgggaggccaaggcgggtgcatcacctgaggtcaggagttcaagactagcctggccaacatggcaaaaccccgtctctactaaaaatacaaaaattaactgggtgtggtggcacatgcctgtaatcccagctactcaggatgctgaggcaggagaatcacttgaacccgggaggcggaggttgcagtgagccgagatcgcaccactgcactgcagcctgggcaatacagcaagactctgtctcaaaaaaaaaaaaaaagcagtgcarcttcttatgtgctgatatggagtcatttccaggattcagtatgtgaaaaccaaaccaaaacaaagccggtgcagaacagggtgtgcagagtgccactttttgtggcagtccccaacttaaaccattttttgtctttgcaaggctgcaaaagcaatgcaaatccaggagaaaccgtacttcaagtacccatacaaccattctgttttccaccctcagtacagtattcagaaaattacatgagctgttcacctctttattataaaataagctttgtgctaggtgattttgcccaactatagg

SEQ ID NO: 128498 - DNA, 601 bp, Human
catatgtgtatgtgtgtatatatgtgtagatgtatgtttacatgcctgatgtgaggagaacatctgtgattttggacttctggcatccggaactgtgatagaatcaatttctgttgtttgaagccacgcagtttgtgggacctcgttgcagcagccccaggaacagaataccccatcccagagcacctttgtagggtgtacaaaagaagctgataggaaggagagcttgggaacagggatggggagaagcctggggaagaaggactcctcggccttgaagtctggtggaaggagttgcagraagtgggtggaagtgagaaagaccatgctctgtggcctcggttttgaccatgaagaaaaaagcaaggccgtccaatcagatgagtggagatgagcaggaggctggaatagagcagctggggaaatgcggaggggaagcctgtggacctggggcagaggacagaccttgggtctgggtgatgcaggactaggggtgtgaaaggtgtttgggaaatgacttgcctcagatcccagctctggggaattcatttcactaccacgactgacttaggggcctgggaagtacctagcccagtcccag

SEQ ID NO: 128499 - DNA, 601 bp, Human
acctcgttgcagcagccccaggaacagaataccccatcccagagcacctttgtagggtgtacaaaagaagctgataggaaggagagcttgggaacagggatggggagaagcctggggaagaaggactcctcggccttgaagtctggtggaaggagttgcagaaagtgggtggaagtgagaaagaccatgctctgtggcctcggttttgaccatgaagaaaaaagcaaggccgtccaatcagatgagtggagatgagcaggaggctggaatagagcagctggggaaatgcggaggggaagcytgtggacctggggcagaggacagaccttgggtctgggtgatgcaggactaggggtgtgaaaggtgtttgggaaatgacttgcctcagatcccagctctggggaattcatttcactaccacgactgacttaggggcctgggaagtacctagcccagtcccagcacagcaagaaagaactcttttctgaggcagggctgactcatggtgtgcaagcagggccagtggctgtcagcaaggggtgtgcaggagagggcatggcggggcagaggctgcccttcctgttgccctccagccctgctg

SEQ ID NO: 128500 - DNA, 601 bp, Human
cctggggcagaggacagaccttgggtctgggtgatgcaggactaggggtgtgaaaggtgtttgggaaatgacttgcctcagatcccagctctggggaattcatttcactaccacgactgacttaggggcctgggaagtacctagcccagtcccagcacagcaagaaagaactcttttctgaggcagggctgactcatggtgtgcaagcagggccagtggctgtcagcaaggggtgtgcaggagagggcatggcggggcagaggctgcccttcctgttgccctccagccctgctgggctctracctcgtatatggaccaccagagcaggatgatgcattagaaatcatccgaggggccgggcactgtggctcacgcctataatcttagcactttgggaggcccaggtgggcatatcatctgaggtcacgagtttgagaccagcctaggaaacatggtaaaaacctgtctctactaaaaatacaaaaattagccaggcgtggtggtgtgcgcctgtaatcgtagctactcgggaggctgaggcaggagaattgtttgaacccaggaggcagaggttgcagtgagccgagattatgccactgcc

SEQ ID NO: 128501 - DNA, 601 bp, Human
tgccactgcactccatcctgggcaacagagtgagactctatctcaacagcaacaacaagacagagtgcccagcagactgagaagggactcaaggggcggcggaatggaacttgtgcctttgtcccatctgtcctgacacttgcctttaattcatggcctgcaggggcagcgtgtccatttattagcacaaaccattgtctacagaagggctggcaagacacaggcagggacagggtggtggtggcttcacgctctccagcttcccttcgttgtcagcattattaaaataaacatgtaggtrccaggcagagagctaacgcccgacattccaacagctcagcgagttctggcagcagccctatggggtggactccgtcattatctgcagtccacagacctggttggaagaaaccggcagagagttgactttgtgtaaaaactttagtatcaaaacctcgtttcacaccaaacctaggaactggactagaaatataattatcacacacatacgcacaccccaatcctgttcaccaaaaataaaaaccatcagcaaagcccctagggtcaagaatgccagattctggccaaggtggaccagggg

SEQ ID NO: 128502 - DNA, 601 bp, Human
gcagacacgggtgaggcaggtttggctgacacctcagcagtgtctcctgttactactgtaagtctaaaattagctcaaaataaacagttttaaaaaactatagttcaagtaaaatcagagaatatttgactaggggccgccataaagggatgatgagagcgttggggagccctattttgggagaggtttctgggaaacctacatgctaacggatatgggtaatactggccttatagaatgagttgggaagtgttcccttctggaagtttgtgaagaattgatattaattttttttttttttgagatggagtctcgctctgtcgcccaggccggagtgcagcggtgcagtctcagctcactgcagcctccacctctcggattcaagtgattctcctgcctcagcctcctgagtagctgggactacaggctcatgccaccacgcctggctaattttgtcttttttcagtagagttagggtttcactatgttggccagacttgtctcaaattcctgacctcaagtgatcctccctccttggccttccaaagtactgggattactggcgtgagccaccatgcctggccgctattaattcttgaaa

SEQ ID NO: 128503 - DNA, 601 bp, Human
gctgagcctacaggcatgtgccaccacactcggctaatttttgtagtttttttagtcacaaggtttcatcatgctgcccaggctggtcttaaactcctgggctcaagggatccgcctgccttggctggcctcccaaagtgctgggatgaaccaccacacctggcctgatttcagtcttttaaaatttattgagacttgttttatggcctagcatattgtctatcctggagaatgttccatgagcacttgagaagactatattctgcttattgtccggtgtagttttcctttttttttttttgggacggagtcttgctctttcgcccaggctggagtgcagtggcgcgatcttggcccactgcaagctctgcctcctgggttcacgccattctcctgcctcagccttccgagtagctgggactacaggtgcctgccaccacgctgggctaattttttgtatttttttttagtagagacggggtttcaccgtgttagccaggatggtctcgatctcctgacctcgtgatccgcccgcctcggcctcccaaagtgctgggataacaggcgtgagccaccgtacctggcctgtccagtggagttt

SEQ ID NO: 128504 - DNA, 601 bp, Human
ttgagacttgttttatggcctagcatattgtctatcctggagaatgttccatgagcacttgagaagactatattctgcttattgtccggtgtagttttcctttttttttttttgggacggagtcttgctctttcgcccaggctggagtgcagtggcgcgatcttggcccactgcaagctctgcctcctgggttcacgccattctcctgcctcagccttccgagtagctgggactacaggtgcctgccaccacgctgggctaattttttgtatttttttttagtagagacggggtttcaccrtgttagccaggatggtctcgatctcctgacctcgtgatccgcccgcctcggcctcccaaagtgctgggataacaggcgtgagccaccgtacctggcctgtccagtggagttttctatagttgtctgggaggtcttgtctatagtgttggtcaagacttctatttccttgttgatctttcacgtagtaattatgtctattattgaaagtaggatactgatgtctgccattattattgttgaattgtctatttctccttcaattttgtcaggttttgcttcctgtatgttaaggctatgtta

SEQ ID NO: 128505 - DNA, 594 bp, Human
gacttctatttccttgttgatctttcacgtagtaattatgtctattattgaaagtaggatactgatgtctgccattattattgttgaattgtctatttctccttcaattttgtcaggttttgcttcctgtatgttaaggctatgttattaggtacatgcacatgcttataattgttaagttttcctagtgaattaacccttttatcagtatatgatgtcttcatttgtctctagtagcatttttcatctcaaagtctgtctttgagataagcactccagccctctttggttaccatttgcrtggtatatctttccccatccttttacttttaacctgtttgcctctttgaatctaaagtatgtcttgtagccaggtgtggtgacacgcacctgtaatcccagctacttgggaggctaaggcacgagaatcgcttgaacctgggaagctgagattgcagtgagtcgagatcatgccactgaactccagcctgggtgacagagcgagactccatctcaaaaaaataaaaataaaataaaaaaataaagtatgtctcttgtagattacatgtagctggcatacaagtgaatcatagt

SEQ ID NO: 128506 - DNA, 442 bp, Human
ttcaagcgattctcctgcctcagcctcccgagtagcagggattacaggtgcatgccaccacgcccagctaatttttgtagttttggagagatgaggttttaccatgttggccaggctgatctcgaactcctggcctcaagcratatgcccacctcggcctcccaaagtgctgggattacaggcatgagccaccacgcccagcttggatcgtggttttttccttttaatctattctatctatctctggttttaagtggagagtttaatctatttacattaattactgataaagtttacatctgccattttgcttttttttcctatatgtcttaaatctttttgttctttctccataactgccttcttttgtgccacgtattttctagtgtaccattttaattcccttatcatttcttttttttttttcttttctttttttttt

SEQ ID NO: 128507 - DNA, 601 bp, Human
aagcaatcctcccacctcagcctcctgagtggttgggacaacaggtgcacgtcaccacactcagctacttttttattttttaatttttgtagagatagggtcttgctatgttgcccaggctggtcttgaactcctggcctcaggcaattctcccaccttggcctcccaaagtgctgggatttcaggcgtgagccaccacactcaacttaagctattgatcttattgatgatcctgtgtatgtgatgagtcatttttctcttgctgctttcaagagtctctgtcttcagctttgattatgaygtttctaggtatggatatctttgagtttatcccacttggaattcattgagtttcttggatgtgtagattatttttttaaaaatcaaatatggaatatttacaaccattatttattcaaatattctttcctaccctttctctctctcctctccttctgtgacttccattatatgtatgttggcatgcttgatggtgtcccataggtctttagactctgtttttctttgttctcttttctttctattcctcagactacataatctcaattgacccatcttcacgttcagtgattcttctgcc

SEQ ID NO: 128508 - DNA, 601 bp, Human
tgctgggatttcaggcgtgagccaccacactcaacttaagctattgatcttattgatgatcctgtgtatgtgatgagtcatttttctcttgctgctttcaagagtctctgtcttcagctttgattatgatgtttctaggtatggatatctttgagtttatcccacttggaattcattgagtttcttggatgtgtagattatttttttaaaaatcaaatatggaatatttacaaccattatttattcaaatattctttcctaccctttctctctctcctctccttctgtgacttccattatrtgtatgttggcatgcttgatggtgtcccataggtctttagactctgtttttctttgttctcttttctttctattcctcagactacataatctcaattgacccatcttcacgttcagtgattcttctgcctgctcaaatatgccatcctgtagcttcgctgctatatttttattttggttaatgactccagaatttctattttgttctttcttttaaaaataatttctgtctcatttggatgtggtggctcgtgcctggaatcctagcactttgggaggctgaggtgggtggattacctga

SEQ ID NO: 128509 - DNA, 601 bp, Human
tatcccacttggaattcattgagtttcttggatgtgtagattatttttttaaaaatcaaatatggaatatttacaaccattatttattcaaatattctttcctaccctttctctctctcctctccttctgtgacttccattatatgtatgttggcatgcttgatggtgtcccataggtctttagactctgtttttctttgttctcttttctttctattcctcagactacataatctcaattgacccatcttcacgttcagtgattcttctgcctgctcaaatatgccatcctgtagcttckctgctatatttttattttggttaatgactccagaatttctattttgttctttcttttaaaaataatttctgtctcatttggatgtggtggctcgtgcctggaatcctagcactttgggaggctgaggtgggtggattacctgaactcaggagttcaagaccagcatgggcaacatggtcaaaccccatctctacttaaaaaaaaaaaaaaaaaaatcagccaggtgaggtggagtgcacctgcaatctcagctacttgggaggctgaggcaagagaattgcttgaacccaggaggcagag

SEQ ID NO: 128510 - DNA, 601 bp, Human
ttctttcctaccctttctctctctcctctccttctgtgacttccattatatgtatgttggcatgcttgatggtgtcccataggtctttagactctgtttttctttgttctcttttctttctattcctcagactacataatctcaattgacccatcttcacgttcagtgattcttctgcctgctcaaatatgccatcctgtagcttcgctgctatatttttattttggttaatgactccagaatttctattttgttctttcttttaaaaataatttctgtctcatttggatgtggtggctcrtgcctggaatcctagcactttgggaggctgaggtgggtggattacctgaactcaggagttcaagaccagcatgggcaacatggtcaaaccccatctctacttaaaaaaaaaaaaaaaaaaatcagccaggtgaggtggagtgcacctgcaatctcagctacttgggaggctgaggcaagagaattgcttgaacccaggaggcagaggttgcagtaagttgagattgtgccactgcactccaggctgggcaacaaagcgaaactctgtcttcaaaaataataatgataatgatttttgtct

SEQ ID NO: 128511 - DNA, 601 bp, Human
aatctcaattgacccatcttcacgttcagtgattcttctgcctgctcaaatatgccatcctgtagcttcgctgctatatttttattttggttaatgactccagaatttctattttgttctttcttttaaaaataatttctgtctcatttggatgtggtggctcgtgcctggaatcctagcactttgggaggctgaggtgggtggattacctgaactcaggagttcaagaccagcatgggcaacatggtcaaaccccatctctacttaaaaaaaaaaaaaaaaaaatcagccaggtgaggtrgagtgcacctgcaatctcagctacttgggaggctgaggcaagagaattgcttgaacccaggaggcagaggttgcagtaagttgagattgtgccactgcactccaggctgggcaacaaagcgaaactctgtcttcaaaaataataatgataatgatttttgtctatttgtatcttttatttggtgagagatcatctcatgcttttctttagttctttcgatgtgacttcctttagttctttgaacatgtttagcatagctgatgtgaggcctttgtctagttagtccaatatctgggcttc

SEQ ID NO: 128512 - DNA, 601 bp, Human
ttgtgccactgcactccaggctgggcaacaaagcgaaactctgtcttcaaaaataataatgataatgatttttgtctatttgtatcttttatttggtgagagatcatctcatgcttttctttagttctttcgatgtgacttcctttagttctttgaacatgtttagcatagctgatgtgaggcctttgtctagttagtccaatatctgggcttcttggggacaatctctatttattgcttttttattcctgtgtttgggccatacatttgtatttcttggcatgtcttataatttttttttattaaaaactatactttttgtatgatttaatgtggcaactttgcaaatcagattgacatacctcccagagtttgtgttgttgctgtttgttgtagttgttctttgtttcattaatacattttcttagctagttctggaaagtctgtattccctgtcacgtgtgaccacttatagtctctgcttagcttagtgattagttaatgattgaacaaagatttccttaagcatttgtcaccaaaaaatctccccttctctgctaaggggctctgtgtgcgtgtgtgagcatgcctttacactcag

SEQ ID NO: 128513 - DNA, 601 bp, Human
gtggcaactttgcaaatcagattgacatacctcccagagtttgtgttgttgctgtttgttgtagttgttctttgtttcattaatacattttcttagctagttctggaaagtctgtattccctgtcacgtgtgaccacttatagtctctgcttagcttagtgattagttaatgattgaacaaagatttccttaagcatttgtcaccaaaaaatctccccttctctgctaaggggctctgtgtgcgtgtgtgagcatgcctttacactcagccaggcagttgtcaactctgccttagtgtctrtgcagagatgaggtcagccagagagtttagggctttatcggttttcctgagcatgacacagctctgggcgtgcacacagctctatccatgcttgtgaccttctagactcccaggaatatgtcagatcttttcaaagccctgtggacacatcatgcttcagcttttccttttacttatttacttttgttgtttaaatgtaatagaagttgagcacagtggctcacgtctgtaatcctaacactttgagaagctgaggcgggaggatcgcctgcattcaggagtttgaaactagcctgtgca

SEQ ID NO: 128514 - DNA, 601 bp, Human
aatgtgaattttcaaggccaccacggaactgcagagtgtgcgatcttaactagggcaagtgaaaatgccactgttcttaccaagattctgctgtttttcttgaataaacattctcccgactgccctaagcctctggctaatttccagagttctgaaaaacttgattctgaccatttttgccagttttctcactgctattatggaggagagaatttttggaggtccttacttcacggattttgctgatggcacacctggaaaactgatttttgtttgtttgtttctttgagacagagtctcrctgtgtcacctaggctggagtgcaatgtcacgatcttggctcactgcaagctccgcctcccaggttcatgccattctcctgcctcagcctcccgagtagctgggactacaggtgcccgccaccacgcccagctaatgttttgtattttttttttttagtagagacggggtttcgctgtgttagccaggatggtcttgatctcttgacctcgtgatctgcctgcctcggcctcccaaagtgctgggattacaggcatgagccaccgtgcccagactttttttttttttttttgagacaggg

SEQ ID NO: 128515 - DNA, 601 bp, Human
ttttgccagttttctcactgctattatggaggagagaatttttggaggtccttacttcacggattttgctgatggcacacctggaaaactgatttttgtttgtttgtttctttgagacagagtctcgctgtgtcacctaggctggagtgcaatgtcacgatcttggctcactgcaagctccgcctcccaggttcatgccattctcctgcctcagcctcccgagtagctgggactacaggtgcccgccaccacgcccagctaatgttttgtattttttttttttagtagagacggggtttcrctgtgttagccaggatggtcttgatctcttgacctcgtgatctgcctgcctcggcctcccaaagtgctgggattacaggcatgagccaccgtgcccagactttttttttttttttttgagacagggtcttgctctgtcacccaggctggagtacagtggtgtgatctcagctcactgccacctccgcctcctgggttcaagcgatcctcctgcctcagcctccccagaggctggtgcatgccaccacgcctggctaatttttgtatttttaatagaaacagagttttgtcatgttggcca

SEQ ID NO: 128516 - DNA, 601 bp, Human
aagcattccccactcctctctgctctgtatgttcttatacttttgctgcttcttcgggagtgggagccaggatggctgagaaactcctcctctgaagctgtctgtagtcagctgcttcctaaggccccgatctccctctcagacctgctgcctcctgcccaggggagctttcagattatggaatagacccgggctcccataaacgtccctgccaaactatctgggtgccagagctctaaaagactgaggcagagccactttgccatgattaattcaggagccttgactcagtcattattcataacctctttcagtggtttttcatgccagctcataccagcccagactctggtgctccgctgctccaagaagggcccctctagggccatgtgggacccagtgggacctactcttgagcactgctttgccaaagtagaacaggcttatcttttatttttatttatttttattttttgttttgtttttgagacagccttgctttgttgcccaggctggagtgcaatggcgtgatctcagctcactgcaacatctgcctcccaggtgcgagtgattctcatgcctcagcctcctgagaagctgg

SEQ ID NO: 128517 - DNA, 601 bp, Human
tacttttgctgcttcttcgggagtgggagccaggatggctgagaaactcctcctctgaagctgtctgtagtcagctgcttcctaaggccccgatctccctctcagacctgctgcctcctgcccaggggagctttcagattatggaatagacccgggctcccataaacgtccctgccaaactatctgggtgccagagctctaaaagactgaggcagagccactttgccatgattaattcaggagccttgactcagtcattattcataacctctttcagtggtttttcatgccagctcatacmagcccagactctggtgctccgctgctccaagaagggcccctctagggccatgtgggacccagtgggacctactcttgagcactgctttgccaaagtagaacaggcttatcttttatttttatttatttttattttttgttttgtttttgagacagccttgctttgttgcccaggctggagtgcaatggcgtgatctcagctcactgcaacatctgcctcccaggtgcgagtgattctcatgcctcagcctcctgagaagctgggattacaggtgcctgccaccacgcccagctaattttt

SEQ ID NO: 128518 - DNA, 601 bp, Human
ctgccaccacgcccagctaatttttttgtgtttttagtaaagatggggtttcatcatgttggccaggctggtcttgaactcctgaccacaagtgatccacctgcctcagcctcccaaagtgctgggattacaggtgtgagccaccaggcctggcctatttttattttttgagacagggtcttgctctgtcacccaggctggggtgtagtggcacgatcatggctcactgcagcctcaacctcccaggctcaagcaattctcccacctcagcctcccgagtagcaggcagcctcccgagtarcagcctcccgagtagcatgtgccaccatgcccagctaggttttaaattttttgtagagacggggtctcactatgttgcccaagctgctcttggattcctgggctcaagcaatccttttgcctcggcctcctaatgcgctaggattacaagcatgagccactgtgcttggctgagcaggcgtatctaagaaaacatatttctgggccagctgagttcagggaaaatgccttgaacttggagaaatactaagtcaaagcttacgagctaagtacttttgttattttacaaaacggcctttcc

SEQ ID NO: 128519 - DNA, 601 bp, Human
actctgggagtctctccagagagtctgtagaggctggtaggaaactcaggctgatttgaaccaagccctgattctagaaaaccacatacctgccaaaccagaagcagcagccccctctctcccctgctccctgccctaaggaaggaagcctgtgcccccttccactccttcttcatctccttcctcaccagcctgctgggacacccgaaagggcagcctggtggcggagctatccaccattgagtccagccaccgagaccctgtgtatggcaccatctggctgcagtcgaagacgggcacygagtgcttctcagcttccacggatgggcaggtacccaccagccagacactggagagaggagggaagggaggggcagtaactgttccctggttccccatcagaacccctggggacatttcctttaacacattttattttgagatggagtttcactcttgttgcccaggctggagtgcaatggcacgatcttggttcactgcaacctctgcctcccgggttcaagcaattctcctgcctcagcctcccaagtagctgggattacaggcgcctgccactatgcctggttaattttttattttt

SEQ ID NO: 128520 - DNA, 601 bp, Human
ccaggctggagtgcaatggcacgatcttggttcactgcaacctctgcctcccgggttcaagcaattctcctgcctcagcctcccaagtagctgggattacaggcgcctgccactatgcctggttaattttttatttttagtagagatggtgcttcactatgttggccaggctggtctcgaactctgacctcaggtgatccacccgccttggcctcccaaagtggtgggattacaggcatgagccactgcgcccagcctaacactttatttttaagttgagtagtgataatacatgcccacrgaacagaatctaaagggtgcaaaaaagaaaatgccttcctctcacctctgcctgcacctcctcccctccctccctctcttatgtctgccttcagagctagtctctgcgtatgcaaggaaacacacctctctcttctttactctttctttttgcacacttcacacactattctgtactcgatgttttccattgtgtgtaccttggagatagtttcatatttcatacaccgctgccccatgcctattaataactgcatcatgtgggtgtaccataatttatatatggattctaatattttgt

SEQ ID NO: 128521 - DNA, 601 bp, Human
tcagcctcccaagtagctgggattacaggcgcctgccactatgcctggttaattttttatttttagtagagatggtgcttcactatgttggccaggctggtctcgaactctgacctcaggtgatccacccgccttggcctcccaaagtggtgggattacaggcatgagccactgcgcccagcctaacactttatttttaagttgagtagtgataatacatgcccacggaacagaatctaaagggtgcaaaaaagaaaatgccttcctctcacctctgcctgcacctcctcccctccctccmtctcttatgtctgccttcagagctagtctctgcgtatgcaaggaaacacacctctctcttctttactctttctttttgcacacttcacacactattctgtactcgatgttttccattgtgtgtaccttggagatagtttcatatttcatacaccgctgccccatgcctattaataactgcatcatgtgggtgtaccataatttatatatggattctaatattttgttgctaccccccaaaaaatacagcaaagagcatctttatacacagattgttgcacacatgcggggatatatctac

SEQ ID NO: 128522 - DNA, 601 bp, Human
taaagggtgcaaaaaagaaaatgccttcctctcacctctgcctgcacctcctcccctccctccctctcttatgtctgccttcagagctagtctctgcgtatgcaaggaaacacacctctctcttctttactctttctttttgcacacttcacacactattctgtactcgatgttttccattgtgtgtaccttggagatagtttcatatttcatacaccgctgccccatgcctattaataactgcatcatgtgggtgtaccataatttatatatggattctaatattttgttgctacccccmaaaaaatacagcaaagagcatctttatacacagattgttgcacacatgcggggatatatctacagcagacattgctggcagtgggacttctaggtcggagcacacatgcatttttaacattgccggatattgccttattgtggggagtcttggcatataccgattcttggccttgcacctggaggttttgattcagtaggtcgagggcgaggcctcagcatctgggttgtatgaagcttgccggcgactctgatgatcagccaggtgtgggaactgtggacagaacagcaatcctcaaag

SEQ ID NO: 128523 - DNA, 601 bp, Human
agcagacattgctggcagtgggacttctaggtcggagcacacatgcatttttaacattgccggatattgccttattgtggggagtcttggcatataccgattcttggccttgcacctggaggttttgattcagtaggtcgagggcgaggcctcagcatctgggttgtatgaagcttgccggcgactctgatgatcagccaggtgtgggaactgtggacagaacagcaatcctcaaagtgtatttgctcccacgaattgccgggagctccatcctttgtggcccagtggctgaccccaggayggtggggtgagggcggagaaggcaaaagccaggggaaatacagggcctcgaagtctcactgtcgcccctcctcccaccaggtcatgtggtgggacatccgaaagatgagcgagcccactgaagttgtgatcttggacatcaccaagaaggaacagttggaaaatgccttgggggccatctccctggagttcgaatctactttggtgagtgtcccttgctgtcccttccccgacttgcattgacagggcagccagggctaaagacaggccattgctaggatatcaggtgctcgtggaaccc

SEQ ID NO: 128524 - DNA, 601 bp, Human
gtggggagtcttggcatataccgattcttggccttgcacctggaggttttgattcagtaggtcgagggcgaggcctcagcatctgggttgtatgaagcttgccggcgactctgatgatcagccaggtgtgggaactgtggacagaacagcaatcctcaaagtgtatttgctcccacgaattgccgggagctccatcctttgtggcccagtggctgaccccaggacggtggggtgagggcggagaaggcaaaagccaggggaaatacagggcctcgaagtctcactgtcgcccctcctcccrccaggtcatgtggtgggacatccgaaagatgagcgagcccactgaagttgtgatcttggacatcaccaagaaggaacagttggaaaatgccttgggggccatctccctggagttcgaatctactttggtgagtgtcccttgctgtcccttccccgacttgcattgacagggcagccagggctaaagacaggccattgctaggatatcaggtgctcgtggaacccagcaccagcccagggaggccaccctcactgcagccatcctagacgtgtgtggcctttacaacaactttccagcagg

SEQ ID NO: 128525 - DNA, 601 bp, Human
cttgtttgcttcggggtcatgggccatcattcctagggctttgggaggccctggcctcgaacatacctgggcaaccctagctcaaggctgagagatgaatgttgatggaaggaggagacaattccactgaccccctccccagaggacaaggcactgggcagggaggttggggtggcgagggctcaggaaaacattctgtcccagaggcaaggctttctaggccaagtgctagacatgcagccacatcactactagggccatctcctccatgcctggcccttgcagggtgcacactgtgtgytggacacttgtggctgcctgatttaataagcttgtgcagtcgcctacaaccatctcgtggggtaatgttattatccgtacttgccagacacacacgatgagtcttcatgagattaggttgtgagtcctagtacctggtaaagctgggactcaaacccagggctccaactctgaggcccagggtgtccacctgcagcccaccatgaagtctgaggctagaggcacgatgggccactcagatctgggtggcctttctctctggctcactgacgggcggcgtgcagtcggcttgaatactttc

SEQ ID NO: 128526 - DNA, 601 bp, Human
gacaaggcactgggcagggaggttggggtggcgagggctcaggaaaacattctgtcccagaggcaaggctttctaggccaagtgctagacatgcagccacatcactactagggccatctcctccatgcctggcccttgcagggtgcacactgtgtgttggacacttgtggctgcctgatttaataagcttgtgcagtcgcctacaaccatctcgtggggtaatgttattatccgtacttgccagacacacacgatgagtcttcatgagattaggttgtgagtcctagtacctggtaaagcygggactcaaacccagggctccaactctgaggcccagggtgtccacctgcagcccaccatgaagtctgaggctagaggcacgatgggccactcagatctgggtggcctttctctctggctcactgacgggcggcgtgcagtcggcttgaatactttcttctctggacctctcaagcttggtctttccacttgcccttgacgcccaacttgaagcccagatttttgttttgttttgttgagacatcgttttgctctgttgcccatgctggagtgcagttgtgtaatctcagcttactgcaac

SEQ ID NO: 128527 - DNA, 601 bp, Human
ctcaggaaaacattctgtcccagaggcaaggctttctaggccaagtgctagacatgcagccacatcactactagggccatctcctccatgcctggcccttgcagggtgcacactgtgtgttggacacttgtggctgcctgatttaataagcttgtgcagtcgcctacaaccatctcgtggggtaatgttattatccgtacttgccagacacacacgatgagtcttcatgagattaggttgtgagtcctagtacctggtaaagctgggactcaaacccagggctccaactctgaggcccagrgtgtccacctgcagcccaccatgaagtctgaggctagaggcacgatgggccactcagatctgggtggcctttctctctggctcactgacgggcggcgtgcagtcggcttgaatactttcttctctggacctctcaagcttggtctttccacttgcccttgacgcccaacttgaagcccagatttttgttttgttttgttgagacatcgttttgctctgttgcccatgctggagtgcagttgtgtaatctcagcttactgcaacatccacctcccgggctcaagcctcagcctcttgagca

SEQ ID NO: 128528 - DNA, 601 bp, Human
ggaatgctgaggacacagcaccattgtaggctcaggccctgctggtggaggttgttcagtctagcccagaagttaagacagaacagtaaacaaggaagggcattgcgtgatggagggggtcatgctcagagacgcgaggggagcactggaccaggagtcaggagaccagcctttgtgcattcagtccgcagtgaagtgaataactactaaagctcagttcgtgggcgatggacccatgtcagacaagctcgtgcccctcaaagagctcacccaccagtggtagggggacgagttacatcaycgactgccaggtagcttcctgagtgctggttggtcacctgctctgagttctcagggacaccagcctggacaatgctatgacaaatgtcactgtcttgccagggaaggctctgcccatcccatgagtgatctgggtgggccaccctgcgtcccctccctgggtcttctttactctctctgtaaacaaacattcaggatctttatggccaaatgcatcgaggacacagtggtgctctgcagagggggctagtgacctgacaaccctccaggactggaggagccagggagggcttcattcagc

SEQ ID NO: 128529 - DNA, 601 bp, Human
actggaccaggagtcaggagaccagcctttgtgcattcagtccgcagtgaagtgaataactactaaagctcagttcgtgggcgatggacccatgtcagacaagctcgtgcccctcaaagagctcacccaccagtggtagggggacgagttacatcatcgactgccaggtagcttcctgagtgctggttggtcacctgctctgagttctcagggacaccagcctggacaatgctatgacaaatgtcactgtcttgccagggaaggctctgcccatcccatgagtgatctgggtgggccaccctgcgtcccctccctgggtcttctttactctctctgtaaacaaacattcaggatctttatggccaaatgcatcgaggacacagtggtgctctgcagagggggctagtgacctgacaaccctccaggactggaggagccagggagggcttcattcagcacaggctccttgagcagcttccaaaaagatggggtctgaggagcccgggaagagtggggactgctctccaggaggggccacagcccttgccaaggcttgatctgagggcctttctagcgcctgcagaccccccaagcaagctcc

SEQ ID NO: 128530 - DNA, 601 bp, Human
gaccaggagtcaggagaccagcctttgtgcattcagtccgcagtgaagtgaataactactaaagctcagttcgtgggcgatggacccatgtcagacaagctcgtgcccctcaaagagctcacccaccagtggtagggggacgagttacatcatcgactgccaggtagcttcctgagtgctggttggtcacctgctctgagttctcagggacaccagcctggacaatgctatgacaaatgtcactgtcttgccagggaaggctctgcccatcccatgagtgatctgggtgggccaccctgcrtcccctccctgggtcttctttactctctctgtaaacaaacattcaggatctttatggccaaatgcatcgaggacacagtggtgctctgcagagggggctagtgacctgacaaccctccaggactggaggagccagggagggcttcattcagcacaggctccttgagcagcttccaaaaagatggggtctgaggagcccgggaagagtggggactgctctccaggaggggccacagcccttgccaaggcttgatctgagggcctttctagcgcctgcagaccccccaagcaagctcctgtc

SEQ ID NO: 128531 - DNA, 601 bp, Human
ctgagttctcagggacaccagcctggacaatgctatgacaaatgtcactgtcttgccagggaaggctctgcccatcccatgagtgatctgggtgggccaccctgcgtcccctccctgggtcttctttactctctctgtaaacaaacattcaggatctttatggccaaatgcatcgaggacacagtggtgctctgcagagggggctagtgacctgacaaccctccaggactggaggagccagggagggcttcattcagcacaggctccttgagcagcttccaaaaagatggggtctgaggakcccgggaagagtggggactgctctccaggaggggccacagcccttgccaaggcttgatctgagggcctttctagcgcctgcagaccccccaagcaagctcctgtccatgcccgctaatcccagaattgatggttcgtggagtcttcccctcctgtgtcactccttccacagcccaccaagttcatggtggggaccgagcagggcatcgtcatctcctgcaaccgcaaggccaagacgtcagctgagaagattgtgtgcaccttcccgggccatcatggccccatctacgccctccagaga

SEQ ID NO: 128532 - DNA, 601 bp, Human
gcttcattcagcacaggctccttgagcagcttccaaaaagatggggtctgaggagcccgggaagagtggggactgctctccaggaggggccacagcccttgccaaggcttgatctgagggcctttctagcgcctgcagaccccccaagcaagctcctgtccatgcccgctaatcccagaattgatggttcgtggagtcttcccctcctgtgtcactccttccacagcccaccaagttcatggtggggaccgagcagggcatcgtcatctcctgcaaccgcaaggccaagacgtcagctgaraagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaagaggcgatgctggggacaggaggggatgcaggagacaggaggggatggagggagcccagctgggccccggagagtcccgagcctccatatgtaaaatggagaaaaacctttccacaaacacccgagctcgtgttagcaagtgacttg

SEQ ID NO: 128533 - DNA, 601 bp, Human
cctgacggttggcgactggacagcccgcatttggtctgaagacagccgggaatcgtccatcatgtggaccaagtaagaggcgatgctggggacaggaggggatgcaggagacaggaggggatggagggagcccagctgggccccggagagtcccgagcctccatatgtaaaatggagaaaaacctttccacaaacacccgagctcgtgttagcaagtgacttgctccagccactccacaaagtgataagcttcaaacactcagttactaaaaataatggccatggcttaattttatttccytttttttttttttttttttttgagacagtctcgcttagttccccagactgagtgcagtggcgtgatctcggctcactgcagcctccacctcccaggttcaagagactctcctgcctcagcctcctgagtagctgggactacaagcacctgccaccatgcccaactaatttttgtatttttagtagagatgggattttgccacgttggccaggctggtcttgaactcctgacctcaggtgatccgcccacctcggcctcccaaagcgttgggattacaggtgtgagccaccgcgtctggct

SEQ ID NO: 128534 - DNA, 601 bp, Human
aattctaaccacccccttgagtcattcaccaccgagcactgccatgtgtattgtgcattgcatgtataaataattacttttttctcttgctaaaaaaaacatcctggggttcctttcctgcccacagaaccacagactcctgcaacgtcaaagccaccagcaaccctaatgagcatctttggttccagtgcttcccaaatctggttgcatcagaatatcttgggaggagtttttgtttgtttgttaaaatgcttttgagatggagtcttactctgtcacccaggctgaagtgcaatggcgmgatctcggctcactgcaacctccgcctcccgagttcatgcgattctcctgccttatcctcctgagtagctgggattacaggcgcacgccagcacacccagctaatttttgtatttttagtacagacagagtttccccatgttggccaggctggtctcaaactcctgacctcaggtgattcgcctgcctcagcctcccgaagggctgggattacaggcatgagccaccgtgcctggtggaggagtgatttttttaaaatccagattctcagccccaaccctgggggtactaacatagaatc

SEQ ID NO: 128535 - DNA, 601 bp, Human
ttcaccaccgagcactgccatgtgtattgtgcattgcatgtataaataattacttttttctcttgctaaaaaaaacatcctggggttcctttcctgcccacagaaccacagactcctgcaacgtcaaagccaccagcaaccctaatgagcatctttggttccagtgcttcccaaatctggttgcatcagaatatcttgggaggagtttttgtttgtttgttaaaatgcttttgagatggagtcttactctgtcacccaggctgaagtgcaatggcgcgatctcggctcactgcaacctccrcctcccgagttcatgcgattctcctgccttatcctcctgagtagctgggattacaggcgcacgccagcacacccagctaatttttgtatttttagtacagacagagtttccccatgttggccaggctggtctcaaactcctgacctcaggtgattcgcctgcctcagcctcccgaagggctgggattacaggcatgagccaccgtgcctggtggaggagtgatttttttaaaatccagattctcagccccaaccctgggggtactaacatagaatcttgggcttagcccaggaatgggtt

SEQ ID NO: 128536 - DNA, 601 bp, Human
cacagaaccacagactcctgcaacgtcaaagccaccagcaaccctaatgagcatctttggttccagtgcttcccaaatctggttgcatcagaatatcttgggaggagtttttgtttgtttgttaaaatgcttttgagatggagtcttactctgtcacccaggctgaagtgcaatggcgcgatctcggctcactgcaacctccgcctcccgagttcatgcgattctcctgccttatcctcctgagtagctgggattacaggcgcacgccagcacacccagctaatttttgtatttttagtayagacagagtttccccatgttggccaggctggtctcaaactcctgacctcaggtgattcgcctgcctcagcctcccgaagggctgggattacaggcatgagccaccgtgcctggtggaggagtgatttttttaaaatccagattctcagccccaaccctgggggtactaacatagaatcttgggcttagcccaggaatgggtttgctaaggagcaaccccaggcttgtgactcagccagtccttgctttgggagcagaaacctggttcgatgtcctcattctacaggggtgggaacgctgg

SEQ ID NO: 128537 - DNA, 601 bp, Human
aatgcctgtaatcccagcactttgggaggctgaggcgggaggatcacttgaggtcaggagttcaagacgagcctggccaatatggtgaatccccatctctaataaaaatacaaaaaatcagctgggcttggtggctaacgcctgtaatcccagcactttgggaggccgaggcgggtggatcacctgagatcaggagttcaagaccagccgagattgcgccactgcactccagcctgggcgacagagtgagactccgtctcaaaaaaaaataatatttggcacttagttaaatctgaatttwaaaaaaaaaaactattttttttttagtataagtatgtcccatgcaatatttggtatatacttatactaaaaattattcattgtccaaaaatctccagatgtttctttttttggggggatgaagtctctttgttgcccaggctggagtgcagtggcacgatcttggctcactacaaccttcacctcctgggttcaagcaattcttctgcctcagcctcctgagtagctgggattacaggcgcccaccaacacccctggataatttttttatttttagtagaggcagggttctgccatgttg

SEQ ID NO: 128538 - DNA, 601 bp, Human
gaccaggtccagcaacacgtgcctgctgcctggagttagcagcagagaaatgccagtggccagcccacgggaaggactgtgcccagagccctttctttattttatttgagacagggtctcactacgttgcccaggctggagtacagtggcacaaacatggctcactgcagcctcgacctcctgggctcaagcgatcctcccatctcagcctcccgaggagctgggaccacaggtgctcaccaccacacccggctaatttttttattttttgtagaaacagggtctttccttgttgtccagkctggtctcaaaatcctggcttcaagcgatcttcctgccttggcctcccgaagtgctgggattacaggcacatgaccagcccagagccctttaaagaacagcctgtcagacacctgaggtcaagagtttgagagcagcctggccaacatggtgaaaccccatctctagcaaaaataaaatattagctgggtgtggtgacgggcgccagtaatcccagttactcgggaggctgagacaggagaattgcttgaacccaggaggcagagattgcagtgagccgacatcgtaccactgcactcca

SEQ ID NO: 128539 - DNA, 601 bp, Human
tggatgagtgaggtcagcacagctagaagtcagacacaaggaagaacttcctacctagcaagactctgagatcctggagcccagaagggaccaagtgagccaagctgtggctcagaagcctctgtccctccaaccatgatgtggtctacctcccacaggtaccacatggcttacctcactgatgctgcctggagccccgtgaggccgaccgttttctttaccaccaggatggacggaaccctggatatctgggacttcatgttcgagcagtgcgatcccaccctcagcttgaaggtcacgygcatgtccctccttgtgcatccaggtcctcagggagccaggtcccggcgtgggtgtgagtgtggggtgctgtgagcacgtgtgcagtgtgtggccaggtgtgtttgggcctctgtgggggagccgtgtgcaggctgactgcagcgattgcttttgagcgtgtgctcctacaaaggttaaggggcctgggggatttggcatcctggtagcacaacagaaccacctgggggaaatttaaaaagaaacaaaagcaggtacccggcatctcctacccacaggccgattccttcagagcccctgg

SEQ ID NO: 128540 - DNA, 601 bp, Human
acaggtaccacatggcttacctcactgatgctgcctggagccccgtgaggccgaccgttttctttaccaccaggatggacggaaccctggatatctgggacttcatgttcgagcagtgcgatcccaccctcagcttgaaggtcacgcgcatgtccctccttgtgcatccaggtcctcagggagccaggtcccggcgtgggtgtgagtgtggggtgctgtgagcacgtgtgcagtgtgtggccaggtgtgtttgggcctctgtgggggagccgtgtgcaggctgactgcagcgattgctttygagcgtgtgctcctacaaaggttaaggggcctgggggatttggcatcctggtagcacaacagaaccacctgggggaaatttaaaaagaaacaaaagcaggtacccggcatctcctacccacaggccgattccttcagagcccctggggtttggctgctggaccttccccttcatgtcagggtggccagagctgagccccactggctggggccacggaagggtgggggcattggggaaccacagggtgactgtgaggcggaactgaaggggtggggcgggagatgaggcagggaagccagg

SEQ ID NO: 128541 - DNA, 601 bp, Human
accaccaggatggacggaaccctggatatctgggacttcatgttcgagcagtgcgatcccaccctcagcttgaaggtcacgcgcatgtccctccttgtgcatccaggtcctcagggagccaggtcccggcgtgggtgtgagtgtggggtgctgtgagcacgtgtgcagtgtgtggccaggtgtgtttgggcctctgtgggggagccgtgtgcaggctgactgcagcgattgcttttgagcgtgtgctcctacaaaggttaaggggcctgggggatttggcatcctggtagcacaacagaaycacctgggggaaatttaaaaagaaacaaaagcaggtacccggcatctcctacccacaggccgattccttcagagcccctggggtttggctgctggaccttccccttcatgtcagggtggccagagctgagccccactggctggggccacggaagggtgggggcattggggaaccacagggtgactgtgaggcggaactgaaggggtggggcgggagatgaggcagggaagccaggagccttgacaaccagtctccgagtttgaacttcatcctgtgggcagaggcgtcctgaggatgttt

SEQ ID NO: 128542 - DNA, 601 bp, Human
cctcagcttgaaggtcacgcgcatgtccctccttgtgcatccaggtcctcagggagccaggtcccggcgtgggtgtgagtgtggggtgctgtgagcacgtgtgcagtgtgtggccaggtgtgtttgggcctctgtgggggagccgtgtgcaggctgactgcagcgattgcttttgagcgtgtgctcctacaaaggttaaggggcctgggggatttggcatcctggtagcacaacagaaccacctgggggaaatttaaaaagaaacaaaagcaggtacccggcatctcctacccacaggccrattccttcagagcccctggggtttggctgctggaccttccccttcatgtcagggtggccagagctgagccccactggctggggccacggaagggtgggggcattggggaaccacagggtgactgtgaggcggaactgaaggggtggggcgggagatgaggcagggaagccaggagccttgacaaccagtctccgagtttgaacttcatcctgtgggcagaggcgtcctgaggatgtttgaatagggccaagtggctgagcctccccaggggccagttaatcagacacacataactttgct

SEQ ID NO: 128543 - DNA, 601 bp, Human
cccaaaacgtgctcctcaccatggcttgaacattctacatgaagaagttgagccttggaaggggttcaggttcacagaacttggccccttcctcctcctgcctgccacacacttcctgtctctctcttagtctgcaattggcccaaaacgctggtggtcacaaagtaccgcgtggtactgaagctgttttacataggctgggtccttatgcccactatttctaatcctggccacagccctgcaaggtgtcctgtcctctctatgggtgagggggccaaggagactcaggaggagctagccygaggcctcccagtctgcatgtggcagaagccaggcgtgaacccaagtctgccagattcccccagctctgcccactttccgcactgtctgggccctcaccagccgcagagctggcacccgggttccagggtgctcagcgacccaggcttcagccatttggctgctttggtcctcgtggggttcacatcccaggggagtggggaaggcctgtcccctaccaacaccaacacttctgtgctgtcttcccctgcagcagcaaccaagtccagaagaagaccaggtggtggaggagggagaggaa

SEQ ID NO: 128544 - DNA, 601 bp, Human
tctgacgagtaggttaaaactaggggggatcaaagtttgtctcatgtaacgagataataaatcatcaaaacggacttcattaattatcctgtgctctgtgctatggctacgagtgccccgtgaaggggtgactgaccaatttagaccttggccctttgggagttgcagaatgcttgttggttctgttcaatgcagacattgcaactcgccgactagaagaatagtcctttaaaattcttgtgttgcatggtattataaagcagtctgtatgaatgaatacagaaattcactcttgaacagygtatttttgcttatttgtctaacaaatttgtttcatcaaagtggaaatggcagagcaagtagccttttattagatacaatcataaaaatctcactgcattcagagtgctattaaaaacctgtaacaatatatgatctatttattttgatgttgaaaccatgaggttgttagttgtctgcatatacacaattgatacaaccattctaatgataaagctggtcaaaaaatgagttcattcattgagtgacttaatatccataaagccataaagccttacataaacataaccgttcataaatg

SEQ ID NO: 128545 - DNA, 601 bp, Human
tgaatagatctcataagccagatctacgcattcctcaaaaactgtgcttcaatgcctttatagaaggatcaataagcaggtagccataattgatacagtcatacttcacttacctataggagaaaagtatgtaacttcaatgatttcaatctcacttaagactcactcagaagcaattcagaaagggctgctaaagcctgaaacagctatcactaaagcccctaccaatcactcttagcttcaatcaatgtcttatttatgtttatggaccaaaggtccagaagaaatataatgatggggkgggtgttctgtaaacctgtgctgtctgatatgggagtcgctagccacatgtggttatagagcacttgaaatgtagcaagtgcaactgagaaactgaatttgaaatcttgttttattttacctagtttacatttaaatttaaatagccacacgtgtctagtagctactatatttttagtgaaggtaagcctaccaatagcatcatgttacaactaacagtttgacgatagtgaatttcaataaaaaccatacaaagcaaactcaagaagcacagcagttcagagatacgtaagtagggaaa

SEQ ID NO: 128546 - DNA, 601 bp, Human
tgatgaatagatctcataagccagatctacgcattcctcaaaaactgtgcttcaatgcctttatagaaggatcaataagcaggtagccataattgatacagtcatacttcacttacctataggagaaaagtatgtaacttcaatgatttcaatctcacttaagactcactcagaagcaattcagaaagggctgctaaagcctgaaacagctatcactaaagcccctaccaatcactcttagcttcaatcaatgtcttatttatgtttatggaccaaaggtccagaagaaatataatgatgaggggggtgttctgtaaacctgtgctgtctgatatgggagtcgctagccacatgtggttatagagcacttgaaatgtagcaagtgcaactgagaaactgaatttgaaatcttgttttattttacctagtttacatttaaatttaaatagccacacgtgtctagtagctactatatttttagtgaaggtaagcctaccaatagcatcatgttacaactaacagtttgacgatagtgaatttcaataaaaaccatacaaagcaaactcaagaagcacagcagttcagagatacgtaagtaggg

SEQ ID NO: 128547 - DNA, 601 bp, Human
ttttattattattatactttaagttttagggtacatgtgtacaatgtgcaggttagttacatatgtatacatgcgccatgctggtgcgctgcacccattaactcgtcatttagcgttaggtatatctcctaaagctatcttaaaaataaaccaacaaatgaaaatcctgcgcataataaaactgtgtactttttaaaaacaattaaaatcttatgtggccatgccatgaaattaaacaagaatttttgatgaatagatctcataagccagatctacgcattcctcaaaaactgtgcttcartgcctttatagaaggatcaataagcaggtagccataattgatacagtcatacttcacttacctataggagaaaagtatgtaacttcaatgatttcaatctcacttaagactcactcagaagcaattcagaaagggctgctaaagcctgaaacagctatcactaaagcccctaccaatcactcttagcttcaatcaatgtcttatttatgtttatggaccaaaggtccagaagaaatataatgatggggggggtgttctgtaaacctgtgctgtctgatatgggagtcgctagccacatgt

SEQ ID NO: 128548 - DNA, 601 bp, Human
ttttttttttttactgcttatctgtatcataacaaaacacaagtcaattagaaaagatttccctaataagtgattcctttatccacagtttttccctcagtatcacacacatacacacacaccatgcacacgcacacacacatttactcacacagtttgtcatcaataagaattcttttcctgctgtagtaataaagataaaatatcaaagaatttcttttcttttcttttattattattatactttaagttttagggtacatgtgtacaatgtgcaggttagttacatatgtatacatgygccatgctggtgcgctgcacccattaactcgtcatttagcgttaggtatatctcctaaagctatcttaaaaataaaccaacaaatgaaaatcctgcgcataataaaactgtgtactttttaaaaacaattaaaatcttatgtggccatgccatgaaattaaacaagaatttttgatgaatagatctcataagccagatctacgcattcctcaaaaactgtgcttcaatgcctttatagaaggatcaataagcaggtagccataattgatacagtcatacttcacttacctataggagaaa

SEQ ID NO: 128549 - DNA, 601 bp, Human
cagtggcatgtgtttgtcatttcctgtctcataatcaaaatgctgtaaaggccacagaaagcaatccacccgcacctccagtagctaaacgcatttattttactattttataatgacagtagttcatcattgaggagggctattctcattaaccatgaatactaattaagcatgttgatcataaataatcaattttcagagaggaagaaaaaatatggctttaattcttaatttttaaaaaaagacgtcaggatttacaggtcattgttaagaacaccagtcttcatttaaccataaatgytaggatactggtttattcagaatgttgcttgatagaatgtaggagaagctcatatttttctggattattattttaaagttttaatgttctatttagtcttacatggacaaattttgagatatcaaaggttaaacaatttaattaaaattaaactatttgctccattttacttgaaaattataggaataaatcaatatttgtctgcggttttttttttttactgcttatctgtatcataacaaaacacaagtcaattagaaaagatttccctaataagtgattcctttatccacagttttt

SEQ ID NO: 128550 - DNA, 601 bp, Human
agtactctgggaaagtggacacgcagaaaacaaatttgaatggaatccatgaaaagtacacagaaaataccatgctccaaggtttggcatccagaacaagaaggaaaatgtgatgtgtgatacattttttatttttttccctttcccttttttttttttttttttttttgacacagcgtctcgctcttgttccctaggctggagtgctctcggctcactgaaacctatgcctcctagcttcaagcaattctcctgcctcagcctccctagtagctgggactacaggcgcctgccaccacayccggctaatttttatattttttaatttattttttatttataattttttatttagagacagggtttcaccacattggccaggctattctcggactcctgacctcaggtgatctgcctgcctcggcctcctaaagtgctgggattacagttgtgagccactgcacctggttcactttcatttttcattgcatgaaagtatctacaattatctgcaaggtcacagatttcctggaactaacttcacacagaatttcatcacaacaatttaaaagaacagccaaacgaacctctgtttctagca

SEQ ID NO: 128551 - DNA, 601 bp, Human
ttgcacagacgggatctcactatgttgcccaggctggtctcaaaactcctggcttcaagcaatcctccagccacagcttcctgtagtgctagaattataggtataagccacagaacccagccacaaaaattgaaaggtagtttatacattgtaagtactctgggaaagtggacacgcagaaaacaaatttgaatggaatccatgaaaagtacacagaaaataccatgctccaaggtttggcatccagaacaagaaggaaaatgtgatgtgtgatacattttttatttttttccctttcccttttttttttttttttttttttgacacagcgtctcgctcttgttccctaggctggagtgctctcggctcactgaaacctatgcctcctagcttcaagcaattctcctgcctcagcctccctagtagctgggactacaggcgcctgccaccacacccggctaatttttatattttttaatttattttttatttataattttttatttagagacagggtttcaccacattggccaggctattctcggactcctgacctcaggtgatctgcctgcctcggcctcctaaagtgctgggattacag

SEQ ID NO: 128552 - DNA, 601 bp, Human
aataacttctctttaaaaggttttctctgcatttaaacacctttggctatattaaacaaacactgttccacaaaaatattacaataaaatatatataaagtgtgtcatccctgtttccgtaaaattgtttatttgtttgcttatttattctttatttttagagatggggtcacactctgtctcctagactggagtgcagtggtaaaatcttagccattgcaatctcaaatttctggcctcaagccatcctcccacctcagcatcctaagtagaatctacaggcatgcaccgccatgctcawctacttttttaaattttttgcacagacgggatctcactatgttgcccaggctggtctcaaaactcctggcttcaagcaatcctccagccacagcttcctgtagtgctagaattataggtataagccacagaacccagccacaaaaattgaaaggtagtttatacattgtaagtactctgggaaagtggacacgcagaaaacaaatttgaatggaatccatgaaaagtacacagaaaataccatgctccaaggtttggcatccagaacaagaaggaaaatgtgatgtgtgatacatttttt

SEQ ID NO: 128553 - DNA, 601 bp, Human
ttcttataaatataaatattttaaaataaattactatggaatacatgcaataattattcttagaaacttactggaaaaaaatgcatcaagagttcatgctacctataatttctccacacatacattctcaaatcaaagacatgagtaataatatattttccagaatacagaaatcttacattaatatatcaatatataatgagcaaagaataccgtaactcagcaaattgttggtttatattttttatataaaaatatgtaatcataaatatgtagttatttatttaatttaatttatttwtataaaatttatattttatataaatttaatttaatgtattaaattttatataaatttaatttaatgtattatttatataaaatatgtaattataaatatataattataaatgtgtaattataaatatataattataaatttatataaaaatatgtaattataaatatgtaattatatctaatagggtatattattttttctaaaacaaagtaaacatacaaatgagagattaaacaaattagcataacataaatttatctgctctaaagctgggaaaagatgtgaaagaaattatttttg

SEQ ID NO: 128554 - DNA, 601 bp, Human
gacaaagattctacttcaatttatattaaatgacatgtctagtgtgccttccatatccatgggttctgcattcatggattgatgcaaccatgaattaaatacacttaaaaaataaagtaaaaaataacaacacaagaataaaaatgatacaaataaaaaacccaatacagtataacaattatttacatagcatttacattgatttagatattataagtaatctggagatgatttaaggtagaagatgtgcctaggttatatgcaaatactacaccattttataccagggacttgagcatcsaaagattttggtatccttgggggtcctggaaccaatgtgccacatagaaggatgattgtataagcaagacatttttatataaaaatattgagtaattaatcattttcttataaatataaatattttaaaataaattactatggaatacatgcaataattattcttagaaacttactggaaaaaaatgcatcaagagttcatgctacctataatttctccacacatacattctcaaatcaaagacatgagtaataatatattttccagaatacagaaatcttacattaatatatcaatata

SEQ ID NO: 128555 - DNA, 601 bp, Human
gatacacaaggaactaacaacgatatacagaaaaagcaagcagaagggatacatgtcacttatactcttttgtacttttgaatcatataaatgtgtggcctattcaaaatttcaaataaaatatagataaaaatgggcacttcaaaactaatgttgaggtaagttttgaaagagtattattaatttaaaaattatgtatttaggctcttaagaaattataaggaaacaaatgtttttggaggatttccataacgactaactacgtccacagtagagatgaagaatgagaatcatcttgtaytttttagcaatatataagagatttaacagcaataaagatttgcaaaccaagttctttttcctgttgcctttaacaagcacatacctaatttaattcgtctcactttaaattcattggcaaacttttcaagttctctgatttctggagaatccatgtctattggctcttccaccaatttacttttccgcctgagttcctgcttgaaatcagcagctgtggggtcctctgccagaagaggctggtgtataggaggaaatccatgactcaaggtgtggtcaggaaatttataaagacaagggg

SEQ ID NO: 128556 - DNA, 601 bp, Human
aattacttttatctagtcactgaaagaattcagatagaaacatctgccattcataatatttaaccagtgtttaggtgtgtcctaaacacttcataaggcacttgaaaattatggcttttttatcattattgttagttaccaaataatatatgctcaaaaaattttaatatattaactataatgcataaaatatacggttatatatcataacattcttatttcaactctaaaagattcaatgatattgttgaagggtactaaataaaactaagaattatgtcactttccctaaaaccatatwtattaagaggctatgattacacatttcatgtatacttctgagcccattttatagtttttgataatgcctctgtcttcagactaatgatccttattgtttgtcgcaaacatttttagagtacagctgaaataacatataatttgaaacattcacagtaatatagatagaaaactgaaaatgaatttcacaaagattcctactactgtgcttatcacatgtaatagctacatattatttcaggacctaaggctatatacctatatgtataaaatggttgcatatgatgcccatcaataaata

SEQ ID NO: 128557 - DNA, 601 bp, Human
tgttaattttggttcattgtcacacaaatctgtgtatctttgtcaactattacacactattttttaactatatattcttggcaaatcagaattatttagtaagattcattatactttgaagtacttgtgcaatacttcaaaacatatttcttctagttaataaattacttttatctagtcactgaaagaattcagatagaaacatctgccattcataatatttaaccagtgtttaggtgtgtcctaaacacttcataaggcacttgaaaattatggcttttttatcattattgttagttaycaaataatatatgctcaaaaaattttaatatattaactataatgcataaaatatacggttatatatcataacattcttatttcaactctaaaagattcaatgatattgttgaagggtactaaataaaactaagaattatgtcactttccctaaaaccatatttattaagaggctatgattacacatttcatgtatacttctgagcccattttatagtttttgataatgcctctgtcttcagactaatgatccttattgtttgtcgcaaacatttttagagtacagctgaaataacatata

SEQ ID NO: 128558 - DNA, 601 bp, Human
ctttctgggttgaaatgcaagaggtcatgttgaacttgaagagaccgaaacactgattactagtgtcacatttttaaatactatagacaccatggatactacattgtcagagcaataagttatagctaaaaggggagaagatatggccagtctcttagaaatgattgttttctttctgtttgtattcaaaattttggagtaaaagtgttcttgaatcaaacaatacataattttccatcaaatgttgaaaattattagctctccatttctcaaaattaagttattacattattattattttttatttatttatttatttatttatttatttatttatttattttgagacggtgtctcgctctgtcgcccaagctggagtgcagtggcgcaagctcggatcactgcaacctccgcctcccaggttcaagccattctcctgcctcagtctcctgagtagctgggattataggcacccaccaccatgcccggctaaattttgtatttttagtagaaacagagtttcaccatgttggccagactggtctcgagctcctgacctcaggcccgccttggcctcccaattcaccttacatttatatgt

SEQ ID NO: 128559 - DNA, 601 bp, Human
aggacggcgagggcccgccccctcccccaggttgcatcagaagggaggggagagtgcacaaaagaagagtttgtccacagtggcctgttagtgccatgagttcctccccactctctcgcagtttctctctgatcccccactcccggggagaagggcttgagacactcgctaagaaaatctcagggatgaacataaatggataaaagatgaaggggcaggcgagcgacaggcttgcttcctggtctcggccgcagtggtcttgccttttgcctaatcgccctgtaaatctatcgtaaggagkctgggcgcggtgactcacgcctgtaatcccagcactttgggaggccgaggcggggggaggggtggggagatcacctgaggtcaggagttcgagaccagcctgaccaaacggcgaaatcccgtctctactaaaaatacaaaaattagccgggcgtcgtggcacacgcctgtaatcccagctacttgggaggctgaggcaggggaatcgcttgaacccgggaggcggaggtagcagtgggccgagattgcgccactgcactccagccggggctagagtgagactccatctcaaaaataataa

SEQ ID NO: 128560 - DNA, 601 bp, Human
aggcaggacggggatccaggtgttctgatgaaagtgctaggcttcatctccatcctagctgcctttcccaggatctcccttgacattgttaaagagaaggttaagatcttatttattcttacaacaaatatttattgagtccctaatatttgtcaggctgagctatgtcctagatgtttatttggcatagattagatgctgtcctttccacaaaagaggattgtagagtctgatgtcattaccctgagattatgtttcccagttggcgttgggtaacccactggcatgtctccactgtgtscccaggatcagagcagtgcttggcacataactgggctcaacactgcacaatgttaaaagaattctgctgtgtctggctatgatttcctgggggaagaagcctgaagacacttgaagtttcatgttttagtcttttttttttttttttaaagacagggtcttgatttgttgcccaggcttgtttacagtggtacagtcatagctcacactgcagcctcgacctcctgggctcaggcaatcctcccacctcagcctcctgagtagctggagctacaggcatgcatcaccattcctggctaat

SEQ ID NO: 128561 - DNA, 601 bp, Human
gcctgtaatcccagctacttgggaggctgaggcaggagaatcgcttaaacccaggaggcggaggttgcagtgagccgagatcgtgccattgcactccagcctgggcgacagggtgagactccttctcaaaaaaaaaaaaaagaaagagcaaatggcttaagtgagcaactagctagtctctgccccatttttcaattttaagggacttggaaaaagactcagaaatggaatgaattggattgttaaaactgtatggaaatgtaaagtaaaaattatggctggaagagatgctacccttagygggtgggtctttggagggtgggtggatcaggccctaggctttgaggaatgactatgcttgtaaggcctcagaatgtagttgctttccgtagtgtcttgttgggtcccaaatgtcttcattttccatgacaattaaataaatgccatcacctgttttcctgggcagatgcaccaacccagttccaactgtttcaatcctgggaaacagatggctagagcttttgtttacacgagctgtggatggttttagttatccaggtggtggaagggtccactcatgcttcatcctcctgactgccat

SEQ ID NO: 128562 - DNA, 601 bp, Human
ctatgcttgtaaggcctcagaatgtagttgctttccgtagtgtcttgttgggtcccaaatgtcttcattttccatgacaattaaataaatgccatcacctgttttcctgggcagatgcaccaacccagttccaactgtttcaatcctgggaaacagatggctagagcttttgtttacacgagctgtggatggttttagttatccaggtggtggaagggtccactcatgcttcatcctcctgactgccatgactgtaaggactgggcagtggctccaagaatcatttctctttaccactcarcattcatgtagtgttagctaatgtggcagaggacagtgcaggtggtgaatgatcccgagtagactacgagcctttgggagtggctctctgctctcaggttggctctttggtttgacccaggatgcctctgagttgctgtgccaatgaacagtaaactcatttaattattgacccaatcaaaaaatactgaataagaggtcaagtatactaaatacagagcacaatacatcaaaaagtcagatatacttttattttttagttgcccactgtttcacatttctcttgacaccaactcagtat

SEQ ID NO: 128563 - DNA, 601 bp, Human
ttcttgtggtcatctaatccagtggttctcacactgggtttctcgcatgttccccagtgggtgttttggctggatggtggagttagttggcctggcagggcctcctgatatcgtcagagcacctctggggttacaggtacatcttgcttgctttgaagaaagcattctgctctggaaactggggtgggggattaggaacagaaactattgcctgttttttacagataaaaaactagttcccagggaagtaaggcgatgagccagaagtcaccaagcattcagccgtaaaagctggacaaakgaggacaatagaattctcagacttcttagagcacatggccatcttgcattctgttttaccttttgcttcctaggaaaccctggaggacatcgacaagaacggggatgggtttgtggatcaggatgagtatattggtgagtactgacctagagtcttgctcagctgtcctgactgggccacatgaccccacccacacgtctggctactttccccagacgtctcttttagcaacagctgcaagtctatacgtcactcctgggagcttccagcctgcttgtcccatcagccctagtgatgtag

SEQ ID NO: 128564 - DNA, 601 bp, Human
taaggcgatgagccagaagtcaccaagcattcagccgtaaaagctggacaaatgaggacaatagaattctcagacttcttagagcacatggccatcttgcattctgttttaccttttgcttcctaggaaaccctggaggacatcgacaagaacggggatgggtttgtggatcaggatgagtatattggtgagtactgacctagagtcttgctcagctgtcctgactgggccacatgaccccacccacacgtctggctactttccccagacgtctcttttagcaacagctgcaagtctatamgtcactcctgggagcttccagcctgcttgtcccatcagccctagtgatgtagtatcagggaagtattattaggcctcattcagtggagaagagatgaaaaggctggccctacacaaggctggccaacagttggccccatgactctgagaggtgcccttcatcacactgcctagttttacctttgcaaaaggacattggagatcccatagatttacagtgaagatagaggagacagtgtcagggcaaagcctctaaaactggactgggtcaatggagcctagaaactctgagtagatgcag

SEQ ID NO: 128565 - DNA, 601 bp, Human
gtctggctactttccccagacgtctcttttagcaacagctgcaagtctatacgtcactcctgggagcttccagcctgcttgtcccatcagccctagtgatgtagtatcagggaagtattattaggcctcattcagtggagaagagatgaaaaggctggccctacacaaggctggccaacagttggccccatgactctgagaggtgcccttcatcacactgcctagttttacctttgcaaaaggacattggagatcccatagatttacagtgaagatagaggagacagtgtcagggcaaagmctctaaaactggactgggtcaatggagcctagaaactctgagtagatgcagctgtgattaacagaactgtttatgtgtctgagcactttgcagaaaggcattcttcttagaaagataaatgctttacagagtgcacaattgcccaataatatgctcattttgtgcccctcgtttcccatcctttggatgggagtcctatagtgtcaaattaatgtatttgggtctgaacccaccattgctggttagagcccttcctggtagccccaaatcccccccagcccaaccccccgctagaaagga

SEQ ID NO: 128566 - DNA, 601 bp, Human
cagtgtcagggcaaagcctctaaaactggactgggtcaatggagcctagaaactctgagtagatgcagctgtgattaacagaactgtttatgtgtctgagcactttgcagaaaggcattcttcttagaaagataaatgctttacagagtgcacaattgcccaataatatgctcattttgtgcccctcgtttcccatcctttggatgggagtcctatagtgtcaaattaatgtatttgggtctgaacccaccattgctggttagagcccttcctggtagccccaaatcccccccagcccaaccccccgctagaaaggactagagcaggcaacaaggacaattccatttgatcctcaccacctgctatggcacatggctccagctgcaggctcccttctcatggcagctcttttcccaagtctcaataaagtaaaagctggaaaatcatttggtttaggtgttgacctatgaaaagagaaatgaaatatgtataatttttgtacagatttttaatcaaagccattaattacctttaaatgtaaaactcagagcctgagttgctgtctctggttttgtggttgtattactttgccatcccagac

SEQ ID NO: 128567 - DNA, 601 bp, Human
ctggggatgaaatgagactgacagcaaagactgcatgatcaaaacaaacaatgtagtgcttttgattgaaagtgtgcgctctgcccagccctccggaactgtgcattgaaatggtgcaaagtcagaggcagaactctttgagtggctttgcctaaaagaagcatcccattctttacagtgaatagggagagggaggtggaggcgttgcgcttgaaaatcgaatacctagtgactcacaggcagaggaaacccaatgtattgactcgtcatttcacttctcggggaggcttctcttcaagcrgcaccaagtggaaagtgtgtggtggggggtggtagtaggaagagcactggaattaggaaccctaccttcaccaattagctgtgtgaccctggggtaatcatgtaatggcttcaaacctcagcttcctcatctgtaaaatgggggaaaaaaaagtgagcccatttttacaggattcgatgaagctcgaattagctaatacatattacaactctttctcaaaaacaatgtagacatgtcagttaggggtctaccttgtagtcaagggtcttgtctttttttttccttcacttactacctgct

SEQ ID NO: 128568 - DNA, 601 bp, Human
ctttgcctaaaagaagcatcccattctttacagtgaatagggagagggaggtggaggcgttgcgcttgaaaatcgaatacctagtgactcacaggcagaggaaacccaatgtattgactcgtcatttcacttctcggggaggcttctcttcaagcggcaccaagtggaaagtgtgtggtggggggtggtagtaggaagagcactggaattaggaaccctaccttcaccaattagctgtgtgaccctggggtaatcatgtaatggcttcaaacctcagcttcctcatctgtaaaatgggggaaaaaaaagtgagcccatttttacaggattcgatgaagctcgaattagctaatacatattacaactctttctcaaaaacaatgtagacatgtcagttaggggtctaccttgtagtcaagggtcttgtctttttttttccttcacttactacctgcttcattcaccacctgacatttccaagctctgcttccgtgacagagaaactgcctgcagggtatctctcttttccaagagctactgacacacacacaatgcaaaaacgtttcctttttcttttccttgccattttgtacaatgggga

SEQ ID NO: 128569 - DNA, 601 bp, Human
ctgacacacacacaatgcaaaaacgtttcctttttcttttccttgccattttgtacaatggggataatgacccatcttgtagaattgttataaggatgaaatataatgacaagtgaaagccctttggaaatgatataaacaatagtactaaacacagtggctaagactctgggttgaaagcagagtgaccatgttcctgtgcagcctccagctcatatgagctgtgggtcattgggtaagactttacctcattgttttcatctgtaaaatgggaattataacagcactcactttgtaaggytgttatgtgaaaatcaaatgaaaactgtgtgtagaacactttatacagtatctggaccatagtgttcaatgttagtcattattattagttttcgcttatgtagtgccagtttgggttgtagagggcttttacatcaaaatggcacatttgatcataatagccccatgatttataaattatcatctccattttacagacaaggaaacttcaggctcagtcactgaactaagtcaaaagccgggatttatcttttggcttctaaactcagttctttctactccaccacatggccttcatcat

SEQ ID NO: 128570 - DNA, 601 bp, Human
tagaacactttatacagtatctggaccatagtgttcaatgttagtcattattattagttttcgcttatgtagtgccagtttgggttgtagagggcttttacatcaaaatggcacatttgatcataatagccccatgatttataaattatcatctccattttacagacaaggaaacttcaggctcagtcactgaactaagtcaaaagccgggatttatcttttggcttctaaactcagttctttctactccaccacatggccttcatcatgaataaattactgcatcattatccccaagaarctgcctaccagctgtttgagttaggtctctggattggttgtcgcctttcctaaagctcaggaggtcaagtttgttttatgggggtgggggaggtttaccttcccactttcctttgtaaccaacaataaccttcccttctagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacagg

SEQ ID NO: 128571 - DNA, 601 bp, Human
ccaagaagctgcctaccagctgtttgagttaggtctctggattggttgtcgcctttcctaaagctcaggaggtcaagtttgttttatgggggtgggggaggtttaccttcccactttcctttgtaaccaacaataaccttcccttctagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcaygcacaggctgaggccaggcatctggtatatgaatcagacaaaaacaaggtatttcccattcttctggaatcactgattgaagggagacagtttacataagatcggttttgtttgctttttcggcgatagcattgacccatgtggccatgtctttattgacttttccttcttgtcctacagtggagacctgtaaacttgagctaataccgtgataacccacagtaaaattattaggccccaactttcctggaaagtcagctgtgagccacagacttacattaagtcacatttcctaagatt

SEQ ID NO: 128572 - DNA, 601 bp, Human
ccgctctggattgcgccccctgaacagaatgtctttttccatctgcccctgcggaggtggccagaaactccgtggcccttgcgccaccgtcagctgcacaggaccaggcgcttccattgtggtccacgcccgtctcactcccttttcgcaagcctgcgggaggcagggacattttacagaggaggaaacagaggctgagggatgacttgcccacgaccgccaagccagcttaggctcccgggtcttggtgcgctcgccccatccaggggaccccaaaacgccctccgccgccccagtcccyggcctgtgcgcgtggacgcggggtccctactcacagccacttgatgccatagcacacgccggtctggagcgccagggcgaagagcagcgcctcgcagacctgcggccgcgccctcatcgtcgcgcggcgggcgcgcccggggtcacacccaggaggagccgcgccgaagtcctccgcctgcacggccgccgctggtcctgcacgccgcctgcagccggggagagcggaggcggcgggttaaggcggcgcgcgggcgggggaggcgttttattcaaattacaaaggaggggtcggggcccg

SEQ ID NO: 128573 - DNA, 601 bp, Human
cttcaccacccccagccccctgagcaggcactcccttcagctcggcaccaagcctctctctccctcctacccctgcgtgaataatttctatctaaaggaatgccctgcacatgtgcacagtggcatctgacagcttctgaggtcctttcaggagcctcttctcatctgatttgagggaggtggggagtctcaccctcctgtgacagaggaggacaaggaggccccaagaagtagagtgacactttcccaaggtcgcccaggtggaggggtcaggagtgtctcagcggaactcccgctaggstcaaggagactgacggacaaggaccgctcctgggctggccgctctggattgcgccccctgaacagaatgtctttttccatctgcccctgcggaggtggccagaaactccgtggcccttgcgccaccgtcagctgcacaggaccaggcgcttccattgtggtccacgcccgtctcactcccttttcgcaagcctgcgggaggcagggacattttacagaggaggaaacagaggctgagggatgacttgcccacgaccgccaagccagcttaggctcccgggtcttggtgcgctcgccccat

SEQ ID NO: 128574 - DNA, 601 bp, Human
attaatcaataacttggcctgagaaggggcagggccagtgacctccagactgtttgctggcggcgcagccactatcaccctgtcttccaactaattcacaaaccctttgcagcgccctccccagcccccacaacctgccccctgctgtcttatctgcaggctccctgccctggccccagattccagacccttgtcctgtcctggactttccctctcagggagcccctctgcccacagcgtcctctccattgcccgaaccagccaactcccggcagcgcttcagtcaccagaggcacagccycggaaaagcttcccggtgtctcacatctgtgtccccaccaggtgggcttccttcctctaggcctccagattcccgctctggtttctcctcgggcacttggacacttgtggagttatttacagcctgggcttatctctctcaacttagagcgcagctcctccgggaaggggctggtgtttactcctctcttcaccacccccagccccctgagcaggcactcccttcagctcggcaccaagcctctctctccctcctacccctgcgtgaataatttctatctaaaggaatgccctgcacatg

SEQ ID NO: 128575 - DNA, 601 bp, Human
ggaagacggggttccctcctcgaatcgtcaattaatcaataacttggcctgagaaggggcagggccagtgacctccagactgtttgctggcggcgcagccactatcaccctgtcttccaactaattcacaaaccctttgcagcgccctccccagcccccacaacctgccccctgctgtcttatctgcaggctccctgccctggccccagattccagacccttgtcctgtcctggactttccctctcagggagcccctctgcccacagcgtcctctccattgcccgaaccagccaactcccrgcagcgcttcagtcaccagaggcacagccccggaaaagcttcccggtgtctcacatctgtgtccccaccaggtgggcttccttcctctaggcctccagattcccgctctggtttctcctcgggcacttggacacttgtggagttatttacagcctgggcttatctctctcaacttagagcgcagctcctccgggaaggggctggtgtttactcctctcttcaccacccccagccccctgagcaggcactcccttcagctcggcaccaagcctctctctccctcctacccctgcgtgaata

SEQ ID NO: 128576 - DNA, 601 bp, Human
atctctgtgtgccccagtctctgtttcctcttctgtgcaacgggggtaatagcagcacccacctcacagggtggttgggatatttaaatggaacaatatacataaggcacttagaacggcgcctagcacaaagtgaggccatgtgtgtgtagacatatatgtacatatacatagatatatgcacgtggcctacacacgtgtatctatatatacacatgcatacacagatcgttgttattcttaaactccaccccttttcccacctccccctctatcttaaactctagcaagactttaatcmcctattgctagactatcagtttctcataggagtgcagtatgatctaacttacatgacccaagctctcggagcagcgtctggggcacttaggagtaggctcttgtggtgcctggtttctccaggtctccccgcatgcgctgttcggcctccaggcttctgctcgtgctgtgcctcccgcctaggacgcctgctttgcactccgtctctgaccatccaaatcctccctgtccttccaatcctggcctatgcatctcccttagatagaactgatcactcctcctctgggctgccatgctccct

SEQ ID NO: 128577 - DNA, 601 bp, Human
gctaggcagcttaactcaaatcctgcctctactacctctgagctgtgacaccctgctaggtagagtcccccatctctgtgtgccccagtctctgtttcctcttctgtgcaacgggggtaatagcagcacccacctcacagggtggttgggatatttaaatggaacaatatacataaggcacttagaacggcgcctagcacaaagtgaggccatgtgtgtgtagacatatatgtacatatacatagatatatgcacgtggcctacacacgtgtatctatatatacacatgcatacacagatygttgttattcttaaactccaccccttttcccacctccccctctatcttaaactctagcaagactttaatcccctattgctagactatcagtttctcataggagtgcagtatgatctaacttacatgacccaagctctcggagcagcgtctggggcacttaggagtaggctcttgtggtgcctggtttctccaggtctccccgcatgcgctgttcggcctccaggcttctgctcgtgctgtgcctcccgcctaggacgcctgctttgcactccgtctctgaccatccaaatcctccctgtc

SEQ ID NO: 128578 - DNA, 601 bp, Human
aagcccaggccagcggaggctcctgggtgagtccccggctttccagcctcactgaacacttccctgctcccagctgtgctggggctccctgtgcccaacagtccacagagctaggcagcttaactcaaatcctgcctctactacctctgagctgtgacaccctgctaggtagagtcccccatctctgtgtgccccagtctctgtttcctcttctgtgcaacgggggtaatagcagcacccacctcacagggtggttgggatatttaaatggaacaatatacataaggcacttagaacggcrcctagcacaaagtgaggccatgtgtgtgtagacatatatgtacatatacatagatatatgcacgtggcctacacacgtgtatctatatatacacatgcatacacagatcgttgttattcttaaactccaccccttttcccacctccccctctatcttaaactctagcaagactttaatcccctattgctagactatcagtttctcataggagtgcagtatgatctaacttacatgacccaagctctcggagcagcgtctggggcacttaggagtaggctcttgtggtgcctggtttctcc

SEQ ID NO: 128579 - DNA, 601 bp, Human
gagtcgggaaatgtctggtgtgtctagatgccagcatccggcacagggtgggccacacagcatccctcagacgcggtttcttgacctaaatggaactgttctggcctgccctggcctcaccttcttggggaacctgttgctgaaccctgccttacttcctgggtgggctctgaccacacagaggcaaacgtcatcacctcagtgtgtttcccggttgtcaacagctcttccacctccacccagcaaaccctgtccctgcgtgcagtgccgtcatggggtaaacagctccatatgggcatgkcccttcccggttgacagagcctcccacttcacacctcagagggcagcccggaggggatgatcagccctgctttaggggctgtgcttgtccagcacccgccagcaggccccgtcatccttcttggtgaggctgtcagtccctgcaggcactggggtcacttctctctgggtccccactctgctttgctctgagcggtccccacccagcccgtcctgagcctgctctgccgcttgccctcgcccaactttcttcccgctccttctgagccagcttcctccattttcaaatgagaaggacaac

SEQ ID NO: 128580 - DNA, 601 bp, Human
agtattggaccagacggagtgagaaggcctgggttctcactcaagctctgtcctctatgtgctgtgcaaacttgggcaaactattgcccctctctgggcatcaactacaacgtgaggacctctcagggtcctgccaaggctgaatgatatgtgctacggtaagtactcaataggttctttcatttcctcctgcctctcacgctctgccatgtcccacccaccctataacccccaaagatagaaaccttcccagagacccagaaagcagggcctggtgtctgtggttagggcggcgtgactygccctgtgtaagatcaactgtggtgtccagggcagtctcccctcactgccaccccctaaactatgagtcgggaaatgtctggtgtgtctagatgccagcatccggcacagggtgggccacacagcatccctcagacgcggtttcttgacctaaatggaactgttctggcctgccctggcctcaccttcttggggaacctgttgctgaaccctgccttacttcctgggtgggctctgaccacacagaggcaaacgtcatcacctcagtgtgtttcccggttgtcaacagctcttccacctc

SEQ ID NO: 128581 - DNA, 601 bp, Human
cactcctggcctagccccaggaagagcacaagccttggacaccagctgtgtgacctaggtaagttatccaacctctctgggcttcatgttcctcatctgttacaaagaaatgataaggccaggcgcggtggcttacacctgtaatatcccagcactttgggaggccaaggcgggcagatcatctgaggtcaggagtttgacaccagcctggttaacgtggtgaaaccctgtatctactcaaaaaatacaaaaattagccaggcatggtggcgcatgcctgtaatcccagctgctcaggagrctgaggcagaattgcttgaacccaggaggcagaggtttcagtgagccgagattgcaccactgcactccagcctgggcgatagaacgagactctgtctcaaaaaaataaaataaaataaattaaaataaaataaaatagaaataattactacttcaaaaggctatgatgaggctgggggttgttgctcatgtctatgatctcagctactctgaggccaaagtaggaggatcctttgaggccaggagtttaagaccaccctgggcaacatagtgagagccgtctctaccaaaaagtaaaaaa

SEQ ID NO: 128582 - DNA, 601 bp, Human
tcagggagtctattgagtacagtgagcacagagccctttgcttgaggctgctgacttcatccacctcgtccgtgctttgggaaacgttagcctggtgggtccctatgaaccctggtgatgttagaggacccaagagcctcccagatcccagctctgggcacctgggttccaagactctaggaccaggcccctcctcgatctgccgttctcctaggccttctctgagggcagcctgcatcggcagcacttaaggaccccacaaccctaaaggactccacatggactcactctcagtgccccmacccacagcagaggccgtctggaacccagagtcagctggccttcagcaacccagcagagacccaggagcgacagggaaccaagagggggccattctgcagccagaagtgctgagtgccccgcctgctgtggacccagcggtcctcacccagggtcagggctgagacctggcaaggtagagatcccagaacccctgggctgagttctgagggaggcagcccattgccaagggcactgcacaggcttgggtagactccaggctatatcactccccttgcgaccttgagcaagtcacttaacc

SEQ ID NO: 128583 - DNA, 601 bp, Human
cccctctttgggcctcagtgtttgtacttataaaccgtatttcccagaatgggctccagtgagacactctgacaaaagggatccatgtggggaacacgatgtactatgtccctgcttggagagtcaggatgcacatttacgttttaaaggtcctgagaagtcctgcagcaaagcaacaggcttggtgttaaaattcaactcagggagtctattgagtacagtgagcacagagccctttgcttgaggctgctgacttcatccacctcgtccgtgctttgggaaacgttagcctggtgggtcyctatgaaccctggtgatgttagaggacccaagagcctcccagatcccagctctgggcacctgggttccaagactctaggaccaggcccctcctcgatctgccgttctcctaggccttctctgagggcagcctgcatcggcagcacttaaggaccccacaaccctaaaggactccacatggactcactctcagtgcccccacccacagcagaggccgtctggaacccagagtcagctggccttcagcaacccagcagagacccaggagcgacagggaaccaagagggggccattctgcagc

SEQ ID NO: 128584 - DNA, 601 bp, Human
acccgcccttctggccccagcctttccctcaatggactttgcctcctggtttcctggctccttccaaaaaaggctcccaaactgtcagctggcagagcagtggatccccctcacaccccatgtgaccttgggcacatcaccgtccctctctgggcctcaggccctattcataacataggatcacaaccccatcctacctaagctttaggataattatactaacaaaacagctgtacagttcacaaagctcacctccaccacctgatttagttctcacacagctgtgaattattagtctttrttcaacattcattcaacactgagcagctacgtgccagaaaccatgagaaatgctagattcttatgatcacaataattatacatactattaactgaagcctttctagatgcgctacatgaggtaggagttttccatcattgtttcatgtgattactaaacccatttattatgttgtaaagtcccatatccatgcaaggaattcctaataaaggattaaagagccactcagttttgtgatgacctggaacttgaaaaatttagtatctaattcagacttggccattaacttgttgtgtgatc

SEQ ID NO: 128585 - DNA, 601 bp, Human
atgaccgatggaaggagagacagggttgtcaggggccacatggcctccacccgcccttctggccccagcctttccctcaatggactttgcctcctggtttcctggctccttccaaaaaaggctcccaaactgtcagctggcagagcagtggatccccctcacaccccatgtgaccttgggcacatcaccgtccctctctgggcctcaggccctattcataacataggatcacaaccccatcctacctaagctttaggataattatactaacaaaacagctgtacagttcacaaagctcacytccaccacctgatttagttctcacacagctgtgaattattagtctttattcaacattcattcaacactgagcagctacgtgccagaaaccatgagaaatgctagattcttatgatcacaataattatacatactattaactgaagcctttctagatgcgctacatgaggtaggagttttccatcattgtttcatgtgattactaaacccatttattatgttgtaaagtcccatatccatgcaaggaattcctaataaaggattaaagagccactcagttttgtgatgacctggaacttga

SEQ ID NO: 128586 - DNA, 601 bp, Human
gaaaacttggcccccatgaggagcccgtagctgaggttgtccgcacatcctccccagcggttcccgggcccgggtggctcacctgggacggggccgcaggagcagccgggcaggtcgccggaggtgcaggcccgggcgatggcgtggctgatggcggcggccgacagcgcatacacgaaggccgactcccgggtccctgagggtgggaggggaaggtcagccgacgctgatccagggctaggaccctgcccaggtcagaggtcctccaccttcgcccacaccctgctgtaaccaaggtgaygccagcaggggtcggcactagggccattgagatgtcacccctgcttccccaattccttctgaatataccagctgacagccacactcaggaccccacacccacaggcatgccctcacccacgtcctcctactcacactcacagctctaggcttccacccacttgccctgcactggcattaggggatgctttacagtagtgaggcccaggctctgagctcctgatgcgccagacaaatgcacaaaggacctgctatgcgtggacctgtgtccccccgaaggatgtgttcaagtcctgacccc

SEQ ID NO: 128587 - DNA, 601 bp, Human
gttgtgtagacgcatcagtttattggcttgggatcctgtttttttcaccttcataggagcatcggaaaacttggcccccatgaggagcccgtagctgaggttgtccgcacatcctccccagcggttcccgggcccgggtggctcacctgggacggggccgcaggagcagccgggcaggtcgccggaggtgcaggcccgggcgatggcgtggctgatggcggcggccgacagcgcatacacgaaggccgactcccgggtccctgagggtgggaggggaaggtcagccgacgctgatccaggrctaggaccctgcccaggtcagaggtcctccaccttcgcccacaccctgctgtaaccaaggtgacgccagcaggggtcggcactagggccattgagatgtcacccctgcttccccaattccttctgaatataccagctgacagccacactcaggaccccacacccacaggcatgccctcacccacgtcctcctactcacactcacagctctaggcttccacccacttgccctgcactggcattaggggatgctttacagtagtgaggcccaggctctgagctcctgatgcgccagacaaat

SEQ ID NO: 128588 - DNA, 601 bp, Human
cacatcgccactcagggcctctgtcttctttcgtgcaaggcgagcacataattcctgccttgcagagagctgtaaggatgaaatgagatcacacacacaaaagggttttgtgaaccataaaagttaaatcaatattggttttgaaaaatccatttaagtaataactatggtggagcccccttgggctcagaggcttggggagactcttgccctggcttcaaaaaggactcgggcccaccagcttccctggccctcagtttccctattcatacctgaggggcagaagttagatgccttctaygggccttccagttctgccttttaaacccttctttcaacacaagacttggattcctctgcccaggcctaccctcctgcctctcctgtacagagacctgcaagagtcatgggaacctgggcccatcccctgcatcagagacatggggaaactgaggcacagagtgggcaggacttgcccaagacaagtgagttagtgggggagctggccaaggtcccaggactccttcccctcaccagtgccaggaagtgaggacccagggagtgtgtttgggtacccaatctggaattgtctgtggaggtc

SEQ ID NO: 128589 - DNA, 601 bp, Human
agtgatagagctttttgctttaaagcttggaggtggtgtgggccttcctgcaaccgtggggggcacagctgaggggcaggaagaaaggcattttcagggatagggatgccattgtttagcacctgctgtataccaagcgctctaacacataatggagattgatcaccacaacggcccaagggaggtatccttacttcccccattttaaaaagaagaaacaatagctcagagaggctaagtctcatgcccaagggtgcagatagaaaatcatggagcttgaatttgaacccagatctgaggstgattccaaaagtggtggcttttaattgtttcatgctttttctctcactaaatgcttgctggaaaaaaggcagaaaagaagagaaggaaggaagggaggagggtaggaaggggagaagaggcaggggtaagtgcagggggcacctccccgccgcctggctgactttccccccactgccagtgctcctgccaggccaccctcagcaagccacatcgccactcagggcctctgtcttctttcgtgcaaggcgagcacataattcctgccttgcagagagctgtaaggatgaaatgagatcac

SEQ ID NO: 128590 - DNA, 601 bp, Human
tgtccaggctggatcagggaccctctgggctcccttcacaccaggcttttctgtcacgacctgagcccttggggacctcccaccagcacctgccagagccaggcagagacacagctgacatgcagtctcatgtaatgggcacaagaaatgcttgtggttatgaactactgagaaattgggggtgtttgttactgcagcaaaagccaactaatacagatgcctgcaagggtccccctagggaaggaccgggagccgcaaggcaggaaacctgtgggggctgcgaaggaagccaggagggtargtggtgctgagggcggggcctcctcatgaggagtgaggggcagctgggagagaggggcctggcagcctgagggcacgggggaggggagactgcccgggaggggaggggagaggggagatgctaggtaagtgcgcttggagatcactcgacaaccctgtgagcggtggggtgccctccccactgtgcggaagacgaggctgagcttcagatcagtgagggatgtgctcaagtccccctgttgggaagctgtgccctccctgacacacacagagccacatatggatccaggaagaccctttc

SEQ ID NO: 128591 - DNA, 601 bp, Human
ggccataggcccagggaagggccgttggatgcctggctcccagggtacagggtggctcagactgtgggtgggggtgggtttcagaggtgcaggcctctggaagaaatatgacaagagggctagggtttggaatattgtctgcagattaggccttggtttccccaggttagatttgaggaggctgcaaggcatcttccgcagagagggaggcagcctctagagataccccgcatgcacacgcctttcacagttcaccaggctcacttacacccaacccccaacctcatcatcaatcttaaatttcccctcctctaggaagccttccttgatgtccaggctggatcagggaccctctgggctcccttcacaccaggcttttctgtcacgacctgagcccttggggacctcccaccagcacctgccagagccaggcagagacacagctgacatgcagtctcatgtaatgggcacaagaaatgcttgtggttatgaactactgagaaattgggggtgtttgttactgcagcaaaagccaactaatacagatgcctgcaagggtccccctagggaaggaccgggagccgcaaggcaggaaacctgt

SEQ ID NO: 128592 - DNA, 601 bp, Human
acgctgctcgtggaggaataggggtctgttggccatgtgcctcctgtgggtcaggctctccctccagtgtcttatcttagtggaggcctgtagggcccttgggtcagtggaatgattacgtccattatgcagatgaaaacaggctcagcaaagggcagaggcttaaacttggggactaaaactaaggccctgacttgctctccctaccctaaagggtggggcatgggagccagcaggggctgcatttcttcccaaatgtgggatgcgaagacattgaaggtccctataaaatgcaaacatycttccactgctctcagttcttctgtctagtgacaaatcatctgttcagactggtggctcctctagctgggctgaggctagacagggagtgttttcatgagatgtagttggggacagagcagcagggggctggggcactgacagggacaaagggtccccacatgtgggccgaggaatcccagaatgtccaagatgggaaagtcctagagatgaccgaatgcaatcctcatatttactgatggggaaacagacacagaagggagaggggccttgcccgtggtgagtacaaggtctgtgagag

SEQ ID NO: 128593 - DNA, 601 bp, Human
gatgtcaagatcatttgatttttagaatcctaggataaatgctgaaatactcgaacccccactgggcatcagacacgctgctcgtggaggaataggggtctgttggccatgtgcctcctgtgggtcaggctctccctccagtgtcttatcttagtggaggcctgtagggcccttgggtcagtggaatgattacgtccattatgcagatgaaaacaggctcagcaaagggcagaggcttaaacttggggactaaaactaaggccctgacttgctctccctaccctaaagggtggggcatggragccagcaggggctgcatttcttcccaaatgtgggatgcgaagacattgaaggtccctataaaatgcaaacatccttccactgctctcagttcttctgtctagtgacaaatcatctgttcagactggtggctcctctagctgggctgaggctagacagggagtgttttcatgagatgtagttggggacagagcagcagggggctggggcactgacagggacaaagggtccccacatgtgggccgaggaatcccagaatgtccaagatgggaaagtcctagagatgaccgaatgcaatcct

SEQ ID NO: 128594 - DNA, 601 bp, Human
accctggcctcctgagtagctgggactacaggcacacaccaccatgtccggctaattttttatttttgtagcgatggaatcccactatattgctcaggctggtcttgaactcctaggctcaagcaatcctcccacctcagccttccaaagtgctaggattacaggcatgagctgctgtgcccagccttgttttgttgtcttggagatagcttttttctatttcttctacttctaaatactggaaggaccctccaaccaatctaataagcctatctttatgtgtaaccttttacagagtctygctctgttgcccaggctggagtgcagtggtgcaatctcagctcactgcaacctctgcctcctgggttcaagcgattctcttgcctcagcctcccgagtagctgggattacaggcgtgtgccaccacacacagccatatttaatctttaattaaatattatgagagatgtcaagatcatttgatttttagaatcctaggataaatgctgaaatactcgaacccccactgggcatcagacacgctgctcgtggaggaataggggtctgttggccatgtgcctcctgtgggtcaggctctccc

SEQ ID NO: 128595 - DNA, 601 bp, Human
gtgtctccaggcccctggccccagttgctgagggtccttgagcagagtcctcgctcctgcgtggggcggagggcagggcctcacttgcagacatagcgctccacggtacgctcacacctgcggcaggtgacgtagcagcaccagtggtacttacagtggcaccgctcgaccacgcggtctgtgtaggggttgtagccacgcccgcagcacataaggtcgcagctgtcgcttccgttggatgtcttgttgcactgcctattgtgggggcaggaaggaggtcagtgcatgccttggtcaccaycccaccaacaccccatgactcccagccaggcagccggcagcgtctcccatggccaccgactcagcccttcttagaagctgtcttgatctttggggaattttaaataatcctcttacctaaaggtacttctaacttttccctatatttctaataaggggttaccaaaatgatggggctgttttcttttatttttttgagatggggtctcactctgttgcccaggctggagtgcagtggttgtgatcatggctccctgcagccttgacccccgccttccccaccacccaggcccccggctca

SEQ ID NO: 128596 - DNA, 601 bp, Human; identical to SEQ ID NO: 21263

SEQ ID NO: 128597 - DNA, 601 bp, Human; identical to SEQ ID NO: 21264

SEQ ID NO: 128598 - DNA, 601 bp, Human; identical to SEQ ID NO: 21265

SEQ ID NO: 128599 - DNA, 601 bp, Human; identical to SEQ ID NO: 21266

SEQ ID NO: 128600 - DNA, 601 bp, Human; identical to SEQ ID NO: 21267

SEQ ID NO: 128601 - DNA, 601 bp, Human; identical to SEQ ID NO: 21268

SEQ ID NO: 128602 - DNA, 601 bp, Human; identical to SEQ ID NO: 21269

SEQ ID NO: 128603 - DNA, 601 bp, Human; identical to SEQ ID NO: 21270

SEQ ID NO: 128604 - DNA, 601 bp, Human; identical to SEQ ID NO: 21271

SEQ ID NO: 128605 - DNA, 601 bp, Human; identical to SEQ ID NO: 21272

SEQ ID NO: 128606 - DNA, 601 bp, Human; identical to SEQ ID NO: 21273

SEQ ID NO: 128607 - DNA, 601 bp, Human; identical to SEQ ID NO: 21274

SEQ ID NO: 128608 - DNA, 601 bp, Human; identical to SEQ ID NO: 21275

SEQ ID NO: 128609 - DNA, 601 bp, Human; identical to SEQ ID NO: 21276

SEQ ID NO: 128610 - DNA, 601 bp, Human; identical to SEQ ID NO: 21277

SEQ ID NO: 128611 - DNA, 601 bp, Human; identical to SEQ ID NO: 21278

SEQ ID NO: 128612 - DNA, 601 bp, Human; identical to SEQ ID NO: 21279

SEQ ID NO: 128613 - DNA, 601 bp, Human; identical to SEQ ID NO: 21280

SEQ ID NO: 128614 - DNA, 601 bp, Human; identical to SEQ ID NO: 21281

SEQ ID NO: 128615 - DNA, 601 bp, Human; identical to SEQ ID NO: 21282

SEQ ID NO: 128616 - DNA, 601 bp, Human; identical to SEQ ID NO: 21263

SEQ ID NO: 128617 - DNA, 601 bp, Human; identical to SEQ ID NO: 21264

SEQ ID NO: 128618 - DNA, 601 bp, Human; identical to SEQ ID NO: 21265

SEQ ID NO: 128619 - DNA, 601 bp, Human; identical to SEQ ID NO: 21266

SEQ ID NO: 128620 - DNA, 601 bp, Human; identical to SEQ ID NO: 21267

SEQ ID NO: 128621 - DNA, 601 bp, Human; identical to SEQ ID NO: 21268

SEQ ID NO: 128622 - DNA, 601 bp, Human; identical to SEQ ID NO: 21269

SEQ ID NO: 128623 - DNA, 601 bp, Human; identical to SEQ ID NO: 21270

SEQ ID NO: 128624 - DNA, 601 bp, Human; identical to SEQ ID NO: 21271

SEQ ID NO: 128625 - DNA, 601 bp, Human; identical to SEQ ID NO: 21272

SEQ ID NO: 128626 - DNA, 601 bp, Human; identical to SEQ ID NO: 21273

SEQ ID NO: 128627 - DNA, 601 bp, Human; identical to SEQ ID NO: 21274

SEQ ID NO: 128628 - DNA, 601 bp, Human; identical to SEQ ID NO: 21275

SEQ ID NO: 128629 - DNA, 601 bp, Human; identical to SEQ ID NO: 21276

SEQ ID NO: 128630 - DNA, 601 bp, Human; identical to SEQ ID NO: 21277

SEQ ID NO: 128631 - DNA, 601 bp, Human; identical to SEQ ID NO: 21278

SEQ ID NO: 128632 - DNA, 601 bp, Human; identical to SEQ ID NO: 21279

SEQ ID NO: 128633 - DNA, 601 bp, Human; identical to SEQ ID NO: 21280

SEQ ID NO: 128634 - DNA, 601 bp, Human; identical to SEQ ID NO: 21281

SEQ ID NO: 128635 - DNA, 601 bp, Human; identical to SEQ ID NO: 21282

SEQ ID NO: 128636 - DNA, 601 bp, Human; identical to SEQ ID NO: 21272

SEQ ID NO: 128637 - DNA, 601 bp, Human; identical to SEQ ID NO: 21273

SEQ ID NO: 128638 - DNA, 601 bp, Human; identical to SEQ ID NO: 21274

SEQ ID NO: 128639 - DNA, 601 bp, Human; identical to SEQ ID NO: 21275

SEQ ID NO: 128640 - DNA, 601 bp, Human; identical to SEQ ID NO: 21276

SEQ ID NO: 128641 - DNA, 601 bp, Human; identical to SEQ ID NO: 21277

SEQ ID NO: 128642 - DNA, 601 bp, Human; identical to SEQ ID NO: 21278

SEQ ID NO: 128643 - DNA, 601 bp, Human; identical to SEQ ID NO: 21279

SEQ ID NO: 128644 - DNA, 601 bp, Human; identical to SEQ ID NO: 21280

SEQ ID NO: 128645 - DNA, 601 bp, Human; identical to SEQ ID NO: 21281

SEQ ID NO: 128646 - DNA, 601 bp, Human; identical to SEQ ID NO: 21282

SEQ ID NO: 128647 - DNA, 601 bp, Human; identical to SEQ ID NO: 21272

SEQ ID NO: 128648 - DNA, 601 bp, Human; identical to SEQ ID NO: 21273

SEQ ID NO: 128649 - DNA, 601 bp, Human; identical to SEQ ID NO: 21274

SEQ ID NO: 128650 - DNA, 601 bp, Human; identical to SEQ ID NO: 21275

SEQ ID NO: 128651 - DNA, 601 bp, Human; identical to SEQ ID NO: 21276

SEQ ID NO: 128652 - DNA, 601 bp, Human; identical to SEQ ID NO: 21277

SEQ ID NO: 128653 - DNA, 601 bp, Human; identical to SEQ ID NO: 21278

SEQ ID NO: 128654 - DNA, 601 bp, Human; identical to SEQ ID NO: 21279

SEQ ID NO: 128655 - DNA, 601 bp, Human; identical to SEQ ID NO: 21280

SEQ ID NO: 128656 - DNA, 601 bp, Human; identical to SEQ ID NO: 21281

SEQ ID NO: 128657 - DNA, 601 bp, Human; identical to SEQ ID NO: 21282

SEQ ID NO: 128658 - DNA, 601 bp, Human
agttaagtaacttcaccaaggtcacacaaactagtgttagaatttgtattcaaacccaggcagtctagctccagaggctatcatataaaccagtgtatcttaaatccttacaatcttttacactgctgctggagtgatcttttaaaagatacgtgggctgggtgtggtggctcacgcctgtaatcccagcactttgggaggccgagacgggcagatcatgaggtcaggagatcgagaccatcctggctaacacagtgaaaccccttctctactaaaaatacaaaaaaaaaaaaaaaaaaaatagccaggcatggtagcgggcgcctgtagtcccagctactccagaggctaaggcaggagaatggcgtgaacccaggagcagagcttgcagtgagccgagatcgcgccgctgctctccagtctgagcaacagagcgagactccgtctcagaaaaaaaaaaaaaaaaagatacatgaattttcttactcgctgggcttagaaagctttgatatatcatgtacaggagaaagttcacacttcttagtgtgatattcaagggacatttagcaatacatgcccttagggaccaaggtctttattt

SEQ ID NO: 128659 - DNA, 601 bp, Human
gctggttaagtgtggaagcaggtctgaagaaaggtctgccaggctccagtgcacgtgctgttttctattatgccatgttggtgccaaatcatcagtaaaatagaaaagtgtaattatgagagccttcataagaaagcaggcacatagaagatttaggaaggttttcaatcaaaatttaaaataaaataattttgggttttttttttttttttttttttttttttttttgggacgaagtctcgctctgttgcccagcctggagtgcaatggtgtgattttggctcgctgcaacctccgcctytccagttcaagcgattcttctgcctcagcctcccaagtagctgggactacaggcacgtgccaccacgcctggctaattttttgtgtttttagtagagacggggtttcaccatgttagccaggatgatctcaatttcctgacctcgtgatccacctgccccggcctcccaaagtgctgggattacaggtgtgagccaccacgcctggctaattttggtatttaatgtgagttttggtggagcaaaatttgtatttatgtgcagcagcacattttattcttctttattcatccgtctctaca

SEQ ID NO: 128660 - DNA, 601 bp, Human
ccaccgtgcctggcctgaaagcattgtttttaaattaactgcagtttactaaatgagtaaaccagtagtcaggacttactgatagatctcatagtctttaactaggacctcttataggcaattatgctactaagttcattttctctagtttactgaatgtttaatagagaatggaaatgtaatgggtaagttaaatgagcccttcccaaaacatgttcagaacttttggcttagagcaaaagtcagctttcaaatgttgaaaaggtgaatgaagaataaaataggaagaataaaatcagcrtaaagaagtaaagcattctttgagggcagttaagtatatgtagtcttctgcccaagagatgttctctgtctctgcccctgtcctttaattttggcttgaattcacagagttactggactaagactgctttgtttgagatgtcactgcgaattaaggcttcactgtcacatctctcatagctgccttgtaacttctacattcccgctggtgccaggcatgttccaaggcagcattccaaggtttagtgatttcaccctgatgtctctgccaataaaaataaccagttaccattaaaaccta

SEQ ID NO: 128661 - DNA, 601 bp, Human
tcttttctcccaatatgtcaagtgtgaagtgattggacccaatgattctttcttagttggcatccctgactgttcttaggcttctgttccttaaattcagactctgcaagaagtaaactaatgtcatagaggaaaatgacttttccacagtagcactgatttttctgttcccgagattctttgattctaatgacagagttaaatttgaacatgggaggaaaactgactttaaacagtttatggggagaacatctggagatttaaactcatgaaaaattcagtgtaagccaagaaattgacycagcagcattaaaaaaggagctaagatgatcttatattgcattaattaaaatatattgtccagatcaagagaagtaatagtcttcctggactttgtgttcattagatcatatttggagtattctgtttaatttgggtcccagtttactttgatgggaaagagccggggagatggccaggaagataaatgattttaaagcagtcatgtaaagactagttgggaatagaggatatttagagaatataaatatcctagagaagagaggactttggggatatagttgccgtctttaaacagtta

SEQ ID NO: 128662 - DNA, 601 bp, Human
tccagtggtccaatggatggtttgtcttttttttctttttaccacaaagacctgacttttttctcattggatatgtgaattccaaccttctttttgaatgacatttagtatggtgcttgaaaattcaaacagaataatgcctcatttatttggcaatatcaatttataacagccaaacagtaatccaaagttagcattaaaaatccgctaagcaaattggaaaggaagaactcaaattatctttgtttgcagattatatgatctttatttatttatttatttatttatttatttatttattgagatggagtctcactctgtcatcaggctggagtgcagtggtgcgatcttggctcactgcaacctctgcctcccgagttcaagtgattctcctgcctcagcctcccgaatagctgggactacaggcgtgcatcaccatgcccagctaattttttgtatttttagcagggatggggttacaccatgttggcaaggatggtctcgatctcctgagctcatgatctgcccgcctcggcctcccaaagtgctgggattacaggcgtgaaccactgtgcctggcccagatgatatgatcttatgt

SEQ ID NO: 128663 - DNA, 601 bp, Human
gcacatattgatgtttcttggctaaattaatttttttaaatgatagttgccaaatggaatggttaattcagttctcctacatttattagtgtgacattccatttaaggaaaagctttcagctttttctgtttaattgtatcaatgtagacacatggattcctgttttatccggtgaattattatctggtagtataagtatttattttgatactcaaatcactccagatttggccatgggaatctcttcaatctggcttctgtgttcttaagacatatttccatcactctttgagtatgtccttactttctggcataatatattacaggctcatattccctttgcccctggattagaattagtcatttctctaaggagttttgttttgttttagtacagaataataataataaaaaaacccactgttgattgacttaaacatttctgttttttagagacaaggtcttgctgtgtctcccaggctggcgtgcaatggcctgatcacagctcctcaaactcaagggattctctcatctcagcctcttgagtagctgggactacaggcttaggccaccatacctggctgatttaaaattttttag

SEQ ID NO: 128664 - DNA, 601 bp, Human
tacacacacacatacacaccctttgtaactcaggaagcctcatgagcatatggtctaaagtgttcacccccttcagattgctttttgcttatcagtgattaaaaggcttgggaggcatttgagaatgtgtgaggctggtaatgaactggaggtccaacgggatgaaaagggaggaaaaaggagagtgtggtgttttattttttggaacagacttcaataattataattactagtatgctggtataaacttgcctttggagacactgtggtaattttgatttatgtccagttaaaactgcarcaaaactgccaatacagaaggaattctgtgtttactcattttcttcagatagtaggccaaatggagaaattcgttaagccaatcctgaaacactataccaaaaacttaaatgagcaaaattaatcacatgtattggcaataggggattccatgaaaatgtttcaacttctggcagcaacttttaaactttctaatttcagtaataaggctatttgcataactctaaatgtagcaggcaaatggtacaaagaagaaagaagacagtgtggtgtagagaaagaagggaactggaaattaaga

SEQ ID NO: 128665 - DNA, 601 bp, Human
atagcacacaacccactttctgttctgaacgtgtaatgcactctgcttccttaatgactttgaaaagctattcccaataccctaaacagcagttcccttgcatacagctgtcagagtcttagctacccttccttcatattggagcttaaatgctgtctcctttaatgagcctttcccaagaacaagttatcttagactaatgtatccattttgcaagggtacttagatttgtagatacagataacttcaataatgtgtttgataaggtatgtcaggatagctttgggagcaagatgaagargtgtaagctaaatgacagaaaagataggtcgactggtaactacttgatgacttgctatctagagggaaatttttaaatgcatggcatagggctctgctattgacctagtctttttcaacatgtccattcatttgattacttacctgccaaatgtttattcagtactgcatgctggaaactatgcaatatgctgggtatacagtggtgatcaagggagacatggtttttcctcttgagaataccacaatctaagcctttgaacaaagatatagaaaattgactaagttaatgcagtggtaa

SEQ ID NO: 128666 - DNA, 601 bp, Human
ctgtcagagtcttagctacccttccttcatattggagcttaaatgctgtctcctttaatgagcctttcccaagaacaagttatcttagactaatgtatccattttgcaagggtacttagatttgtagatacagataacttcaataatgtgtttgataaggtatgtcaggatagctttgggagcaagatgaagaggtgtaagctaaatgacagaaaagataggtcgactggtaactacttgatgacttgctatctagagggaaatttttaaatgcatggcatagggctctgctattgacctwgtctttttcaacatgtccattcatttgattacttacctgccaaatgtttattcagtactgcatgctggaaactatgcaatatgctgggtatacagtggtgatcaagggagacatggtttttcctcttgagaataccacaatctaagcctttgaacaaagatatagaaaattgactaagttaatgcagtggtaacgtggaacttatagagacagtgattattgcgtaacggaattagtaaataagatctctggggactggaaagatagaattatattcagctcatcttaaattttaagata

SEQ ID NO: 128667 - DNA, 601 bp, Human
atcatttggtattgccagttttgtaagttctagccattataataggcttgtagtagtgtatcattttgattttgatttttacttttataatgactaaagttatgagcaccatttcatgtgctaatagctcattcttgtatcttattttttgaagtgtttgttcaaatattttgcctattctcaattattgggttgtttatatttttatttttatgtaggaattctttgtgtattttggatagaagtcctttgtcaggtgtacacacacacacacacacacacacacacacacacacacacctatcccaagtgtttttttctcagtcatgacttgattttttttcatttcctcaataatgcccttaggactaatttttgcctagtcagagtttttgcatatattttcctatgtgttattccagaggcactgtagtcttagcttttacatttaggtccctaatccatctcaaattaatctgtgtgtatgaggtgaggtacaggttaaggttcatttatttcctatatacgtattaagttatttcactgccatttgttgacaaagtttttcttttccttattaaaaaattgagtatgtatgaat

SEQ ID NO: 128668 - DNA, 601 bp, Human
ctatgtgttattccagaggcactgtagtcttagcttttacatttaggtccctaatccatctcaaattaatctgtgtgtatgaggtgaggtacaggttaaggttcatttatttcctatatacgtattaagttatttcactgccatttgttgacaaagtttttcttttccttattaaaaaattgagtatgtatgaatgattctttctataatctgaaatgtgtgcgtgtgtgtgtgtgtgtgtgtgtgtgtatatattttttgtttgtttgtttgtttgtttgtttttttgagatggagtttygctcttgttgcctaggctggagtacaatggtgcgatctcagctcaccacaacctctgcctcccaggttcaagcaattcttctgcctcagcctcccaagtagctgggattacaggcatgtgccatcacgcctggctaattttgtatttttagtagacacagtgtttctcaatgttagtcaggctggtctcgaactcccagcctcaggtgatctgcccacctcggcctctcaaagttctgggattacaggcgtgaaccaccgcacccagccctaaattatatttcattgatctgtttgttta

SEQ ID NO: 128669 - DNA, 601 bp, Human
agagactgggaatggccagtcagtagagcagtcagaacacaaaacatttatcgataaagttcactatcttatacgggtacagctcgtggtgctccaaaataactataatagcaacaccaaagatctctgatcacaggtcaccataacagatataataataatgataaagtttgagatattgtgagaattaccaaaatgtgacagagagacatgaagtgaccacatgctggtggaaaaatggctccagtagacttgattgactcagggttgccacaaaccttcaatttgtttttttttttttgtttcttttttttaaatatctatgaagcacaataaagcaaaatgcagtaaagtgaggtatgcctacatacagaaatataattgatttttttgtgtatattgaccttatatcccatgaccttgctaaattaacttattaattttagtatttgttttgtagatttctgatcattttccacatgacaattatgtcatctgcaaataaagacagtttgaccatttggtatggaaatgtataagaaatacatgagctatatttaaagataaagaggccaggtgcagtggcatagggctgtaatcc

SEQ ID NO: 128670 - DNA, 601 bp, Human
tatatgtgcatctatttctggattttcttttctgttccattgatctatatgtctgtatttccccaataccaaactcacttattatcatagatttgtcatcttaaaatttgacagggtaagtcttccaactttgttaaaacttctgtggtttttctgggttctttatatttccaactgaatttgggaatcagtttgtcaatttctacacacacaaaaaaaaggtctgatggaattttgataagaagctgtagataaaattgtggagaattgctatcttaacaatagtgggtccttcaatccrtgaacatggtgtatatctcttttacttagatttctctctaattctctttataatgttgtagctttcactgtagagattttggacatcttttatttatttatttatttaattttgagacggagtctcgctctgtcgcccaggctagagtgcagtggcgcgatctcggctcactgcaccctccgacttccgggttcacaccattctcctgcctcagcctcccgagtagctgggactacaggcgtccaccaccacgcccagttaattttttaaaaatatttttagtagagacgggggttcacc

SEQ ID NO: 128671 - DNA, 601 bp, Human
ctaaatccgggttctaagcctgttactgctaagtctgtgaaattaatggataggaaatattttctgcggaaatcttttccttttcttagtggttgactaggtgtaggtccagtagaaacaacctgtaaatgacatttaaaagcagatgtgttaacttttgggacagctgccacaattttaaaaccttttttctgattgttatttattttcaatttggggggaagaattactacaggtgaagataaaatataccctaagctgtcaattctcaaagttattggtctcaagacctctttgtacycttaaaaatctcaaagaattcagtaatacatttttatgaaaaataagcatatttttctgaacaaaaggtttaattagcattacattgcttaaatattttgtgaatttaactgctattaagctaatgtctagcctaataaaagacacctggattttcacatctgcttctgcagtgaatctgttgcaatatcgtaagtctcgcagactctggtaaactccatcatacacttatgagaaaatgagagtggaaaagaggcatacagcttagtaatatgcgaatatgttttatcttacaagactc

SEQ ID NO: 128672 - DNA, 601 bp, Human
tcttgctctgttgcctagactgagtatagtggcaggatcatggctcgctctagccttgaactcctgatctcaagtgatcctttcacctcagccttctgagtagctaggactataggtgcatgccaccgcatccagccaattttgttattttttatttttatggatggggtttcactgtattgcctaggctagtctccaacttctgggctcaagcaatcctcccacctgggcttcctaaagtgctgagattacagccatgtgccaatgtccagcctaattgctttattatctctttttcctrctgtgagttttggtagattgtctttcaaagaattggtttatattagctaaattaccaaacttctgggcatagagttgtttatagtgtttttttattcttctgatgtttgtgagatcaattgtgataacccctctttcttcatattagtaaattttgccttttctcttttttccttgaagagtctggctagaattttttttttttttttgagatggagtttcactctcgttgcccaggctggagtgtaatggcgtgacctcgactaactgcaacctccacctcccaggttcaagcaattct

SEQ ID NO: 128673 - DNA, 601 bp, Human
tcaagcaatcctcccacctgggcttcctaaagtgctgagattacagccatgtgccaatgtccagcctaattgctttattatctctttttcctactgtgagttttggtagattgtctttcaaagaattggtttatattagctaaattaccaaacttctgggcatagagttgtttatagtgtttttttattcttctgatgtttgtgagatcaattgtgataacccctctttcttcatattagtaaattttgccttttctcttttttccttgaagagtctggctagaattttttttttttttttgagatggagtttcactctcgttgcccaggctggagtgtaatggcgtgacctcgactaactgcaacctccacctcccaggttcaagcaattctcctgcctcagcctctcaagtatctgggattacaggtgcctgccaccatgcccagctaattttgtatttttagtagagatgaggttttgccatgttgactaggctggtctcaaactcctgacttcaggtgatccacgtgcctcagtctcccaaagtgctgggattacagacctggccctggctagagttttatcaattttatttacctt

SEQ ID NO: 128674 - DNA, 601 bp, Human
ttcttattttgtggtttaccgttttgcatcctttacccattttgtcatttttgcattaactgttttttttttttgagatggagtttcgctcttgtctcccagactggagtaaaatggcgtggtctcggctcactgcacccctctgcctgctaggttcaagcgattatcctgcctcagcctcccaagtagctgggattacaggcacctgccaccatgcctggctaatttttgtaattttagtggagatggggttttgccatgttggccaggctggtctcaaactcctgacctcaggtgatcygcccgccttggcctcccaaagtgctgcgattacaggcatgagccaccagcccggccgcattaactgttcttttaatgaattgataagagctcaatatgtgaattttcatttctttgttttttttattttcttaaaaatcagttttaatgaggtatattttacaatcaaattaatcaatttaaaatacacagtttgatgagtttagctaatgtattcaggcaggtagctaccaccacaatcagtgataacatttctatcattgtaaacagctttttggccttgttgtagtcagttctttcc

SEQ ID NO: 128675 - DNA, 601 bp, Human
ctttcctctgatgaaatgtctgtttagatctttcatctgttttttggaaagtggggaagggggatggatggtaacgttattattaagttgtaagagttctttttatattctggatatgttctttatcaaatatacgctttatatgttttttcttccctatcttaacagtgtattttgagtttattcatcattttttttaaactttattcttttccttttttttgagatggggtctcactcttttgcccaggttggagtgcactggtgtcatctcagcccactgcagctttctgggttcaaragactctcctgcctcagcctcctcagtagctaggattacaggcgtgtaccaccacgcctgggtaatttttgaatttttagcagagacgtggtttcaccatgttgtccagcccggtcttgaactcctgaccccaagtgatccgcctacctcccaaagtgctaggattacaggtgtgagctaccatgcccggccacttctggaactttctttgtgtttgttcaccctctgcattgtggcctggaaacactccccatgtagtgatttggagccgttatagggctcacgtttcttgttttcctt

SEQ ID NO: 128676 - DNA, 601 bp, Human
aaagtactccaagtatattgctttttggtcatctgacttaatgtggaaaacccagaagaatgacaatttattggttttaactgtaattttgacaggagctggccattggccagtctcagaccaaactctggtgagagagaaccaagagtctgtgttttgttttgttgctggaagcaagattcatagtctttagctattatatttataggagccaacattgacattttgctgttaaaattatattgcctgacttgtgttcttgctgaacagagaggctatctgatttaacagagtagaacaytgatatatgcctggacagggtcaaagcagttttggaagatggtaaaccaagctccggcatttttgttccctctctcccaatgacctattgatgtgataataaatatacatgtataaagaatgaaaccatggtaatggtagaaacaaaagaggatgtcattgggatagcaaaggttttggcacagttctccaagatacaaagtagataggactgttttgatgaataaactaaagtagagaaaaactgcagcctagaacacaaatagaaacggctgcaggtagggttcctgatagaaccatc

SEQ ID NO: 128677 - DNA, 601 bp, Human
ggtagggttcctgatagaaccatcagaggcttcaagcttggaatttgccagtattgagatcaagaattaagtagagcaataatcagggtaattgagcctgttggcccattctccttcttgtgtgcatttggagcagctttctataacatttgctgtagctgctttctaaacataatggattcctgacctgcttaggtcccacggtataagtgtttgacatggtagaaagttgcagtagaacttaaagtgactggacttttatcgccaacccagaggaaaacatgaaagacaactctactcragagtgaaatacctaccccaaataaaatcccagtgtgaagctcccttgacagttgcagtaatttgaagtaaaagtataccttctcccagcatatatacccagaaggaaagcctagttgtcaacaggaccagctcacttatactaatggcactaaggggtgaggctttttatggaaataaatctcatagctccagaggaaacctatgccagttgtctatactaatcagtctaatcacttattcatgggtttgaaaggagcactaaggatcatcagatatttgaggaaaacagcatgaatga

SEQ ID NO: 128678 - DNA, 472 bp, Human
agaagttgggggctgctgtgtaataaggtgaaataattgagctaaagcttttaacaaatcgttaatgaccaagtgtagactagtatgtgactacggcagatataaggcagtttttactagcttgcagtttcttctgcatagacctcttttggatattcacaagaaagattgaggacaggttaggaaatctttgttcttctgcaggtaatgtgtcttttttctatggctgccttggacattttctcttcatttcttgtcttcagcagtttgaatatgatggtctggggtgtggtggagcaaraaggagggaggaagggaatatgtgtgttttcaggtggatcacctgaggtcaggagttcaagaccagcctggccaacatggtgaaaccccatttctactaaaaatacaaaaattagccagacatggtggcgggtgcctgtaatcccagctactggggaggctgaggcaggag

SEQ ID NO: 128679 - DNA, 601 bp, Human
tcccagatacttaggaggctgaggcaggaggatcacctcagcttggggaagttgaggctacatttagctgtcatcatgccactgtattccagcttgggtgacagaaaccctgtctaaaaaaaaagaaaaaaagaattgaggtatgagggtatcatttaaaatgtgaaatattcctgtaattcacattcatggagttaaattttgtacagccataactcagactatctgtcgtcatgtaaaaatagttgaaaaatcagaatacacatttcctatacactatgattttcacgaaaatactgatttttttttttttttttttttttttttttggagacagagtctcgttctcttgcccaggctggagtgcagtgtcatgatcttggctcactgcaacctccacctcccaggttcaagcgatttccagctaatttttgtatttttagtagagacggggtttcaccatgttagccaggctggtctcgaactcctgacctcaagtgatctgccagccttggcctcccaaagtgctgggattacaggcatgagccaccgcacctggcctaaaataatgatatttatgaggaagatgacggttcataaa

SEQ ID NO: 128680 - DNA, 601 bp, Human
tttaaaaaaggaaaaaaaaaaagaaaaagaaaattgaagctcagagagattagttaattttttcaaggagtcatattaaacagtgataaacctaaggttattcctggtctgcctgattctaagattcgtataattcttgccacaattcagttttcttcctcgctttgaataataacctctttaaacctgtgacaactttttagtattctatagcagctgctttctgggagagactctagtgaaggaactccaagctggttattctgtgatattcatgagactttgctgggatagactttaygctgcatggggtgatactgtttgagaaactccaccgtagtgctccaacattagtgtgcttttctaagtgggtaagttactgttgcagtatgccaaggagacctggacacagtgggagaaaaatgtccagtgaagggtgttcatctgagttccactgaccgagacatttagcttaaaaaaaaaatgtttgtgtgtgtgtgtgtgtgtgtgtgtgtgtgtgtgtgtgtgtgtgtgtgtttaagtaatccataacacgagagccttttgtggtaatgagacccagatttccttctgtgtctgt

SEQ ID NO: 128681 - DNA, 601 bp, Human
aactttttagtattctatagcagctgctttctgggagagactctagtgaaggaactccaagctggttattctgtgatattcatgagactttgctgggatagactttatgctgcatggggtgatactgtttgagaaactccaccgtagtgctccaacattagtgtgcttttctaagtgggtaagttactgttgcagtatgccaaggagacctggacacagtgggagaaaaatgtccagtgaagggtgttcatctgagttccactgaccgagacatttagcttaaaaaaaaaatgtttgtgtgtgtgtgtgtgtgtgtgtgtgtgtgtgtgtgtgtgtgtgtgtgtttaagtaatccataacacgagagccttttgtggtaatgagacccagatttccttctgtgtctgtatccctttatgcaggcatgatttcttggaaaggagagtccatatgtcaaacaatgtctcattgagaacatggaatgattccatagatgctgtggcagtgattagagtcttaaatattttgtcctgtctggatcagtgggtgcttggttccttaacaaatcagctgcctcagtgattgggaaggcaggatggta

SEQ ID NO: 128682 - DNA, 601 bp, Human
ctttttagtattctatagcagctgctttctgggagagactctagtgaaggaactccaagctggttattctgtgatattcatgagactttgctgggatagactttatgctgcatggggtgatactgtttgagaaactccaccgtagtgctccaacattagtgtgcttttctaagtgggtaagttactgttgcagtatgccaaggagacctggacacagtgggagaaaaatgtccagtgaagggtgttcatctgagttccactgaccgagacatttagcttaaaaaaaaaatgtttgtgtgtgtgtgtgtgtgtgtgtgtgtgtgtgtgtgtgtgtgtgtgtgtttaagtaatccataacacgagagccttttgtggtaatgagacccagatttccttctgtgtctgtatccctttatgcaggcatgatttcttggaaaggagagtccatatgtcaaacaatgtctcattgagaacatggaatgattccatagatgctgtggcagtgattagagtcttaaatattttgtcctgtctggatcagtgggtgcttggttccttaacaaatcagctgcctcagtgattgggaaggcaggatggtaag

SEQ ID NO: 128683 - DNA, 601 bp, Human
gtcatctcagctttctgtaaccaactaaattaaaatacagtaatgtaatgggacagtgggataagaaagaaaaccagatgactctgacatgtgaccccaacctgaacttactgcttttctagttttcggtatactcaaataaaaatagagtccagtgtaatgcttgcaggggctggggggactggacagaggaataatatatttagttaatagtggggtatgtcccacattcaatactgttacattattaatatatgtgaaatcagtgtttctcaacaggactcccaacacatcagtgagygtgccagtagttcatggactatttgcagtccattattatttatcataggacagcatagatgctttgtgttctgatatgaagtaatcattgaatttaataaagctttattttattggtgttgcatgaaagtagctctgttcttttctttaattcttgtatgtttgaattttttggtaagcaaagaatgggagaatgagggtaattatatcaagccagagagtttgcagtaggtaatttgggggaatattttggtttcctgacaaaaatgaatggaaggaaagagtaaaaattatttttagg

SEQ ID NO: 128684 - DNA, 601 bp, Human
gatcacttgagcccaggaggtcaaggctgcagtgagccatgatcctgccactacccgacttcaacttgtgcaatagagtgagaccctgtctcaaaaaaaaagaaaattaaattagaaataccatgcatgattcattgtcatgagtttcaaatgtggatgtgcataaaagaagttatgggacatggaaaatgattgagaggtgtcaacatatatctaaggggaattctaggaataaagattagaagacatggcaagaaagaaatattcaaaacatggtggctgagttaaaaaaaaaaacacmgacaatattaagaacaaaaaaaggagacacatgtgccacacagattgaaaactcataagaacatactgtgaacagtttttaaaaggtaggtggaatagtcttttttagaaaaaaatataaaataacaaaattgatccaaaaagaaatgggaaaactgaataggagctgcttccagagtatagtagcatagatatcttgaccaacactgaaactgcttgagaaaaacaaattctttaattatatttattagttcacaagaaaataaagaatacttaggtcaaaaactgagtaaaggcaaga

SEQ ID NO: 128685 - DNA, 601 bp, Human
agcagacaaggagggtttggttgaagttacttgacaataagaagaatatcatgcacattactgcaaccctagaaagactgattaacaattatatgaaagtatatcagaaatgagtttgtgagtgaaaattttagcacataaatagcaaaaaaagaaaaaaaattccaatgcaagaacccttagggaaaatggttaaaagacaaaccactcaattaaaaaattatcaaagggtattgtatcaatcatgtttcagtcagaaaagcagaattagtgtgaatattatggtctgatggatttatttggacaagatcgtacgcaattgtggaagaagctacagaaataagagtgcaaaagcagggcttggagatcagagaaaagtcactaccccagcccttctgaagctctggtgcaggtagacaactcaggcaaagaagtaggaagtgaggtatatccagctgctgcgtggaaccccagaggagagcaggtggagacatctatggaaggctgttgccactgcatctgatagtgggaagggagttggtattggtcagcagggccagcagctgggaagaagagctagatgcagaatggaagcacagac

SEQ ID NO: 128686 - DNA, 601 bp, Human
tcatcaggaacaaaaatgagggagtgattattttaagttgaggggcaactgggaaataatatttctcagcaaatgaatcaaaagccaatttgtttatattcatttaataaatacttagtgggcttttactgtgtataagctactgtgacattctgtttggacctatatttgaaatcactaggtttttgtaaagaacatcttgatatattggtatgtgtcttcaataggaagttatatgttctagaggacacccatatgtctgggttaaagtctgtattttaaattagagtgtctctagtaktatattcaaatttggcaaaaaacttatgtaagtatttttgtatgatacagaaacatatgtttccatcatttagctaagtaaaattcataaaacaaattattcttatgtctagtagaagtgtacatagaattctgactcccaagtttgtattatttcttgagatagtaaccatgctcaaccctcaaattatgacatacatatgtatgtgttccaagatacaataatttaaagaaagtctttggttaaaaatacacactgtggtgtaagacctgagttagaatccagctctttgtcacctta

SEQ ID NO: 128687 - DNA, 601 bp, Human
aaaatgattaaccaaagaattaccagacatttgaggaaacttgagaagccaaaatcatgaaaaagaaatgtggaggaaagaaagaatatagggataaataaaaatcaatagtttgttgggattttttttaggagactttaaataatatcctcagagagacaagggaaagtactatgtccaagaacaaaaacaagatgatataaaaatgaacatttagaaaagatgaagcgtggcaaattaaaatgaaggaagtgttttaaaaattcaacagaatgctggaggtaaagttgtttttctcttaaaaaaaaaaaaaaagccggagatcaaagataagaaagaaaagataagaaattagaggatttcctcaaatatttgatgatccaacaatccagatagcagtgagtacaaaaaagaaacagaaaagggaaggtaggaagttatccaacaaataataatgcaagaaaattctaataattaaaatacttgatttcaaatggaaagagtcgagcccagtgagtgcctagcacaataacattttaaaagcccacactaaggtacatcactgtgaaattatggaattctagaggtaaagtgaagattc

SEQ ID NO: 128688 - DNA, 601 bp, Human
gatcataccactgcactccagcctgggcaacagagtgagactctgtctcaaaacacacacacacacacacacacacacacacacacaaaaataaatatgcacctgctccttctcccgtgtttcccatcacaattcacagataccgccatctgcctcgtttctcaattgagaaacgaaagggtcatctttgactcctcccctctttaccattttgtaacaatcaatccatcacaaaattctttcagttcttcccacatatctattcacatatcttcctctctacttctggaaccctaaccaraactgttatttctggcctggattttgcaataacctcctatccaggtcctgttcacctttatttaccacactgtagccagtctggtctttaaaaaacataaacacccatgctttaaaaagttattatcctcccagctgggcacggtggctcacacctgtaatcccagaactttgggaggccaaagcaggcggatcatgaggtcaggagatcgagaccagcctggccaacatggtgaaaccccgtttctactaaaatacaaaaaattagccacacatggtggcatgcgcctgtaatccctgc

SEQ ID NO: 128689 - DNA, 601 bp, Human
gctagaatgacaggaaagtgtcagctctgggaagatttaaggagcaaacacttaaaaaacagagaatagcaagttcaaaagtcccaaagtaggaaacaatcttggcatgttcagggaacagaaggaaaaccagcatgacttgagcatagtgagtgccaaggagaatgacatgaggtagcagtggctttagccacgtaaggccctgtgggctaccctgtgtggtttaaattttatttcaagtgcagtggaaaatcttttgatggttctaagtaggagactgggtgccacaatcagatttgattttttaggatcagttggctatgggaaagagggggaaaatgtccattgttaatcatgcttttcatagattataactttagcccgaaccaatggatatctgttactttctgtgttactttaaattgattatgatgtttaaaatgagatatcacttatgggggaaggttaaatggcccttagtgtaaagttattaatccaaagaagaatggaaacttaaaaaatagatttgaatacagttaaaatattaaatgataaatggaaacagaaatattattttaaaatggcttattttttaaagagt

SEQ ID NO: 128690 - DNA, 601 bp, Human
aagaagaatggaaacttaaaaaatagatttgaatacagttaaaatattaaatgataaatggaaacagaaatattattttaaaatggcttattttttaaagagtacattttggactggttaataaatgtaactttttaacatggaaacagatgctgaaatattttcagtccccagtgtaaccccccacagccagccatttccatctcacgtgcctatggcctgccttatgctttcacagcattaccatcaacagttaaaacttcagtgacactatacaatgtagcagaaaaatgcaagatgkttttttttttccccctctttagtcttggcagggtaaaacatggtcctttttactctaccaggtgctttactttggccataataatttagtatgggtctatagcttttggtcacttcccttactcgatcatgggggaaaaataggggcagcttgcatgctgctggcattttacattaacatttttttcacaggtttttgttgttgttgttgttattgtcgccctggaggacttgaatgaggctcgtgtggttttttttgttgttgttgttttgttaattgcttctttgaagtgcatgtagc

SEQ ID NO: 128691 - DNA, 601 bp, Human
acagttcttttttttgatcacagtctttttccgtgcccttaaaatgactacagagaagcaatgaatacaaattggaatcctcttgctacttgctaaactcagaatctttttttgtatttttacttgctggtagactatacttcgatgtgtgggcttcatcatctcttgcctctgcagcttgaccaattgtaattttcttagactatttctagggactcaatttgcattgttgtttatggagtaaaagttcagtgcctttgcaagtacttcatggtctcctcactttattattcagggcccraaggaaaagaccaagcacatgacccttccagtctgtcttagatgtttgtggcactctcaacatcacatcagttagtatgccacttaaataatgtctttccgtatgccgtagtaagactatcagatgcctaggtttgtattttcctgaaagaaatatgtagcatttctttagaacttctggccctacttcaagatgtaggcattccacaagttttctaattataaaggaagactaacttcctttgttttttatttttttttgtttttgtttttgagatggagtcttgctgtgtcacccagg

SEQ ID NO: 128692 - DNA, 601 bp, Human
aaaatatatatattataaatgcagactagcactttacatttaaataattaaattatttaggtagatgcaatgaaaggaatgaaattttgtcatccacagatttcaaaaaggtggatgaaatgatttaatggaaagaacataacaccaacaattagaaatttcaaggttagaccgggtgcggtggctcacacctgtaatcccagcactttgggaggccgaggtgtgcggatcacgaggtcaggagattgagaccatcctggctaacacagtgaaaccctgtctttactctactaaaaatacaaaaaaaaaaaaaaaaaaaaaaaaaaaattagctgggtgtggtggcggacacctgtagtcccagctactcaggaggctgaggcaggagaatgatgtgaacccaggaggcggagctggcagtgagctgagatcgcaccactgcactccagcctgggctacagagcaagactctgtctcagaaaaaaaagaaatttcagggttatattccatcacttttaacttgccagtaccttgggcagatagtatctttctgctgtgtctcagacttctcatctaaagaatcaaaaagttgagtattatg

SEQ ID NO: 128693 - DNA, 601 bp, Human
attgagaccatcctggctaacacagtgaaaccctgtctttactctactaaaaatacaaaaaaaaaaaaaaaaaaaaaaaaaaaattagctgggtgtggtggcggacacctgtagtcccagctactcaggaggctgaggcaggagaatgatgtgaacccaggaggcggagctggcagtgagctgagatcgcaccactgcactccagcctgggctacagagcaagactctgtctcagaaaaaaaagaaatttcagggttatattccatcacttttaacttgccagtaccttgggcagatagtrtctttctgctgtgtctcagacttctcatctaaagaatcaaaaagttgagtattatgtgccctgagccccatgtcagcaccatgttctttacatctctgcttcttaactttaccactcttataatttagtctgttcattgctttttcaaaatcacttttaagttgtttgactcgcgacagcatgatcaaaaaggttttaagattcttgcaaggtgcagtggctcaagcctgtaattccaacattttgggaggccaaggcaggaggatcacttgagctcaggagttcgagaccagcctgggc

SEQ ID NO: 128694 - DNA, 601 bp, Human
gttaattggtctattcagggattccatttcttcctggtttagtcttgggagagtgtatgtgtccgggaatttatccatttcttctagattttctagtttatttgcatagaggtgtttatagtattctctgatggtagtttatatctctgtgggatcggtggtgatatcccctttatcattttttattgcatctatttgtttcttctctcttttcttctttattgtatatttgtttttaagaggaaagaactagaaaattaattggaagcttggagcatgtggacagggattatcaactgtrgagttcactagagtgtaatttggctgggctctttctcattagggaacacctgacatcattctatttaggtctttcctcttcagcttgtcaaggatgttccagtcatcccgctttaaagtacaagccgattgcttgttttctggaagcagagttgggaaagaggactgaaggttttggcacttagtatgcgtatgttcacttaatcaccttgttttcagtaaagtgcctttgcccttaattgtacctgacggttccctctccaaggaataaaattctagtgtatttgtcaggatggaaaaa

SEQ ID NO: 128695 - DNA, 601 bp, Human
catgtggacagggattatcaactgtagagttcactagagtgtaatttggctgggctctttctcattagggaacacctgacatcattctatttaggtctttcctcttcagcttgtcaaggatgttccagtcatcccgctttaaagtacaagccgattgcttgttttctggaagcagagttgggaaagaggactgaaggttttggcacttagtatgcgtatgttcacttaatcaccttgttttcagtaaagtgcctttgcccttaattgtacctgacggttccctctccaaggaataaaattmtagtgtatttgtcaggatggaaaaagaactgttgcctggctcacggagtttgaaaggaaatctggggatataattgtataacagattttcaaccggtcttcctattccccaactttactgccaattccagaagtacctagggccaccagttcttgagcctttgtggattctcagattgcctctcaactttccctacttctggcttggaattcaactttttcaattctgctaaatttgttaccacttatctatctgctttttagcttgcaaaacattgttgcagttatatattttcctatt

SEQ ID NO: 128696 - DNA, 601 bp, Human
tcctattctttgtctttgttaagctaattaagccattaaaaaagcatgttattaaatttacatatgtaaaaaaatttgtgatataaatatatgtctcatatatcatatattcatatataaatatatgtcttatatatcatatattcatatataaatatatattttttaatcccttggagctgggtgtggtatctcttgcctgtaatcccaatgctttgggaggccaaagtgaaaagatcatttgaggccaggagtttgagaccagctcgggcaacatagtgagaccctatctctataaaakattttttaaaaattagctgggcatggtggtgcccacctgtagttctggctacttgggaagctgaggtggcaagattgcttgagcccaatagtttaaggttgcagtgagctgtgattacgccactgcactccagcctgggcaacagggcaagactctgtctcaaaaaaaaaaaaaaaaaaaaaagcccttagagggagatgccacctctgcttttactgagtagctcctatcagatcaactctcccacagattaaaaactgtaaacaaaaatataataaaacaattatatgaaggcagtag

SEQ ID NO: 128697 - DNA, 601 bp, Human
tgttgtagtgaggacttaatgaaataatataacataaaatgcttagcattgattcctggcacataactaatcactgaataaacacattaacagctgtagcactattttcattatcgttagcaccatcattattccatcatagaacctggacaaaagcctaacatatatttagattatttccaaatttcccgttacaaacagtgccatgcatgtatctccatttctgccattatcgtcaccaccacacatatacatgcacacaattcagtaattatttattacttgttgaattaagtaattwcttctaatgatcctgtcgggtatttgtggtcactatacgtggctggggaggtaccagaatgctcctgtatgtttcttatgtaatccaatttatagcaacagatttaagtgcattttttcatttcagtaaaactgatatgtagatttatttgaatttttataaagaatccctgcacttataataatattttcatttgtgttttccatacataggaactccctgtagctacacattgcttataggattgtgttactgcagtaaacagaatatactctagctagattaggcagaaatggtatc

SEQ ID NO: 128698 - DNA, 601 bp, Human
ttttaaaaataaagtttaagatatatctgccattcaacccagcaattccactcctaggtattggtccaagagaaacaaaaatataagtccaattaaaaacctatgtccacatacttatagcaacttaattcttaataataaaaatgagaaacaacccagatgtccctcaactggcatatagataaatcatttttggtacatccatagaatagaatactactcagcagtaaaaaggaccagactactcacacatatagtaacctggatgaatctcatgtgaaaaaaggcagacacaacaggytaaatactctatgattccatttctacaatgttctggaaaactgtctctgttctattagactgtaatcttgatctgagtgtatagttctttgcaccaagattgcatcaaagtcaatgaattggaagcagaaatgcctatttttttttttaagatggaatcccgctctgttgcccagactggagtgcagtggcgtgatctcagctcactgtaacctccgcttcccaggttcaagcaattctctcaccttagcctcccaagtagctgggattacaggcacacaccaccatgcccggctaattt

SEQ ID NO: 128699 - DNA, 601 bp, Human
cccaaagtgctgggattacaagcgtgagccaccatacccagcctcagaaatgtcaaatttgatcagtttagagagtaagctttagctgtgaagggaatcaaagatccagattgggccaaaggtcaatacagggtattttggggtaaatcgaggtacacaggactatcaacatgagggcaaggagcagaagttgggcctgctggacctgctgaacagcatgaatatctacattaatggatcctactcaagtctactgactcatatagcctttagcctccagagaacatagcccttctttgaggaccactgattaaaactgattgcagttgcatccaaggttgtgatttacctgcttttgacaaatttgcagttttgctttgattgtttatttgcaatgtgcgttactaatcctccttagcaactcacaaggattggaagtgatagagactacactaacaggttgactccagagttgcatgagtttaatagtgcttctagttgctttctggccaatataagattccaaagcaaaggaccatcttaattgaaatatttttaatatggcagattttataatggtaaatttaactcagatataatc

SEQ ID NO: 128700 - DNA, 601 bp, Human
aaagtgctgggattacaagcgtgagccaccatacccagcctcagaaatgtcaaatttgatcagtttagagagtaagctttagctgtgaagggaatcaaagatccagattgggccaaaggtcaatacagggtattttggggtaaatcgaggtacacaggactatcaacatgagggcaaggagcagaagttgggcctgctggacctgctgaacagcatgaatatctacattaatggatcctactcaagtctactgactcatatagcctttagcctccagagaacatagcccttctttgatgaycactgattaaaactgattgcagttgcatccaaggttgtgatttacctgcttttgacaaatttgcagttttgctttgattgtttatttgcaatgtgcgttactaatcctccttagcaactcacaaggattggaagtgatagagactacactaacaggttgactccagagttgcatgagtttaatagtgcttctagttgctttctggccaatataagattccaaagcaaaggaccatcttaattgaaatatttttaatatggcagattttataatggtaaatttaactcagatataatctgt

SEQ ID NO: 128701 - DNA, 601 bp, Human
aagtgctgggattacaagcgtgagccaccatacccagcctcagaaatgtcaaatttgatcagtttagagagtaagctttagctgtgaagggaatcaaagatccagattgggccaaaggtcaatacagggtattttggggtaaatcgaggtacacaggactatcaacatgagggcaaggagcagaagttgggcctgctggacctgctgaacagcatgaatatctacattaatggatcctactcaagtctactgactcatatagcctttagcctccagagaacatagcccttctttgatgacyactgattaaaactgattgcagttgcatccaaggttgtgatttacctgcttttgacaaatttgcagttttgctttgattgtttatttgcaatgtgcgttactaatcctccttagcaactcacaaggattggaagtgatagagactacactaacaggttgactccagagttgcatgagtttaatagtgcttctagttgctttctggccaatataagattccaaagcaaaggaccatcttaattgaaatatttttaatatggcagattttataatggtaaatttaactcagatataatctgtg

SEQ ID NO: 128702 - DNA, 601 bp, Human
agtgctgggattacaagcgtgagccaccatacccagcctcagaaatgtcaaatttgatcagtttagagagtaagctttagctgtgaagggaatcaaagatccagattgggccaaaggtcaatacagggtattttggggtaaatcgaggtacacaggactatcaacatgagggcaaggagcagaagttgggcctgctggacctgctgaacagcatgaatatctacattaatggatcctactcaagtctactgactcatatagcctttagcctccagagaacatagcccttctttgatgaccactgattaaaactgattgcagttgcatccaaggttgtgatttacctgcttttgacaaatttgcagttttgctttgattgtttatttgcaatgtgcgttactaatcctccttagcaactcacaaggattggaagtgatagagactacactaacaggttgactccagagttgcatgagtttaatagtgcttctagttgctttctggccaatataagattccaaagcaaaggaccatcttaattgaaatatttttaatatggcagattttataatggtaaatttaactcagatataatctgtgc

SEQ ID NO: 128703 - DNA, 601 bp, Human
tttttattctatttcttttttcttttctttttttttttttgagacagggtctcactcttatcacgcaggctggagtgcagtggcacaatctcagctcactgcagcctcaacctcccaggctcaagcaatcctcccacctcagcctcctgagtagctgggaccataggcaagcaccaccatgcccggataattttttgtacttttggtagagacagtgtttcaccatgttgcccagactcgtctgaaactccacccgcctcagcttcccaaagtgctgggattatgggtgtgagccaccacrcctggccagttttaagatttttgttagagtttggggagtatctagtgacaagtacatagaaaagctcaactggtggaaaaaatggcagttatcacttccagtgaaacaaacaaaaaagtacaagaaaggaataatacattacatggctcagcagtgaacagtgtttatgtaggtatagtgaggtaaacagtaaatattgatttaatttaaaatatgatattgaatgtattgagaagatgaggaagggaactatgtgtgggagagtagagtcaagttctcatattctttaagaaaaagcta

SEQ ID NO: 128704 - DNA, 601 bp, Human
tatctagtgacaagtacatagaaaagctcaactggtggaaaaaatggcagttatcacttccagtgaaacaaacaaaaaagtacaagaaaggaataatacattacatggctcagcagtgaacagtgtttatgtaggtatagtgaggtaaacagtaaatattgatttaatttaaaatatgatattgaatgtattgagaagatgaggaagggaactatgtgtgggagagtagagtcaagttctcatattctttaagaaaaagctagtagataatgtatgggaaaggggataaagtgtttgtgtgagagcaaagtggtataagagtgctaaattctcttctttcatggtgggagcatagtagatgatgtctctaactggaggggaagggagaataagaaatcttaatataagcatattattcagaaatatgaggtaaagaagaaacagctaaaaggtgttctcagagtttggggtagatagtagagcagagaactgctttttttttcattataaatcttgtagtggtttagacttgttaaaccatacttatactttattaataataatatatgtgttatgtatgcatttatttttgagttcccta

SEQ ID NO: 128705 - DNA, 601 bp, Human
aaagcccagaatcagtgagagtgaactctttctctaagtatcactcaagcagagaaaaatcagttgaattctagagtcaaacaaaagaaaactgactgtttttagtaggtgtttatttatgccccctgttgtcttactctgaaggcctgctttctattcacatgatttgtggttttattctttaagagagggatatatttaaaagtttgacttagccactcttaaatttaagtgctaaaagagttaaaccttaagaccgatgccccttcacatttgtacacagacatacattttataaagyctataaactttcttcatgtgtaatatgtcatttgaaaaacacatttttgcagagctgtgttgtccacttactgtgtgtttgatgtgtggatgagcatgtgtgagaatatgcacatccacttacttcggctctcctttatggtcagttacggaagcaaatggtgatactcagagacacagtgaaaggaagtgaagaacagaccgatgaaaaccattagcaacttatccagagtactcagaaggacacttaattttagaaaattggcctctaccagaaataaatcaaacaaagggcagatct

SEQ ID NO: 128706 - DNA, 601 bp, Human
catttactgaagtgtctgtcttttctccactgatgataatggcatctcttttgtaaaccaagttcgcttatccatagagatccatttccaggatccctattctgttctgttgctttatttggctagccatcgattagtatgacatttttaattattgtaagatgtaatttctaaaagtgttgttgagatttgagaatgaaataaaaatcaaaatgtccattttactattgataaagctacttggaaaatggggctttagatctgaaataaaacgggcttgcaaagatgtcactcaaaattraacttatcctcataatcacaatgtaaactggagagccataggctttccctacagaggcaggcccttaactacattggcagacagcgatcaggtgacttttcttcaggagcccagatagggctgagccaagaatacccagttgctattttgccctctagattcaccaatcaggaaagtccctcctcctctgagagagtgagaggatggagagagccaagagtgttaactcctaaagccatgttccttcataggaacagaaaaggaaaatacctccaattttcttgatatctgttagggaaa

SEQ ID NO: 128707 - DNA, 601 bp, Human
atgatctgagatggaatcgtttcatcctgaaaccagcccccctgcccacggcccatggaaaaattgtcttccatgaaaccggtccctgctgccaaaaaggttgggggccactgctttagcatatgttgataagtgtcagtaaataagtatccttctggatcgaatgcactgtcctaagtttcaagaaggcttagcaatatggtctttgcccatcaaaagctggtaagtgtcagcagcattagaaatgagcactggctgtttcagtatgaccttgggtgccaggcatgggaggtattttttgtttgtttgtttgtttgttttgagacagtgtctcgctctgttgctcaggctgaagtgcagtggcgccatcatagctcactgcaacctcgaactcctgggctcaagtgattccccccacctctgcctcccaaagtgctgggactgcaggcatgagccaccccgcccagctgtgacctttgggtttaagctcgatttagatataattccctgtgttttgttttgttttattttgttttagcctctggatccatctgaggaaatgccttgtgttttaattttaaagagtttaaatatcatttta

SEQ ID NO: 128708 - DNA, 601 bp, Human
aattaggacctactaacctctcccatcttagaaatgaggaaactgaggaactgaggggttacataacttaatgtgacacagccatcaagtggaagagctaagatttgagcccaggcagagcagttttagaagtcctgctttaaccattacatggacaacctctcctataactatgttaagaataaagtgttttacacaagggatcatttagcatctggtgattccagaaaaggaatcttgttattacagccttctcctggttttcttcattcctctctgaatgctccttcttatctcattyggagggtcctcttcctctacctcatcacgaaaagctggagctcctaaaggcttagtcctaggcccttttttctctcactttattctaagtggagataagttctgatatcagaaattgcctcctgtacattttcacagcacattctaagtgcccatgcgtttttctaccagtcttccatcccagtcacgataagctctttgctttctgcgaatgaaaccacttttcactcttttacactagccaggaagccaggcaaaaacctttgttcctccttttcttcctcacccttatatccaactc

SEQ ID NO: 128709 - DNA, 601 bp, Human
gtcttccatcccagtcacgataagctctttgctttctgcgaatgaaaccacttttcactcttttacactagccaggaagccaggcaaaaacctttgttcctccttttcttcctcacccttatatccaactctggcaattcctgccaatttctcctgctatttctgtttgtctatgtctgtacatttccattctgatccatgcctccattacctttcacctgtactactgcacagcctgcagtctcccaccatccactctggacccctccattctgctctcccaactgcagccagagtgcaytttccaaagtataaatgtctctctctctctctctctctgcacctctgacacacacactcactcactctcacactctctctcgctctctctctctctcgctttctctctctctcttctttgcctgaaagttctaaacatggcttgtggcttctgcatggtccagactttgttttcctcctcagttttatcttctaccatagaactcttcactcattgaccttttgggtcctcaaacattgttatctttcttgataaaaggtcttagcaaatgctgttcctgctacctggaagatactcttc

SEQ ID NO: 128710 - DNA, 601 bp, Human
tcttcactcattgaccttttgggtcctcaaacattgttatctttcttgataaaaggtcttagcaaatgctgttcctgctacctggaagatactcttccccaccaacccattctttacctggtgaagaactctactagcccttctaatcttgtccttttctgtctgggtcagatctctgctacaagctctttgagcccgtgtcctctcctgcatagcttgggtcagaggtggttgtttgacattgatgtatgtgatgtatgtgtacttgtctgtcctctctcactagacaataaattccatkaaaacatgaaccatggcttttttccaattattatagccccagagtctagcgcagctagatactcaatacatatttgaataagggggtaaatcaattaatttgttttatactctgcctcctttaggagtataggggactacaaaagataaggttaccaagatgtcatctctagagtcccagtctcttactaaacagtaattaaattgcggcaaattgcaactcaaacacttctgcccaaggcctccagcatctctgaaaatggtggcagagctatccatttttcttttaaagtaacaaaca

SEQ ID NO: 128711 - DNA, 601 bp, Human
atttttcttttaaagtaacaaacaactaaaccctcacagtttggttcagtgagagtttattagagagctgatggtaggtcagtgttagtagtatctttcaaagacttcatctcacagattctgtcactggccctgggagtctaatgcatcctttagctcccttccaagtctagtttttaaactctgaaagcattctctgaccagggttttaatttccctatcgagttccttctgggggctgggttctgtgagattgttgttcctctggtttccctggcaaaggcagaggttttgggttttgttgtttttttttttcattttttccctggttttcagcataaacagtttattattcccaagtatcaagtgttgtccagatactccgaggggtccccaggtatcattcctggcatctctttcctgttctttccatgttctcgtgtaggatgttacttaagccctatataaatgacatcaagatgggctatgtctgtttctacagaccattttacagtcctcataatgttggttgcctgactgtgattttactacattaatttgtatgatgatttcttaaagtgaaagctgatgagtgaagtgg

SEQ ID NO: 128712 - DNA, 601 bp, Human
ttcttttaaagtaacaaacaactaaaccctcacagtttggttcagtgagagtttattagagagctgatggtaggtcagtgttagtagtatctttcaaagacttcatctcacagattctgtcactggccctgggagtctaatgcatcctttagctcccttccaagtctagtttttaaactctgaaagcattctctgaccagggttttaatttccctatcgagttccttctgggggctgggttctgtgagattgttgttcctctggtttccctggcaaaggcagaggttttgggtttttttgtttttttttttcattttttccctggttttcagcataaacagtttattattcccaagtatcaagtgttgtccagatactccgaggggtccccaggtatcattcctggcatctctttcctgttctttccatgttctcgtgtaggatgttacttaagccctatataaatgacatcaagatgggctatgtctgtttctacagaccattttacagtcctcataatgttggttgcctgactgtgattttactacattaatttgtatgatgatttcttaaagtgaaagctgatgagtgaagtggttga

SEQ ID NO: 128713 - DNA, 601 bp, Human
gtttttaaactctgaaagcattctctgaccagggttttaatttccctatcgagttccttctgggggctgggttctgtgagattgttgttcctctggtttccctggcaaaggcagaggttttgggtttttttgtttttttttttcattttttccctggttttcagcataaacagtttattattcccaagtatcaagtgttgtccagatactccgaggggtccccaggtatcattcctggcatctctttcctgttctttccatgttctcgtgtaggatgttacttaagccctatataaatgayatcaagatgggctatgtctgtttctacagaccattttacagtcctcataatgttggttgcctgactgtgattttactacattaatttgtatgatgatttcttaaagtgaaagctgatgagtgaagtggttgacttgacccctcccaggacctctctttatctccgtggaggatcactgtgtattccctgatcccatggagctcagcctggagcctgagctggcctccagatgggctctcggcaataggcaccccctcatcctctgtccactggcccaagctgggccatggaggcctgatg

SEQ ID NO: 128714 - DNA, 601 bp, Human
cttaagccctatataaatgacatcaagatgggctatgtctgtttctacagaccattttacagtcctcataatgttggttgcctgactgtgattttactacattaatttgtatgatgatttcttaaagtgaaagctgatgagtgaagtggttgacttgacccctcccaggacctctctttatctccgtggaggatcactgtgtattccctgatcccatggagctcagcctggagcctgagctggcctccagatgggctctcggcaataggcaccccctcatcctctgtccactggcccaagmtgggccatggaggcctgatggccaagacctcacatcacaaagcctggtgaactggatttcttcagcttgcttattttgtcttttgcctgtggaactttctctttcaccaattcatctttccatcactacttggtttaaataaaatccaaaggctgccttgttcagttatacctttttatactctgtttttatttagacagactttggtaggaaaccttccaagcaaagccccgggggaaaagtgaccattggcacagatttcagcctgtgcttttggcccaatattgtttctatttttat

SEQ ID NO: 128715 - DNA, 601 bp, Human
gcagctgggattacaggtgcccaccactacaccgggctaatttttgtatttttagtagagatggggttttgccatgttggccaggctgatctcgaactcctgacctcaggtgatccacccaccttggcctcccaaagtgctgggattacaggcatgagccaccacacctggccttttttttttttttttttggtgggcgggggagtcttactttcatccaagctggaatgcagtagcatgatcatagctcactgcaagctcaacctcctgggctccagtgatcctcccacctcagcctccytaagtgctgggactacagacataagccaccacgcctggcactgtacttctttatttccttcttgcagctagctccctgatgtacagaagtggaggtgtgggaaggtaggtggtaggagtttcgtttgttcctgcttgaaacagtatgctgtataagagaaacagtaaagggaaggagatttagattccagtccttcttctacctattaccctgtgttcctgtgcaagacatgaatatgtctgagtctcagttgcgccttctgtaaaatgagaataatacttggaatttgaagcctactga

SEQ ID NO: 128716 - DNA, 601 bp, Human
aactgtttggagcttggctatcttaaaaatctggaatgtagctgggatcctggaagtaataaaaaaatcaattctgaacagctaaaactaatgttaccaaactcatataataaatacagcatattgtgcccaggacagctcctggcccgccacgcaaatcctgtttactcatactttgcacacaattttcaggacatctgctttacaagaacacagcaaactaagaaagggtatagtggccactgcgggcaggggcactgattcaaccacccacagcgccagaggggactcgaagaacccrcgccaggcttacctccagacctgcgtcctacagaacagacaccactgaacatcctgtagtccccttattgtgtcatcgctcagtaatgttcatatcagtggcccagaggcaacgagaaaatgccttttcttgttcaacttttttaagatggtaagaaaagctgtaataaaaatttttgaaaggttaaatctcatagaactaaaaatggagggaaaaaatgtggtgataaaaaggtaaaccttagatatgtagacttctttattatctctccaaaaataactaatttccttaccattctta

SEQ ID NO: 128717 - DNA, 601 bp, Human
agctcagacctaagtatgctgttccctgtctctggatccagaaggcttacactgagttctgaagtccaaagtaacttcttgtttttgtttctcttctagtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccacygtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaa

SEQ ID NO: 128718 - DNA, 601 bp, Human; identical to SEQ ID NO: 103003

SEQ ID NO: 128719 - DNA, 601 bp, Human; identical to SEQ ID NO: 103004

SEQ ID NO: 128720 - DNA, 601 bp, Human; identical to SEQ ID NO: 103005

SEQ ID NO: 128721 - DNA, 601 bp, Human; identical to SEQ ID NO: 103006

SEQ ID NO: 128722 - DNA, 601 bp, Human; identical to SEQ ID NO: 103007

SEQ ID NO: 128723 - DNA, 601 bp, Human; identical to SEQ ID NO: 103003

SEQ ID NO: 128724 - DNA, 601 bp, Human; identical to SEQ ID NO: 103004

SEQ ID NO: 128725 - DNA, 601 bp, Human; identical to SEQ ID NO: 103005

SEQ ID NO: 128726 - DNA, 601 bp, Human; identical to SEQ ID NO: 103006

SEQ ID NO: 128727 - DNA, 601 bp, Human; identical to SEQ ID NO: 103007

SEQ ID NO: 128728 - DNA, 601 bp, Human
acatccttctcagacagagacttaccaccttctttaggaaacgttccctgttcaagcaccataccctaaacctttgccttttacctttctgggatctcagctcaatctcactgctgccgcccactatgtggaacatggttaccgagattgattgtggcctataataaggggaagagatgtgggaatgggagaggaggagaagatgagagacttgaaaatgatggcatgttgtggaaagtgttacttatggaagtgagtgtatgtgtgtgaatgccttgagggcagaacaaagttgaaagartggctataatctcttctgaagtaaacaatcaaaccaaaagaagaaaccaaagttaagcaagaaaaacatatctgtctgctctctctggccattggcatcataaggcagtatggaatctcaagaataggagtcatggtaatgagctcctgagctcctgtcctggctctaccatttgtcacttctgtgaccttggacagatgactttatctctctgaatctcctttcctcgtctgtaaaagaggacaataatacctgccctaactcccttataggctaccaagtggtatataaatgctggct

SEQ ID NO: 128729 - DNA, 601 bp, Human
agcataaataaactcagtggcctttttataaactcccaaaggaatgccaggcatatctcaaaatctcactaatttgtcacaatcgaaattacatacttaaaagcaacccagccctggtgcctaggtggttatgtgactaaatgcaggaaggagggtgaacacctggctgaggctggcgacaccagtctcctaaaggagccacttagagaaacaacagaatttcacttacacatggaaagaaaagaagcaggttgccttaataggctcacaaaagataacatgctttgagaaagtaacaaargtccttctgttattcttgaaagagaatctagagaaatgtctcttttttttgaagggctatagattgtatagaattctttttttttttttccaacaacgctgttaatgagtgggccttcctttattaaagaaagaatgtttcattccccatgcttcgaataaaaataagctttctgaaatttgcgtccccaattttatgactaattgttaaatttttatagaccaccttgcatgtcacaatagagcatgcttgttgggctttttgtcttaattacacattcatgttccttttggtttgagg

SEQ ID NO: 128730 - DNA, 601 bp, Human
atgcccttgactgggtaaattatgtgcagtattcccttttctgaagctaattcaaagcactaatggacttaatacgtagcatgcatatgtgaggtgagctattcatggaaccaaattagctcataagagatattatccattatatgcctcctagtaatcatttcctcttttctcaaacacaaaccaacccagaagaaagatgctaaatttaattataacaactttatgtgaacaatgcaggtaagccatccagtgtgcttccaaatgcacttagaacctgtcaagcagtttaaatattttyatatggaatctaggggtttgcagctaatatatgaggtgaattttaaatgattttacagatgtcattgggaaagtgagtaatatgagtaatgaggtgactgggccagtgaatcatgggaacctgtcaaacatggggagatgtcagggaagagatgatatcaaatagaagtaacttagcaacccagcatttagctgtccagagaatgagcaagagtagcccctttaaaatagctgagtaaatttatcagttcctgtatatcttaggtatgctataaaaataagtctgttctctgtcaacctg

SEQ ID NO: 128731 - DNA, 601 bp, Human
atttatctttggaatatacctaggagtgggatcgcagagtcatatgcttagagtatgtttaaatttataaaaaccatactaaattgcttttagagtggctgtaccattttgcacttacaccagccaagtatgaaagaccacttactcagcatgtacttatttcccatttgtatatcttttttgatgaagtgtctgttcaaatcatttactcatttactaaatcaggttgtctattaccttataaatgaatcttgagagcttttattgtttctggacataagtcatttgtcagatatgtgayttgcaaatattttctctcgggctgtggcttgtcttttcattctcttggtgatatccttctaagagaaaaatttcttaattttgataaaatccaatttatctttgtttcatgttatggattattattttgctgtcaagtcgaagaacttttgggttaattcaaggtcaaaaaaattctcccatgttttattctaagagttttatttaagtcttcattttggattaatttttatgtgtgatgtgaggtataggttgagatttacattatgttccagcacgatttattgaaaagattgtattt

SEQ ID NO: 128732 - DNA, 601 bp, Human
tgcccccctttgcctggagttgtcattctctagtacctttcacttatagcataagctggctttctaaaggactgctgtgttgttgcattgacaccgtatctctccaacaatgtgaaatcaacaaatccctttggcaatttctgaaacatataacaaattgtgcattattctctaaaaaaaatcaactttgatgggcttattttatttctacttcgaatggtaactggtaattgttattaccttactctcattccaattatcaatactctagctacagagagtaccaccagaccctgtaccrggacctagtctagcctcctggctgtcagataccttgcaaggagtagacactcaataaatgttttctgaatgaatgaaattaaatatagattattagaaatgctgctggaggagaagccaatgaaagtgtgtgagttttatcaagttggtttgcctgagctggtgctaaaggagcaaattggaaggtaaccattaagaaacatctcatgctgtgaggatatagcatgtcattccatcttttgaagtgactgtgaaaggaaaaaaaaaaacatggctgtagtattatgaaagcctcgcgaat

SEQ ID NO: 128733 - DNA, 601 bp, Human
ttcattcaaacaaattaggtttttctggtaagtcattaacacctcctctatacacacacacatacacacacacacatatgtgtttttgtaaatgcataaggacctttagataaagaaacagattcagcagtctaataacaagacctcactcacataaatgttttcaggtttaatttagttttggtgacggaaagatgctgatgtttcttcatccttagtctgtggtgatttgtaaagctactcagtaggataccttttgggagtacactatctgtaaagcaaaactaaaaaataaaagaaraaaggaaaagaaaaactgaaggaaggaaggagggaggaaggaaggaagcaaggaagggagggcccctccaatggaagtcagacaccaaggttagttaccatgactcagttaccatgacttgtgagtcatttacttctgatttcctgtgaaaatattgataaacttgaacccgattttgcagatgtattcttctattcaaccatatttttatttgagccactcagctattcacgcttattcttaatcacaagaatttgtgaatacttccaaaattgcatttattacgttcttggtatttta

SEQ ID NO: 128734 - DNA, 601 bp, Human
aaaatattgataaacttgaacccgattttgcagatgtattcttctattcaaccatatttttatttgagccactcagctattcacgcttattcttaatcacaagaatttgtgaatacttccaaaattgcatttattacgttcttggtattttagtagagggaagggagaaaggtgtatgcaagctccatcttgagccttgggcagatcccaagctgcctggttgctaagccaaggcatgcaggctcatactgacaatgccatagccatacctgtggggctggtagcaatgagctttgaatgygtacaacactatatggtttacaaagcccttacacaattattcatttgcttccccttatgccaagcctgtgaggtaggcagaacaggtagaatcagagatgaacggtattgctaactgggagaactagaagccatccaagtcaaagcccacatgttgtaagcaggaaagctgaggcccagaatggacaagcaacttgaccagggccacccacatagcttttggcagagctaggcttgagttaagttctccctatcttaatacttagtccatgttgcttttggggctctctctgactataac

SEQ ID NO: 128735 - DNA, 601 bp, Human
ctttatcatttccatgtcctagtgactggcttataatggctacacacgcctgtaatcccagcactttgggaggctgaggcagactgatcacaaggtcaggagtttgagactagcctggccaatatggtgaaaccctgtctctactaaaaaatacaaaaattagcctagcatggtggcacgcacctgtagtcccagctacttgggaggctgaggcaggagaatcgctggaacctgggaggcacaggttgcagtgagccaatatggcgccactgcactccagcctgggtgacagagtgagackctgtctcaaaaaaaaaaaaataaaaaataaaaaattagtagaacaaatgcaaagaatccaccaaacagatctgccatttgctgtgtgaccttggacaagtcactttacctctttgtgcttcaattccttgtctgtgaaaagggtgtgaggctaatccctgcctgtttagtttctggtacaaaaagaccaaccaattacttactacacactaggcaggagagatacaaaggtgaataaggtgaggcttgtgacaacatactagttacttgagataacagctattcaggtagctgtgtgtta

SEQ ID NO: 128736 - DNA, 601 bp, Human
cctgcaagtggttttggatttgttttgagtcctagccatgagctattgtttggataatatggtggaaaattgagccttttgtgattttgtggggtttgactttggagtcttcatatcacattaatataagtgtcttcctattattagaagttatgtagaatgctctatcacttatgaaatccattctttgccaaatactaaaagataaaacagtattccttagtcttttcttcattatccatgttagtcagtcttacagagggagacatatttgttatagtggaaagtgtgcactcttgtmccagtaatcaaacttcacttgctactaaatgtaaggctgtgtataagtgacctcacctcttggaacccccattacctcagttgcccgttgggaatatgaatccctgctttctgtctctctctgtctctctctcaaaggatcaaaggatcccaaacataaagcagtgcttccttgtggaagttcagaccagtctcagatgtgtgtgtgtgtgtgtgtgtgtgtgtgtgtgtgtgtgtgtatgtaacttatttttgttaaaagagaagtgattcttggtgttgtgtacaggtactcatcatt

SEQ ID NO: 128737 - DNA, 601 bp, Human
gccttttgtgattttgtggggtttgactttggagtcttcatatcacattaatataagtgtcttcctattattagaagttatgtagaatgctctatcacttatgaaatccattctttgccaaatactaaaagataaaacagtattccttagtcttttcttcattatccatgttagtcagtcttacagagggagacatatttgttatagtggaaagtgtgcactcttgtaccagtaatcaaacttcacttgctactaaatgtaaggctgtgtataagtgacctcacctcttggaacccccatyacctcagttgcccgttgggaatatgaatccctgctttctgtctctctctgtctctctctcaaaggatcaaaggatcccaaacataaagcagtgcttccttgtggaagttcagaccagtctcagatgtgtgtgtgtgtgtgtgtgtgtgtgtgtgtgtgtgtgtgtatgtaacttatttttgttaaaagagaagtgattcttggtgttgtgtacaggtactcatcattggatcctgttataaagctgtggcaacattttgggagcaggggctcatccctacctgatgactgggtgaaggat

SEQ ID NO: 128738 - DNA, 601 bp, Human
ttgtagaaggagaaacacccaaaggagaaacccttagattttagggtcatgattttgaaagtaacactgatctaaactttgcttaatgatcttccttcacctatgaaagaggtcagaactaaacgaacagctaatctcactgtcccagtatgggtgtgtgctattcctttttgcattcacacccaccctttttaggcttctgttctccttccccctggcatctccagcaaagggagttatccatccagttcaggtccaacacttgtacagcaattgcagtgttttcaggtgggttctccarttttgaagataatttgtgcaagttgcaattttgacatttgcaagtgtatacaatagaactgttgtttaaatgggcttttatagttaagtgcacactttgaaatcaggcacagtttgcattttctgccaattatctgtgctaccatcaaccccatgacaaaggtagaagcaagtggactaaaatggtgaaagcaagaagtctacacacccactcctgtctcatttgattcctgccaaaacgttggtttgaaagaaaagtacactttaaataacaaccaacacatacaatggcaccatgtgc

SEQ ID NO: 128739 - DNA, 601 bp, Human
cttgaaactatgaaccttgactcataataatatgtagtttggttggggtggggggagaatcaaatttcccattgtcttagtctacttggactgctataacaaatactataaacaacatggcttataaacaatagaaatttacttcccatagttttggagcctgagaagtttgagatcaatgcaccagcataaagggtatcttgtgagggaccatttcctcatagaaagctgttttcttactctaatcccacatggtagaaggggtgaggggtctctctcaggcctcctcttataagggcastaatcccattcatgagggctcaactctcatgtcatgatcccctccccaaatacccatgtcctaatactatcaccttgggggtgaggattttagcatattaattttggagtaatacaaacagattataggacccataataagtaaataacagtaaaagttaatgagatcaccattaagttctctaagtttgtaaatacagaccaggtcaatacctgggatacgaaaacaactgtgatttcagtgaaaaaataaatctctagatggcttgtttcccacattttaactagttcaaacactgta

SEQ ID NO: 128740 - DNA, 601 bp, Human
agaaaactaatatttgggtctatttttataagagactcatccattgcctttcatgcttaccaacttgtttgataattagaaagtggctttatatcctcatggtgaaataattttcaaaaatatccccatctgttatcaaccacagcggcatatttccaaattcttctcagcatttttaaacagtaactgggagtgaagcaaataatgctggtggaaggcactgaaattgataagcaagggaccaaagttaaaaaaaattcacttgtataattgaatgtaatgttgtgataacacacccccmcacacacacacatgcatacatatgctctgtatcccagaacagtaggtcactctaatgtctgatctaatgagatgcacacatagacatatgcacactcttttttcagttattacattgtaaagtgctatgatcagagatacttttcatgtgcacagtgaatgataattttaacacactttcacacaatacattagcccatgtgagtggcacagcattcctgttagatagccaattgaaaagaaaccaggcgtagggaggggaagatattttcctaaagtcctccacctagggagtggcagg

SEQ ID NO: 128741 - DNA, 601 bp, Human
ctgaagatctacagtacaaccccatagtatactgccttgtccttgccaaaggttctagggtccctgagagagcaataagtgagagaaaagtatccagagaagagtagaagctaacgatttagcaacctataactctgacagctccattgcctaatttctggagttacttgttttggcataagaagcccactttataaaaattccagatggagatttcaattttgtaactacatagaatatttcttctttttttctttttttttaacttttattttaggtttgggggtgcatgtgacacggrggtttgttatacatattgtttcatcaacaagttataaagcccagtactcaatagttatcttttctgctcccctccctcctcacaccctctcctctcaagtagaccccagtatctgctgcttgattctgtgtgttcataagttgttaacatttagcttccacctgtaagtgagaacatgcagtatttggttttctgttcctgtgctagtttgctaaggataatagcctccagctccatccatgtttctgcagaagacatgatgtccttcttttatatggctgcatagcattccatgggata

SEQ ID NO: 128742 - DNA, 601 bp, Human
ggctttccttctgccaagggcaagtatctggagaagggcccacctggaggtccctggagaaggacccacaatagctagagcatctgtgcaccagtctggtaaaagagatgagggaagggccatgctaccagccttcactacagggctaagtttggtagagccaggtagcttcctatctaagcaaggccttttgtttcctgagcaactttcagaagagcacagtgttgactgagcagaataaagcccatccttagatagtgaaatttttaaaaagtatcctttgataattagcaacagtatrcacatagatgagctaagcaatattttctttgatgcgaacagtccttcttgaagtacaagaaggcaacacagatgttcattcggcttcttatgtgttcagatactgtggaaacagaattcccagttcctcaaacaaaacatttcattcatacctgtccatacttgcatgtgcctcctgtgtcatgcctctctgcctgtggtactctggaatctttgtcttctattcacttctcaagattgcacaccagcataaattcctaggtgaagacttcctagaacacaggtccacacaatgaaaaag

SEQ ID NO: 128743 - DNA, 601 bp, Human
gcaggacagtaagcagagtggttagggacatgggctttggaatcaggccactgtggattgccagaccagctctccgttcttctcttgtccagctgtgagacttttttttttaaaaaagacggctctatttagatgcatataacataaaacttaccattgtaaagtatacaattcagtgttttctagtatattcacagagttgtgaaaccatcaccactgtctaattctagaatatttttatcaccccgaaagaatcttcataacattagcagtcactccccttgccccatccccccaagcyctggcaaccagtctctttcagtctctacagatttgcctgttttagacatttcatatgaaaggaatcatgtgatatgtggcctttggtgactggtttattgcacttggcataatattttcaaggcttattcatgttgtaccatgtgtcagtactttcttcctttttgtagctgaataatcattcatttcatggatctatcacatcatgtttatccattccatcagttcattgacatttgtgctgtttctactttatgtctattccgcgatggttaatgatgttgagcatcttttcatctgc

SEQ ID NO: 128744 - DNA, 601 bp, Human
taaagtgttctgttatcagcagctgaaaatttgccatgcatcacataggactaagaattggtccttgcccccattgagtttaatgtaagacacaatggctgtcagcaggtatgagttgtagtgcacttaacagcgacttagtatttcagttgttttggacagcttccttagatagatattaatggaccaactccataaaggagttatttccttaatcatttgacaattaggagctgacgtgaagagatgagtaatgaagtaccctctgtgattgtactttggaggtagccacaggggtttyttatatctaatctgctgtagttgctctaagaagctgaagggagactgagaggggcaattccaaaaggaattctgcctttcctcatcacttgagaatggaagctaaccagtgactgggtttgtctccaaagagaatgctgagtactagagacactcttctgcctgatagagaaagtcctcacttggcatctgagccttatcaaaatgaagagacatttgatagacaggcagcctagtgtgagggaaggctttgatgtctggtggaattcctgatttaaattcagtgttcttagacaacctt

SEQ ID NO: 128745 - DNA, 601 bp, Human
aaaatccagaccactcatttttcaggtgccttgccttaggagagaaagatttcttatccacatcatgggcttacatctctcagatcaaattttacaggaagagatcggtcatatatcagaaggttaatgactagccatttctctcccagctcttttgcggccacccagctacccagcagcagagggcactgaaaggcagtgcaggttcactgtgccttttacctccgtcatccagagagacccagcaggctttgacaacagcctccagagctagggatggttatcatgcccctcttctttmatgggaaactctgagcaccttgtcctgtagagatccagtgccacatcccacatacacagtgattgatcagtacatttattgcacttttagtagtaaaaatgtatagaatccagtcatctctggagatgctgaaatagtattttccccttgatttaggggaaggtagagagggaagatatgtgcaaatatgatataaatataagagctcaaatatctaattagctgaaacaatcttggttccctctacacctttgaaggatttgcagctgtcagattgtagctccaatactttattctcat

SEQ ID NO: 128746 - DNA, 601 bp, Human
atataagagctcaaatatctaattagctgaaacaatcttggttccctctacacctttgaaggatttgcagctgtcagattgtagctccaatactttattctcattgcaagatgtatccgaggatgatttagaaaatatgccttctaactcaaacaccactctgatctctttgtaggatgcttgaggatgacctgaagctgagcagtgatgaagatgaccttgagcctgtgaagaccttgaccactcagtgcactgccactgagctctaccaggttagaagagcttagggctttgttttggratgaaggggggagcaggaggaactggaatggctttgacatgctttgacatgcgcaaacttccccatgctttatctctgggctttggagagagggaaagaagcaaagatgagcatagtgttctggaacaggtcaaatcagttcaaactttcattaaagctatagtaaggagatgcagagctctttaaaactgctttcaaccccctcccatctctctctctgttccatacacaaatgctggtcagtggtaagcaatagagattgtcttgccctctcttggactacttattgtcttgggtgag

SEQ ID NO: 128747 - DNA, 601 bp, Human
tccctcctcttcggagtgtaaacaagagccttacattcagttgcaggatgaattgagatgcacatcagcctggagctcagctcttcctccagaggcttattttttccctccatacagagcttactgtcctctggcacattttcatgcccagagcataatgtccaggcctatgagtttgcctagtcattcttgattcatttatctcatcaatgtttaagtgactattaagtgcaagacatagttctatccactgagaacaaattttccccaacctctgcctgtcaaaagtatgttcctgccyctgttacgtatagcaaagacctatttcattgattattagaaaagaatgaataaagttaaaatgtggaaagcccagtgatctaaagataggtaacatgtttttgcttcctagaggttcaaggttcaaatacagaatgtttccatgcacgttttcaggcatccataataatggttagtgttttcctgaagattataatccccgtatgacaagtcagaaattcaggcatccaggtgttgcaaaatcttgagtgacattttgtcctcttaatctgccacccttggctgtgtgtgcttaatgcca

SEQ ID NO: 128748 - DNA, 601 bp, Human
agcatggatttccagcactaacatctaaaatttggaagtgttttattcagttgttatgcatagaggtcttcagtatgttgaatatcacttgtcaccgagaatgtcaagtccagagttagattatatgttgtctctgctaaaagtggttgcctctgtattctaatttacagcagtattctcttctctgtagcccttacccacctccaagattcacaaagatccccaaacagatacttttttaaaggatctgaacaaccctgaggttgtcaaatagctgcttcaatgctctttttatcaaacwtaacgtctatagcctgaaaaagtctatgggagtacaagtttggttctgattacataattatgctacagaaatatgaaaaaaaaatcatcactaaaaccctccaggtgcttaaacagtttgatagactgtagccattctgccatcagcacccccagctgtgttgcttagcaacattttaattccagaagaatcgaaggagatgaaatccctgtggagaaggaaacagaaataagagggctgttgacagatgatctgagttgtttcttctaatatactgtgaagatcactagctcttttcat

SEQ ID NO: 128749 - DNA, 601 bp, Human
ttaagtttctgggagaatggatcagctaatgccaacaagaaatgtttttgttttgtataataaaataactaaatttccagagcaccagggtagcatttagcataccattaaatccaagccctagtacgtttttccaaaaggtgttgtgtactttgcttttaagtttcatttttcttaggccaaagaatattccctatcaggctctgtaacatctagaggggcatccgtagtctggagatatattatgttgtagtcttatggaagtatttgtagtagctgaggttttgtcaggtcgtgcagytgggggttgaaatcttctctgcagcctgatttcttttccgtctgaatgccctaaaggctcctccactgtgagcctgtggctggcaagctcggagaattagaggatggtgctaatgaggccagggtcagggcttttgtccctgggtgggcgattagtgatcttctttcctgcagttcaactgcactcctcccttcagtccgcctgcatgcagatgtgtgccccaggtcataaggagtggggctagggctggaggaatgtaaatcaaggccctcaatggcaaatgtctccaagctccagccc

SEQ ID NO: 128750 - DNA, 601 bp, Human
atatatttgaaaatctgcttagtaataaacctaagtcataaccaactggtaggtgtttagaattgtcttctaattaagtaagatactgttctcagaatgagtttgggttcatgataccaaactcagcacttgaagaaggagacttcctcaagacctcagctcagaaacaaaaactccacagcagggttcagttgctctgcctgacaggagaacagagtcaaagtttttaaaaagttttatacatagtggtccttttgccatttctgatgacatcaaaggcatccctcttgaggaaatctcractgcacaaccctactatgcccccagttcagcaggaagcagttagagcagttgttggccaacctccccaacagcacttgggttttcccattgagagggggactgagagacaggactagctggatttcccaggccgactaagaattcctaagcctagctggggaaggtgaccacaccctcctttaaacacagagcttgtaactcagctcacacccgaccaatcaggtagtaaagagagctcactaaaataccaattaggctaaaaacaggaggtaaagaaataatcaaatcatctatcgcc

SEQ ID NO: 128751 - DNA, 601 bp, Human
tcacggacgtttctagccacaaggtctaggcaatatctctgcaaagtggttaaactaaacaagctttctttaattttatatgcttctcatgaatatgtaagtcattaaatcccttggtcacatctcagtgatggggtaaaaatatccctctcttaatattgaagtgtacaaaacaaacaaacaaacaaacaaacaaaacccaagaccgtgttaaaggaaataacattgctacaaggttaattttgcctcatacagcatttcctagaactgaattgcctgatctcctccctcgggggttgcrccaatgcttgcaataaccaaggctgattttattggaaaatcacctctagatgaagaacatactccagaggagattttgtatgggacaaactggtttctggtgccagtgtcatgttatccaggttagcactctttgagctcccaatctttctgttcattcaggcagcacattcattagcaacccttaaaacagggtagaataactagacatatcagggaatttactttaaattgttttcaagacttattggctagcaggccagtattcaaattgtagctcttaacatgcacattgaatgtt

SEQ ID NO: 128752 - DNA, 601 bp, Human
gtggttaaactaaacaagctttctttaattttatatgcttctcatgaatatgtaagtcattaaatcccttggtcacatctcagtgatggggtaaaaatatccctctcttaatattgaagtgtacaaaacaaacaaacaaacaaacaaacaaaacccaagaccgtgttaaaggaaataacattgctacaaggttaattttgcctcatacagcatttcctagaactgaattgcctgatctcctccctcgggggttgcaccaatgcttgcaataaccaaggctgattttattggaaaatcaccwctagatgaagaacatactccagaggagattttgtatgggacaaactggtttctggtgccagtgtcatgttatccaggttagcactctttgagctcccaatctttctgttcattcaggcagcacattcattagcaacccttaaaacagggtagaataactagacatatcagggaatttactttaaattgttttcaagacttattggctagcaggccagtattcaaattgtagctcttaacatgcacattgaatgttttactagtagtggtgagactcgcggtagtttttatttcaaatgct

SEQ ID NO: 128753 - DNA, 601 bp, Human
gattttcaaggaattagaaggctatatacccttaataaaaaaaagaaacaatgtgatccataatataatcttttctaattcagaaagaccatataagactctcactgtgaatagttctcattgtgccatttgcacagaaattctgattactcaaaagttctaggtgcttggacacaatcatgctcagtctcattttccagaatatcaaattatgttcttggatttggtagtttggtgttaaatcacacctttgctctatgtggcttcctaccacctcaacaaaactatagtcaatcacacwgtgatgtaaaaaaaacatacggtagtgtctgcacaaattctacagtgtccaggttaagtcaagcattgcctagacattttgtctcctactttcccaacaagaagatagttgtattggggtagtttttctatagattatagattattgagagtagaactcccccaggctttttagtggtatagatgactgaaatccagacatattgatccttgtaacatttggagtgacaaggggtaggagccctgaacctcttgactgcaaaccatcatgttagtttatcctgacatactattccaattc

SEQ ID NO: 128754 - DNA, 601 bp, Human
aatgtggatacaaattagattttatccctcaatccaccacccagtattctcagtgttgcagatgctctgtgttatatttaaaacttcacttgggaggaattgaggccaagttagcctaatctctggattagtctcacttagatttctgttctctcaatctttatttagtaaccgaagacaaaaacaattgattagatttaaagagaactttgcataaatagggtatcattactgacactaaagagagatctacaaaggaatgcagggaaataggagccctgttataggtctcctccctttcccccccactgctggagaaagacacacagttcccaggagatacagtagtctccttatttcttgtactttccctaatctcttgatgtacttgacagagaaatgtacttgtagttcacatttactaagcagatagcagtttaaaatgagctttcactatgttaaagaaaatgtctacctgggagattaaagggccagtctttaaggacacacggcacaggaagtggataggccctctgcactgagtagtgactgatgaggagcctgtgctggctttgaagggatcctattccttcccaagcag

SEQ ID NO: 128755 - DNA, 601 bp, Human
cctaatctctggattagtctcacttagatttctgttctctcaatctttatttagtaaccgaagacaaaaacaattgattagatttaaagagaactttgcataaatagggtatcattactgacactaaagagagatctacaaaggaatgcagggaaataggagccctgttataggtctcctccctttcccccccactgctggagaaagacacacagttcccaggagatacagtagtctccttatttcttgtactttccctaatctcttgatgtacttgacagagaaatgtacttgtagttcrcatttactaagcagatagcagtttaaaatgagctttcactatgttaaagaaaatgtctacctgggagattaaagggccagtctttaaggacacacggcacaggaagtggataggccctctgcactgagtagtgactgatgaggagcctgtgctggctttgaagggatcctattccttcccaagcagcagctcagtatggctccagctcagtgagtgagagttgtaatgttggagaagaggctctagtgagggcatagggtggggtcatgaactcgtttgggttcaggcaatgaataaagg

SEQ ID NO: 128756 - DNA, 601 bp, Human
tggattagtctcacttagatttctgttctctcaatctttatttagtaaccgaagacaaaaacaattgattagatttaaagagaactttgcataaatagggtatcattactgacactaaagagagatctacaaaggaatgcagggaaataggagccctgttataggtctcctccctttcccccccactgctggagaaagacacacagttcccaggagatacagtagtctccttatttcttgtactttccctaatctcttgatgtacttgacagagaaatgtacttgtagttcacatttactwagcagatagcagtttaaaatgagctttcactatgttaaagaaaatgtctacctgggagattaaagggccagtctttaaggacacacggcacaggaagtggataggccctctgcactgagtagtgactgatgaggagcctgtgctggctttgaagggatcctattccttcccaagcagcagctcagtatggctccagctcagtgagtgagagttgtaatgttggagaagaggctctagtgagggcatagggtggggtcatgaactcgtttgggttcaggcaatgaataaaggtctgtgctc

SEQ ID NO: 128757 - DNA, 601 bp, Human
gctagtcttggctctccaactagctgtgaggcagagaccagctccaccccctttctgaacctcagtttcctctaattaaaatgataattgaactcactccttcttggtaatagaactatataccatatgtttagctaagatcagagccccttgacgaacctgtggggtattgaacaagggggcaacaaaaaatgaaaaactaccttaactgaaaaaaatgggacagttcaacatctaaggcactacatctatatctgcatccagaaggcatgcaaacttggcttaaggtttttatgttgartgagggtggcaaggcttttctggaagacaaggcagtgtgatggaaagccaaggaacttgcatacacataggcctggttctcttcaaagctttcaacttgggccagtcactgggcctcctaagcctcacgtttcctatctataaaatgggaacggtaaaccccactctacctgcatttcacagaccacaggcccttcacctgaactgggctgttttccatcttatttgagagtaaatgaggcaatgaattatgttgtttttctttcagcccacccttggccactccccagcccccacctgc

SEQ ID NO: 128758 - DNA, 601 bp, Human
tgcatacacataggcctggttctcttcaaagctttcaacttgggccagtcactgggcctcctaagcctcacgtttcctatctataaaatgggaacggtaaaccccactctacctgcatttcacagaccacaggcccttcacctgaactgggctgttttccatcttatttgagagtaaatgaggcaatgaattatgttgtttttctttcagcccacccttggccactccccagcccccacctgcagtgcaagccagcgggggttctggcagctccagcgaatcggagagcagctctgagtcrgattcagacactgaaagtagcaccactgacagcgaatctaatgaggcacctcgtgtggcaactccagaggtgagtgaaggtgccagggccctaaccatgatctgcctgtcccacaggcagcaccctcaacacacacacacacagacacacacacacacacacacactttcagcacaataattaataattaatttagcatgataaccacttcagaaaagtacccagatttttaacagcacttttaaaaagcatatattcacatactcctaacatgcatacattttttgctgtgtgactgat

SEQ ID NO: 128759 - DNA, 601 bp, Human
agacaataataatattactgctattaataatagaaatacctgttgaacatggaccatgcatgtgccaggcactgtgctgagctcttgacttgcattttctcatattatcctcatgacaaccttacagagtacttattattatttttgttttacaaatgagagaataaggttctaggaggttaaaaagaactttcccaagacctcacagatagacagtagtagagccaggactgaaaaccctggtccatgtgtatccagagctgatgttctcaacctgaaagctccactgcccacagtggcwgctgatacaacttcctcaacccttgcctgccattgtcttgtgcaggttgctatcacaactactcaagtgtttttaattctgtcaccctctattggctggtaccataagcctcagctgatggctttcaaaggaagagctcttctaataaaactgatggcagaactcagagttaggaatcaaggacccgaatagtatgtatcattgccatggtttagtggatgctaatgtctgcatgcatgttcctataaattggttattgcccatacaccgacgaaagctcagtggtttctattttttgga

SEQ ID NO: 128760 - DNA, 601 bp, Human
cttctaataaaactgatggcagaactcagagttaggaatcaaggacccgaatagtatgtatcattgccatggtttagtggatgctaatgtctgcatgcatgttcctataaattggttattgcccatacaccgacgaaagctcagtggtttctattttttggaagtaaaatctttttgtccttcagtaaaaatacaaaaggcctgatttgtttgcagggaatgacagcatcacatagaaggcactggcactctggcagctggaaagcctttccttttgaattatacttgaggtgtgcttacrttcctttcaggatcagagactattacctttgcctcctggtgagaggttgagtgatgattcccacaaaggattttggaaacaggtttccctcattggcatccctgccaacccactggaacatctctctgtgaataattcttttcttcctggccaaactagagaatattttcagagaaggagtcgaaatgagcttaaataagtagactgcagctggtttgtatctggctatttaggtcatttgaatattatggatagtgggtatgtgcaggtgtgtgtgtatgagtgtgtgtatttgtatat

SEQ ID NO: 128761 - DNA, 601 bp, Human
actctaattcagatttatcactaaaattagtcaaaacgaacttttagcactcagtgaagggtaaaaggaagtaaataaattaacaagaagcatcaagagaacccctatcactttaaccagatcacctgcttctacccaacattcagttctgatggtgattactcagtttccctggaaaagcaactccttgatcttgacagaacgaggcagctgcttcctctttgatgtcattacttaacattcatatgaatcttgaggaccagtagctatgtccggaactccacagaagccaagggaatgaaaaaaaaaaaaaaagctgtcttttcctgacacagaactgtcccaggaggagggccactcccagacagctcatctctctggcctcctcaaacatgtcattccaaggagctggcacctgttcttccttctctctgtgtgtggaaggttccagagtccagcaggaggcctcctggcacctcctcactcaaacagcttgagtcttcttcagagaagtcctgccttctgtttctgccaagcattgtgaccaagttatttctgtcttataaatatcacttaactaacaatcatgtcagcaacttga

SEQ ID NO: 128762 - DNA, 601 bp, Human
tatctctccctctcgttgtccatgcatctcttcctttctccctccctcctcctctctcctctctatattcttccttccctttcccctcacatttatcactagatttagacctttgctgtggctgtcttaatgggatggtggagctatgtaatggcagcacccaattagcttgatgtttggtgtcataatagaacaaaagctggtgattcatggcgttcataaaatatccagggtcacctatttatcctcaagctgtgtgcattgttttctttctttttttttttttgccttctttcgtaaygtgcttgacattcaaagcatttatgacaaggtgttttaaaaagctggacctaatggaaactatttgtcctcctttttcccaggagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtc

SEQ ID NO: 128763 - DNA, 601 bp, Human
tagtactatattttttggctttttgacacactatttcaaactatcatttataatgaaagtgatgggattattgtcaacagtcatactacagcttctcatctttcatgacaatagcatcaatttgttaatcttctcctgagagtgaaattgatgtcctcacaaagagttctaaagcaaaaatgtatgtgttcattgtccatgagacttctaaaaagcagcccttagttgcaagtactgtctataggacactacaatgagcagatagtttagtaaatttcatgaatagaaactagttgaggcratgatttggattcaggtccaccaaaaagatagcaataacagcaacaacaatgccacaaaccacatatgataccctgcctgcatttttctcttctcaactagccttggtgtcatgatgatagaaccttaagccggtaacttcattgtttttttttttttttttttgaaaatagccaatcaagtttatttataggtggttaactggaatatatattaagaatagttgggcattgaaaagtatacataggcagataggtggcatatagttggctaagtgttgctaataagtttgaaaaaacag

SEQ ID NO: 128764 - DNA, 601 bp, Human
cgaccctctggaagcaaagtccccatacaccatgtactctgagactgtggagctcctcaggtgaatggcctttctgcaatcatcttcctacactcatttcagctagaattagaagctatgttttaaaaaatgtatcatttccacttattaataatttgtccaagccatcctcttagaagtcatcataattagttcttgccattttattaatatcatggaaaatttataattgatggatgctgactttataaattatcccctccagaagttataatgtgagtgttataattttcaatattcrtaacattaaaatggaaatgtagtgggtagaaataagtataatcattttaccatttagcattgacttgtcttttcaaaggtgcagttttataattcaaaaaaatggtgctctcaggatttctattacaaaccatgttttctaagaatttttatcttggttattaaaaagggaggggcactgttccaactcagagttggtgtttaaggctgcaggtgtggagtagactttccatgcatctggaattagggaaatagatgaggtggtagtaggggctggcggtacagatgagaggatgagaat

SEQ ID NO: 128765 - DNA, 601 bp, Human
gacactcaacagaatactttgcagcgattgaaatacaacaatgacagagactatgcagccgcacaaaatatatttattatatgatgttaaaataaaatcgagctgcagaataacatgcacactacaattatgatcatgaaaagtttgtatatgcatctgaaccaaactggaagggaaatgaaatcatagctgtaataagtcagtgagattatgggtgatttccctctctgcatattcttctttcttattttcttttaagaagacacatgctgtcttaaaaatatgaaagtaaggccgggcrcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaatatgaa

SEQ ID NO: 128766 - DNA, 601 bp, Human
aatattcattgatatatggtaagtgctgtttaataaaaccaaaggcataatagtgctgaaaatgtgaaggcacttgctcagccaattatccaagccttcatgataatttttatattaatactaaaatgccctagcctaagatagaaaagcatccactataatgctgattggaggctcagggaactcacctgcgcctgaggccttatttagagttctatctgcttgggacagctcagtcttaatagcagtggagtaggggcccaaaaaccgttgacctggtgctgaagctgcccttggcttmcagggtaagctaagagggccccttcctctatctgggcttgttctttatcgctaaaatgaaggggttggacccaatgccctcgaagtcccactgaagagatgtctcttatagagagtgagttcgaatcccagttctgtgtcagctgtgaagttagctaacttgcctgagcatcagttcctcctctgattccaaaataccccttaccagcccaagcccacacccctcagtgatgggaagggaaactagatgactgtggacatagaccgctttataactccaagctgctttttcagtttttca

SEQ ID NO: 128767 - DNA, 601 bp, Human
agggaactcacctgcgcctgaggccttatttagagttctatctgcttgggacagctcagtcttaatagcagtggagtaggggcccaaaaaccgttgacctggtgctgaagctgcccttggcttccagggtaagctaagagggccccttcctctatctgggcttgttctttatcgctaaaatgaaggggttggacccaatgccctcgaagtcccactgaagagatgtctcttatagagagtgagttcgaatcccagttctgtgtcagctgtgaagttagctaacttgcctgagcatcagttyctcctctgattccaaaataccccttaccagcccaagcccacacccctcagtgatgggaagggaaactagatgactgtggacatagaccgctttataactccaagctgctttttcagtttttcatcatttcaaaattcctgcatctctgatcaaaataatttcttcaagaataaaacagtctctactgccactttataaatatctagaaaacgtactccaaaagcaacgggacaatgaactctactttgaaatcataaaaacattcagtgcgagggaacagatccattgaaaactacacat

SEQ ID NO: 128768 - DNA, 601 bp, Human
cctgcgcctgaggccttatttagagttctatctgcttgggacagctcagtcttaatagcagtggagtaggggcccaaaaaccgttgacctggtgctgaagctgcccttggcttccagggtaagctaagagggccccttcctctatctgggcttgttctttatcgctaaaatgaaggggttggacccaatgccctcgaagtcccactgaagagatgtctcttatagagagtgagttcgaatcccagttctgtgtcagctgtgaagttagctaacttgcctgagcatcagttcctcctctgattccaaaataccccttaccagcccaagcccacacccctcagtgatgggaagggaaactagatgactgtggacatagaccgctttataactccaagctgctttttcagtttttcatcatttcaaaattcctgcatctctgatcaaaataatttcttcaagaataaaacagtctctactgccactttataaatatctagaaaacgtactccaaaagcaacgggacaatgaactctactttgaaatcataaaaacattcagtgcgagggaacagatccattgaaaactacacattaactcaatt

SEQ ID NO: 128769 - DNA, 601 bp, Human
cgcctgaggccttatttagagttctatctgcttgggacagctcagtcttaatagcagtggagtaggggcccaaaaaccgttgacctggtgctgaagctgcccttggcttccagggtaagctaagagggccccttcctctatctgggcttgttctttatcgctaaaatgaaggggttggacccaatgccctcgaagtcccactgaagagatgtctcttatagagagtgagttcgaatcccagttctgtgtcagctgtgaagttagctaacttgcctgagcatcagttcctcctctgattccaaaataccccttaccagcccaagcccacacccctcagtgatgggaagggaaactagatgactgtggacatagaccgctttataactccaagctgctttttcagtttttcatcatttcaaaattcctgcatctctgatcaaaataatttcttcaagaataaaacagtctctactgccactttataaatatctagaaaacgtactccaaaagcaacgggacaatgaactctactttgaaatcataaaaacattcagtgcgagggaacagatccattgaaaactacacattaactcaattactt

SEQ ID NO: 128770 - DNA, 601 bp, Human
gacccccttggcctcccaaagtactgggattacaggcatgagcccctgtgcctggccttttttttttttttttttttttttttttttttttttttttatgatacagccttgctctgactcccaggctggagcacagttgtgcgatcatggctcactgcagcctcagtctcctgggctcaagcaatcctctcgcttcagcctcccgagtagctgcaactacaggcacacgtcacatgcctttctaacttctttcgacatttgtggcacatgacaactttgtcattttctctaagaattacaracgagaaagtctttctttcttgccataaattgacatttaagagttaatgactaacactggggaaaaagactaggaaatagcttttgcaacctaccacaacaaagaaacccagctttcactgcctttttgtcatttcactgtcttctgtgcctagaccccttagcttggacatctcctcatcccactcctaccttaagaataaatctttctatcaagaagtgacgaagtagctcagaaattataaacatagcagaaacactctcgaacccattcacaccagacaagcacagagcaagtgtg

SEQ ID NO: 128771 - DNA, 601 bp, Human
cccccttggcctcccaaagtactgggattacaggcatgagcccctgtgcctggccttttttttttttttttttttttttttttttttttttttttatgatacagccttgctctgactcccaggctggagcacagttgtgcgatcatggctcactgcagcctcagtctcctgggctcaagcaatcctctcgcttcagcctcccgagtagctgcaactacaggcacacgtcacatgcctttctaacttctttcgacatttgtggcacatgacaactttgtcattttctctaagaattacagaygagaaagtctttctttcttgccataaattgacatttaagagttaatgactaacactggggaaaaagactaggaaatagcttttgcaacctaccacaacaaagaaacccagctttcactgcctttttgtcatttcactgtcttctgtgcctagaccccttagcttggacatctcctcatcccactcctaccttaagaataaatctttctatcaagaagtgacgaagtagctcagaaattataaacatagcagaaacactctcgaacccattcacaccagacaagcacagagcaagtgtgag

SEQ ID NO: 128772 - DNA, 601 bp, Human
ccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaastgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgt

SEQ ID NO: 128773 - DNA, 601 bp, Human; identical to SEQ ID NO: 107261

SEQ ID NO: 128774 - DNA, 601 bp, Human; identical to SEQ ID NO: 107262

SEQ ID NO: 128775 - DNA, 601 bp, Human; identical to SEQ ID NO: 107263

SEQ ID NO: 128776 - DNA, 601 bp, Human; identical to SEQ ID NO: 107264

SEQ ID NO: 128777 - DNA, 601 bp, Human; identical to SEQ ID NO: 107265

SEQ ID NO: 128778 - DNA, 601 bp, Human
cgtcaggctccagttgagtggggaccaatccttgtggcaagtctgtgaaccatcactgtggctctagggtagcagagaaaaaagcaggcatatgtccatctggccacaaggaaggagaccaaggggaagagagaaggtaccaagagaggtgttcacatggaggtgcgtcagaacaccgagggcaaggcagaacgcggtcttcagaccccaactggagcccaggaggcccgcgagtcccagtttgggaaacactaagccaggcttggataacttgtctgaggctgtggtcatcccaacatgwgagccagaggccccaagggagatgggcattccccacccctcagcttcctcagtgccttttgtggagtggaggtgacatgaggctgcaggttgcagggagccacgtgtgggctgcatttcagagcaagtgtgtgggagtggagcagacacgcagagtaatggggcagggtcaagaaataataaatctaagtctagcgttggtgggataatgtcggtgtcactaaaagaaatggggaatttggaaggtaaagtaactggaggtaggaatgaacccaagatttactaagcaccttctgtatac

SEQ ID NO: 128779 - DNA, 601 bp, Human
tgccttttgtggagtggaggtgacatgaggctgcaggttgcagggagccacgtgtgggctgcatttcagagcaagtgtgtgggagtggagcagacacgcagagtaatggggcagggtcaagaaataataaatctaagtctagcgttggtgggataatgtcggtgtcactaaaagaaatggggaatttggaaggtaaagtaactggaggtaggaatgaacccaagatttactaagcaccttctgtataccaaactcaacactaggagtttatacaatctttaaaacagctctaagagtagayattataattcccttctgccaataataaataataagtgactaaggtgtttttgaagctcaagattgcttgattctgcagtcttgttttaaattttggacatggagagtttggagttctgagatgagggaaggcatctgtcatagtgagagagctgaaaacatggagctcaggacaaaagtcagtgctagagagatcagttggaagagttatctttattgtagtgagacattgaatttttcagtggaaaaaaagcacagaaaaagactacagagggccaagaaaagaaactgaggctgtcaa

SEQ ID NO: 128780 - DNA, 601 bp, Human
agtaatggggcagggtcaagaaataataaatctaagtctagcgttggtgggataatgtcggtgtcactaaaagaaatggggaatttggaaggtaaagtaactggaggtaggaatgaacccaagatttactaagcaccttctgtataccaaactcaacactaggagtttatacaatctttaaaacagctctaagagtagatattataattcccttctgccaataataaataataagtgactaaggtgtttttgaagctcaagattgcttgattctgcagtcttgttttaaattttggacatrgagagtttggagttctgagatgagggaaggcatctgtcatagtgagagagctgaaaacatggagctcaggacaaaagtcagtgctagagagatcagttggaagagttatctttattgtagtgagacattgaatttttcagtggaaaaaaagcacagaaaaagactacagagggccaagaaaagaaactgaggctgtcaaaatgaaaagaggaggaggagtgggtgagagacaaaggagacacaggcagagagatgtggacagcacagcccacagacacacactctacaagggacacagac

SEQ ID NO: 128781 - DNA, 601 bp, Human
agtcagggagcataggtgagggggagcctgggtgagggtgaccagagcttttaaccctgtcctccctgccttccagtgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacggtaagggctggggatagcctggctgttggtaaggagctcaggccacagcgccctcgctggcccygctgctccgtccatccaggggggcggcctggaggaaggggcagcgtgcgcgaaggctttcaggggcggggcccagcaaatcgaggcctcggcggagtcctgcccacagggacatcagtgccgcccccgcgctgactccttcccggcgaggactcagcggggagggatgcgcccaagtcccttgagggtcacagggcttctgccagagttaagttctatttaaaaataaaatgttaacctaaaaaccaatagtcatggtctcggccagcgcctcgccgagttgcagtgagctgagatcgtg

SEQ ID NO: 128782 - DNA, 601 bp, Human
agtcatggtctcggccagcgcctcgccgagttgcagtgagctgagatcgtgccctcccacgcccgcagcccgcgtcctgccttggcctccgtagtcgctgagagccacagcctagagcgccagcgcgcaggcgcacaactgacgccaggccacgaacccagtactgcgcctgcacagcagaagcactagcactgaggccgggccgcgaacccggcactgcgcctgcgcagcaaaaggacacgcactgaggccaggccgcgaacccagcacggtgcctgcgcagcaggaagaccggcatccmcaccggacgacgaacccagcatcgcgcctgcgcagtaggaggagagcaatgccaccaggccgcgattgcgcagccgcagcagccccgcgcggaagacgctaccctcctctcccccgaagaggcggggcttcgaacgaacctggaaatggccgaggggtctcgacttcctcaccccaggcatcaggaaaggtgcctgcaggacagggctctgaagtggaagtgggcggtggtgatgccgaactgacaagaatgagctgaagagaagaaagtagccgagaagggggccaagccggagctcag

SEQ ID NO: 128783 - DNA, 601 bp, Human
ccacagcctagagcgccagcgcgcaggcgcacaactgacgccaggccacgaacccagtactgcgcctgcacagcagaagcactagcactgaggccgggccgcgaacccggcactgcgcctgcgcagcaaaaggacacgcactgaggccaggccgcgaacccagcacggtgcctgcgcagcaggaagaccggcatccacaccggacgacgaacccagcatcgcgcctgcgcagtaggaggagagcaatgccaccaggccgcgattgcgcagccgcagcagccccgcgcggaagacgctaccytcctctcccccgaagaggcggggcttcgaacgaacctggaaatggccgaggggtctcgacttcctcaccccaggcatcaggaaaggtgcctgcaggacagggctctgaagtggaagtgggcggtggtgatgccgaactgacaagaatgagctgaagagaagaaagtagccgagaagggggccaagccggagctcagtgagcaacagctaggccagccgcggctggtgccatcagccacaccactaactgtggacccaaatggaaactttgaggccccttacaggtcccccagcgcaggcc

SEQ ID NO: 128784 - DNA, 601 bp, Human
tctcgacttcctcaccccaggcatcaggaaaggtgcctgcaggacagggctctgaagtggaagtgggcggtggtgatgccgaactgacaagaatgagctgaagagaagaaagtagccgagaagggggccaagccggagctcagtgagcaacagctaggccagccgcggctggtgccatcagccacaccactaactgtggacccaaatggaaactttgaggccccttacaggtcccccagcgcaggccaccgccgaaggttactggggaagacccctgcagcttccatgtggacattactckcttgcttcatcccggagtgcagtcacctgcagcctgggaccacctgactgatgtcaccctggagatccatgccaaaagagctggggaaagttcaccttctaatgacccctgcggaccagggtgaagttacaagttatggccaggtcaaggaattataagtcaataaataaactgcctcagggagacgtactcagagtccaggaaaatctaggaaacaccaagaagggcgagcgcagcatcagcccctgcaaaattgcactgctgcctcctggctcacatgttgccccatccttactttag

SEQ ID NO: 128785 - DNA, 601 bp, Human
tgtcttaaagcatacctcaataaaaagattgaactcacataaagtatgttttctgaccataatggaattaaagtaaaaattactaacagaaaaataactggaaacttccctaagtactcggaaattaagtcacacatgtataaataatctgtgagtcaaagagaaaattttaaggggagtaagaaagtattttgagctgaacaaaaatgaatatgtaacataaaatctgtgggatgcagctaaaaaagcagtgtttcaagggaaatttatagcattaaatgctcacatgggaaaagaaagrcggtctcaaattgtttatgtaagcttccactttaataaactagaaaaaaagaaaaaaataaaccaaaaggaaattgaaaaagcagaaatcaaagaaatttaaaacaaaaataatagacaaaattaataagctgatgaaactcaaacaagactgacaggaataaaaacaaacaaacaaaaacaagaaaaaggacctatgttggaaatggaagagaggggacatcactacagaaactgtagatgttaaatgtataataagaaaatactttgaacaactctgcatatataaatttgcatgaga

SEQ ID NO: 128786 - DNA, 601 bp, Human
actacaaacgccttaaaataacagggatttattgtcgcagctttggagacaagtctgaaattagggtgtcagcagtgttggttccttctggaggctctgggagagtctctgtcccaggctctctgctcgcttccaggagcacccggcaatcatgggcatccttgggctgcggacgcgtcgctcctgtctctgctttcatcttcgcatggccttctctctctgtgcctctgtgtgactttttctgtctcttataaggactttctcctttatttagggcccacactgacccagcatgatctcwtctacagccttggcttagttaacatctgcaaagacccgatttccaattaaggttctattctgaggctgcaggtggacctgaattagcagggagggcactattcaaccaactgtagagagttaaaaaacaataagcctgtggacattttttagcgtaatctaggctcttgatgacctgttttaaactaatcagcaatgaatatttttcagctaacgtaatcactattgacaagcacgtgacccttgtctgaatgttaactcaggcatagcaactaaaaaccatccattgaccagctcggga

SEQ ID NO: 128787 - DNA, 601 bp, Human
tgtgcctctgtgtgactttttctgtctcttataaggactttctcctttatttagggcccacactgacccagcatgatctcatctacagccttggcttagttaacatctgcaaagacccgatttccaattaaggttctattctgaggctgcaggtggacctgaattagcagggagggcactattcaaccaactgtagagagttaaaaaacaataagcctgtggacattttttagcgtaatctaggctcttgatgacctgttttaaactaatcagcaatgaatatttttcagctaacgtaatsactattgacaagcacgtgacccttgtctgaatgttaactcaggcatagcaactaaaaaccatccattgaccagctcgggagtagcaaacagagcaagccattcttggtgcaacctgtttctaggtaattaacttgaaaatattttcaatattcaacaaagatggttcatttaagatgactgaagccacatcttcacagatgcagaagatctgaatagctttcctctttagattgaatagttctagaacaattcattcctaaaagtgacttccattggggaaaatatcctattcagcttga

SEQ ID NO: 128788 - DNA, 601 bp, Human
ggttccatatgcatccttcaagcgctgcttcaattatgtgcctgaaacatctcagcaagtgaaagacactgtggctgaccttgctactggcaatgacattcaagcttaagctggttaaaaaatattttaactgaagtcatttcttgacatacacacgaatattttttaattctagaaacaatcacaaatccatttaaaaccaagtgtgggccgggtgcagtagctcatgcctgtaatcccagcattttgggaggccaaggcgggcggatcatgaggtcaggagatcgagaccatcctggcyaacacagtgaaaccccgtctctagtaaaaataccaaaaaaaaaaaaattagctgggcgtggtggtgcacgcctgtagtcccagctgctcaggaggctgaggcaagagaatggcgtgaacctggaaggcggagcttgcactgagcactgagccgagattgcgccactgcgctccagcctgggcaacagaatgagactctgtctcaaaaaaaaaaaaaaaaaaaaaatcaaaaggcaaatgtgatgtgtgaaaataaaattacataatctactttgtagtgcaaaaagttcaggctgggcaa

SEQ ID NO: 128789 - DNA, 601 bp, Human
tgtgggccgggtgcagtagctcatgcctgtaatcccagcattttgggaggccaaggcgggcggatcatgaggtcaggagatcgagaccatcctggccaacacagtgaaaccccgtctctagtaaaaataccaaaaaaaaaaaaattagctgggcgtggtggtgcacgcctgtagtcccagctgctcaggaggctgaggcaagagaatggcgtgaacctggaaggcggagcttgcactgagcactgagccgagattgcgccactgcgctccagcctgggcaacagaatgagactctgtctcaaaaaaaaaaaaaaaaaaaaaatcaaaaggcaaatgtgatgtgtgaaaataaaattacataatctactttgtagtgcaaaaagttcaggctgggcaaggtggctcacgcctgtaatcccagcactttgggaagccaaggtgggtggatcacctgaggtcaggagttcaagaccagcctggccaacatggtgaaaccctgtctctataaaaaaaaaatacaaaaacttagctgggcgtggtggcgcacgcctgtaatcccagctactcgggaggctgaggcaggagaatcgcctgaacccag

SEQ ID NO: 128790 - DNA, 601 bp, Human
ccgggaaggaactgttccgaactaggacagaggggctccgccacccaagcctgcctgcctgtcccctccctccgggcagccaaggaggctgtgagctccacagggaagtggccggggctgagggagaggctgggcccaggcaacgcccccctcagccccttcccactgggcatttccatggctgcccgtggcatgcccaggacgatgctgtcctgtgaaacagaagagagggagaaggcgcagccacacgctcaagtgtcctcaaacctcccctacaccaggagacaaggctaaagccagrgagccacccacactgcaggggcatcagcgggcaggaggacggtgccgggtgggcaaggcctccatctgctcttctgtttgacgggaggcagaaagagttggtgtcctcgcttcatttctaattttggaatttttttacccaaacacctaaatcctatggaggtagatagtaccttagagaaaaacacatctacttattttcaaaggtaaaaaagaaaatcactctttgaggcttttttgttaagagacagtaccttgctctgttgcccaggctggagtgcagtgtcgcgatctcggctca

SEQ ID NO: 128791 - DNA, 601 bp, Human
ggactaatgctgccagattaaacaaataaaagcacaatactttcaattaaatttcaatttcacataaactagaaatacattaaacaaaagcacaatactttcaattaaatttcaatttcacataaactagaaatactttcagtgtaagtatgttccaagtatcgcatgaagcatacatatgcgaaaaattatttgctgtttatctgattcaagtcaaactaggtgtattagtcagttttcacactgctgacacatacatacccgagactgggtaatttataaagaaaaagaggttgaatgractcacagttccacgtggctggggaggcctcaccgtcacggtggaaggcgcaaggcacgtcttacatggcggcagcaagacagagaatgagagaacaagcaaaaggggtttccccttagaaaaccatcagctcttgtgagacttattcacttccaccagaacagcatggggaaaccgccctcacgattcagttacctcccaccaggtccctcccacaacacacgggaaatatgggagctacagtttgagatgagatttgggtggggacacagccaaaccttgttgctgggcatcctgtat

SEQ ID NO: 128792 - DNA, 601 bp, Human
aagcctgactttccctcatgtaagctggatgatgagttgacaaattatgcaaaaaagaggcaaaaacatgaccccttttctagccatgaatgttttaagaaatgttttaagactcggtattgtcagtagtttcattggtctgtacatgtgcccagccactatcacaggacgggaaactccccagagaaaagaaaaccaaaatatgcccgggctccaaacttgcaagtccagctccctagggacagcatgtggcacccctgtcagtgcttgctcccctgggaccgtgttccaagtcctggcrggtaggagacccttcacaggagctgccacagggacccccaggaagtcacctgggatggaggtgtccgtgcaccatgggggacaggctcacactgctgaaccgtcgggacaccaggcaggcacaccggttgaggcagatgatgtttctgcacagactggcgtctcctggtcccaggtagaaatcctgccacagagacgggaaaggctgctcccacagggagcatcttttccaaagcatggacagatgtgtcgtgtgcatgagactttagagagctctgtgatggagttggtagaaagaaga

SEQ ID NO: 128793 - DNA, 601 bp, Human
tgctgcaagaacctccaagaactgagggctgtgactcagaagcacgcatgcttcccacagcggcacttgtttcagagaacagaatttctcccaagtgggggtattttgaagccacagttactcctttatgtgatccctggagaagtggtcctgttcgtgtctgagtacaggactgccggagatagcagtcaccagtaggccagggtgcccaccttggagatgctgccaacggctgtcctgttgggctgtgacacctgtcaggttactggaaacattgtaacttacttgaggttttttgtctttttttttttttgctacccagttgccactgttgtggaggtttttaaaaaaacttctgacccttatagcatacatacatttcctcctcaagctctgtgtgctgatgctcttattttcttctataccaaaattgccttctgggggtaagtttattttaataactcaaaattcctgggtctctccagagtaatacaggcatcttgtgctgccaaagcttactttaaatttatttaaatgatatttctttgttttcctctgaaagctgagacctggctgggcatggtggcttacacccataatc

SEQ ID NO: 128794 - DNA, 601 bp, Human
gagctgagatcatgctactgcactccagcccagctgacagagtgagattccatctcaaaaacaaaaaaacaaagtagggcagatgactgtcactccagagggtctgagtgcagctctgcctgaggctggagtcagccagatatccatccaaaccggatttccagcccaggcccatatggggttagcagatctacagtgaggctcagccaggcttttgggtttatgagttcaccgggaggagtggggtgtcttcgtcttttatcctcagggtctgataggtgcacgcttgttgaatgaatcmgaggactgcctgactcctgttaggagttgaaaatgaaggtcaccgtgtctcatctcccacccaatttggcatgatttttttttttttttttgaggcagagtcccgctctgtcaccccaggctggagtgcagtggcgtgatctctgctcactgcaagctccgcctcctgggttcacgccattcttctgcctcagcctcccaagtaggtgggactgtaggcgcccgccaccacgcctggctaatttttgtatttttagtagagacggggtttcaccgtgttaaccaggatggtcttgatctc

SEQ ID NO: 128795 - DNA, 601 bp, Human
gggctgctgtgcccacagttggagtggctgcaggggagggcatgcaggccgtgcggccttctggcttcagatgctgctgccctgtggttccgtggtggcatttctgcctgggaggactcctgtgcagttagcaacataagacatgaagcatataattgtcacttgtcagtctttttaaatcgctgtgcaaatgaattaacagttcagtttcttataattttagctttccaaatcatgctttcctgtgctgtgatagctcctgcagtccccgttttccagagactgactctcaagaggtctrgaaggaccagcctgggcagcacagggaggctccatttctgcaaataataaaacgagttagctgggcgtagtggcgcacacctgtggtcccagctacttgggaggctgaggtgggaggatcacttgagcccaggagttaaggttgcgatgagccgtgatcactccactgcactccagcctgggtgacagagcaagactctcagagaagggtctggaaggaactaaccaaaattttcattccccagagatacacaacgccttttatagacaagatcttttgcagttttgttctaatactaga

SEQ ID NO: 128796 - DNA, 601 bp, Human; identical to SEQ ID NO: 27913

SEQ ID NO: 128797 - DNA, 601 bp, Human; identical to SEQ ID NO: 27914

SEQ ID NO: 128798 - DNA, 601 bp, Human; identical to SEQ ID NO: 27915

SEQ ID NO: 128799 - DNA, 601 bp, Human; identical to SEQ ID NO: 27916

SEQ ID NO: 128800 - DNA, 601 bp, Human; identical to SEQ ID NO: 27917

SEQ ID NO: 128801 - DNA, 601 bp, Human; identical to SEQ ID NO: 27918

SEQ ID NO: 128802 - DNA, 601 bp, Human; identical to SEQ ID NO: 27919

SEQ ID NO: 128803 - DNA, 601 bp, Human; identical to SEQ ID NO: 27920

SEQ ID NO: 128804 - DNA, 601 bp, Human; identical to SEQ ID NO: 27921

SEQ ID NO: 128805 - DNA, 601 bp, Human; identical to SEQ ID NO: 27922

SEQ ID NO: 128806 - DNA, 601 bp, Human; identical to SEQ ID NO: 27923

SEQ ID NO: 128807 - DNA, 601 bp, Human; identical to SEQ ID NO: 27924

SEQ ID NO: 128808 - DNA, 601 bp, Human; identical to SEQ ID NO: 27925

SEQ ID NO: 128809 - DNA, 601 bp, Human; identical to SEQ ID NO: 27926

SEQ ID NO: 128810 - DNA, 601 bp, Human; identical to SEQ ID NO: 27927

SEQ ID NO: 128811 - DNA, 601 bp, Human; identical to SEQ ID NO: 27928

SEQ ID NO: 128812 - DNA, 601 bp, Human; identical to SEQ ID NO: 27929

SEQ ID NO: 128813 - DNA, 601 bp, Human; identical to SEQ ID NO: 27930

SEQ ID NO: 128814 - DNA, 601 bp, Human; identical to SEQ ID NO: 27931

SEQ ID NO: 128815 - DNA, 601 bp, Human; identical to SEQ ID NO: 27932

SEQ ID NO: 128816 - DNA, 601 bp, Human; identical to SEQ ID NO: 27933

SEQ ID NO: 128817 - DNA, 601 bp, Human; identical to SEQ ID NO: 27934

SEQ ID NO: 128818 - DNA, 601 bp, Human; identical to SEQ ID NO: 27935

SEQ ID NO: 128819 - DNA, 601 bp, Human; identical to SEQ ID NO: 27936

SEQ ID NO: 128820 - DNA, 601 bp, Human; identical to SEQ ID NO: 27937

SEQ ID NO: 128821 - DNA, 601 bp, Human; identical to SEQ ID NO: 27938

SEQ ID NO: 128822 - DNA, 601 bp, Human; identical to SEQ ID NO: 27939

SEQ ID NO: 128823 - DNA, 601 bp, Human; identical to SEQ ID NO: 27940

SEQ ID NO: 128824 - DNA, 601 bp, Human; identical to SEQ ID NO: 27941

SEQ ID NO: 128825 - DNA, 601 bp, Human; identical to SEQ ID NO: 27942

SEQ ID NO: 128826 - DNA, 601 bp, Human; identical to SEQ ID NO: 27943

SEQ ID NO: 128827 - DNA, 601 bp, Human; identical to SEQ ID NO: 27944

SEQ ID NO: 128828 - DNA, 601 bp, Human; identical to SEQ ID NO: 27945

SEQ ID NO: 128829 - DNA, 601 bp, Human; identical to SEQ ID NO: 27946

SEQ ID NO: 128830 - DNA, 601 bp, Human; identical to SEQ ID NO: 27947

SEQ ID NO: 128831 - DNA, 601 bp, Human; identical to SEQ ID NO: 27948

SEQ ID NO: 128832 - DNA, 601 bp, Human; identical to SEQ ID NO: 27949

SEQ ID NO: 128833 - DNA, 601 bp, Human; identical to SEQ ID NO: 27950

SEQ ID NO: 128834 - DNA, 601 bp, Human; identical to SEQ ID NO: 27951

SEQ ID NO: 128835 - DNA, 601 bp, Human; identical to SEQ ID NO: 27952

SEQ ID NO: 128836 - DNA, 601 bp, Human; identical to SEQ ID NO: 27953

SEQ ID NO: 128837 - DNA, 601 bp, Human; identical to SEQ ID NO: 27954

SEQ ID NO: 128838 - DNA, 601 bp, Human; identical to SEQ ID NO: 27955

SEQ ID NO: 128839 - DNA, 601 bp, Human; identical to SEQ ID NO: 27956

SEQ ID NO: 128840 - DNA, 601 bp, Human; identical to SEQ ID NO: 27957

SEQ ID NO: 128841 - DNA, 601 bp, Human; identical to SEQ ID NO: 27958

SEQ ID NO: 128842 - DNA, 601 bp, Human; identical to SEQ ID NO: 27959

SEQ ID NO: 128843 - DNA, 601 bp, Human; identical to SEQ ID NO: 27960

SEQ ID NO: 128844 - DNA, 601 bp, Human; identical to SEQ ID NO: 27961

SEQ ID NO: 128845 - DNA, 601 bp, Human; identical to SEQ ID NO: 27962

SEQ ID NO: 128846 - DNA, 601 bp, Human; identical to SEQ ID NO: 27963

SEQ ID NO: 128847 - DNA, 601 bp, Human; identical to SEQ ID NO: 27964

SEQ ID NO: 128848 - DNA, 601 bp, Human; identical to SEQ ID NO: 27965

SEQ ID NO: 128849 - DNA, 601 bp, Human; identical to SEQ ID NO: 27966

SEQ ID NO: 128850 - DNA, 601 bp, Human; identical to SEQ ID NO: 27967

SEQ ID NO: 128851 - DNA, 601 bp, Human; identical to SEQ ID NO: 27968

SEQ ID NO: 128852 - DNA, 601 bp, Human; identical to SEQ ID NO: 27969

SEQ ID NO: 128853 - DNA, 601 bp, Human; identical to SEQ ID NO: 27970

SEQ ID NO: 128854 - DNA, 601 bp, Human; identical to SEQ ID NO: 27971

SEQ ID NO: 128855 - DNA, 601 bp, Human; identical to SEQ ID NO: 27972

SEQ ID NO: 128856 - DNA, 601 bp, Human; identical to SEQ ID NO: 27973

SEQ ID NO: 128857 - DNA, 601 bp, Human; identical to SEQ ID NO: 27974

SEQ ID NO: 128858 - DNA, 601 bp, Human; identical to SEQ ID NO: 27975

SEQ ID NO: 128859 - DNA, 601 bp, Human; identical to SEQ ID NO: 27976

SEQ ID NO: 128860 - DNA, 601 bp, Human; identical to SEQ ID NO: 27977

SEQ ID NO: 128861 - DNA, 601 bp, Human; identical to SEQ ID NO: 27978

SEQ ID NO: 128862 - DNA, 601 bp, Human; identical to SEQ ID NO: 27979

SEQ ID NO: 128863 - DNA, 601 bp, Human; identical to SEQ ID NO: 27980

SEQ ID NO: 128864 - DNA, 601 bp, Human; identical to SEQ ID NO: 27981

SEQ ID NO: 128865 - DNA, 601 bp, Human; identical to SEQ ID NO: 27982

SEQ ID NO: 128866 - DNA, 601 bp, Human; identical to SEQ ID NO: 27983

SEQ ID NO: 128867 - DNA, 601 bp, Human; identical to SEQ ID NO: 27984

SEQ ID NO: 128868 - DNA, 601 bp, Human; identical to SEQ ID NO: 27985

SEQ ID NO: 128869 - DNA, 601 bp, Human; identical to SEQ ID NO: 27986

SEQ ID NO: 128870 - DNA, 601 bp, Human; identical to SEQ ID NO: 27987

SEQ ID NO: 128871 - DNA, 601 bp, Human; identical to SEQ ID NO: 27988

SEQ ID NO: 128872 - DNA, 601 bp, Human; identical to SEQ ID NO: 27989

SEQ ID NO: 128873 - DNA, 601 bp, Human; identical to SEQ ID NO: 18065

SEQ ID NO: 128874 - DNA, 601 bp, Human; identical to SEQ ID NO: 18066

SEQ ID NO: 128875 - DNA, 601 bp, Human; identical to SEQ ID NO: 18067

SEQ ID NO: 128876 - DNA, 601 bp, Human; identical to SEQ ID NO: 18068

SEQ ID NO: 128877 - DNA, 601 bp, Human; identical to SEQ ID NO: 18069

SEQ ID NO: 128878 - DNA, 601 bp, Human; identical to SEQ ID NO: 18070

SEQ ID NO: 128879 - DNA, 601 bp, Human; identical to SEQ ID NO: 18071

SEQ ID NO: 128880 - DNA, 601 bp, Human; identical to SEQ ID NO: 18072

SEQ ID NO: 128881 - DNA, 601 bp, Human; identical to SEQ ID NO: 18073

SEQ ID NO: 128882 - DNA, 601 bp, Human; identical to SEQ ID NO: 18074

SEQ ID NO: 128883 - DNA, 601 bp, Human; identical to SEQ ID NO: 18075

SEQ ID NO: 128884 - DNA, 601 bp, Human; identical to SEQ ID NO: 18076

SEQ ID NO: 128885 - DNA, 601 bp, Human; identical to SEQ ID NO: 18077

SEQ ID NO: 128886 - DNA, 601 bp, Human; identical to SEQ ID NO: 18078

SEQ ID NO: 128887 - DNA, 601 bp, Human; identical to SEQ ID NO: 18079

SEQ ID NO: 128888 - DNA, 601 bp, Human; identical to SEQ ID NO: 18080

SEQ ID NO: 128889 - DNA, 601 bp, Human; identical to SEQ ID NO: 18081

SEQ ID NO: 128890 - DNA, 601 bp, Human; identical to SEQ ID NO: 18082

SEQ ID NO: 128891 - DNA, 601 bp, Human; identical to SEQ ID NO: 18083

SEQ ID NO: 128892 - DNA, 601 bp, Human; identical to SEQ ID NO: 18084

SEQ ID NO: 128893 - DNA, 601 bp, Human; identical to SEQ ID NO: 18085

SEQ ID NO: 128894 - DNA, 601 bp, Human; identical to SEQ ID NO: 18086

SEQ ID NO: 128895 - DNA, 601 bp, Human; identical to SEQ ID NO: 18087

SEQ ID NO: 128896 - DNA, 601 bp, Human; identical to SEQ ID NO: 18088

SEQ ID NO: 128897 - DNA, 601 bp, Human; identical to SEQ ID NO: 18089

SEQ ID NO: 128898 - DNA, 601 bp, Human; identical to SEQ ID NO: 18090

SEQ ID NO: 128899 - DNA, 601 bp, Human; identical to SEQ ID NO: 18091

SEQ ID NO: 128900 - DNA, 601 bp, Human; identical to SEQ ID NO: 18092

SEQ ID NO: 128901 - DNA, 601 bp, Human; identical to SEQ ID NO: 18093

SEQ ID NO: 128902 - DNA, 601 bp, Human; identical to SEQ ID NO: 18094

SEQ ID NO: 128903 - DNA, 601 bp, Human; identical to SEQ ID NO: 18095

SEQ ID NO: 128904 - DNA, 601 bp, Human
ggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccggtgagtraggacgcgcccctccgccggcgggcgggacccagccggggcaccgggagaccccgaggcgtaggtctccgtttgcccacccgcctcctaggaggcgcctctcggttctcctcgccttccctccctcccctccgtggtggcgcctctgagctgtcagcgccgaggctaaagggagccgggcttggggaacagcggggttcggggtgccccgacgcctcgcctgaactagtcttctgcccctcactccgcctcccccagagccgctgctttgcctcgtttctcgccctcttgacgggcgccg

SEQ ID NO: 128905 - DNA, 601 bp, Human
gcggcgccaccggaaccggtgagtgaggacgcgcccctccgccggcgggcgggacccagccggggcaccgggagaccccgaggcgtaggtctccgtttgcccacccgcctcctaggaggcgcctctcggttctcctcgccttccctccctcccctccgtggtggcgcctctgagctgtcagcgccgaggctaaagggagccgggcttggggaacagcggggttcggggtgccccgacgcctcgcctgaactagtcttctgcccctcactccgcctcccccagagccgctgctttgcctcgyttctcgccctcttgacgggcgccgaggtgcgtgggcttctgagcattgaacaatggttctgcctcctctgccaggcgcagtgttgggaaggaggcagagggccaagacgtgtgcggcagcctcgggcgcaccctcgaaccccggggagtgcgggagcggacggggggagaaggtgagcgcctccggggacgcggagcgccaggggccggccgggcttcagagtcttccggcggccgcgagctggcgcacgttcggtgggcggcggccgggaggctccgcggagccgagggcacccggact

SEQ ID NO: 128906 - DNA, 601 bp, Human
tctagtgtagctttgttccctggatcaccctcttgcccactttatgtggcatttacctatagtgcctgtcctgtgtcattttgattgtttgcttttatggcctgagtccccagatacttaaagcatgtataaaggtcaagtagagctgccaaatattaagactttagtacaatagactgctatttaacactaaacattgctagcaaaggtgacagtctccatgctcaaaagaagtgaagacctgatccaagtgtctctacctgtcataaaattgaataaccgtaaacttgacttgagtagkttcattacagttttggaagaggaaaaaagttgttacaagccccttctgctccaggagaggtatcaaattgataagacttaacaagaactcctagagtagaacatgaccataagatcaagggaacacatagtacccagccgtgtggcttcgggttttgatcccaaaccttgaagacttggcacacagcatagaaatacagctaattcattttaaatatctagcccattttctgtttctcacagaatgtaaatttgttcttttcagtgcagggaaaagtgtttaagacaaggcagttgccta

SEQ ID NO: 128907 - DNA, 601 bp, Human
agagtgatagactactttcaaggcaaacagtccaaaaatactgtctgctgaggttatgggcgagatatacttgttaagcggaagtaagtagtccagggacaattttttctgccacctaaagagttttgggctagaaaatctgaggactgatagtttttctgaagagttggggcagagtctaacctagctataggcgaatctggcttttaagtaaaaatcatctcaattttactgtctgcatttttcaaactaaatcagtgtctctttgctaagttcgtctattggcttgcaacaaaaactstaaacactgttaataccacttagttaagtacactaactgcactgcaggaaccaaatgagatggcaggtgataacacaggttaagtgtcctttatctgaaatacttgaaaccagaagggttccacagagtttagattttttcagattttgggacattcacacatacataataaggtatcttggggatgggacccaagtctaaacatgaaattcgtttatatttcacatacaccttatacacatagcctgaaggtaattttatagactatttttaatgattttatacaagaaacaaagtttt

SEQ ID NO: 128908 - DNA, 601 bp, Human
ttggattttggagcatctcagattgcggattagggatgctcaacctggaccataaatttagcatacttttccccttgagtgaagtctcctaggaaagcttgggcccaacagttattttgagtctctaagcaagagaatgcctgttaggtcctgtgagagtaagtgtggagattctgttagaaatgtttcaatgcttgcttagagatcctttgcctactttgtagtttagagatgctggaaactataagatgaagcctctggctagagcagctgattttgccaacttgggggccatctgggkagcctttatgtatgtagacgaggtggtggggatggggggacttgcaatttgccaaccaagggacataacaaagcctcggcgatagacagcatttgtgagttacatcacatgttagaacttaatagttctcccacatgctgtgaataaacagggtttctattttatagactgcctctaatctttcattttcttaagaaagacttccccacatctgaggtattaactgatctgtatgttcactaagtaggttgcagattgatgttggtcatctttgtgcatcttctggaaaccacttaatgt

SEQ ID NO: 128909 - DNA, 601 bp, Human
ttgcctactttgtagtttagagatgctggaaactataagatgaagcctctggctagagcagctgattttgccaacttgggggccatctggggagcctttatgtatgtagacgaggtggtggggatggggggacttgcaatttgccaaccaagggacataacaaagcctcggcgatagacagcatttgtgagttacatcacatgttagaacttaatagttctcccacatgctgtgaataaacagggtttctattttatagactgcctctaatctttcattttcttaagaaagacttccccasatctgaggtattaactgatctgtatgttcactaagtaggttgcagattgatgttggtcatctttgtgcatcttctggaaaccacttaatgtacatctactgagtacctaccatatggcaccaggcatggggacagagtgaccatagcactggtggttccttcctttgtggcacttagtctagtaggggaatcaaagcaggaaacagccaaagaccgcttggaatagaagctctgaagaggagtgagcagatccagtgtttaagacttaatcataaaagaggcagatagcagctggagatt

SEQ ID NO: 128910 - DNA, 601 bp, Human
gtggttccttcctttgtggcacttagtctagtaggggaatcaaagcaggaaacagccaaagaccgcttggaatagaagctctgaagaggagtgagcagatccagtgtttaagacttaatcataaaagaggcagatagcagctggagatttctggaatttccatatgctatctgggttctagcttatgaagtttccctaaaattaccaagaacttagactttaatttcaaaaagccagaaataattctatgtctgcagataatcctacaaaagtgatatgactaaagcaacaatggattacwgccagtattaccaaagagcattaaaacatgtcagaagtaaaatctgcgtctgatatatcacactcaactttaccagttagccgctgctaaccttctcaggtgttggaacctctcttttcacatggaaatgaagccaacacacccaaagggacacactcattctgacagacaagtgtgtgaaaatgcactgtttttaaatgataaattgcaacaaagaggccgggcgcggtggctcaaacctataatcccagtgcttttggaggccgaggcaggcagatcacgaggtcaggagttcgagac

SEQ ID NO: 128911 - DNA, 601 bp, Human
tttttaaatgataaattgcaacaaagaggccgggcgcggtggctcaaacctataatcccagtgcttttggaggccgaggcaggcagatcacgaggtcaggagttcgagaccagcctggccaacatagtgaaagcccatctctactaaaaatacaaaaaaattagctgggtgtggtggtgcgagcctgtaatcccagctactcaggaggctgaggcaggagaatcgcttgaacccgggtggcagagatttcagtgagccgagataacgccactgcactccagcctgggctacagtgcgagamtccatctcaaaaaaaaaaaaaaaaaattgctacaaagatgaggtgaaggtaccctcataggcctagggaacagggacctttataacctagagtctttcaaagtattctagctagtaaaacaaccagtcacacttggtttcaagttctgaaaaagctgggggaaatgtttttgacaaaagtttttagttcagaccagctttattagtaaactaataaatcaactcatgcacccaagactaccaactagtgcctagagaatataggatgtcaggcaccaggtcctgagttacaaatgtgaac

SEQ ID NO: 128912 - DNA, 601 bp, Human
aggccgggcgcggtggctcaaacctataatcccagtgcttttggaggccgaggcaggcagatcacgaggtcaggagttcgagaccagcctggccaacatagtgaaagcccatctctactaaaaatacaaaaaaattagctgggtgtggtggtgcgagcctgtaatcccagctactcaggaggctgaggcaggagaatcgcttgaacccgggtggcagagatttcagtgagccgagataacgccactgcactccagcctgggctacagtgcgagaatccatctcaaaaaaaaaaaaaaaaaattgctacaaagatgaggtgaaggtaccctcataggcctagggaacagggacctttataacctagagtctttcaaagtattctagctagtaaaacaaccagtcacacttggtttcaagttctgaaaaagctgggggaaatgtttttgacaaaagtttttagttcagaccagctttattagtaaactaataaatcaactcatgcacccaagactaccaactagtgcctagagaatataggatgtcaggcaccaggtcctgagttacaaatgtgaactgcagcccatgccttaggggatctct

SEQ ID NO: 128913 - DNA, 601 bp, Human
ggagttcgagaccagcctggccaacatagtgaaagcccatctctactaaaaatacaaaaaaattagctgggtgtggtggtgcgagcctgtaatcccagctactcaggaggctgaggcaggagaatcgcttgaacccgggtggcagagatttcagtgagccgagataacgccactgcactccagcctgggctacagtgcgagaatccatctcaaaaaaaaaaaaaaaaaattgctacaaagatgaggtgaaggtaccctcataggcctagggaacagggacctttataacctagagtctttsaaagtattctagctagtaaaacaaccagtcacacttggtttcaagttctgaaaaagctgggggaaatgtttttgacaaaagtttttagttcagaccagctttattagtaaactaataaatcaactcatgcacccaagactaccaactagtgcctagagaatataggatgtcaggcaccaggtcctgagttacaaatgtgaactgcagcccatgccttaggggatctctgtgtctaaaggtgaaaaatggtagctgaactcatctccttgggtgatggctctgtgacagggactattatga

SEQ ID NO: 128914 - DNA, 601 bp, Human
agtaagtaatggggccaatcaaagatagactacacagggagggaaggatggattttagaagaacctctgcctagtaagacacccaaataaattttttctgcaaaatagttttgagggctttactcacatgttactatcatgtgtattgtaaaagaggcatttatctcctgtgtccctcctgtgatgaacattaggccttatgagggtgttattggtatatgctacaaccctgaaaatgaaagagccacttacattatgggtagaagctgtagcttcttaaccttagtgcagtggttctcamagtgtggaccgaaattggcaacattaattcaatgttaattgagttcatgtgtcaacattgactcattagaaatgcaaacttaggccctgttctagacctgctgaatcagaatccaggctggggcccagcattctgtgttttaacaagccttcctggggattctgatgcacacgggagcttgagaacgactgacttagtttaccactcacagaagctaacgattttcaaggtatatccgatggagggcctttcctctgacttgaaccctagacaagaaaaccaagagctataatcctttta

SEQ ID NO: 128915 - DNA, 601 bp, Human
tctgcccagggcaatctgggacaagtgactgtactttccttctctaccaggtttcctgatctgtaaaagaggaataatagggccaactgtgcaggattaagaattttaaaagctaagagatgtgaagtcttagagcagtgtttgaccaacaacaaaaacgattcgattatgtccatgattcttaagatcaatttgatgtaaatggaaattgaatgtaactgacaattgaactgtaaaattcacttatttccatgactcagaagaattagcctacatattcaccactttttagtggcccccraactagtgtttttgttgctgtttgtttgtttgttttcgagatggagtttcactcttgttgcccaggctggagtgcaatggcactatctcggctcactgcaacttctacctcccaggttcaaacaattctcctgcatcagcctcccaaggagctgggattacaggtgtgtgtaatgcctggctaatttttgtatttttagcagacactgggtttcaccatgttgaccaggctggtcttgaacccctgacctcaggtgatctgcctgcctcagcctcccaaagtgctgggattacaggcatg

SEQ ID NO: 128916 - DNA, 601 bp, Human
caacaacaaaaacgattcgattatgtccatgattcttaagatcaatttgatgtaaatggaaattgaatgtaactgacaattgaactgtaaaattcacttatttccatgactcagaagaattagcctacatattcaccactttttagtggcccccaaactagtgtttttgttgctgtttgtttgtttgttttcgagatggagtttcactcttgttgcccaggctggagtgcaatggcactatctcggctcactgcaacttctacctcccaggttcaaacaattctcctgcatcagcctcccmaggagctgggattacaggtgtgtgtaatgcctggctaatttttgtatttttagcagacactgggtttcaccatgttgaccaggctggtcttgaacccctgacctcaggtgatctgcctgcctcagcctcccaaagtgctgggattacaggcatgagccaccgtgcctggcccaaactggttcttacaatgtttcagaggctgactttaaggccagagcacaatctttgtgcttgacagctcagaacatttcccttaacacctgttgtggtactttgcctcttacaaacccttctcccctt

SEQ ID NO: 128917 - DNA, 601 bp, Human
attagcctacatattcaccactttttagtggcccccaaactagtgtttttgttgctgtttgtttgtttgttttcgagatggagtttcactcttgttgcccaggctggagtgcaatggcactatctcggctcactgcaacttctacctcccaggttcaaacaattctcctgcatcagcctcccaaggagctgggattacaggtgtgtgtaatgcctggctaatttttgtatttttagcagacactgggtttcaccatgttgaccaggctggtcttgaacccctgacctcaggtgatctgccygcctcagcctcccaaagtgctgggattacaggcatgagccaccgtgcctggcccaaactggttcttacaatgtttcagaggctgactttaaggccagagcacaatctttgtgcttgacagctcagaacatttcccttaacacctgttgtggtactttgcctcttacaaacccttctccccttaggaaaacttttttgctgactcagaaatttgcttgtcctgaaaggagttttagcttacaaatagaaacactgtcattaaagtggcaagcagtagaagtgaactagactaaaaataaat

SEQ ID NO: 128918 - DNA, 601 bp, Human
aaagacctcaaaagcttaggccacaaaaacaaaatagacaaatgggacttaattaaactaaaaagcttctgcacagcaaaagaaataatcaacaaagtgaagaacaacctgccgaatgggagaaaatatttgcaaactattatctgacaggagactaatatccagaatatacaaactcaaacaatggggaaaaaataatcccattaaaaagtggagaaaggacatgaatagacatttctcaaaagaggacataaaaataaccaacagatacatgaaaaaatcgttaccattactaatcatyagagaaatgcaaaccaaaaccaaaatgacatataatcttataccagtcagaatggctattaataaaaagacaaaatacaacagatgttgctgaggatatggagaaaagggaagtcttatacactgctggtgagaatgtaaactaatacagccaccaaggaaaacaatatgcagatttcccaaaaaactaaaactggaattaacatttgatccagcaatccctctactgggtatctacccaaaggaaaaatcagtatatccaagggatacctgcactggcatgtttattgcagcactattc

SEQ ID NO: 128919 - DNA, 601 bp, Human
caaaagcttaggccacaaaaacaaaatagacaaatgggacttaattaaactaaaaagcttctgcacagcaaaagaaataatcaacaaagtgaagaacaacctgccgaatgggagaaaatatttgcaaactattatctgacaggagactaatatccagaatatacaaactcaaacaatggggaaaaaataatcccattaaaaagtggagaaaggacatgaatagacatttctcaaaagaggacataaaaataaccaacagatacatgaaaaaatcgttaccattactaatcattagagaaaygcaaaccaaaaccaaaatgacatataatcttataccagtcagaatggctattaataaaaagacaaaatacaacagatgttgctgaggatatggagaaaagggaagtcttatacactgctggtgagaatgtaaactaatacagccaccaaggaaaacaatatgcagatttcccaaaaaactaaaactggaattaacatttgatccagcaatccctctactgggtatctacccaaaggaaaaatcagtatatccaagggatacctgcactggcatgtttattgcagcactattcacagtaac

SEQ ID NO: 128920 - DNA, 601 bp, Human
aaactaaaactggaattaacatttgatccagcaatccctctactgggtatctacccaaaggaaaaatcagtatatccaagggatacctgcactggcatgtttattgcagcactattcacagtaacaaagatacagaatcaacctaaatgcccatcaataatgaaagggtaaagaaaatatggtacatatacacaatggaatactattcagccatgaaaatgaatgaaatcatgccatttgcagcagcatggggatggaattggaggtcattatgctaagggaaataagccaggcacagcargacaaatatcttatgttctcaatcgtatgtggaagcttaaatatttcattccatggaggtagatggtagaaagatgacagagactcagaagtagggggaaagggagagcagatgaaaggaagtgggttaaagaatacaaacctacagtaaggtagaagaaataacgtcaatgactgtagttaacaaaaacgtgctcgcgtgatggacaccctaaatcctcggatttcatcagtatagattcattacatacatgtaacaaaattttacatgtacctcataaatttatacaaacaccaccaa

SEQ ID NO: 128921 - DNA, 601 bp, Human
aagaaaatatggtacatatacacaatggaatactattcagccatgaaaatgaatgaaatcatgccatttgcagcagcatggggatggaattggaggtcattatgctaagggaaataagccaggcacagcaggacaaatatcttatgttctcaatcgtatgtggaagcttaaatatttcattccatggaggtagatggtagaaagatgacagagactcagaagtagggggaaagggagagcagatgaaaggaagtgggttaaagaatacaaacctacagtaaggtagaagaaataacgtcartgactgtagttaacaaaaacgtgctcgcgtgatggacaccctaaatcctcggatttcatcagtatagattcattacatacatgtaacaaaattttacatgtacctcataaatttatacaaacaccaccaagaagaaccctgtttttcttggagccagtgaactgccaatgtgtctgtgtagcaaagttaactacttagagaagcaaggctcccaggaaaataggtccttgaagttagtgtgcatattctatagtctgattccatctatataagtgacagtaaaagtgagaattttttgac

SEQ ID NO: 128922 - DNA, 601 bp, Human
tggtagaaagatgacagagactcagaagtagggggaaagggagagcagatgaaaggaagtgggttaaagaatacaaacctacagtaaggtagaagaaataacgtcaatgactgtagttaacaaaaacgtgctcgcgtgatggacaccctaaatcctcggatttcatcagtatagattcattacatacatgtaacaaaattttacatgtacctcataaatttatacaaacaccaccaagaagaaccctgtttttcttggagccagtgaactgccaatgtgtctgtgtagcaaagttaactayttagagaagcaaggctcccaggaaaataggtccttgaagttagtgtgcatattctatagtctgattccatctatataagtgacagtaaaagtgagaattttttgacgctccaggaattcattcattacaaatttaaataggcacataagtgagtaggtacaagcgacttccaaccccctcacccaaaggagcagagatattctaaggattagagctggaagaaaacctagacaatttcttaatagaacccttttcaaattcttacaccaaaatccaatattcaaaagaaagtcttggtag

SEQ ID NO: 128923 - DNA, 601 bp, Human
agcagagatattctaaggattagagctggaagaaaacctagacaatttcttaatagaacccttttcaaattcttacaccaaaatccaatattcaaaagaaagtcttggtagaggcagaggtggaacacccagggcctctgctactgtggcctttccctccacttcaaccacccctctagcctgaggcattcttgtgaaacctcatggctttaaggaacccactaacaattgcattttgccccatcttctcacctgtctgagcagaaatgcctagcacttctacttccaaggtattttttgmggtgtcattggctttagtttagcctgaagaattaaaagaatctcgagtgtagatgatttcaagctcaacttgttccctttatgaaagtataatactgaatttgagacgtaactttcatggatggaaatagactgcaggtccacaatcctataatcccaaagctttggaaaccaaaagcctcttaactcatttggtgctttcagttctcctagagctctgcacagcagcagtcccagctgagcaccagaggtggataggtagaaccttttaaaaacttgaacagaaaacttaacagtgttc

SEQ ID NO: 128924 - DNA, 601 bp, Human
gagagggagtaaaacacagctttatgatgatcaggcagaagcttgagtaaagtggaaatatctcggataagaaaagctagaaattaaactcctttttggcttcggatattttcttagtagaaaatgctgatgcctgtcctgagtctcctcaatatagactcttagagcagagctgctaggattttaatagaatttattactgttgatagcttgtatattacaactaaattcagagaccctctttaaggcaatagtagagtaaatatcagccttgggatactgtatgcccatacttaatccsaggccactctgagtgcctaggaaatctgtagcttcaaactcattcttaaggaggttgtcttccaggtaccttaaccctgaggtgggaaactatcaattgacattgacctttaagttgctattcaaatctgattacaaggtttccattttgattatgtagatatcaatgtcaatgttgttgtctcattttgacttaataacctttggtaactaaaaccttaaaaaaaaaatcagaggctttcagtctttactgtatcttaactccaacctgactattctttccaagtatatttatacctat

SEQ ID NO: 128925 - DNA, 601 bp, Human
ggataagaaaagctagaaattaaactcctttttggcttcggatattttcttagtagaaaatgctgatgcctgtcctgagtctcctcaatatagactcttagagcagagctgctaggattttaatagaatttattactgttgatagcttgtatattacaactaaattcagagaccctctttaaggcaatagtagagtaaatatcagccttgggatactgtatgcccatacttaatcccaggccactctgagtgcctaggaaatctgtagcttcaaactcattcttaaggaggttgtcttccrggtaccttaaccctgaggtgggaaactatcaattgacattgacctttaagttgctattcaaatctgattacaaggtttccattttgattatgtagatatcaatgtcaatgttgttgtctcattttgacttaataacctttggtaactaaaaccttaaaaaaaaaatcagaggctttcagtctttactgtatcttaactccaacctgactattctttccaagtatatttatacctatgttctcagactacaaatcattcttttcctgattactcaaggtagagtcttaccactttcacagt

SEQ ID NO: 128926 - DNA, 601 bp, Human
gcagagctgctaggattttaatagaatttattactgttgatagcttgtatattacaactaaattcagagaccctctttaaggcaatagtagagtaaatatcagccttgggatactgtatgcccatacttaatcccaggccactctgagtgcctaggaaatctgtagcttcaaactcattcttaaggaggttgtcttccaggtaccttaaccctgaggtgggaaactatcaattgacattgacctttaagttgctattcaaatctgattacaaggtttccattttgattatgtagatatcartgtcaatgttgttgtctcattttgacttaataacctttggtaactaaaaccttaaaaaaaaaatcagaggctttcagtctttactgtatcttaactccaacctgactattctttccaagtatatttatacctatgttctcagactacaaatcattcttttcctgattactcaaggtagagtcttaccactttcacagtccccaaaggtagtaaggtcatatagaactgcaagacacgtaccctcagcattgagaatattgcaaacatattaagaatccagtggcaatgaggggagagggg

SEQ ID NO: 128927 - DNA, 601 bp, Human
atctctatttctaccctattcttgctgctccttctaaatcttcttcactgtgcttgtaatagaaacatcattaatggataatagtatggatgtggacaagaaatgccattaaaggattaggacttggctgattatagccacacacgtagtttcaacaaatgagagaaatgagtccacaggcagagatgatgccccttgtggtctctgggcaatctggattccttctattttcgtctggctccatttgcccgagatcactattccagccaccatgcccaattttcaggtaccaggaatgaasagatggaaagaaaatggatcctctatcctcttaaggacatttcccaaagttgtatataccattttagtttacattccattagtcagaatgtagccccttggctgcacctcactgagaaagaggcttgaaaatctagtatttagtcttagcatgcacccagctaagaacgcaattactgtcagtcactggctgaagagccatcctactctggcccttaggatgtcatagcctgccgagtctgcagtatccttctgagaaggtccccatccatgggtattaggtatcttgaatctataacca

SEQ ID NO: 128928 - DNA, 601 bp, Human
taaaatccacttctaacaattgctttgaaagaatctatacttctctgtgtaaaggaataaaattgaatgtttgacgtggggttatcaacttgagaatggaatgataaggtgatgttccatttaaatgacaggacctagtttatcttagatcagacaaacgtggaataggaatctgggagaagggagaagaggaccagaaatagagacaaacagaagattgcttagaaggggcttttttccccttttaattttcaaatggctctgatcctagaaaagaaggcaagccatggacatgagaaaatcccataaagtttcagggggttaattaacccttgacatagaaactacaagccagcacagatcaaagatcagataaggattcttttttaattctctgcctacaatagttgctaattctaaagcattagcagggcggaagacattctctccccaagagaatggggatacagtgtcacagccatcaatcagcatctattaaaagatcactgtgagaaatgcctatgtatgcaatctatacaacctcatgtcaagccaaaatagctgagaactgcatggcaagattacatttacataccatgaa

SEQ ID NO: 128929 - DNA, 601 bp, Human
caaacagaagattgcttagaaggggcttttttccccttttaattttcaaatggctctgatcctagaaaagaaggcaagccatggacatgagaaaatcccataaagtttcagggggttaattaacccttgacatagaaactacaagccagcacagatcaaagatcagataaggattcttttttaattctctgcctacaatagttgctaattctaaagcattagcagggcggaagacattctctccccaagagaatggggatacagtgtcacagccatcaatcagcatctattaaaagatcaytgtgagaaatgcctatgtatgcaatctatacaacctcatgtcaagccaaaatagctgagaactgcatggcaagattacatttacataccatgaatacatgctgaaatttgctctacgatccctttgttcagggttgtaaacattctgaaacaatattctatgtgaatattggtgctaacattgtcatttatcttttaaaagatgttatataaagatgttcactatacaaggtagaaatacagaagaaaagtagagtctaaatgtaggtttcatcaactgccatcttgttatgcctttacc

SEQ ID NO: 128930 - DNA, 601 bp, Human
caacctcatgtcaagccaaaatagctgagaactgcatggcaagattacatttacataccatgaatacatgctgaaatttgctctacgatccctttgttcagggttgtaaacattctgaaacaatattctatgtgaatattggtgctaacattgtcatttatcttttaaaagatgttatataaagatgttcactatacaaggtagaaatacagaagaaaagtagagtctaaatgtaggtttcatcaactgccatcttgttatgcctttacctacttcttcatgcatcattattaaaatgctrtaaagtatgcatcatggcagaccttgttctacacctgatctctcagagcagtatcacaggtgttttcatgccaatgtgtaaagcagatcagtagctcctttagaagcataagaaagtccattctaccatctcagggaagaaacttacatccagtctcaggaccaagaatagttctcctgtgcaacactttatcatcatttgcattttaacactaagattttaatctattccacaagacactgagtctcatgctatttctgggttacctaggtaatttagttctcttactaaatatctcct

SEQ ID NO: 128931 - DNA, 601 bp, Human
ggtgcctgtagtcccagctactcgggaggctgaggcaggagaatggcgtgaacccgggaggcggagcttgcagtgagccaagaccacgccactgcactccagcctgggtgacagagcgagactccatctcaaaaaaataaataaaaataaataaaaaatcaatcaatcaatcaatcatggggtctctttacagccattccgctactccctcttttgtagcttccaaagaatatcacaggttgaattatagcaactaaccctgcagaccctctgacttcttcctccatgctcaggagaacayagaccttgaatagcacttaattcattaacattagtgtttgagtttttcagtgattttagaaacaggcatgaatctaaagctagcatggccagtcttgtttccttggctgtgtaattcaaggagataatcctttatagatcatcataatttgtcaacccatcttgagttctagaaattaactgtaatcactgtctctctcctttacaatatcttactctcaaccagagtggtccaagggcacactctaagctctgagagttctacctgctttaaaccagtgatttgagaaacagtcccttt

SEQ ID NO: 128932 - DNA, 601 bp, Human
agaaagaatataatctaagaaagataagcttagggtatcctgtgtggctactttatatcaagattcatcctgctccgtgattccttcatgggtaggataatcaagctgcccgatttgcttaggacagtcctggtttatgcttatcttccagatataattaaaagtgtcccctttctgctgagactgtcccagtttggacaaaaaattgcatggtaaccctaagtataggggaaagacctgccccaggaagaattagcaacagaatcaattcctctccttaggctattttaacattagcagkcagttatggatattagcactgacagcttcaatgacttttagctggttgatgttagcctaccccttggctagaaaggctaaaatcttctctcccttgaattctaagtacaacatctcttgttacactgattgagttttctcccctttctacctgatgagtttctttgcccctgtagaccagtatgggtgacaatattcagtactggggtttggccttcattctccacactaaacacatgtgttgttaggggatgccccttgaacagtatattagtcagctcagactgctgtcacaaaaata

SEQ ID NO: 128933 - DNA, 601 bp, Human
tgagtcacaggtattagcgcttccaggcagcacaggagcagcagctttgcattgatcagttctgaggctcttttgagactgtatatcatcaacagatatgagaacatgccgcatacatgaaatcagctgtggcgcccattctactcagtgtatcccagtgtcctggagatgtgatggtgaaaatgattgtgacagtggagaagatgaagaaaactgtggtaagaagatcagtgttgagtgacgtaacccaaagacccttttcctaaaggaagggtgggcaggggaaactaatctaagcctraagacgcactgacattgactcacttttcagtgacttcactatctgctcaattacttgtccttcataactgccctaaaaccctaaaagacattcatgtggcaattgaccatcgcttggtgtttcttttaggcaaatagaaataagaaggtaagtcattcaaggcacttatatatagaagtagctcagggaagcagcaattgtgtgggcttttgttttgacagtaattcatgtgtcttttgcactttggcacaataaaattagaaggtgagtagggttggcaaacacattcataggtctaaa

SEQ ID NO: 128934 - DNA, 601 bp, Human
tcacaaatagcctgggttttaaatgtgaaagatattaattgaaaataagttgtcaagtgactactacatttttattccagatataaacgaatgcttggtaaataatggtggatgttctcatatctgcaaagacctagttataggctacgagtgtgactgtgcagctgggtttgaactgatagataggaaaacctgtggaggtgagtctaagaagaaaacctggaccctgcaggtgatgggaaaggatagtatgtacctagtaaggtataggagcagcaagactaattctgatttccctccyagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggtaaatgaacttggactggtatggctgttgtacctttatgagtaagtgcctctaaaaggtacagccagtgactacaatagtcaaactaaacatgaaattgtacttgagaacaatgctgctaacctcataatacagcagtataggtcaaatagcagatctctcccctagatat

SEQ ID NO: 128935 - DNA, 601 bp, Human
actgtgcagctgggtttgaactgatagataggaaaacctgtggaggtgagtctaagaagaaaacctggaccctgcaggtgatgggaaaggatagtatgtacctagtaaggtataggagcagcaagactaattctgatttccctcccagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggtaaatgaacttggactggtatggctrttgtacctttatgagtaagtgcctctaaaaggtacagccagtgactacaatagtcaaactaaacatgaaattgtacttgagaacaatgctgctaacctcataatacagcagtataggtcaaatagcagatctctcccctagatatgtaccttgatcattccttttgcatatgataccatgaatacctaccaggtttgcatgctctgtttccaaaacttgagtccaactcaaacaagtgacttattcatcactcaccctgttcttgaaggctgtaaccccacgactgccttcctaaactgt

SEQ ID NO: 128936 - DNA, 601 bp, Human
ttaatttttcacagctttgtttactggtcagactggggtgaaccagctaaaatagaaaaagcaggaatgaatggattcgatagacgtccactggtgacagcggatatccagtggcctaacggaattacacttggtatgtatgttcttccttctcgaccacccactcaactatcttcatagtgtttccatttatctccatggtgaattctggactagcagatgactctactgcttccgcctaaattctagcaggaattttcaatgggagtaactgaacaacacaagtaaaatggtggattarcaaattacacattccataattactggcctgttgtccagctgggcctaatatgtgacacaaattcagtgaacgttgggtcttgggtgcactcatactaaatattctgggcatgagtgccttagcatttcctgaattgcaggcttttaacagttttcttctggctttttggaggagaacaacaaaatggtagcctcttttaatattttctgtaatgtgagtaatatttcttaagtcatttgctttgagaatctcaggtaccctgttagtccccaaaaatgaacgtggatacaggctctgcat

SEQ ID NO: 128937 - DNA, 601 bp, Human
acaccgactgtccttcccaaagtttcatgtatctcttttttgcatgaagattgctatttcaatgttgacacatcagctgtacaacttagttcagcagtggtttgtctattttacctggttttaaaataaccttttacatggcttgtctggacaaaacagctagccatgctggaaccctggcattaaccaggttcttggtttttataattcaggtactgcaactactgtgacttacagtgagacaaaagatacgaacacaacagaaatttcagcaactagtggactagttcctggaggtattgagttcagtactgcaaactgttaatctcaactaacagccacactctttgtatctacagcttaaataattaatgcagcctttaactactatttctgccccaattggtaacctatatttaaacaccaaagacttaaaacttgcatatcttttcctgactgatcttaaaggtttctagtagagaactgtcagtgaaatggctactacagcatgtgactcaaatacttctaagccagagttgttcctggtgttcaattgttgtagatactgaacatcaatattggatgcaaaggttttggctcc

SEQ ID NO: 128938 - DNA, 601 bp, Human
tcagcatctaaccctcaccaactgacaagtgggtcaacttaaagtcaccactatattaagatatttttggttatagaaatgacatgtaaatactagcatgaaccaagtagctcattactgaactattaaatccattgcctactggatatttgaaagtaaattagcatatcatatataggggagttggcttaaagtcagtgtattgagtaagattcacttagccaaaattattatatgctttgctttaaaaaggtatcccaccgcccttagtatagctagcttttcttccagcaatagtcastcacttgttcttcagatgaaacccaagtggagtatttggccttcacgtaggaaacaggctgaacaaaacaagtattgatcactcccctctcaaactccggtgaaacatggaacagtggtcaattcttgacacacacatggcttttcacatttttccccaagacttatgatcattaagtagaaaagacagaattagtcacactatcttatctcactaccaagcaggtatagttgaattcaagttaaatgcatgaatgatacaactcagtattcttttgtatctgactgacttttcttctaa

SEQ ID NO: 128939 - DNA, 601 bp, Human
actttatcttcgactaccaaaggaagttcaggaacttcctcaatacgatgacctttagacatgaccagtgctggtagggctgaggcagccagggcagaacagatggcataccgtttttgggttgtgttcactctacgatgccaacggcgccaggttttggttggtgcaaaccttcggcctccacgacacatgtttccaaaagcaccctggccggagcggtgagtcccaccacctcgaactctgggaattcgagccacagctctgccagtaccccaagactcagtgctggtccgatgacctkctaattcactggcagcgtagggctgtctgttgtttttgcgcaagttggtgtgaacaaagttcacgatgtctggtcgaataggagccttgaatacagcgggctaagtgacatttttgccagatgactcccccttttcggagtacagcgacatcagtgggcggacacacgccatggcggagagagtagacagccactctcctctcagcccggctgctgcccccaggaaaaagcgtcacgtagatttttatcagttactcttaataataaacaatttggtaagttcaatattattatcatccc

SEQ ID NO: 128940 - DNA, 601 bp, Human
agggaattgtaaaatctggaatagaaatagagggtgaatacgtcctcccaaattttctataagtcacagcttctcaaaaaaattcatgtttagaagagacgtatgtgtcagtggaggaagtgtaatgataatattcagtaattgagtacgtactatgttccaagttttcttgtcacatagatttttgtttgtttgtttgtttctcactgcctgtataatcaggtctttattcaaaagaagctgtccacaatgatttgacctttatggaataatcaaatttaagagttaatgcagcaggctwcttttcctctacagtaggtttcttttctgcaggcttcttttcaggggctgatttcttggtagctgctgccttttttcccaccagaggcttcttctgcttcttcacaccaacagcagccttctttcctttcttacctaccacaggcttcttgcctgcaaccgccgccttctcatctggtttggcttctagtgctgctgcagcagcagctgccttatccatccggagcttgtgattcctggcctggcgaagaatggtgttccggcgcatggtctttgcatatgggtttagcttcaacatgat

SEQ ID NO: 128941 - DNA, 601 bp, Human; identical to SEQ ID NO: 33482

SEQ ID NO: 128942 - DNA, 601 bp, Human; identical to SEQ ID NO: 33483

SEQ ID NO: 128943 - DNA, 601 bp, Human; identical to SEQ ID NO: 33484

SEQ ID NO: 128944 - DNA, 601 bp, Human; identical to SEQ ID NO: 33485

SEQ ID NO: 128945 - DNA, 601 bp, Human; identical to SEQ ID NO: 33486

SEQ ID NO: 128946 - DNA, 601 bp, Human; identical to SEQ ID NO: 33487

SEQ ID NO: 128947 - DNA, 601 bp, Human; identical to SEQ ID NO: 33488

SEQ ID NO: 128948 - DNA, 601 bp, Human; identical to SEQ ID NO: 33489

SEQ ID NO: 128949 - DNA, 601 bp, Human; identical to SEQ ID NO: 33490

SEQ ID NO: 128950 - DNA, 601 bp, Human; identical to SEQ ID NO: 33491

SEQ ID NO: 128951 - DNA, 601 bp, Human; identical to SEQ ID NO: 33492

SEQ ID NO: 128952 - DNA, 601 bp, Human; identical to SEQ ID NO: 33493

SEQ ID NO: 128953 - DNA, 601 bp, Human; identical to SEQ ID NO: 33494

SEQ ID NO: 128954 - DNA, 601 bp, Human; identical to SEQ ID NO: 33495

SEQ ID NO: 128955 - DNA, 601 bp, Human; identical to SEQ ID NO: 33496

SEQ ID NO: 128956 - DNA, 601 bp, Human; identical to SEQ ID NO: 33497

SEQ ID NO: 128957 - DNA, 601 bp, Human; identical to SEQ ID NO: 33498

SEQ ID NO: 128958 - DNA, 601 bp, Human; identical to SEQ ID NO: 33499

SEQ ID NO: 128959 - DNA, 601 bp, Human; identical to SEQ ID NO: 33500

SEQ ID NO: 128960 - DNA, 601 bp, Human; identical to SEQ ID NO: 33501

SEQ ID NO: 128961 - DNA, 601 bp, Human; identical to SEQ ID NO: 33502

SEQ ID NO: 128962 - DNA, 601 bp, Human; identical to SEQ ID NO: 33503

SEQ ID NO: 128963 - DNA, 601 bp, Human; identical to SEQ ID NO: 33504

SEQ ID NO: 128964 - DNA, 601 bp, Human; identical to SEQ ID NO: 33505

SEQ ID NO: 128965 - DNA, 601 bp, Human; identical to SEQ ID NO: 33506

SEQ ID NO: 128966 - DNA, 601 bp, Human; identical to SEQ ID NO: 33507

SEQ ID NO: 128967 - DNA, 601 bp, Human; identical to SEQ ID NO: 33508

SEQ ID NO: 128968 - DNA, 601 bp, Human; identical to SEQ ID NO: 33509

SEQ ID NO: 128969 - DNA, 601 bp, Human; identical to SEQ ID NO: 33510

SEQ ID NO: 128970 - DNA, 601 bp, Human; identical to SEQ ID NO: 33511

SEQ ID NO: 128971 - DNA, 601 bp, Human; identical to SEQ ID NO: 33512

SEQ ID NO: 128972 - DNA, 601 bp, Human; identical to SEQ ID NO: 33513

SEQ ID NO: 128973 - DNA, 601 bp, Human
ggagacagcgagactcccgtctcaaaaaacaaaacaaaacaaacacaagacgattatctcagatgtctttacttatcctaaaagccaatgacttctgtacgattgcagcacaccccctgcccaacccaattctatatcctgtaaagaatataaccttgcatctatcaattataaaaatgtccttcatcatctataacccatctatatccttctccctaaccacttatttataattgtaagagcaacgtttgctaaagagtctctttaatactaagaaattataggcaaatcttgaatctcmagataatgttatatgacatatgatctttctcacttatgttctcaccactctttagaagaaatcacaggccagtgtgttcacaatccacatacatgaacagcattactttgtcagtatctttccaaacaagccaactgccctgcgtatgaataagacctgtagtaaatatctgatgatgaattcactcccaactttttaaatagcttgagtcagatctccagaccttgaagattattctattttcattcaacagtatttatcaaccacctaatgcaaaggcactttctaaaataccacaaa

SEQ ID NO: 128974 - DNA, 601 bp, Human
agagggtgggaaggggataagtgttgaaaaattacctattgggtacaatgttcactatttgggtaatgggtaccctagaagcccaaaccccaccattatgtaatttagccataaagcaaacctgcatatgtatgctctggatctacaattctaaaaaagagagaatatgcttaaaagaaataaaaggaacataagcaatagattgaaacatgtaacactttttgtagatcaaaactatatatagttcaatctaataaactggtagcttgagggatgggaaagttgtatatgtgtatatggyagagtatgctaagatttttttaaaaatgtttaaaaaataaacacaaaatggccgggcacagtagctcatgcctgtaatcccagcactttgggaggtcgaggtgggcggatcacgaggtcaggagatcgagaccatcctggctaacatggtgaaaccccgtctctactaaaaatacaaaaaattagccaggcgtggtggcaggcacctgtagtcccagctattctggaggctgaggcaggagaatggtgtgaacccgggaggcagagcttgcggtgagccgagatgatgccactgcactgc

SEQ ID NO: 128975 - DNA, 601 bp, Human
ggtgggtgggcgggtgggtgggccagggtgtgtgtgtgttgtgttagggaccaaaagaagggcatgctaaggtaatgtttaaaatgcttaaaactaaaaaatcaaggtgcagtaaaataagtatactatatttaaataaatggaggtaaatatcagaataacaggtttaaagaggtcaatgtagttgcctatgaggagtggtttgtgggagaatgggggaggttaaaggccatttttttaaaataacagaccttgctaagttttttgagtctttatactattatataccctattaagaccyggtgtaaatatttgataatatgtaaattcaataaaaagaaaacttttttttcatgtttacagaaggcaccttccagagataggaacactatttccatcacactcttgttagtgataggcactctctcaaaaccattcttctacagagatgaaaaccagagtgagttaaatgttcaacattgcctttaaaaagataactgttatctttttaaagttagttataacaatgtctgaattgttctttacttgctcttcagatgacatgacaaaagctatccctttctcaataaggttcagagtc

SEQ ID NO: 128976 - DNA, 601 bp, Human
aaatgaaaaaactgaataaagtttcccagaaatgaaaaagcatgaatgtccagactgaaatggcccatgaagtttctagtacagtatttgaaaataggcctgcatcaatgcacatcatcataaagttcataaaactggaatttcaaatattctacaaagtttcagagaaaaaaaaatcacataaaccacataaaaaagatcagaaatcagattggtgtttggcttgtccatggcaatcctgcaaactagaagaaacacagtcattaaatctaagaaaaataaatgagttttacaggaaagraaggtaatcactgtttactacaaggctggatttgaaaagcatttatatatcatggtaatataagcactgaatttactgaatttactgaaattaaaatataacttataggttgagacatgaaattattgtttttgtacctaaaaaaacacatatggttcaatctgtcaagaacataagggacaggaagggtgggtgggcgggtgggtgggccagggtgtgtgtgtgttgtgttagggaccaaaagaagggcatgctaaggtaatgtttaaaatgcttaaaactaaaaaatcaaggtgcagt

SEQ ID NO: 128977 - DNA, 601 bp, Human
gtgataatgatacggactatgaaatccaggctgaagtggtctcagatggagatgagaaacttgttgggaactggagcaaacttgtggggaattgctatgtccccacccaagcctcatcttgaattgtaattcccacaattcccacattgttgtgggaggaacccggtgggaggcaactgactcatgagggcaggtcttttctgtgctggtctcgtgatagtcagtaattcttatgagatctgatggttttaaaaatgggagtttccctgcacaagctctctctctttacctgctgccatcygtgtaagacatgacttgttcccccttgccttctgccatgattgtgaggcctccccagccacatgaactgtaagtcccttaaatgctttttcctgtataaattacccagtctcatgtatgtctttattactagcatgaaaatggactaatacactcatcattctagtatattaggttggtgcaaaaattaaattaatggcaaaaaccgcaattacttttgcaccaacctatatataatattgaatgcctcaaaattttaaaaattagctataaactttctctttatgtcaaaatcaacaaa

SEQ ID NO: 128978 - DNA, 601 bp, Human
ttctatagagacccattggtccaaaaagtctttataaagatgataggatgggtaatatcaaaatttgagtttctaatcaagatacttagatatttttatcaattttattgaattgggcaacaatgtctatatttggaaataagactctatgatgttttgtgagatcatgaaaagacaggaaatttcatatagcatttcagattgagtatccctaatctgaaaatccaaatgctgaaatgctccaaaattctaaactttttgagtgccagtatgacaccacaagaagaaaattccacacccracctcaagtaatagcctgcacaaaattacttaaaatattgtataaactcaccttcaggctatgtgtataaggtatatataaaaaaacatatatttcatgtttaatgctgggtcccacccccaagatctctcattatgtatatgcaaatataccacaaactgaaaaaagttccaaagcaaaagtacttctgttcccaggcatttcaggtaagtaatattcgccctgtacatagtaagatcttgctattctttgttcagaattctctatccctgaaccatattgtctaagaaagtgtgacaa

SEQ ID NO: 128979 - DNA, 601 bp, Human
ggaacaaaagttcttgactagtaaagaaaatgaaagcagcactggtttctaaaatagctacagaggataagttacttgaaagtgagaacaaagagaaagtggccaaaagccaatgttacaagaaaaggagtttaaaaactccaaatttttttttagaagatcatgaattctactactattactactattaataataacaatgaaaataataatagtaaaaaataataaacatattaaaggcttattataatcaggtactaacctaaatattttagcagaagtattatttaatatttttagmtataaatgagcaagacattgttacaattattttatagaagagaaaactgagtttcagaaaaagccaataagttgcccagtcatataagtagaaaggactagagccaggatttgaatttatgccttccaacaataaagcccactcaatttccacaaaatctgcttccctttatgaagtagtcctcaaagaaatacaagaggaagcccagaagccacggaagaaaaaagagataatagtcaatagtatcaagtgtcaaagaaaaatccagaaagatcctagaaaataatgttggatttagct

SEQ ID NO: 128980 - DNA, 601 bp, Human
aagttggtgttggttctgatctagagtctgagcctccctgactcataatccagtccaatacaaggaaggaggaacaaaagttcttgactagtaaagaaaatgaaagcagcactggtttctaaaatagctacagaggataagttacttgaaagtgagaacaaagagaaagtggccaaaagccaatgttacaagaaaaggagtttaaaaactccaaatttttttttagaagatcatgaattctactactattactactattaataataacaatgaaaataataatagtaaaaaataataaacrtattaaaggcttattataatcaggtactaacctaaatattttagcagaagtattatttaatatttttagctataaatgagcaagacattgttacaattattttatagaagagaaaactgagtttcagaaaaagccaataagttgcccagtcatataagtagaaaggactagagccaggatttgaatttatgccttccaacaataaagcccactcaatttccacaaaatctgcttccctttatgaagtagtcctcaaagaaatacaagaggaagcccagaagccacggaagaaaaaagaga

SEQ ID NO: 128981 - DNA, 601 bp, Human
ggaggtatctttattgagaaattgtctggcattttttcaaacgactgatgactacactgggtgcctattcaaagtgaaagacaccaccaccacctctgcagatcagaggaagttggtgttggttctgatctagagtctgagcctccctgactcataatccagtccaatacaaggaaggaggaacaaaagttcttgactagtaaagaaaatgaaagcagcactggtttctaaaatagctacagaggataagttacttgaaagtgagaacaaagagaaagtggccaaaagccaatgttacaaraaaaggagtttaaaaactccaaatttttttttagaagatcatgaattctactactattactactattaataataacaatgaaaataataatagtaaaaaataataaacatattaaaggcttattataatcaggtactaacctaaatattttagcagaagtattatttaatatttttagctataaatgagcaagacattgttacaattattttatagaagagaaaactgagtttcagaaaaagccaataagttgcccagtcatataagtagaaaggactagagccaggatttgaatttatg

SEQ ID NO: 128982 - DNA, 601 bp, Human
cataaaaggcagataataccaactaccttgcagggttgttttaagcttgagaaataatgagccatgcattaagcatagggacacataataagatgctcagtagattgtagcttctattactatgatccattgtttgaactggacttctgacagaagtaaaatggtaggtaaattcaaaatgatagctattattgaaaacttaaatagcttatagtgcagactgaaatattattcataagctcaagataccaagacacctgtccaggtgccacctaacaccctacttcaactcttaccacamccttcccacgctctcccccagccatatagactctgtttcaactccacaaacccaccagctcctctctcgtgccaggtcttcatacactcacttccctgaataaacacttccttttattccctcactgttacctctattcctcaaatcttagcttaaaagtcagtccctctggggaaacttccttgaccagctcatactataaatgacaattttgatttggaccttaaagtttacctttctttgacacactgatgacaaacagactcagctatacattgagatctattagaatgagggtgt

SEQ ID NO: 128983 - DNA, 601 bp, Human
atacttagagtctgagtttaggtagggcataggaggttcaaggatcacttttttaaatttgctagttattttgctcaaatagtcctttatatcctgggtgctcttctttgctttactacttttgcttgtgacatttcttgataatgcatagtgattggtagagctaaaattaatccttcttgacataaagtaaattatgttctttaccatggggttgccatgtttagtacagctgtcagagggcttatagcacttcacagtttatcttgtttaattcatctgactgctttatctctggaartagagcttaagagctcatgaagtcagatgacttgagaatgactcttggccaaaaaaaaaaaatggctaaagcaaggtatattagttaaaatattagacttaagacttagcactgagttactacgcagccaggacaaagagagtggctccagtttgctttaaatagaaagcctatcagttcacaagggctgtaaggaaaatgaaccatcagagtcttttcagaaatggtttgactgatgtcaacacaagttttgttttgttttattttgtttcaggcagggacagagtgttctgcatgggg

SEQ ID NO: 128984 - DNA, 601 bp, Human
acacacctgttttaaaaatagtcctttagagtacctgtaattcttaattatcatctgttttatgtgtttttcaaacaaatttattttcttgatagtaattttcaagacaagagttgataggaaatgtagagaaaattaggcaaaacctcaaaatttatttttcgctatatatttttctaggtgactataaagtggtttaaactggatatttttttgaagagctcttattgcttagaatatatatggcaaagtttcagttcttatttgtttaaagataaaacactaaataaatacctatggytattgactataatttattagtagctcatattatcactttttgaacttatttcagattggcaaagttatttattttaaaatgttcttcttttaatacaacttcagattcctagaaaaattgcaagaattatacaaaatattcctttccgcagattacccagatgctaatattttactacatggattttatcatttttccctctttttttaaggttctatatttattgatgttcatacttagagtctgagtttaggtagggcataggaggttcaaggatcacttttttaaatttgctagtta

SEQ ID NO: 128985 - DNA, 601 bp, Human
aattttttagtttagtacctgatttctaatttttaatgcttttgtctttttcttgagaatcatttagtttgtattttctagcaatgaggtttgtaaagtagtccaattgtaccaccaattccttatacacacctgttttaaaaatagtcctttagagtacctgtaattcttaattatcatctgttttatgtgtttttcaaacaaatttattttcttgatagtaattttcaagacaagagttgataggaaatgtagagaaaattaggcaaaacctcaaaatttatttttcgctatatatttytctaggtgactataaagtggtttaaactggatatttttttgaagagctcttattgcttagaatatatatggcaaagtttcagttcttatttgtttaaagataaaacactaaataaatacctatggctattgactataatttattagtagctcatattatcactttttgaacttatttcagattggcaaagttatttattttaaaatgttcttcttttaatacaacttcagattcctagaaaaattgcaagaattatacaaaatattcctttccgcagattacccagatgctaatatttta

SEQ ID NO: 128986 - DNA, 601 bp, Human
aattaaaacaaaaagcaaagccagaaactggctaactataattttttagtttagtacctgatttctaatttttaatgcttttgtctttttcttgagaatcatttagtttgtattttctagcaatgaggtttgtaaagtagtccaattgtaccaccaattccttatacacacctgttttaaaaatagtcctttagagtacctgtaattcttaattatcatctgttttatgtgtttttcaaacaaatttattttcttgatagtaattttcaagacaagagttgataggaaatgtagagaaaaytaggcaaaacctcaaaatttatttttcgctatatatttttctaggtgactataaagtggtttaaactggatatttttttgaagagctcttattgcttagaatatatatggcaaagtttcagttcttatttgtttaaagataaaacactaaataaatacctatggctattgactataatttattagtagctcatattatcactttttgaacttatttcagattggcaaagttatttattttaaaatgttcttcttttaatacaacttcagattcctagaaaaattgcaagaattatacaaa

SEQ ID NO: 128987 - DNA, 601 bp, Human
gccttcagtctactaggatatatatcctactaattaaaacaaaaagcaaagccagaaactggctaactataattttttagtttagtacctgatttctaatttttaatgcttttgtctttttcttgagaatcatttagtttgtattttctagcaatgaggtttgtaaagtagtccaattgtaccaccaattccttatacacacctgttttaaaaatagtcctttagagtacctgtaattcttaattatcatctgttttatgtgtttttcaaacaaatttattttcttgatagtaattttcargacaagagttgataggaaatgtagagaaaattaggcaaaacctcaaaatttatttttcgctatatatttttctaggtgactataaagtggtttaaactggatatttttttgaagagctcttattgcttagaatatatatggcaaagtttcagttcttatttgtttaaagataaaacactaaataaatacctatggctattgactataatttattagtagctcatattatcactttttgaacttatttcagattggcaaagttatttattttaaaatgttcttcttttaatacaacttcag

SEQ ID NO: 128988 - DNA, 601 bp, Human
atcaattgatttaattattctagcttttcttagagattggggtggaaactgagggccttcagtctactaggatatatatcctactaattaaaacaaaaagcaaagccagaaactggctaactataattttttagtttagtacctgatttctaatttttaatgcttttgtctttttcttgagaatcatttagtttgtattttctagcaatgaggtttgtaaagtagtccaattgtaccaccaattccttatacacacctgttttaaaaatagtcctttagagtacctgtaattcttaattawcatctgttttatgtgtttttcaaacaaatttattttcttgatagtaattttcaagacaagagttgataggaaatgtagagaaaattaggcaaaacctcaaaatttatttttcgctatatatttttctaggtgactataaagtggtttaaactggatatttttttgaagagctcttattgcttagaatatatatggcaaagtttcagttcttatttgtttaaagataaaacactaaataaatacctatggctattgactataatttattagtagctcatattatcactttttgaacttatt

SEQ ID NO: 128989 - DNA, 601 bp, Human
actcaggctagagatgtagtggtgatcacagctcacagcagttttaaactcctgggcttcagtgatcttcctgctaagcctcccaagtagttgggactacaggcacatgccaccacacttggcctgaggcttacttttaaaagtcacttgttaaaactgtactttacagaaataaaatataatcttttaaagcaacatttaagagtttaaattataaaaagatgaaaagttgtacctttgtatttaatttaaaaatctgtattctgtcccacattcaataattaatatgtcaactataatrtgaatttgggtgagtttaacttttttaaaaaaatactgatcaattgatttaattattctagcttttcttagagattggggtggaaactgagggccttcagtctactaggatatatatcctactaattaaaacaaaaagcaaagccagaaactggctaactataattttttagtttagtacctgatttctaatttttaatgcttttgtctttttcttgagaatcatttagtttgtattttctagcaatgaggtttgtaaagtagtccaattgtaccaccaattccttatacacacctgttt

SEQ ID NO: 128990 - DNA, 601 bp, Human
tttgtttgtttgtttgcttgttgtttcaactggagctcgttccacttttctccatttgacaccttgaggttaatatataaatttattatatgttaggtgaaaaacagactccactctatctcctttgtcccccttagatctgtcactcaggctagagatgtagtggtgatcacagctcacagcagttttaaactcctgggcttcagtgatcttcctgctaagcctcccaagtagttgggactacaggcacatgccaccacacttggcctgaggcttacttttaaaagtcacttgttaaaaytgtactttacagaaataaaatataatcttttaaagcaacatttaagagtttaaattataaaaagatgaaaagttgtacctttgtatttaatttaaaaatctgtattctgtcccacattcaataattaatatgtcaactataatatgaatttgggtgagtttaacttttttaaaaaaatactgatcaattgatttaattattctagcttttcttagagattggggtggaaactgagggccttcagtctactaggatatatatcctactaattaaaacaaaaagcaaagccagaaactggct

SEQ ID NO: 128991 - DNA, 601 bp, Human
aagaaacactccatttttcaaaatgtatttctaaaagtgcttgggaaaattaagcataatcatgagttttaaatattataactgcctaccaaatcaatgaacccataggcaacaaaccctcaaagtcaagggaacctcaaattcaaggaaaaaccttgaaaataagcccaaaacaaagaccaaaaaaaattcccaaaattattggtaaaaaggctttttgtagaataattatgttattaatggtcgtaaacaggactgtaatcgatgatcttatcagtcccataagaaaaaaatcaataaraagattattactgggatctgaagcttaggtttgttcaaagtaaaattaatttatttagtatcactttccaaaaaacttcagaaataattttgctctatcatttcaacaatcatttcaacatacagattttttagatttgtttacaaacaaaaagaaacatgtaaatctgtattatggtttaattctgctaatgatgagatagaaagttaacttgagattcacaaatgggacaatgcttctttaaacctaattatattcataagcatttttatttaagaatataattccattcatcatatt

SEQ ID NO: 128992 - DNA, 601 bp, Human
taattagcattcttagtagtgctatttttatactgaacatttttatactgagctttaaagagtatgaatttgttttattacactagcttctctagatcacttttttcccatgataaagtttctcaacttctctgatgcgctgttgctttgttatttttatatctaatctagatatctttaaaattagatatttttaatacctaattaaaataattaaagaaacactccatttttcaaaatgtatttctaaaagtgcttgggaaaattaagcataatcatgagttttaaatattataactgyctaccaaatcaatgaacccataggcaacaaaccctcaaagtcaagggaacctcaaattcaaggaaaaaccttgaaaataagcccaaaacaaagaccaaaaaaaattcccaaaattattggtaaaaaggctttttgtagaataattatgttattaatggtcgtaaacaggactgtaatcgatgatcttatcagtcccataagaaaaaaatcaataaaaagattattactgggatctgaagcttaggtttgttcaaagtaaaattaatttatttagtatcactttccaaaaaacttcagaaa

SEQ ID NO: 128993 - DNA, 601 bp, Human
tgaaaatggaaagtgtaacaaacaagttgcatttttcgcccctcaggatgcctcattcatatatatgatatgtataagtttctatatcttggctatatctcctatttttaagtaaaaataaatagaaataaaaattctaacacttctttctcatattttttttctttcttttttttttttttttttgagatggagtttcactcttgtcacccaggttagagtgcaatggtgcaatcttggctcactgcaacctctgcctcccgggttcaagcgattctcctgcttcaccttcccaagtagstagggttacaggcatgctccaccatgcccatctaattttgtgttttgagtagagatggggtttcatcatgttggccaggctggtttcaaactcctgacctcaggtggtccgtcttcctcagcctcccaaagtgctgggattacaggcgtgaactaccatgcccggccttctttctcatattctagtaagtcttgttgcactaacctagaatagagatgctccattttggatacatcagatagtgactgcttacgctattcagaaattatagtttaaaaattggagtgtgtgcctgtacat

SEQ ID NO: 128994 - DNA, 601 bp, Human
acaggtatatatgtttgccaaaactcatcaaacagtacacttaaataggtggattttattgcgtgtaaattatacttagaaattttcagttcggtagtttctgaatttttttattatgtttgcttcttagttaaaaatatttacttataaattatatacatgttctagtgtataaatataagtatacactttacaaaacatacaaaaataggaattacaaaataaaaactaaagatcaaatatttaagtatcctgttcattgaggcaacttcattagttaattttacagcacaatatacayttggataagaattcatcactgaaaataatacatacaatagacataaatccatgtgtcaaaaatcttagtatttggaattttagagccaacttcttatttaggtaatatcttcaaattgttacatgactgtcgaagaattggacaggtactcattctgcccttttcttgtttctgcctgcaatattaatgcaatcttcaatctgtaagctatatgtggaaaaatttttaagccacttgtcaatattatgaagttagtttaaaatcagactacataatccattaatccaccttgctgaaaat

SEQ ID NO: 128995 - DNA, 601 bp, Human
atcacacaccggggcctgtcatggggtgaggggaagggataacattaggatatatacctaacataaatgacaagttaatgggtgcagcacaccaacatgggacatgtatacatatgtaacaaaactgcacgccgtgcacatgtaccctagaacttaaagtataataataaaaaaaagaatatatgttgtatgacatcatttattggaaattcaaataaaagtcgtggaaaatataaagcgatctaaataacagaaagcagaccagtattttcctagaatttggatgggagaggaaaggtaytaataacaaagaagagggaagtatttggggtaatgaaaatgttctgtattttgactttggtgatgtttatacaggtatatatgtttgccaaaactcatcaaacagtacacttaaataggtggattttattgcgtgtaaattatacttagaaattttcagttcggtagtttctgaatttttttattatgtttgcttcttagttaaaaatatttacttataaattatatacatgttctagtgtataaatataagtatacactttacaaaacatacaaaaataggaattacaaaataaaaact

SEQ ID NO: 128996 - DNA, 601 bp, Human
tgaaaaatattttggcagtttcttatacggttcaacaaacaattaaccatgggactcaacaggtccactcctaggtatttacccatgagaaataaaaacctatgccctgagaatatacgaatgtttgagaccagaaacaacctaaatgttcaacaataggtgaatggataaaccaactataataaatattggtataatgaaacattactcatcaataaaaaaacctctcatacacacaataacatggatgaactcccaaaacattatgatgagtgcaagaagccagcttgcacaaaagaayatatgttgtacaaaagccaaaattgacaaatgggatctaactgaactaaagagcttctgcacagcaaaagaaactaccatcagagtgaacacgcaacctacagaatgggagaaaatttttgcaatctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaacagacacatgaaaaaatgctcatcatcactggcc

SEQ ID NO: 128997 - DNA, 601 bp, Human
catggcatgctgcggccacatttaaatttattcaaactagcataccatctaaccatatattaccaggtttctcaatacaagctgataagatttctaaaattaaacaaatttcacatcatttttagtattccatttatttcttaccaaaaacatgacctcacttatgttactttttcattattaaagttattttattcttgctttccttggttttaagttacaattttaaaaggttacttacacctatgtgagtgtattatagaaatccatttaattagacacaaattagccaggcatggtrgctcacacctgtaatcccagcaccttgggaggccaaggcgggtggatcacaaggtcaggagatcgagaccatcctggctaacacggtgaaaccccgcctctactaaaaatataaaaaattagctaggcatggtggcacacgcctgtagtcccagttactcaggaggctgaggcaggtgaatcgcttgaacccatgaagcagaggttgcagtgagctgagatagcgccactgcactccagcctgggtgacagagcgagactccatctccaaaaaaaaaaaattatacacaaattaggtact

SEQ ID NO: 128998 - DNA, 601 bp, Human
cttatatggcaactagggaagccaaattcatagaaacaaaattacaacagcagttaccagggggaaatgggaaattgtaatgggtagagagtttcagctttgcaagatgaaaagaatcctggagactggttgcacaacaatgtgaatgtaattaacacactgaactgtacacttaaaaatggttaagatggtaaattttgtattttaccataatttttaaaaatacaggttaaaaaaaaaaaactggagtagataacatttaagacttcttccagctccacagtcttcaaattagcattarcaacaattacgtaatttatcattgtcatgatacaaggttcatgaacaaaattagaacaaaaaattatttatcccataaatattatccatactatttgcagtatgtacattataaacattaatctctatgatccaacaaatgagcctcagtgactaatatttactcaagctctctacagagattcactaaagtattacctaaatgttgaaaatcttatggtcaaatacaaaattcttcagattgaagattactactgatctctttccaaagctgtcatctccactatgaagaccattaact

SEQ ID NO: 128999 - DNA, 601 bp, Human
ggacatttcgctaactgaaataaacagatcacaaaaagacaaatacagtatgattctacttatatggcaactagggaagccaaattcatagaaacaaaattacaacagcagttaccagggggaaatgggaaattgtaatgggtagagagtttcagctttgcaagatgaaaagaatcctggagactggttgcacaacaatgtgaatgtaattaacacactgaactgtacacttaaaaatggttaagatggtaaattttgtattttaccataatttttaaaaatacaggttaaaaaaaaaaaactggagtagataacatttaagacttcttccagctccacagtcttcaaattagcattaacaacaattacgtaatttatcattgtcatgatacaaggttcatgaacaaaattagaacaaaaaattatttatcccataaatattatccatactatttgcagtatgtacattataaacattaatctctatgatccaacaaatgagcctcagtgactaatatttactcaagctctctacagagattcactaaagtattacctaaatgttgaaaatcttatggtcaaatacaaaattcttcagatt

SEQ ID NO: 129000 - DNA, 601 bp, Human
cacgaagtcaggagatcaagaccatcttggctcacacggtgaaatcccgtctctaataaaaatacaaaaacttagccaggagtggtggcatgcgcctgtagtcccagctactcgggaggctgaagcagaagaatcgcttgaacccgagaggcagaggttgcagtgagtcgagatggcaccactacactccagcctgggcgacagagtgagactctgtctcacacacacacgcgcgcacacacacacacacacacacacaaaccccacaactaccactttacatccattaggatggttactrtcaagaaaagagaaaataagtgttggtgagggtgtggagaaattggaacccttgcgctctgttggtggggatgtgaaatggtatagctgttatggaaaacagtatagcagctcctcaaaattttaaaaatagaattatcatatgatccagcaattccgcttctcagtatatactcaaaataattgaaagcagagcctaaaagagatatttgtacagcccattcatagcatcataattcccaatagtacagcttgttcatagcatcataattcacaagggcagggccaaaaggtggaagca

SEQ ID NO: 129001 - DNA, 601 bp, Human
acgcctgtaatcccagcactttgggaggcagaggcaggcagatcacgaagtcaggagatcaagaccatcttggctcacacggtgaaatcccgtctctaataaaaatacaaaaacttagccaggagtggtggcatgcgcctgtagtcccagctactcgggaggctgaagcagaagaatcgcttgaacccgagaggcagaggttgcagtgagtcgagatggcaccactacactccagcctgggcgacagagtgagactctgtctcacacacacacgcgcgcacacacacacacacacacacacaaaccccacaactaccactttacatccattaggatggttactgtcaagaaaagagaaaataagtgttggtgagggtgtggagaaattggaacccttgcgctctgttggtggggatgtgaaatggtatagctgttatggaaaacagtatagcagctcctcaaaattttaaaaatagaattatcatatgatccagcaattccgcttctcagtatatactcaaaataattgaaagcagagcctaaaagagatatttgtacagcccattcatagcatcataattcccaatagtacagcttgttc

SEQ ID NO: 129002 - DNA, 601 bp, Human
gcaacctctgccccccaggttcgagagattctcctgcctcaacctctgcctccagggttcgagtgattctcctgcctcagcctcccgagcagctgggagtacaggtgcccgccaccacacctagctaatttttgtgtttttagtagagatagggttttaccatgttggccaggctggtcttgaactcctgacctcaagtgatccgcccaacttggcatcccaaagtgctgggattacatgcatgagccactgtgcctggcctcacctcgtatcttatgtacttaacagttcttccattttytacttaaatctcttggaaaaaaggttgcaaacacaagaaaaaatggtaaactactatcttccatctttcattgttataatacaaaactaaaaataatatcaaaacaggtatttagtactagccaactattcgttgccatatctctatgtttgtatctctaagcttgaatactactccctatttttaggtgtgtcagtaggtatgggggaagactagcaaatattcatgaggctttatagatactctgcaccaaactgacctcactgactactccgagacagtgagagagaatggatgagg

SEQ ID NO: 129003 - DNA, 601 bp, Human
taagaaaaactgtattggataaagcccctttctgtctgattttcccaatatcctaccactatttccagggatcacctcccaaataaactacttgtacttaaatctttgtaccagagtctgcttctttagtacccaaactaacgcagtatatatgccatctccatgtagcacctgccatcttttttttctttctttctttctttctttttttttttttttgagatggagtctcgctctgtcacacaggctggagtgcggtggtgtgatcttggctcactgcaacctctgccccccaggttcragagattctcctgcctcaacctctgcctccagggttcgagtgattctcctgcctcagcctcccgagcagctgggagtacaggtgcccgccaccacacctagctaatttttgtgtttttagtagagatagggttttaccatgttggccaggctggtcttgaactcctgacctcaagtgatccgcccaacttggcatcccaaagtgctgggattacatgcatgagccactgtgcctggcctcacctcgtatcttatgtacttaacagttcttccattttctacttaaatctcttggaaaaaa

SEQ ID NO: 129004 - DNA, 601 bp, Human
ctccattgtgataattatccacagctgtatcttatataataagaaaaactgtattggataaagcccctttctgtctgattttcccaatatcctaccactatttccagggatcacctcccaaataaactacttgtacttaaatctttgtaccagagtctgcttctttagtacccaaactaacgcagtatatatgccatctccatgtagcacctgccatcttttttttctttctttctttctttctttttttttttttttgagatggagtctcgctctgtcacacaggctggagtgcggtggygtgatcttggctcactgcaacctctgccccccaggttcgagagattctcctgcctcaacctctgcctccagggttcgagtgattctcctgcctcagcctcccgagcagctgggagtacaggtgcccgccaccacacctagctaatttttgtgtttttagtagagatagggttttaccatgttggccaggctggtcttgaactcctgacctcaagtgatccgcccaacttggcatcccaaagtgctgggattacatgcatgagccactgtgcctggcctcacctcgtatcttatgtactta

SEQ ID NO: 129005 - DNA, 601 bp, Human
atgaatccttttttaaaaaaagcaaaatattattaaattatttaatatttgcaggaaagactaattaggagtaaagtcattcaatttattcactattgtatgtgtataactgcaagggaatattattagttgctatcaagggtaagttctctaaacaccagggttgcctgtttatcatttacagcggcttccattttcaaaaattcagatgtctctgttcatagtgctagcaatagcccttttttatttgccagtggagttaagataaagcaaaatgaatttagatactttaaaatcatgyaaccaattccatttctttagcagcacaattaattcttactctttaattttaatactttatattagagcaaagtacttaggattaaataagtgtttccgcttacgcagctctaaaatatattacaataactatcaaataattgatatagatatgctatgactttggggataatttcagtgatctgtataactaaaatcatttaaattactattcaaatgatgataattaataaattatgaagttttacatgtggccagaaatttaaattatataagacttcttttcattaattgtattatc

SEQ ID NO: 129006 - DNA, 601 bp, Human
tcagtcccttgcctactctgtggttcaaaacagtcttcaataaatttacaactctatcctttcaaatcttctatgaagtacatgatttttaaaaattattttttaaaaactattaattatatatatatataatctgtgaatcagaacagtgtttgtttctgggatcgagggatggggagggtagagattgggacgagccagaggaaagttttctagagtgataaaaatgccttaatttaagtgtgggttacacaatcacttctcaaaacataataaactgcataaattgatatctgtgcaytttactgtaaataaattatagctcactaaagattaaaagcaaaaaagtatacaaaatatttctcctttctccactatataaaatacatgcttatacaactgcaaattgagattaagtattttactttacaatgtccagataagtaattcaaattggtgcatgtgtctatgatgtggggtgtttcctctcagaaaactgaacagtaatgtattaagtttctcataatgacatatggccacaatagaatgacaaaatatctgtgggagtaatgaccaagaatgtaattaaaagcaaagactc

SEQ ID NO: 129007 - DNA, 601 bp, Human
tgatctgtcgcccaggctggagtgcggtggcgccatctcggctcactgcaagctccgccctcgggttcccgccattctcctgcctcagcctcccgagtagctgggactacaggcgcccgccactacgcccggctaatttttttttttttttttttgtatttttagtagagacggggtttccccgtgttagccaggatggtctcgatctcctgacctcgtgatccgcccgcctcggcctcccagagtgctgggattacaggcttgagccaccacgcccagcccagagcagtttttttaagaytgctggttaggatgtttcaaattattaaaaaaaaaaaaaaaattaaatgatccctagagcaagttatccaatgagtacacataggtaatatatagggttcaattcaatattaattatttatcctcagaaaactgaacaaaatacttattcaaaagtaagtagttttggaaattataatatatttttatgattcctttttccaaccatagtatcaatattcagtcccttgcctactctgtggttcaaaacagtcttcaataaatttacaactctatcctttcaaatcttctatgaagtaca

SEQ ID NO: 129008 - DNA, 601 bp, Human
tgaagatgtaagaaagctttgtaagcactgacaacaaatcagataattacttaaagaatacttttacactagcgaaagcaaatgatattttgaagccaagaacaaatgactaaagaaatggatcacaaattgctgatgactaatttggggctcaattaatgacgaattagatttacagagcagttgtttttttgtttttgttttgtttgtttgtttgtttgacacggagtcttgatctgtcgcccaggctggagtgcggtggcgccatctcggctcactgcaagctccgccctcgggttcmcgccattctcctgcctcagcctcccgagtagctgggactacaggcgcccgccactacgcccggctaatttttttttttttttttttgtatttttagtagagacggggtttccccgtgttagccaggatggtctcgatctcctgacctcgtgatccgcccgcctcggcctcccagagtgctgggattacaggcttgagccaccacgcccagcccagagcagtttttttaagactgctggttaggatgtttcaaattattaaaaaaaaaaaaaaaattaaatgatccctagagcaagttatc

SEQ ID NO: 129009 - DNA, 601 bp, Human
gccatgcccaattaatttttgtacttttagtagagacggggtttcaccatgttgggcaggatggtcttcatctcctgacctcatgatctgcgggcctcggcctcccaaagtgctgggattacaggcatgaaccactgcacccagcccattttcaattctctttaaaatcattctgttttttcaaggacaaggtctcagcatttaccatctataacaattactaatttcacttttttttttcaatttgaaagcagtcattttagtaattgactaggttacaaaaataatcatgggatacacyttagctcatccatttaacaagactgtttgtctggtcttccctattgccagcatctctaccttttacaaaatgggcggtctttttcttcattccaactcctgaagaagttaatttgaagggccacaggaagttatttgcttctttgaagtgctttccaactgtatagatctcatgaattaaatcctccaggcagatgatgccatatttggttgatgccaagatgtggcatatcttggttgatgccatccaggcagatgatgctcaaccaagagattgaccaatcaaaatgttatctgtcaa

SEQ ID NO: 129010 - DNA, 601 bp, Human
aaatgtatgcagcacatcaaaatatctaactacagaaaattaagtttggcaactctagagagaccataagaatatgtactttaaatgtattttctgctgtgaatacatagatacagattcatacttactcccggtgtctattgatattatgcatatttacaggagagttaaataaagatgtcggttctttcagggtatagaactggaaattacaagaatgaattatttgtttgcagccaaagcactatagtctaaatagcagaacttcttacttatacatgattattaaaccagtgctaayactattattaatagtgatatgcaataatatttcatttgatctttgcaaaaatcctaaggtgaagtaaaaatggtaggcatttttatctccattttataaatagtgacataagtacaaagatacaatgacaactcaaagacatggtgtcagctggcagtgattccagatcttctgactctaatcctagaattcctcccacaataccagtgtttccccaaatatgggaataatgatattggtagtacaaaggcaagacattaagtaacaataaatcatatactaaaaacttaactccatttt

SEQ ID NO: 129011 - DNA, 601 bp, Human
aataaatcatccctagatgcctaccatttatttctcccaaaatagactggcatcaaagagcagaagctacttggaagaagtaaagcaggtttcaaaggcgagagggggagtgtgtctgggagcaggaatgttactcaggaaagatttagtttagaataatttctcagcgacaaaacaggatagatattacataaaatacataaacctatttttgtgaatccaaaggaacatagcaaccattacttcttacaaagtgagtagcattttatcaggattataacactgtattaagcattatttyccttgggtcctagcagagcctaccaatgctaagattctactaaactaagtaataatttattgggaaaagcatttactaaataatactgtggtgaccagaaagagcaaatgagctaaagatgtcaagcttactgcagtattaggagagttctttgtaacaggaggctcctctagtctttctaataataaatgaaactacagaaacataaaatatcaataaatgtatgcagcacatcaaaatatctaactacagaaaattaagtttggcaactctagagagaccataagaatatgtacttta

SEQ ID NO: 129012 - DNA, 601 bp, Human
ttgagaagaataatatgaaggctaacatagcagtagggtcctggctctcttgaccttgtgaccatctgagaaaggaggaattaaatggaagtgaattagttcaataaatcatccctagatgcctaccatttatttctcccaaaatagactggcatcaaagagcagaagctacttggaagaagtaaagcaggtttcaaaggcgagagggggagtgtgtctgggagcaggaatgttactcaggaaagatttagtttagaataatttctcagcgacaaaacaggatagatattacataaaatayataaacctatttttgtgaatccaaaggaacatagcaaccattacttcttacaaagtgagtagcattttatcaggattataacactgtattaagcattatttcccttgggtcctagcagagcctaccaatgctaagattctactaaactaagtaataatttattgggaaaagcatttactaaataatactgtggtgaccagaaagagcaaatgagctaaagatgtcaagcttactgcagtattaggagagttctttgtaacaggaggctcctctagtctttctaataataaatgaaactac

SEQ ID NO: 129013 - DNA, 601 bp, Human
tttccaaagagaataaacaaatatttttcactactttaaaattaaaaaaaaacagtgaaatgggcaaaatgtgaactgaaaagagaagaacaaaggtggaattagcaggaataatctgcaatttcactaattaagtgttcaatgaattaaaatgacctgaccatatcaggtttaaaatgaccttgagttaatttttaaatggttacctagtacacatcagtatgttggcagcaatgaagtctgactgtaataacattctgtaccagaatttattctgtcaactgaagggaaaaaaaattaycccccaaatataaatatatgcatgatgtatttacattcataaacactagatgaattaaaaaacttaacactctcttactgatgcatatttaaatatatggaagcacctcatattactattcaaatattctattacaaatacatttgctaattttgtgtactttttttgtaatttgtattattttttaaaaaagtgaataccaaaacaaattatataccacaggaaaacgtgctagctcaacagaatcaattagtatattttgaggacaaatttatacaatatgttatttcggatgtgctt

SEQ ID NO: 129014 - DNA, 601 bp, Human
gagtgtcatactagaaaacactgaataaatctaatagaaagcaaaaataaaggaaataaaagaacagatgggacaaataaaaaacaaataacaagacactagaattaaatgcaaccatatcaataattacctggaatctacaagattcatatcctaattgtcagagtgggtaaaaatgggtgagatccaactatatgctatccaccaaaacacactttaaatatacagaaacaggttaaaaataaaaggatataaagagataaatcttgcaaatgccaattataagaaaaaatggactggytatattaatatcagtcaaagtagacttcaggacaaagaatattaccagagaaaaagagaaatatttcattaagaaaaatatcaagaaataataaatcctacatgtctttgctcctaaagacagagtttcagaagacatgaagcaaaaactgatataacggaaagaagaaaatttaaaaatccagttacaattggagacttcagcattcttttttccatagttgatacgcaaaaaagacagaaaatcattgagaatacagaaattatcaatcaacttaaccaaaatgactttcacgtcata

SEQ ID NO: 129015 - DNA, 601 bp, Human
atggcacatgtatacatatgtaactaacctgcacattgtgcacatgtaccctaaaacttaaagtataataatactaaaataaaataaaataaagaaatggggaggcttaatggcagctgaaatgtgggagcagagtattaaagaaggcattagagaaaacgacagcaacagacccaagagaatctctcatcattttctgaactgcacaagtgtaaggtgcagagatggtttaagatgtgattacccatagtggtaagactgtagtgaacacctagggcattctgtagatataccagaaggrgtaaagccttagtagtagggctgtactagctctagagtaaagacaactttaggctcatcctaatgaagctaaaaaacaagccttgacaatatctgaattacaagcagtgtaactgactacccaaaacaaaatgtaatatgtttaaaggaagacagcaaaatccagacttacaataccataagaatcataatgcctagcatataataaataacaaaattagacatataaagaagcagggaagtgtgacctgtaatcaggagaaaaatcaatcaatagaaacagaccttgaaatgatagaaa

SEQ ID NO: 129016 - DNA, 601 bp, Human
cctcattctaagaaaaaacaaagcattttatacacactgttctgaaccttgcttcttaaacttaacaatatagaataaatttgaagatcattcaagtatgaaatattatgacataaaataaaaaaggaatatattccttttgacttggaattatgaaaaattttcctcactacaacattcagaagtgataaaaatacttttaaataaaattgtaaacctgtttgcaaggataaaaatataataagcaaaaccgaagacaaatgagcatccaaaattttgagaaagattgataatcctattwaaaaaatgtgtagaaaatctagataaccttgggtttggtgatgcctttttagacataacaccaaaggtgtaattcatggaacaaataattcacaagctggatttcattaaatggaaaatttctactttgaaagacactgtgaagaaaatgaaaagacaagccacaaactggggaagaatatttgcaatactgatctgattaaggattgttatccaaaatttacaaagagctcttaaaactcaacaataagaaaataaacaagctgattttaaaagggccaaagaccttaatacagatgac

SEQ ID NO: 129017 - DNA, 601 bp, Human
cacttaaaataagtcatcagcttgatacgcagttaaattcatgtatttaattttctttttaattttaggatttgctgtatttaattttgatttaattttgttttatgattacatgaaatatctatgtggttccaaagccaaaactataaaacaggcaatatatttggacagatgaccctcctttcacccctgctgcttctatcttacttactgcccccacacccccaacaggtaaccattttcactatgtttaggtttatcctttcattgcctttctttttctctatatctttttagacawacgtgcaaatgtatatgaatgtgtatagaagtgcccacgtgtgaatacatacacacctcattctaagaaaaaacaaagcattttatacacactgttctgaaccttgcttcttaaacttaacaatatagaataaatttgaagatcattcaagtatgaaatattatgacataaaataaaaaaggaatatattccttttgacttggaattatgaaaaattttcctcactacaacattcagaagtgataaaaatacttttaaataaaattgtaaacctgtttgcaaggataaaaatataataag

SEQ ID NO: 129018 - DNA, 601 bp, Human
tattctttcttcatttattagcaaaatccttctataaagaataaattcctctcattaattatttagttactttgaaataaagtttttatgggaaaaataggataagtacatgattctttttatattacagtactgaaaatgactttatcccccagtaccctccagaggtgatcggtgtggttttttattttgtttttgtttgtatccttacgattctcagcttttgaacatatttaatgattttcaatcctagcaatctttttttcttgctaaaattgtcccattgttggccaatggtagyctcttctaactagttcctatgacataaccccaccatctttcttaactctgctactttctgttataacaagatgcttcaggcttatgtcatatttcctactcaagatctggaatcagacatttcttcaaaaaagccctggctcttcttagtggaaaatggaattcaaagactacaattgggacccattaatgcttgctgctaggatgctattcatatttctaggtcttttcattgaaccaagctagaaatacacatattttttgaaggataaaaatacatatcataaattcatagtaattt

SEQ ID NO: 129019 - DNA, 601 bp, Human
atcttggagaatttctggcatctagactgataaacagcatcctgaaatgtcatttaataagttcctctatttcatgtatgctgtataaactggtatatgttggggcttgaacaagttcaattttttaaaagttgtgtacttagtattgtaccatatcagttgacatataacaactggctgtccctctgcaatgttaagtttcactagtggagtcatatgttgccacctgggtctatctattaatagtatcctgctccctatccacgtttcgcctgaggatattagtagccattgatgatcrtttcctacagatattatgttaaataataaaggttgtaaacttgcggtagtctaattctattattctttcttcatttattagcaaaatccttctataaagaataaattcctctcattaattatttagttactttgaaataaagtttttatgggaaaaataggataagtacatgattctttttatattacagtactgaaaatgactttatcccccagtaccctccagaggtgatcggtgtggttttttattttgtttttgtttgtatccttacgattctcagcttttgaacatatttaatga

SEQ ID NO: 129020 - DNA, 601 bp, Human
tgaataaaaacaaaaaaagtcctgcctccatggaacttataggttgacatcacggaaataaatgaaatcactcaaggaaagagtagatgtagtaagaataaagacagcagaggttatcatcctggagtataccaacactgatgggaggtgggcagaagagtcagtgagagaacctgaattcattttaagttaaccgaggaagccaacaggttgcaaacaaaaaacccaatttggaaacaatccttgcgacttacaataattcttagttcctttatttataacaacattctgcatcttattscaaagtagccaagaagcccaaataaaataaatttacaaatttatattattgttgatgcaaaagagataagctggtttcgggcagggggcaggtttagataggaaagtaacatttattatcagacatttttatgtggaatatctcattctgaaaatgttcaaaaatcccaaactcctaatatactagttttatattcatttacatgcaaatacatcacataaaaattgacctcgtataataaaacaaaaagcatagagtttagaagctatcattaaaatacagatatcactaacaaggggt

SEQ ID NO: 129021 - DNA, 601 bp, Human
atttaagtacattggtcacaattataaaacgaatacaaaattaaccagaattctgtttttagttataataataatagataacaacaactgaactcacatgtcatgcacacttctggtgttgagttattacagtagtgaataaaaacaaaaaaagtcctgcctccatggaacttataggttgacatcacggaaataaatgaaatcactcaaggaaagagtagatgtagtaagaataaagacagcagaggttatcatcctggagtataccaacactgatgggaggtgggcagaagagtcagtkagagaacctgaattcattttaagttaaccgaggaagccaacaggttgcaaacaaaaaacccaatttggaaacaatccttgcgacttacaataattcttagttcctttatttataacaacattctgcatcttattgcaaagtagccaagaagcccaaataaaataaatttacaaatttatattattgttgatgcaaaagagataagctggtttcgggcagggggcaggtttagataggaaagtaacatttattatcagacatttttatgtggaatatctcattctgaaaatgttcaaaaat

SEQ ID NO: 129022 - DNA, 601 bp, Human
caaatatagtaagaaaagaaagaagccagagtcaatgaaaagcttccagttttgtatcatctattattgtaccaggctctgtattaggtactttaaatatatttccttgtatccttgcaaaaacccaataagagtgaaattattctccttccccttccatggtaacaataacaaaaagctcagaatatttaagtacattggtcacaattataaaacgaatacaaaattaaccagaattctgtttttagttataataataatagataacaacaactgaactcacatgtcatgcacacttctsgtgttgagttattacagtagtgaataaaaacaaaaaaagtcctgcctccatggaacttataggttgacatcacggaaataaatgaaatcactcaaggaaagagtagatgtagtaagaataaagacagcagaggttatcatcctggagtataccaacactgatgggaggtgggcagaagagtcagtgagagaacctgaattcattttaagttaaccgaggaagccaacaggttgcaaacaaaaaacccaatttggaaacaatccttgcgacttacaataattcttagttcctttatttata

SEQ ID NO: 129023 - DNA, 601 bp, Human
ggaaaaatgcacaaaattggttatgcctagaaggtagaaaataaggcggaggtaggaatgcggagaatgccagtgtggaaagttagattttattttataggtaatggaggtagtgttaggcagtagtgatgtgggtagattcagtgaccaaatatagtaagaaaagaaagaagccagagtcaatgaaaagcttccagttttgtatcatctattattgtaccaggctctgtattaggtactttaaatatatttccttgtatccttgcaaaaacccaataagagtgaaattattctccttccmcttccatggtaacaataacaaaaagctcagaatatttaagtacattggtcacaattataaaacgaatacaaaattaaccagaattctgtttttagttataataataatagataacaacaactgaactcacatgtcatgcacacttctggtgttgagttattacagtagtgaataaaaacaaaaaaagtcctgcctccatggaacttataggttgacatcacggaaataaatgaaatcactcaaggaaagagtagatgtagtaagaataaagacagcagaggttatcatcctggagtatac

SEQ ID NO: 129024 - DNA, 601 bp, Human
attcacagtacaatgctgtaagtaaaagtcaggggataatgttgccctttataagggaaggataagctaactgcagagaaggagagtcagggtccatgtcacaaagaagggagtgacatgtctgtctataaagatcacactagactgggtttagggagactgggaggaaaggagagaagacagagaatgctatttcagcagagaaaacggcatgtccaaaaacatagaagtatgaaaggggaatatttggggaaaaatgcacaaaattggttatgcctagaaggtagaaaataaggcggargtaggaatgcggagaatgccagtgtggaaagttagattttattttataggtaatggaggtagtgttaggcagtagtgatgtgggtagattcagtgaccaaatatagtaagaaaagaaagaagccagagtcaatgaaaagcttccagttttgtatcatctattattgtaccaggctctgtattaggtactttaaatatatttccttgtatccttgcaaaaacccaataagagtgaaattattctccttccccttccatggtaacaataacaaaaagctcagaatatttaagtacattggtc

SEQ ID NO: 129025 - DNA, 601 bp, Human
tatgagaagttatgtactggagttgagaaatctataatctaaacaggaagactactagaacagatatccatacaatgcatacttttgcattttaaaacactgattatctctaaagagtgggcaagtttcaaagagtggtttatataagaaaatcctttaaaataaagatttcttaatttgaccataatacagcatgatgtctctgtttccacttcgactagcatgatgtaggagcgagtgggggaagtatgagtcaaaaaagagtgggggaagaaaaaaatcattttattttaaaaaaaamcttcttagctacaccaagaaatttccattgaaatgaactctctctacatggtatgcaatgtttccaagcaggtttaatcatagtattctaattgattaaatatcataagtagtaagaatttatagaaataaagatgatgatcaagcctttgggaaatcttggaaaaactactgcaaggaaatacacaaatgatgtagcatgggttcctacagaagcaaggataaaataaacaggggcaaaagtaattaaattaccttctcccttgagcaaaaaggtactctattccaacacacagtgctg

SEQ ID NO: 129026 - DNA, 601 bp, Human
acacagtgtttcactgcttgtgtaaccacagaactcttaagggactaatgtacaatggatcatggtatgagaagttatgtactggagttgagaaatctataatctaaacaggaagactactagaacagatatccatacaatgcatacttttgcattttaaaacactgattatctctaaagagtgggcaagtttcaaagagtggtttatataagaaaatcctttaaaataaagatttcttaatttgaccataatacagcatgatgtctctgtttccacttcgactagcatgatgtaggagcsagtgggggaagtatgagtcaaaaaagagtgggggaagaaaaaaatcattttattttaaaaaaaaacttcttagctacaccaagaaatttccattgaaatgaactctctctacatggtatgcaatgtttccaagcaggtttaatcatagtattctaattgattaaatatcataagtagtaagaatttatagaaataaagatgatgatcaagcctttgggaaatcttggaaaaactactgcaaggaaatacacaaatgatgtagcatgggttcctacagaagcaaggataaaataaacaggg

SEQ ID NO: 129027 - DNA, 601 bp, Human
agcacctctgcatctcaattacagaattccatgtaaccatttctcttaaggagacagcatttgaataataagaagaaagcataatttcacctgcaaatatcgaaatttcacattccacttatagaggaagaaaagagattgagagattgaagaaatattccttttaaggttccttattaatcttttaaagtgtatgggaaaataattagatgacttcaaaaatgcattaatacatgattttcaagagatgactataggtatagtactttaaaaatggattttaaattattcaatgtcaatrtatattagtgtaccatttcccaaagcataacatgtgattttattagatattactcaggtacaagtattctctggttctatgcatttctataggacttttcagagcttttaaaagggtaacaggaattgagggttctcaagagaaactgaatcacacagtgtttcactgcttgtgtaaccacagaactcttaagggactaatgtacaatggatcatggtatgagaagttatgtactggagttgagaaatctataatctaaacaggaagactactagaacagatatccatacaatgcatact

SEQ ID NO: 129028 - DNA, 601 bp, Human
agagagaacagggtgcccttccatggtcttttccacataagggcagtcctctctccaaaagaaatttctatgtaaccagacatatacaattactgaaatctaaatggcaagtggattcacaaatcaactcctataccagtcagaatgtgtacatacgtagaagcataaatgaagaaagcacctctgcatctcaattacagaattccatgtaaccatttctcttaaggagacagcatttgaataataagaagaaagcataatttcacctgcaaatatcgaaatttcacattccacttatagrggaagaaaagagattgagagattgaagaaatattccttttaaggttccttattaatcttttaaagtgtatgggaaaataattagatgacttcaaaaatgcattaatacatgattttcaagagatgactataggtatagtactttaaaaatggattttaaattattcaatgtcaatatatattagtgtaccatttcccaaagcataacatgtgattttattagatattactcaggtacaagtattctctggttctatgcatttctataggacttttcagagcttttaaaagggtaacagga

SEQ ID NO: 129029 - DNA, 601 bp, Human
tagacagagaacaggatgcaaacaaaccaggtccccgcccacatgaagcttacattctagtgggggagagacaagtgatcagttaagaatgaaataaaaatgaaataaaagaggatacaaacaaatggaagaacattccatgctcatgggtaggaagaatcaatatcgtgaaaatggccatactgcccaaggtaatttatagattcaatgccatcaccatcaagctaccgatgactttcttcacagaattggaaaaaactactttaaagttcatatggaaccaaaaaagagcccacattgscaagtcaatcctaagccaaaagaacaaagctggaggcatcacactacctgacttcaaactatactacaaggctacagtaaccaaaacagcatggtactggcaccaaaacaaagatatagaccaacggaacagaacagagccctcagaaataatgccgcatatctacaaccatctgatctttgacaaacctggcaaaaacaagcaatggggaaaggattccctatttaataaatggtgctgggaaaaccggctagccatatgtagaaagctgaaactggatcccttccttacaccttatgc

SEQ ID NO: 129030 - DNA, 601 bp, Human
acaagaaaaaccgagtaaccacacacatgtacgttaagtctcgaaagtttttcaccagaggaaaaaacacaacaaaacaaataagaaagctgtgtgaatgccacatcagcatctcaattcagtttcattcattttttccctgtgtacttaaagccaccaagtagtcagctcctgtctcactgatcattcaatgctaatctttaattcattcaacaaatatagattgagcacctatcatgggccactgttccaggtattagacagagaacaggatgcaaacaaaccaggtccccgcccacakgaagcttacattctagtgggggagagacaagtgatcagttaagaatgaaataaaaatgaaataaaagaggatacaaacaaatggaagaacattccatgctcatgggtaggaagaatcaatatcgtgaaaatggccatactgcccaaggtaatttatagattcaatgccatcaccatcaagctaccgatgactttcttcacagaattggaaaaaactactttaaagttcatatggaaccaaaaaagagcccacattggcaagtcaatcctaagccaaaagaacaaagctggaggcatcaca

SEQ ID NO: 129031 - DNA, 601 bp, Human
caccactgcactccagcctgggcgacagagcaagactccaactcaaaaataaaataaaataattcttttagcctacttgagtttaaaaaaaaaaccccaaagtctactgttataaaaaggaattttatattctgtggccgttgctcatgataacattaccaaaatttccagtgctataatggtttttgaagcataccaaaaagatatacatagtcagtacatatatgagtcacttgccctgacaacagaggtcagggaaataaatatggactgaaatcaattttagcagaaatggcattayaaaagatttgatttgaagtcaccgataaaaatttataaacaagaaaaaccgagtaaccacacacatgtacgttaagtctcgaaagtttttcaccagaggaaaaaacacaacaaaacaaataagaaagctgtgtgaatgccacatcagcatctcaattcagtttcattcattttttccctgtgtacttaaagccaccaagtagtcagctcctgtctcactgatcattcaatgctaatctttaattcattcaacaaatatagattgagcacctatcatgggccactgttccaggtattagac

SEQ ID NO: 129032 - DNA, 601 bp, Human
atactggaatcatttataccatcctatgattattttgtaaggatcggcacatctttacttagcatttaaattctttatttctgtatggtagaacagtggttctcacatttttaatgtgcatcagaatcacccggagtgcctgttgcaacacagagagctaggtcccacccctaaagttcttaattctgtagaactggagtgggcaccaaaagctggcatttctaacaagttctcagttgatgtgaatgctgctagcctggggaatacactttgggaaccattgtactagttgatactacarttatgaaacctgattttcacaggaacgaaagggaaaaagtgttttaaaatttattctaggccaggcacggtggctcacgcctgtaatctcaacactttgggaggccaagacaggcagatcacaaggtcaggagttcgagaccaccgtggccaatatgaagaaaccctgtctctactaaaaaatacaaaaattagccgggcgtggtggcgtgtggctgcagtcccagctactcaggaggctgaggcaggagaattgcttgaacctggaaggcagaggttgcagtgagccgagatcgcacca

SEQ ID NO: 129033 - DNA, 601 bp, Human
aatctgtgcctggaccgcatgcactacttatttacttatatgagtttcaaaacagatattctcaagactgaatatccgaatattcatcagactgaaggcagaggatacaccagaaagatgacatgtctattttgtggaagacaccaaaaggaaaacagtacttcagaaaggaattcaagtgacctgatattaaacctccccttactacataagaataaaaaagaataggttaaatataaagtaataaacactaaagaatatcactaataaaacatttgctttcacttatattcaaaagacwtacttatttcttctaacttcatctgctataacaaaaagtaaaaaacaaaaagcatttattcagccattgctacagctactggggaggaaatgcaagaataaatgttaaaagtcagtaatacttcttgtaataacttactgagttttctccttcatgtgtagtattttcattactatgtatgttgacaatgtacagcatactggaatcatttataccatcctatgattattttgtaaggatcggcacatctttacttagcatttaaattctttatttctgtatggtagaacagtggttctc

SEQ ID NO: 129034 - DNA, 601 bp, Human
tttcaaattatggagtttttacatgggccaccaataccctgcaaagaagtagctacattatttggaatcttcaacaaagtgcatatatatatgtaaaatctgtgcctggaccgcatgcactacttatttacttatatgagtttcaaaacagatattctcaagactgaatatccgaatattcatcagactgaaggcagaggatacaccagaaagatgacatgtctattttgtggaagacaccaaaaggaaaacagtacttcagaaaggaattcaagtgacctgatattaaacctccccttaytacataagaataaaaaagaataggttaaatataaagtaataaacactaaagaatatcactaataaaacatttgctttcacttatattcaaaagacatacttatttcttctaacttcatctgctataacaaaaagtaaaaaacaaaaagcatttattcagccattgctacagctactggggaggaaatgcaagaataaatgttaaaagtcagtaatacttcttgtaataacttactgagttttctccttcatgtgtagtattttcattactatgtatgttgacaatgtacagcatactgga

SEQ ID NO: 129035 - DNA, 601 bp, Human
gtctggctgctgcctgacatcacttgtgcctgcctgtttccagcttgattctccagacttcctggaaattctgtgagtcacaaacatctttcaataaattctttgtcttaaataggccagagttggtttctgttgcttgaaaccaagaacctctgccttaaacagtttcaaattatggagtttttacatgggccaccaataccctgcaaagaagtagctacattatttggaatcttcaacaaagtgcatatatatatgtaaaatctgtgcctggaccgcatgcactacttatttacttatwtgagtttcaaaacagatattctcaagactgaatatccgaatattcatcagactgaaggcagaggatacaccagaaagatgacatgtctattttgtggaagacaccaaaaggaaaacagtacttcagaaaggaattcaagtgacctgatattaaacctccccttactacataagaataaaaaagaataggttaaatataaagtaataaacactaaagaatatcactaataaaacatttgctttcacttatattcaaaagacatacttatttcttctaacttcatctgctataacaaaaagt

SEQ ID NO: 129036 - DNA, 601 bp, Human
attgaactagactgaggaaataactaaaggcagccagaatgagcaactttttaatatcttagaaaagtttgagagcacaagaggtgcatttggaaaccagggacaaatatttttaagccaggtactggcttttccaacctcccttacaaacaagctaaaggaaatcaacttaggactcaaataaccaggtggacttgctctaaacaaggagctaggggcacaaagcaatggaaatggtgacacactgtaagagacatgtcatgtttacagtggcagtagggccaggacacaagatcagtayccaggggtagcaatggcagacagtctttgggatggctgcagtggtgtggtgtctgtactgcactatctctgtgctacggttttgtgcatggtctggctgctgcctgacatcacttgtgcctgcctgtttccagcttgattctccagacttcctggaaattctgtgagtcacaaacatctttcaataaattctttgtcttaaataggccagagttggtttctgttgcttgaaaccaagaacctctgccttaaacagtttcaaattatggagtttttacatgggccaccaataccctgcaaa

SEQ ID NO: 129037 - DNA, 601 bp, Human
tgggttgagtaatacaggctgattataatatccttagctgggccaggcgcggtggttcatgcccataatcccagcactttgggaggctgagatgggtggatcacctgaggtcaggagttcgagaccagcctggcaaacacggtgaaatttgtctttactaaaaaaatacaaaaaattagccaggcatggtggcacgcacctgtaatcccagctactgaagctgaggcaggagaatcgcttgaacctgggaggtggaggttgcagtgagccgaggtcacaccactgcactccagcctgggcracagagcgaaactccatctcaaaaaataataataataaaataataataataatattcttagccattgtcccttaaaggtaagaaggcaagcatgaacccacttgttcgagtccctggagccaaagccagagtcatgcacaagtaacaggtaactcctaaaggttttttccatgtctaaatactttaagctcctgaataaatacttaaaaatttattttaaaaaagaagcaccaacggcaaaaataaacagttcttttttaggtactagaaatagactctctaattctgatatctcagatc

SEQ ID NO: 129038 - DNA, 601 bp, Human
caaaaatacacttgcagttggaaatgggggagactttcaaacactgggttgagtaatacaggctgattataatatccttagctgggccaggcgcggtggttcatgcccataatcccagcactttgggaggctgagatgggtggatcacctgaggtcaggagttcgagaccagcctggcaaacacggtgaaatttgtctttactaaaaaaatacaaaaaattagccaggcatggtggcacgcacctgtaatcccagctactgaagctgaggcaggagaatcgcttgaacctgggaggtggasgttgcagtgagccgaggtcacaccactgcactccagcctgggcaacagagcgaaactccatctcaaaaaataataataataaaataataataataatattcttagccattgtcccttaaaggtaagaaggcaagcatgaacccacttgttcgagtccctggagccaaagccagagtcatgcacaagtaacaggtaactcctaaaggttttttccatgtctaaatactttaagctcctgaataaatacttaaaaatttattttaaaaaagaagcaccaacggcaaaaataaacagttcttt

SEQ ID NO: 129039 - DNA, 601 bp, Human
gagtagcaatttttagggagaaaaagcacagaattatattaaggaatgaagtgtgataaattgtctgaatttggctttgacaaaaatacacttgcagttggaaatgggggagactttcaaacactgggttgagtaatacaggctgattataatatccttagctgggccaggcgcggtggttcatgcccataatcccagcactttgggaggctgagatgggtggatcacctgaggtcaggagttcgagaccagcctggcaaacacggtgaaatttgtctttactaaaaaaatacaaaaaatyagccaggcatggtggcacgcacctgtaatcccagctactgaagctgaggcaggagaatcgcttgaacctgggaggtggaggttgcagtgagccgaggtcacaccactgcactccagcctgggcaacagagcgaaactccatctcaaaaaataataataataaaataataataataatattcttagccattgtcccttaaaggtaagaaggcaagcatgaacccacttgttcgagtccctggagccaaagccagagtcatgcacaagtaacaggtaactcctaaaggttttttccatgtct

SEQ ID NO: 129040 - DNA, 601 bp, Human
tggagaagccttggctactctataaacacacactggggtaaagagtagcaatttttagggagaaaaagcacagaattatattaaggaatgaagtgtgataaattgtctgaatttggctttgacaaaaatacacttgcagttggaaatgggggagactttcaaacactgggttgagtaatacaggctgattataatatccttagctgggccaggcgcggtggttcatgcccataatcccagcactttgggaggctgagatgggtggatcacctgaggtcaggagttcgagaccagcctggcmaacacggtgaaatttgtctttactaaaaaaatacaaaaaattagccaggcatggtggcacgcacctgtaatcccagctactgaagctgaggcaggagaatcgcttgaacctgggaggtggaggttgcagtgagccgaggtcacaccactgcactccagcctgggcaacagagcgaaactccatctcaaaaaataataataataaaataataataataatattcttagccattgtcccttaaaggtaagaaggcaagcatgaacccacttgttcgagtccctggagccaaagccagagtca

SEQ ID NO: 129041 - DNA, 601 bp, Human
cagtaaagaacagtaatgcaaaaaaatgcatcacagatatatgaaatatctatatagccctcaaagtcagttcataagctaaaaaatgaccaaagaagaggagaagggataaagtcactaaagagtgtgcctaatccataaactatccccatcactccatcgtgcgactgtggagaagccttggctactctataaacacacactggggtaaagagtagcaatttttagggagaaaaagcacagaattatattaaggaatgaagtgtgataaattgtctgaatttggctttgacaaaaatayacttgcagttggaaatgggggagactttcaaacactgggttgagtaatacaggctgattataatatccttagctgggccaggcgcggtggttcatgcccataatcccagcactttgggaggctgagatgggtggatcacctgaggtcaggagttcgagaccagcctggcaaacacggtgaaatttgtctttactaaaaaaatacaaaaaattagccaggcatggtggcacgcacctgtaatcccagctactgaagctgaggcaggagaatcgcttgaacctgggaggtggaggttgcagt

SEQ ID NO: 129042 - DNA, 601 bp, Human
tcagaagatacttaccacttcggattggaattttagatgttctatgatcgtggaagttgctacctcatcataagaaaaacatcccaagggatcactgcagcttttgggcctgccctctttgtatcattatactcagtaaagaacagtaatgcaaaaaaatgcatcacagatatatgaaatatctatatagccctcaaagtcagttcataagctaaaaaatgaccaaagaagaggagaagggataaagtcactaaagagtgtgcctaatccataaactatccccatcactccatcgtgcgastgtggagaagccttggctactctataaacacacactggggtaaagagtagcaatttttagggagaaaaagcacagaattatattaaggaatgaagtgtgataaattgtctgaatttggctttgacaaaaatacacttgcagttggaaatgggggagactttcaaacactgggttgagtaatacaggctgattataatatccttagctgggccaggcgcggtggttcatgcccataatcccagcactttgggaggctgagatgggtggatcacctgaggtcaggagttcgagaccagcctg

SEQ ID NO: 129043 - DNA, 601 bp, Human
gggccatttcagaagatacttaccacttcggattggaattttagatgttctatgatcgtggaagttgctacctcatcataagaaaaacatcccaagggatcactgcagcttttgggcctgccctctttgtatcattatactcagtaaagaacagtaatgcaaaaaaatgcatcacagatatatgaaatatctatatagccctcaaagtcagttcataagctaaaaaatgaccaaagaagaggagaagggataaagtcactaaagagtgtgcctaatccataaactatccccatcactccawcgtgcgactgtggagaagccttggctactctataaacacacactggggtaaagagtagcaatttttagggagaaaaagcacagaattatattaaggaatgaagtgtgataaattgtctgaatttggctttgacaaaaatacacttgcagttggaaatgggggagactttcaaacactgggttgagtaatacaggctgattataatatccttagctgggccaggcgcggtggttcatgcccataatcccagcactttgggaggctgagatgggtggatcacctgaggtcaggagttcgaga

SEQ ID NO: 129044 - DNA, 601 bp, Human
gattggttgaattacttagtctaaagcacagagctgatgaatcatggatctggaatctacacttaatgtatattctcaaccattatgtcaaaaaaaaagaacataactttttatatctgtcaatgatatatgttaacaactactaaggaacagcttaacaagtggaatagggaccatatgaacttcctgttgctatttgagatttccttacagcttactttactgttttctagcactacactattctccattattacccagaatgaggcctgtagatgatgtacttgcaattgtaaagaaaccatggaaaaggcagggccatttcagaagatacttaccacttcggattggaattttagatgttctatgatcgtggaagttgctacctcatcataagaaaaacatcccaagggatcactgcagcttttgggcctgccctctttgtatcattatactcagtaaagaacagtaatgcaaaaaaatgcatcacagatatatgaaatatctatatagccctcaaagtcagttcataagctaaaaaatgaccaaagaagaggagaagggataaagtcactaaagagtgtgcctaatccataaacta

SEQ ID NO: 129045 - DNA, 601 bp, Human
ttttttttttccagatagaaaaatgtcacttaaaatacacgtaccattcttctcatcactgctatatttcccaactggaaatctcatttgtttctttatttatatgtttatttaataaaataaaacagccatgttggtttcaaatttagataaaatgagaaatgaggtcattttaatttttgtctaccgaatatgacagtggccccacttaactgtgcttaaaatagcacaatctaatgttgatatttaagtatagtcaaataagctgtacaaatagatatagaacaataaatactttgasagatgcgggacatggtgccccctttccttttcatcatccaagcaggatgattcaggatgccccctactagtaagtagatttctcaaataaaacataataatagctaaatatagctaatatttactgaccatttactatgcagcagacactattctatgtgctttttaggcattagctcattaaattttcataaactccatgaggtaggtgctgttatattaataattcctatttcgcatacaaggtgaataactgaagtttggattggttgaattacttagtctaaagcacagagctgat

SEQ ID NO: 129046 - DNA, 601 bp, Human
acgtaatagccagtttcataaatttctgtatcacaaatcttttattttgttaaaacatgagaaattatgctaaactactccaagatttttgattaatttaaaacaaatacttttaatccattataaattatacttgtaatttacaatatatattttagtaaagtaataagagtgttctgaaagtattccacactgggtaaagagccctttccagaaagagccacagcaaatccaggtaaaaagtttagtctggggtgatgatagaaacaaattcatagaaaatgtttttttttttttttttccagatagaaaaatgtcacttaaaatacacgtaccattcttctcatcactgctatatttcccaactggaaatctcatttgtttctttatttatatgtttatttaataaaataaaacagccatgttggtttcaaatttagataaaatgagaaatgaggtcattttaatttttgtctaccgaatatgacagtggccccacttaactgtgcttaaaatagcacaatctaatgttgatatttaagtatagtcaaataagctgtacaaatagatatagaacaataaatactttgagagatgcggg

SEQ ID NO: 129047 - DNA, 601 bp, Human
aaaagtatggtagacgtaatagccagtttcataaatttctgtatcacaaatcttttattttgttaaaacatgagaaattatgctaaactactccaagatttttgattaatttaaaacaaatacttttaatccattataaattatacttgtaatttacaatatatattttagtaaagtaataagagtgttctgaaagtattccacactgggtaaagagccctttccagaaagagccacagcaaatccaggtaaaaagtttagtctggggtgatgatagaaacaaattcatagaaaatgtttgtttttttttttttccagatagaaaaatgtcacttaaaatacacgtaccattcttctcatcactgctatatttcccaactggaaatctcatttgtttctttatttatatgtttatttaataaaataaaacagccatgttggtttcaaatttagataaaatgagaaatgaggtcattttaatttttgtctaccgaatatgacagtggccccacttaactgtgcttaaaatagcacaatctaatgttgatatttaagtatagtcaaataagctgtacaaatagatatagaacaataaatactt

SEQ ID NO: 129048 - DNA, 601 bp, Human
ttgaaccatgagaaagcaaagatgtcactatcttatgttgctgctcaaaaactttcaaattttggagcatttcagattttggattttgcattagggatgatcaacctgtaattgccttctaatggattttcccttctctaatcagttgctcttgcaatctatctccaactttgctgccaggagaattttctgtaacgcagatataaaaataaaaccgcttaaaaacctttccatgattctctcttgccttcagaaaaagttcaaaactcttgtccactttacaaaaatcatcagggggtcrtgcctacataatctcgagacttggtattagccatgttatcaaatgctctcttcactcacatcatattgaccatttttctggtcctgacaaagtgccattttctcttgcctttctgcttcactacataaggattcctctgcctgaaaggccctttcattttattccacctccctgcctttgtcctaatcattcttaagctctcaacggaagcaccttatctcaaaattattttctgcatcctttgccctctatggccactcctcacaggactgttatgttttatgttctgtactttcccaa

SEQ ID NO: 129049 - DNA, 601 bp, Human
tacacatagcgtgaaggtaattttataaaatattttaaataattttgtgcatgacaccaagttagtatatattgaaccatgagaaagcaaagatgtcactatcttatgttgctgctcaaaaactttcaaattttggagcatttcagattttggattttgcattagggatgatcaacctgtaattgccttctaatggattttcccttctctaatcagttgctcttgcaatctatctccaactttgctgccaggagaattttctgtaacgcagatataaaaataaaaccgcttaaaaaccttyccatgattctctcttgccttcagaaaaagttcaaaactcttgtccactttacaaaaatcatcagggggtcgtgcctacataatctcgagacttggtattagccatgttatcaaatgctctcttcactcacatcatattgaccatttttctggtcctgacaaagtgccattttctcttgcctttctgcttcactacataaggattcctctgcctgaaaggccctttcattttattccacctccctgcctttgtcctaatcattcttaagctctcaacggaagcaccttatctcaaaattat

SEQ ID NO: 129050 - DNA, 601 bp, Human
agcaccaccatcctcagctttggaaattattgcttactcttccctctgactgacatgagttgctgagtcctgtcaatgttatcttctaaataattttccaattctcttttccattatcatacacactaccttaattcataatgttctctattatacaggctgagaataccttatcaacaatgcttgggaccacaagtgttttggattttggattttttcagattttggaatattttcatatataaaatgagagatcttggggataggacccatatctaaatatgaaattcaattatgtttyatatacaccttatacacatagcgtgaaggtaattttataaaatattttaaataattttgtgcatgacaccaagttagtatatattgaaccatgagaaagcaaagatgtcactatcttatgttgctgctcaaaaactttcaaattttggagcatttcagattttggattttgcattagggatgatcaacctgtaattgccttctaatggattttcccttctctaatcagttgctcttgcaatctatctccaactttgctgccaggagaattttctgtaacgcagatataaaaataaaaccg

SEQ ID NO: 129051 - DNA, 601 bp, Human
cacacttccgcttctcagtagagggcagcaccaccatcctcagctttggaaattattgcttactcttccctctgactgacatgagttgctgagtcctgtcaatgttatcttctaaataattttccaattctcttttccattatcatacacactaccttaattcataatgttctctattatacaggctgagaataccttatcaacaatgcttgggaccacaagtgttttggattttggattttttcagattttggaatattttcatatataaaatgagagatcttggggataggacccatawctaaatatgaaattcaattatgtttcatatacaccttatacacatagcgtgaaggtaattttataaaatattttaaataattttgtgcatgacaccaagttagtatatattgaaccatgagaaagcaaagatgtcactatcttatgttgctgctcaaaaactttcaaattttggagcatttcagattttggattttgcattagggatgatcaacctgtaattgccttctaatggattttcccttctctaatcagttgctcttgcaatctatctccaactttgctgccaggagaattttct

SEQ ID NO: 129052 - DNA, 601 bp, Human
ctacttagctaatactcagactacttaacattcctgggtgacatccaataaacctccatgactaaaggagctatcatggatctctttcttacctccataaggatcttaagcaaatagtttactcaccctggaccctaagtccctccccatatctctctttcccttcacacttaagctcctcctttataagatgactattctaactcttcatgtcctcactttccactttccaacaactacagtcaagcttctgcccttagcctttcattagaactgcttttaataaggtcacttgtgaccrcagctaaataccaagctaaaagactcctgtcagtccttatctcttgtgacctatctatagtatgacactgttggccactccatgttacccttccctcccttttctgttctgattaagcttatttgattcatctatttttattttcaattgactataacttcaattttaagaggatctttttaactttttattttaaaatactaagttctcaagaagttataatatatatagaacaggttttaaacattcaaatacaaaattgaaattcccagttcttttgctattatcttcaacgccacc

SEQ ID NO: 129053 - DNA, 601 bp, Human
acaaatatttttcatctgaatcacctatagtaatgctttctaaagtatctctctggtggaatgcaacacgaatttacatatggcacatgggtaaacatttttaactttactatttaaatattgatttcaatatgtattaggaaaaaattacacacgattttctattttaaaagtgagtcaacttggaaaacatattaagttaataataatacaggtggcatgagaaaatggcaaaacttacatgtctaaggtttgggatgctggcttacataatataacttctctgggcatgagctagcayaaatattattgttgaaagatgtgaaaattccaagctaaattatattttattctctgtattactgcctggcttttatctcataaagtaagcataatatgaaagtgagttctttctatataaatttaagatattttactgatggaagacagcttattaaagccagcagtttaatgagtaaaactcacctttctaattgccagtaaaattaaaaactctaattcacctgattagagggcatatgtatcagtaacattctgcataatactacatatactacattctgcaaactctcaatactaa

SEQ ID NO: 129054 - DNA, 601 bp, Human
tttctatctctatttcattgcaagaacaaactatatgatgaaatgataaaatgggatacatctccttaattcaaatccccagcacccttttatatgtaatacctagaaaatctatttcattgctgctttagctatgtggttctaaatgaccattctcatatgcttagtagaggtgaaaagcagaagttcaggctacaaagtttgatgatatcaaattctgcaaaattttctatgactatttctattacatcatttcagtacgctaaaatacattgtgttggccgggctcagtggctcacaygcctgtaatcccagcactttgggaggctgaggagggtgggttaccgaaggtcaggagttcgagaccagcctggccaacatggtgaaactccatctctactaaaaaatacaaaaattagccaggcatggtggcatgtggctgtagtcccagctacctgggaggctgaggcaggagaatcacttgaacccagaaggcagaggttgcagtgagctgagattgcactattgcactccagcctgggccacagagtaagacttcatctcaaaaaaaaaaaaaaaaaaaaacaaaaaaccaccaaac

SEQ ID NO: 129055 - DNA, 601 bp, Human
aaaatactgtatttaatattattaaaaggaagagacaacaaatacacataagaaatgcttcaaaattacaaagaaaaaaattacaaaaaggaactctccgctcagaacagctagtcatctgttctgatgttagtaacaaatagcgaattaaaataaagagttttttaaaaataaattagggaaaaggcactgaatgatgaaagtaggaacacatgaaattactacaaatacacaaagtatatacaaagtacttaccaagcacatataatatcctggagaaaatccataaaatgagaaatayaaagcttctcatattactattttctccccaatttatttctatctctatttcattgcaagaacaaactatatgatgaaatgataaaatgggatacatctccttaattcaaatccccagcacccttttatatgtaatacctagaaaatctatttcattgctgctttagctatgtggttctaaatgaccattctcatatgcttagtagaggtgaaaagcagaagttcaggctacaaagtttgatgatatcaaattctgcaaaattttctatgactatttctattacatcatttcagtacgcta

SEQ ID NO: 129056 - DNA, 601 bp, Human
ctattgcacagtaggctgcatcagtcattctataggttatatgtcgaacactaaagaacagtgagaaaaactgaacttatatggtacagataggctcaatgtttggaaagaaatggcttgagtcttgaccaacaaatctttaaagattgtgttcatatacaatcttttctctgattctacagtaaaagaaaaatatacataaactcaattaaatcccatttaatggcatggcatctcctaaaaaaaaaaatcttgatttttaggagtgaaaacaatcaaaaatctatggttagcatttctmacatttggcaagaggcacatgatatgaaatcttaaataggtttcacggcacttcaactttgttaattttactacagtaacagatgtgaaactgtaaactgagaatcacaacctcactgtgagtcaagcagatcttcagtacaattgagacggggatttaaattaaatatacttttcaataatcaattcaaggtaatacaataaacactagcagaagtatatttagacaagtaccgcactatcaatcaatatgggcttggtgagatcactttgtgatttttccatacaaaagttacttttt

SEQ ID NO: 129057 - DNA, 601 bp, Human
atccagtctatcactggcaattatcacatcaaggcaactattctaaggactggagcagaaaactttgccataggaactgggtaacagtgtttgctttgtgctgtttccaagtacccaaacatagctagttttacatcaactgaattaattgactatgcattacacttactgatagccccctaaggagtgacccaacggactatttctcagtcaagaatttcggccacagtatatgctactattgcacagtaggctgcatcagtcattctataggttatatgtcgaacactaaagaacagtkagaaaaactgaacttatatggtacagataggctcaatgtttggaaagaaatggcttgagtcttgaccaacaaatctttaaagattgtgttcatatacaatcttttctctgattctacagtaaaagaaaaatatacataaactcaattaaatcccatttaatggcatggcatctcctaaaaaaaaaaatcttgatttttaggagtgaaaacaatcaaaaatctatggttagcatttctcacatttggcaagaggcacatgatatgaaatcttaaataggtttcacggcacttcaactttgt

SEQ ID NO: 129058 - DNA, 601 bp, Human
tccatggtgtatatgtaccatattttctttatccagtctatcactggcaattatcacatcaaggcaactattctaaggactggagcagaaaactttgccataggaactgggtaacagtgtttgctttgtgctgtttccaagtacccaaacatagctagttttacatcaactgaattaattgactatgcattacacttactgatagccccctaaggagtgacccaacggactatttctcagtcaagaatttcggccacagtatatgctactattgcacagtaggctgcatcagtcattctayaggttatatgtcgaacactaaagaacagtgagaaaaactgaacttatatggtacagataggctcaatgtttggaaagaaatggcttgagtcttgaccaacaaatctttaaagattgtgttcatatacaatcttttctctgattctacagtaaaagaaaaatatacataaactcaattaaatcccatttaatggcatggcatctcctaaaaaaaaaaatcttgatttttaggagtgaaaacaatcaaaaatctatggttagcatttctcacatttggcaagaggcacatgatatgaaatct

SEQ ID NO: 129059 - DNA, 601 bp, Human
caagtgagaacatgcagtatttggttttctgttcctgcattagtttgctaaggaaaatggcctccagcaccatccatgttcctgcaaaggacatgatctcgttctttgttacgggtgcatagtattccatggtgtatatgtaccatattttctttatccagtctatcactggcaattatcacatcaaggcaactattctaaggactggagcagaaaactttgccataggaactgggtaacagtgtttgctttgtgctgtttccaagtacccaaacatagctagttttacatcaactgaatyaattgactatgcattacacttactgatagccccctaaggagtgacccaacggactatttctcagtcaagaatttcggccacagtatatgctactattgcacagtaggctgcatcagtcattctataggttatatgtcgaacactaaagaacagtgagaaaaactgaacttatatggtacagataggctcaatgtttggaaagaaatggcttgagtcttgaccaacaaatctttaaagattgtgttcatatacaatcttttctctgattctacagtaaaagaaaaatatacataaactcaa

SEQ ID NO: 129060 - DNA, 601 bp, Human
aacaaatgctgactttataaacttttattttaagttcaggggtatttgtgcaggatgggcaggtttgttacataagtaaatgtgtggcatggggatttattgtaccaattatttcatcacctaggtattaagcctattattcattatttttcctgatcctctccctcctgccaccctctaccctcctctaaagcccagtgtgtgctgttcccctctatgtgtccatgtattctcatcatttagcttccacttacaagtgagaacatgcagtatttggttttctgttcctgcattagtttgstaaggaaaatggcctccagcaccatccatgttcctgcaaaggacatgatctcgttctttgttacgggtgcatagtattccatggtgtatatgtaccatattttctttatccagtctatcactggcaattatcacatcaaggcaactattctaaggactggagcagaaaactttgccataggaactgggtaacagtgtttgctttgtgctgtttccaagtacccaaacatagctagttttacatcaactgaattaattgactatgcattacacttactgatagccccctaaggagtgaccc

SEQ ID NO: 129061 - DNA, 601 bp, Human
taatcccagcactttgggaggctgaggcgggcagatcacctgaggtcaggagtttgagaccagtgtggcaaacatggtgaaacaccgtctctactaaaaatacaaaaaattagccaagcatggtggcggacacctgtaatcccagctacaaggaaggctgaggtgggagaatcgcttgaacacgggaggtggaggttgcagtgagccgagatcacgccactgcactccagcctgggtggcagagtgagactccatctcaaaaaaaatcaaaaatcaataaataaaaaaataagagagaacwtggtaatactggttgcctctaaggatgagaattgggaaacgggtgagagagactcatgtactttcttatatcttttgaatgtgcaacttaagaatgtataactaattcgtataaataaattaaaattttgaaatcaaacacatggccattggtaacgtagcagcaaaagaataagaaggtaaaattattttgaagagctaaacatatttatactcttagaaaaagcattcccttacaccaaattcataaacatgccaaaccaagaataaataaataaaagcactcataattcttaaatga

SEQ ID NO: 129062 - DNA, 601 bp, Human
ttctaatataatcatttcccttaaatataagggagttcttcgtgtgctaatatgaaacaaaaagtctccaagacatattgttaggtgaaaaaaagcaagatgcggcatttttcttaccatttgtgtaaaaaaaaaaaaaagagagagggagtgaaaaaatatatattctgcttgaatattctgctagaatattgttagaataatacttaaaaaacttggtggcagggagtggtggctcatgcctgtaatcccagcactttgggaggctgaggcgggcagatcacctgaggtcaggagtttsagaccagtgtggcaaacatggtgaaacaccgtctctactaaaaatacaaaaaattagccaagcatggtggcggacacctgtaatcccagctacaaggaaggctgaggtgggagaatcgcttgaacacgggaggtggaggttgcagtgagccgagatcacgccactgcactccagcctgggtggcagagtgagactccatctcaaaaaaaatcaaaaatcaataaataaaaaaataagagagaacttggtaatactggttgcctctaaggatgagaattgggaaacgggtgagagagactc

SEQ ID NO: 129063 - DNA, 601 bp, Human
ttaaaatttcttctaagcatatcttcatatatgataattaaacagaagcgttcatctcatgtaactatattgcttttctgtctcgatgtagtcataaccaataatccaatattatttcaacattttttcctctggtaagatagatgggcaattcagctccttctaatataatcatttcccttaaatataagggagttcttcgtgtgctaatatgaaacaaaaagtctccaagacatattgttaggtgaaaaaaagcaagatgcggcatttttcttaccatttgtgtaaaaaaaaaaaaaaragagagggagtgaaaaaatatatattctgcttgaatattctgctagaatattgttagaataatacttaaaaaacttggtggcagggagtggtggctcatgcctgtaatcccagcactttgggaggctgaggcgggcagatcacctgaggtcaggagtttgagaccagtgtggcaaacatggtgaaacaccgtctctactaaaaatacaaaaaattagccaagcatggtggcggacacctgtaatcccagctacaaggaaggctgaggtgggagaatcgcttgaacacgggaggtggaggt

SEQ ID NO: 129064 - DNA, 601 bp, Human
gtgtggaactgactgacagctgaatggaatacagatgaagtgatggagactacaagtcattcaaagtcccattttattaaatgctttgaaaatgaggcccagaaccttcagtcaatttatgatttagtgtaggaaacagacggttcatggtaatctgtctgaggagtttcatttcagggactgagttggcctagggaaaaagggacacaggaaaacagaaaaagctaagatcataatggtgatacatgttcctgccaaaataagtggacagagtctttttttaaaaaatattgaggctaaytgtaaaacttagtaaattattttaaatagaaattactgttttgtcacataaaataagaactgtgatttatgcataatttatgcatacttctaacttaaaatttcttctaagcatatcttcatatatgataattaaacagaagcgttcatctcatgtaactatattgcttttctgtctcgatgtagtcataaccaataatccaatattatttcaacattttttcctctggtaagatagatgggcaattcagctccttctaatataatcatttcccttaaatataagggagttcttcgtgtg

SEQ ID NO: 129065 - DNA, 601 bp, Human
ggagaaattctttctcagagaactgacaattggtcataggcactgtgtcgtatttttcccctttaaattaaacacatgggccagtagaagaggcagtattgaaactttctgagtctaatattgactcatatgtcactcttagactacaatgtattaatattttaatctgtagcaatgcatttcatattttatctggattatctaatttttataagtgaagcattaagttggtggagtttttttctttaaaaattatgttagtttcaaacaagtaacttaacgtgaaacttgacttgtaaayctaaggaaggatcaagcaaaagatatataagaggttgcctgaggtacaggttactttaatatttataagtagaatttatgagcatcattaaactttgcttatctagatcttgtatgacatagaatctagctttttctggcatgttacccatacacctgtgttctgaaatgctgtttcaaatatgaagtagctaaaaaataaaataattcattatattttgctttaaaattcagaggaattcactggctatgctcaggagagaatgaaggatgctgtgattctctttgtcttaacctgcta

SEQ ID NO: 129066 - DNA, 601 bp, Human
aaaagtcactcaaacttacacttagtaaattttaagtgtatgtgtaaaattatttctaagtccgtagattacaaaactcctatgtcatgaaatttactgccaccaatagttacaatcaaatgccataattagagtttaaaggaaaccagataattctgtggcaaataaagacaacaactggagttacatgtactgagaaagtggtaatcaaatcacatgctttgggggatgaactaatatgcacaggaacatggagaaattctttctcagagaactgacaattggtcataggcactgtgtygtatttttcccctttaaattaaacacatgggccagtagaagaggcagtattgaaactttctgagtctaatattgactcatatgtcactcttagactacaatgtattaatattttaatctgtagcaatgcatttcatattttatctggattatctaatttttataagtgaagcattaagttggtggagtttttttctttaaaaattatgttagtttcaaacaagtaacttaacgtgaaacttgacttgtaaatctaaggaaggatcaagcaaaagatatataagaggttgcctgaggtaca

SEQ ID NO: 129067 - DNA, 601 bp, Human
ctgccaccttactaaaatgtcttattagttgttatagtttttaatttcattctctatgatttttatcaagtacacaatcacatcatctacaagttctgacctctttacctccctttgaatttgtatttcctttcttttgcctaactgcatctttcctgtaattttgaaagcacaattaaacatcacatcttcctttcctataagacagatgaaaaagtcactcaaacttacacttagtaaattttaagtgtatgtgtaaaattatttctaagtccgtagattacaaaactcctatgtcatraaatttactgccaccaatagttacaatcaaatgccataattagagtttaaaggaaaccagataattctgtggcaaataaagacaacaactggagttacatgtactgagaaagtggtaatcaaatcacatgctttgggggatgaactaatatgcacaggaacatggagaaattctttctcagagaactgacaattggtcataggcactgtgtcgtatttttcccctttaaattaaacacatgggccagtagaagaggcagtattgaaactttctgagtctaatattgactcatatgtcact

SEQ ID NO: 129068 - DNA, 601 bp, Human
aattttctataaattcttgcaagtttatttacatgaacagcctttcttgtcaaaaaaactattggtattatgattgagattatgttgaaacattttatgttaacttagggaggttaaatgtttaatattgaaatttcttatccaagaatatggtatgcctttccagttattcaagtttccttttgtatccctggcgaactttaggtgttttttattcagcaattggatcttgcacacttattattagtttgttgccaggcattttttgtttttattataaatgagatctttgtttccattrtattttctaactatctagaaaagctattgatttatttgtgtattaattttgtggctgggtgcggtggctcaggcctgtaatcccagcactttgggaggccgaggcaggtggatcacttgaggtcaggagttcaagaccaacccagccaacatgatgaaaccctgtctccactaaaaatacaaaagattagctgggtttggtggcaggtacctgtaatcccagttactagggaggctgagataggagaatcgcttgaacccaggaggtggaggttacagtgagctgagattgtgccactgc

SEQ ID NO: 129069 - DNA, 601 bp, Human
ctagtctattcatgtgcttagataattgttttaattattataattttatatacattttaatatctgataggttgtttccctccaccccatccctcattatttttctttttacaaaattttctataaattcttgcaagtttatttacatgaacagcctttcttgtcaaaaaaactattggtattatgattgagattatgttgaaacattttatgttaacttagggaggttaaatgtttaatattgaaatttcttatccaagaatatggtatgcctttccagttattcaagtttccttttgtrtccctggcgaactttaggtgttttttattcagcaattggatcttgcacacttattattagtttgttgccaggcattttttgtttttattataaatgagatctttgtttccattatattttctaactatctagaaaagctattgatttatttgtgtattaattttgtggctgggtgcggtggctcaggcctgtaatcccagcactttgggaggccgaggcaggtggatcacttgaggtcaggagttcaagaccaacccagccaacatgatgaaaccctgtctccactaaaaatacaaaaga

SEQ ID NO: 129070 - DNA, 601 bp, Human
cctgcctcagcctcccaagtagctgagattacaggcatgtgccaccaaacccagctaatttttctatttttagtggagatggggttttcaccatgttggtcaggctggtctcgaactcctgacctcaggtgatccacccgcctcaggctcccaaactgctgggattacacacgtgagccaccgcccccgaccccaatctttttctattacaaataagtctacaacaaatatagtttttatgtagcatttcatatacataacagtattatcagtatggtaaattcccggaagcacactgackgagtcagaggatatgtgtatttttaattttgataaaaaatttccacattgctctccaattctgtgccaatttagattcccatcaatcatgattgagagtacctatttccttgcacacttggcaaggcttaccaacctcttccgcattgcttgtatgggatgaaaggtggtatttctttgtagtttatttttcacttccttttcattggactgcctgttcttgtacttgctctgtttttgttattttttctgatgaatttgtaagagtggtctataaatttaaaaaattagtcctttgagt

SEQ ID NO: 129071 - DNA, 601 bp, Human
ccatctagtcaatggaaaccttcttcgaaggatctccagagtgttccttgagctctgcagacccagcagatatatacagaaacaccatcaatcaagctaaggttccagctatgtactgttaaaagctgtatattcaaacaatatgcaaatacattacttccacagcaatgtcaagaagtagcttaactgagagattcgggataaactgttcttttaatcctcaattaaaaaaaaaaaaaaagcagggggattgaggttccaagatggccgaataggaacagctccagtctgcagctcccaktgtgagcaacgcagaagacgggtgatttctgcatttccaactgagcaaacagcacaccaggagattatatctcatgcctggctcagggggtcccacgcccatggagcctcgctcactgctagcacaccagtctgagattgaactgcaaggtggcagtgaggctgggagaggggcgtccgccattgcttaggtttgagtaggtaaacaaagcggcctggaagctccaacttggtggagcccaccgcagatcaaggaggcctgcctgcctctgtagactccacttctgtgggcagggcatag

SEQ ID NO: 129072 - DNA, 601 bp, Human
tgcacatgtaccctaaaacttaaagtataataataattaaaaaaaaaagaaaattgacaaataatacctggcattctgataagggcaggttagtgaacattttaggcaaagcaaacaagataagattgcacaatgtaggttcaaggaagggtaagattggtaatatggtttgggtctgtgtccccacacaaatctaatcttgtagttcccataattcccatgtgttgtgggagggacctggtgggagatgactgcataatgggggcgggtctttcctgtgctgttttcctgataatgaatsgatctcatgagatttcatggttttaaaaacgggagtttctctgcccaagctctctttttgcctgccaccatccacataagatgtgacttgctccttcttgccttctgccatgactgtgaggcttccccagccacgatgaactgtgagctatacattaaaccgctttcctttgtaaattgcccagtctcgtgtatgtctttttcagcagcatgaaaatgaactaatacaattggccaaatgataaggttcctttagggataggtaaatatatacagactgcaactttgtggctaggagtgt

SEQ ID NO: 129073 - DNA, 601 bp, Human
gcagaaggaggaactgtattccttgccagatgcctggagagcaggttgagagagaataaggaagtcaagtggaggtaaaagccctgaaaggatggagatggctttgctgtagccctgcaggtcccagctaggaagactgccaaaaactaacccacctcgggctagatcgcctagaaattcactgtattaacagaaattgatttaaaaggatccaccagacaagactttgagatgtggctggggattataatctccatcctatacgccagtatttaacttttacgttttgacacagtgatgraattataaatcagacatttgtgtctaaaacatagtattaggaagcattactttgactgtaagagaaacttggcagttaagtttttgtgtaagtttaagtgcaacctaaaggcacaggctccatgagctacccaagggaagttaatgcctgttaaatatcgttttcttgggttttgtctttaatacaatgtatttggacattagtattccccaatcttaacattcaataatttagaacgaaacaattattatatcttttgctcttttataaaatgtcttgtaaaatgtatgctgacttcaa

SEQ ID NO: 129074 - DNA, 601 bp, Human
ggactataaagaagacacgaaagaaaaaaattctggaaaggcagacataaaaaatgtaaatactttttgaaacagagtagtatttttcaactaaactaatgaagtttccacatccacaagcatggaacacacaatatgtgtaagttaaaaatgccaaagatatgtttgtaagtacatctacatatcctcataaaataatgcatattgtcaaaggtataatagcatgatttgttctgagtaaagaactcaatattgcttcctttgctaatgaacagaagacatatcatatagaaaaatcttmatttaaagggcatttttttaaagaaatggaattagtcaatcttataatatgaactttacaaccaaaagtatacaaataataaaaacagatctgatgtaattttagtctgataaaagcaaattaaaaaaattttaattaaccagaaacaaataaaacatttaaaaaactgccctacttgtgtactagtcttcttgcaacattaaattacttaaaaataagacaaacatgtaaaaatgagagcttacttatttttcatgatcataggaattatcttgtagattaaaatttttactacaaaat

SEQ ID NO: 129075 - DNA, 601 bp, Human
acctcaaaactgtgtttattcattattctggaaggcacactgcaatgatagttggtaacacaatactttttcagtctatgttcacattctaaagttttatgttatcctgtgtacattacaaaaaaatctttaaagcactgaatgtacaagaaaattttagaaaattgaatccaagtctatattattgaattttaacattaacaaaattaaatcttttgttcatttatttatttataaaagcagaactgaaatagacttaaataactttctcaaagtcacatattgtctccatgcctgagtstggtttccaattcacatttcctgattactccagaccaatgtttcacaaaagcagtaaatatttcacattacttgtgtcaacaaaaattttcatgccatatgtaagacaggtgtaataaagagctgacatttaacttgcaattcaagttattataaattatagaagccaaagaattcatttattgagcaccaaccatgagccaagtaatgtgccaggcatctagtgatgcaaaaatgaatgtgatctcatccttgtcctctaggaatttccaatgaaatgctaaaaataatatggacattt

SEQ ID NO: 129076 - DNA, 601 bp, Human
gaatcatttgaacctgcgaggcagaggttgcagtgagctgagatcgtgccactgcactccagcctggcaacagaaacagagtgagactccatctcaaaaaaaaaaaaaaaaaaaaaaaaaaaaaaaaaaaaactctttacgaaaatactctgaagttgtgctttatagctaattaagggtatatcacctaatgttgtatagtacagtatctctattttaactttttatgtgatttctataagatttaggaaattaaaaacatccatatccttctgtccagctacttaaaatatttatcttrtgataatttatagaaatatggaaagacaaaaatgaagccccagagttctaagtattcttttcatgatattttggttagtgaaaacactcatatttatttccaaaggaagaaaaaccagaaacaacttcttcacattgtttcaattcaattgaactatactatgtttttccttccacatacacatggtttcatattaagagcagaaaaaaaagtaggggctaataagaggtaaaatagagctatctcatcactgaggaatttaaacaatattttgcaagtttaccaaatgatttttaactg

SEQ ID NO: 129077 - DNA, 601 bp, Human
aacaaaaacaaaacaaaacaaaacaaaacaaaacaaaacaaaacaaaacagaccttgctgagtttcccccagattagaaccattagatcatacccctagaaccattagatcatacccctttctgtccaatcatgtttctccagaactatccacttcatcagactgcataaaatacatacagttctctctgtttctttgggccatcatttttgaaagctcccagtcatgtaaaacttatattaaacaaatttgtatccttttctgttgttaatctttcgttataggggtcctagccatgagwcttgtggtggtgagaaaaagatcaatcttttcttcctacaacactcactcctctttttggtatacatttttaatgaagtcaattactaaggaaggctgtgtttattttattaagattaaaaactcttcactttgggaggccgaggcaggtggatcacaaaagagatggagaccatctggactaacatggtgaaaccccatctctactaaaaatacaataattagctggacgtggtggcacacacctgtagtctcagctacttgggaggctaaggcaggagaatcatttgaacctgcgagg

SEQ ID NO: 129078 - DNA, 601 bp, Human
ctgggacctatgcagaggcctcctttctcctacctaattctgcatgctcacttgaaaagaaaaatcataacttctgtcttggttgagctatgctggtaaagaggaaaggattttttcattttgtttactctaaattgtgacataagtcacatgggactagaaggcccttagctatgcaactttattttgtgcttgtgcaaatcatttaacctctctgggactcatctgaaaaaacagaaactattaatgctttgattgtcataaggttttaaagccagactagactgacatatttttcaawtctaagatctatgattctattcatccgtccatccatccgtccatacgtccatccatccatcattcatccatccattcatgaatgcttgagatctcttacaactctaatatcagcaattctgtatctatgaaagttggattcaaagcaaatgtaaggcatcccaaacattctgcaagaattcatactgtgtcaaaaagaatgacttgagagatgtgcagaatagcaagtcagaagctcatgaatactgaaacaaatttctccagttggtatttgcttgggtatgctccttatgttttgtgt

SEQ ID NO: 129079 - DNA, 601 bp, Human
tttactactggaatttggaaaaatatctaaaatatacatgccaatactctctgtgtacttcttttcattatcaaaaataaactgcagcaaatactgttacttagtttgaagaggtggaaattactgatgtcctttttgctctataataatctaacttacttattatctaaattagggtaaacaaattagtctatgagtgcatttcgtcaaaaactgaagattacttcattttagtgcaaaaaaattattttcatatgaagtattttcaatagaagttttttttaaaaaaactgttacacaktctcctgcctccttaaccatggtattttacctccccttgattacccataatgccatcaatatgcaaagcagttgttatattgtgttaggctagattttagtcattagagtgatatttgaaatatttactggagtgcctaggtccatttgcccctccacggagtgtccacaaactgttgtactgaataattttaaacagaagaccctgtctacttgtatttcttcttggcagctgtcatagttcatgactgcctgtgaatcaagtgggctctaatctcctttattttaggtaaaatggctt

SEQ ID NO: 129080 - DNA, 601 bp, Human
caactgacattatagcattgaaacatgacttgtagattttctgattctctatactcttcataaaataatcaccataaactttatcaaatctaccatatcaggagaataataaattttaaaaaacaggtaagatttccattgaaaaaaaaaaagtcaaacaaaaaccttcctgttgaatcctttaaaaatactgaactttttaatatttaagagtattttcctccctttacttccatttactttatgaattaattatttttagatttggttttcccagagtaaactcttagtactctttcaytgagtgtgctctgagaaagacctgtgctttatcaaataatgaaacagcacttggtttcaaaattagtaagaggcaaatgataattttaacagcttgcaactcaatgggtaatcagtgctaaagttgttaatgattaagaaataaaagaaactctcatgctttaatagctgactgtatgcataaaacctgtcactaacacagaaaacttagaaaataattaggaatcttcctccatggggttagtcacagctgctatttaggacttggacagttgtaactctactgtaaaagtaatattct

SEQ ID NO: 129081 - DNA, 601 bp, Human
ctacaagcaaaattgtctgcttccttaggaagatggagacagctgttagtattgcaaatgaaagttcctaatgaaaggagagattatatttttaataaggaatcaaaatcatgatgcattataattaacatatgattatacttaatgatactgagtgggaaacactaattagagataaactatattatgtgggagatgaaaaatgcatcaagatcaacttttagggcaaagaaggaggtaagttggtaaattctggagaaactatgcaggtcagtacttaggaaaagattttataatacayagtagaaataaagaaaaacacagaaaatatatcagaacttggaaatgagtgttttttcattctaaccacaagagtaagggtagcacggtgaatagtggattgaaagatggacagagattgagcaaagacacactatgtgcattcattcttggttgcttggctacaggacctctgcaagccagaagcatatgttatgcctcctgggaaaaggtctagggacaaagtttaggatgggtttgtgccataaagaatgacatcaagatggtaatatggaatacagctcatgtacaagagggctaa

SEQ ID NO: 129082 - DNA, 601 bp, Human
atctcctagaacctttcgtgcatctcaacacatttatctccatgacaattatcaacatcctcaaatacaaaggccataagcatcattttgtagcaaaatatatgcaagaatcaatctacaaacagagtttatcaaattaaaataaagaatcaaagtcagttaaagttatgtatcttcaggtcctagtcatacaaacttatgtattttccatacagctaagatagaaaaaaatgtgcttcagtggcatggggaagaaggaagatgtcttgaaaaagaaatatcatataaaaaaacaaaacawaaaaaagcctggccaagtatcctaggataagcaaaacaaaataagtaagcagcaactgtaatttcttctttttctctgattccacttatttttcttcattttataaatttggaaacaacagaaaagcgtaagaaaaaattaaaatctacaataaacatactatctagagataacattcacactatgctgtctggcctcccattcttttttttccctatttctaattatatttacaaacaaactagtattctcaccatccagacacttgacccctacattgatactaaaattcaactgcat

SEQ ID NO: 129083 - DNA, 601 bp, Human
aaagcattcagttttattctatcttctttaacgtctcatgatagttgtaggatttttttccttgatagtctcataaagttagaaggcaatatttttttcaattgtgaaaagaaaaaaggggagaagggatgcatgaaggggacccatttttggaaatccagaaatttacctaagaatgaaagaattataaggtatttctttggacagcaggagcaaagatgtccatgattaagttttaatacacagcttgaaagtaacttttaatggtcaatggatatattggaactttaatctgaacaaygatctaggagctcaggcctgagaaatgttgatgaatggctttcaattagttaatatctctaaaacatgatcagcctacaaatcctatcatattgtttttcatatctcctagaacctttcgtgcatctcaacacatttatctccatgacaattatcaacatcctcaaatacaaaggccataagcatcattttgtagcaaaatatatgcaagaatcaatctacaaacagagtttatcaaattaaaataaagaatcaaagtcagttaaagttatgtatcttcaggtcctagtcatacaaactt

SEQ ID NO: 129084 - DNA, 601 bp, Human
tttttgcccctttggctatggcaaaaatatgaaaaatatgcaagtttttcttcctaactctttcaataacaagaaacatgtattccatctataaattacaaaaatagaaagtactgtgattaatttaaatgaataaattactttaaaaaagtttataaaaattttttttctaatctgagcctgtgcatatataactttatacataggaaatgagaattctttttggcacttgaagttactactgaaagtaaacagcataattttgatcacaaaagccgaataatacaaattctggaaaacmatttcatagcaatgagtctttaattcatacgcataaaagtcctatatagctcgagatttttaaaaataagctctaataaacacgaaaggcagacatgaactaggactgttatacatatgatgtgcataattttggcaccaaaaaaaatctttctatgtcattgacatctataatagacattgcacttggagaaaagactaacttttcaaaatcctagtagcaactaatatgcattacaccttaacatacctaaaaactgttgatgatgttggctttgggcaattacagtttgctcaacag

SEQ ID NO: 129085 - DNA, 601 bp, Human
caaccactgttaacattttcttgttctttctccttctggatatatatatatccatatatagatatgtatatccatacatatggatatatatatgaaggaaaaggaagaaacatacatatatacacatacataaacacacatgttatttttcactcaagtgaaaatatgtatacataattttttgcatttgctttttcttttaactttaaatctcgaagtgatccattttggtatgtgtatagagttgcctattcttttgatggctgtatagtattctactctaaagattgtattaataccmtattttatttatgcagctccctactagataaagaaattataaccaatcttttgcattaaaaataataatgcaacaaatgcccttgtacacttctcttgtcacccagatataaatatttttgtaggacaaatacctagaggtggaattgctacgccaaaggattcatattaggataggcttaagaaatagagaataaaacttattctcacttttctgcattcctcatctctccactctgagaccagaaagaagaaaaatgaatttgttagtgctaaaagatacgctcaaaagaattagtgc

SEQ ID NO: 129086 - DNA, 601 bp, Human
gggtgggcacagtggctcatgcctgtaatcccagcactttgggaggctgaagcgggtggatcacttcaggtcaggagttcaaaaccagcctggccaacacagtgaaaccccatctttactgaaaatacaaaaagttagtggggcgtggtggtgcatgcctgtaattccagctactggggaggctgaggcaggagaatcgtttgaacccaggaggcggtggttgcagtgagccgagatcgcactactgcactccagcctgggtgacagagtgagactctgtctcaaaaaaaaaaaaaaaaaatccatataggctggtttgcttaaagtaaggttcacttgaacacatgggaatgagaaattgtttagagaatctttacacaaatctttattgaataagatgataaatgtagaaagaaataattttctctatatacataaggaaaatccagaaattctctaatatgggtaaaagcatagtagtcaaaggaaaatgaatattaagtgctttcatcattccaaggaatgttgggaactggtaggacacgttgaagaacacttctggcacatgttgtgttaataaggagagaacctgcccttggtg

SEQ ID NO: 129087 - DNA, 601 bp, Human
aacttcctgggtggaatgtatgagaacaaaagcatccgtactcgtctgcatttaacttactaggaataggtctaaggacgtcggggatgagaatctccaccaaagcctggtacatcccatggtcacagttacacatccatttcaggatagactcatgtttgcacagagttatcagctttgctttcggaagtcgactttctatttcactcagattgctggtgtgaataaatgtagcaaatgaatagatggcaaatgaggataaaaaagaaaatggactttaaaaatagtttaagtttaccamatattactgaggttagaactataccaccattgcactggtgccatacagctggctatatataccgagagagatagacagatatataaaacactcccccagagctgtctatgcacatttgtattttctgacggtatgaaaggcagatatgatagtaattccatgaggatgaaataactaccacagtcccccaaatcagtacaaatgggagctatatacacacactgaaacctcaagagagcagttcatggtttatttctaggatggccaaaacatcaatctattcaattaatgtcatcaggt

SEQ ID NO: 129088 - DNA, 601 bp, Human
accctatgcaacttcttataaacatctctagagattatcactcagagcacagggagcaagagaaaaacaaggaaaatccgattctggaacataaatcagtagagaatttagctagtgaaactttctaaaacatcacttttaatcaacctttagccaggaaacttgctgtaggtagagtagaatatattaccaatttacaaaattgtgagataatgtcagctaattttttttttacttattcctatataaatttacgtgtgttcattaatattatatggaaatatgtttaagcatacatttyaaggtggccgggaacatattaaagatctcataccttctactgttgtctattgttatttagaaaaaaagaaagtataagcatacaaatgttaatatcttccccttttgttctactaaattcctattttcatattttctagaataatttaacacaaatcatctgtgaatagtatacttgaagtacacagtagccaacttcacaagctatatgcttgcttttactttattgatgtcaatgtagagtagtaactgtctcatttcttaaaaagttaaggtcactactgtgtactcatatagatat

SEQ ID NO: 129089 - DNA, 601 bp, Human
ctgcatgtcatggtacaaattattaaatatataaacaataatctaagacaggtgttgtaaggtggggaaagtgaagcctagagcagttaagtaacgcaattgcccaagatcccacagctagtatatgagacagcttaatttcttgcctgtctaacttcaatgactgtgacctttattactctactaactattcagcaaatgctggtgatatattacgttgtcttttaggactgtaaatgtgagcttactttaaccacaaacatgggagcactacagctgtatctgggtcaaactcctctcyttcagaacactgtgaatatagatgctgccatatatagatgagactttgaaaagaaatttgatgatcccaattaagaagaacaaattgggtatctttccttaagagacatgctttgcaaggaaatagaatacctggacattggcaaagtcgacacggttgaggtcactaagcatctggttgatttgggaagtgttctgaagcactgcacgagctgcctgggccaggtgattaagcgacgtgtatcttcgcagagtctgggcaaaggcacttacagcggcaacctgtaacgcaatccaatta

SEQ ID NO: 129090 - DNA, 601 bp, Human
gaacctctttgtagcgctgtatcaactgctattatgattctcggcaagttcatttctatatttccatgcatgtaaatatatacaaaaaattttagaaattagattaagcatctgatttcagaacatgaagggcctgtgtatgtgactgccaaatttataatggcatttacaaatttacaaatttttggcatctgtaatgccaaaaacattaaaaaatattctaattctgcttctctgatagtttgtgaatgtaattttcattactcaatatgttcttatgtctcagtaaaaaacagttcasatattaaaggcttaagtttctcagctattgactttgcctaccagcaggaggtatgcatctgtctgaatgtgcctttccttctggggccctgaactgtaggccttcaagtctttttgaaacgaaaataataactataatagtatctaataataacaagccaattatcctcaactcagggaggacagagggcaggcaagtgatgatctactgggtttgtatatctgcagagaacaagaaatacaagtaagtaattttctctcccttcaagatacctgcaacagatctctgtggagatgaagg

SEQ ID NO: 129091 - DNA, 601 bp, Human
attcaaaaaagagtattactttttggaagattcatatattgtccagttgtaggcaaactaggcaccctgtgcctactttcacgccaaatatcaaagctatacattccactctttaaaaatgggatatctgaatgaccttcagggtggccctgaagaatgctctcttctgttatccaaaacacacaagctgagaaatggcccatataacttctccaattctgcccaagaaaggcagtgatttttttttctgcctcccagggaaccacaattagtcactgacagccaggttaggcaaggagaragcccccattcagagcagaacctctttgtagcgctgtatcaactgctattatgattctcggcaagttcatttctatatttccatgcatgtaaatatatacaaaaaattttagaaattagattaagcatctgatttcagaacatgaagggcctgtgtatgtgactgccaaatttataatggcatttacaaatttacaaatttttggcatctgtaatgccaaaaacattaaaaaatattctaattctgcttctctgatagtttgtgaatgtaattttcattactcaatatgttcttatgtct

SEQ ID NO: 129092 - DNA, 601 bp, Human
aaagatgtcattcattatataataatacagaaaaacaatactgagtcaggtgaatgttaataaatcttttcaggaataaatatcacagatacagaatgagtctttctttatatatttctaagttcaaattttaggcctttctatttctctttctcttttttttgtttttgagatggagtctcgctcttgttgcccaggctggagtgcaatggcataatctcagctcaccgcaacctctgcctcccgggttcaagcgattctcctgcctcagcctcccgagtagctgggattacaaacatgygccaccacgcctggctaattttgtatttttagtagagacggggtttctccatgttggtcagactggtgtcgaactcccgacctcaggtgatccgcccacctcggccttctgttaaaatataataaccctgaaatcatgtgaacaactaaggagaatgttcataacaagtagtttctgatatcattttagaaatgcaaattcaactttttccaataaaattcacatttatttagcagatatttattgtgttcctactctgcggcagggtcttggttcagacaagacagacaaaatttggtt

SEQ ID NO: 129093 - DNA, 601 bp, Human
atcccaattttatttaacccaaaaagaaacatttaaccagtggtaatttccgggtagaagtttttgtatttcctagattatctttttaaaaaattaattaatttttttttttagagacaggggtcttgctgtattgtccaggctggggtgtggtgatgccattatagttcactgcagcattgaactcctgggttccagtgatcttacgctcctcacctcccataggcacttgctaccatgctcagctaattattttattttgttagagatggggtctcactatgttgcccaggctggtctygaactcctggactcaactgatcctcctgcctcagcctcccccaaatagctgggattacaggtgcaagccaccatgcctggcctgtatttaccacattttctaatgtgagcatatattaactgcataataaaaatatttattttaaaagatgtcattcattatataataatacagaaaaacaatactgagtcaggtgaatgttaataaatcttttcaggaataaatatcacagatacagaatgagtctttctttatatatttctaagttcaaattttaggcctttctatttctctttctct

SEQ ID NO: 129094 - DNA, 601 bp, Human
aaacaccaaaacccatcttaatgttcaagaataagggaatgtttaaataatgtatgaggcataaacataatgaaatagtatgaggacgttaaacattatgtttctgaagatatttaatggcaagaaatgcttaagatataattgcaaataaaaaatgttaagagaaaaatatagttaaatagtctatggtaaacaactggatcccaattttatttaacccaaaaagaaacatttaaccagtggtaatttccgggtagaagtttttgtatttcctagattatctttttaaaaaattaattawtttttttttttagagacaggggtcttgctgtattgtccaggctggggtgtggtgatgccattatagttcactgcagcattgaactcctgggttccagtgatcttacgctcctcacctcccataggcacttgctaccatgctcagctaattattttattttgttagagatggggtctcactatgttgcccaggctggtctcgaactcctggactcaactgatcctcctgcctcagcctcccccaaatagctgggattacaggtgcaagccaccatgcctggcctgtatttaccacattttc

SEQ ID NO: 129095 - DNA, 601 bp, Human
tacaatcgtatatgaagataatcataacagcatttttaaaaactctatcaaaacaccaaaacccatcttaatgttcaagaataagggaatgtttaaataatgtatgaggcataaacataatgaaatagtatgaggacgttaaacattatgtttctgaagatatttaatggcaagaaatgcttaagatataattgcaaataaaaaatgttaagagaaaaatatagttaaatagtctatggtaaacaactggatcccaattttatttaacccaaaaagaaacatttaaccagtggtaatttcsgggtagaagtttttgtatttcctagattatctttttaaaaaattaattaatttttttttttagagacaggggtcttgctgtattgtccaggctggggtgtggtgatgccattatagttcactgcagcattgaactcctgggttccagtgatcttacgctcctcacctcccataggcacttgctaccatgctcagctaattattttattttgttagagatggggtctcactatgttgcccaggctggtctcgaactcctggactcaactgatcctcctgcctcagcctcccccaaatagct

SEQ ID NO: 129096 - DNA, 601 bp, Human
tcattaaactagtattagttactttaaatgtttatatccttttacttgaacttatccaaagatatacgtacaatcgtatatgaagataatcataacagcatttttaaaaactctatcaaaacaccaaaacccatcttaatgttcaagaataagggaatgtttaaataatgtatgaggcataaacataatgaaatagtatgaggacgttaaacattatgtttctgaagatatttaatggcaagaaatgcttaagatataattgcaaataaaaaatgttaagagaaaaatatagttaaatagyctatggtaaacaactggatcccaattttatttaacccaaaaagaaacatttaaccagtggtaatttccgggtagaagtttttgtatttcctagattatctttttaaaaaattaattaatttttttttttagagacaggggtcttgctgtattgtccaggctggggtgtggtgatgccattatagttcactgcagcattgaactcctgggttccagtgatcttacgctcctcacctcccataggcacttgctaccatgctcagctaattattttattttgttagagatggggtctcactat

SEQ ID NO: 129097 - DNA, 601 bp, Human
gatttcaattgtgatcatataattttttgtaaggttcaaagtttagcctaagagtcaaatgacataatgtatgtgaaatcttaagaaaactaccaatgtaactatactgttacctacattagtgttaataatatattcattatcataaatagtaggtctagtgaatgatatcttagagttgactacttcaacgaattccttaagtttacagctctataaataattattaaaaataaatgaatactttcatttgcatgccaacatatatgacaaaattctatatataactctatccacgtckttcctaaaattcagtgacatatcaccaatttgtaaaaataatttataagattacaatataagagttatatgaaaataaatatttctattcctatggtaaaaaaaattttaaagcagtgaatcacttactaaaaaagcaaaaacaacacaaaaataaaaagaaaatgttacataacgtttttacccatactaacaaagacttgaaataaatgatttttaaagtaaagcatgaacagaatatttgctcctaattgcatttatcttgctgaagaaagatagcaagtatttaaaattttcaaat

SEQ ID NO: 129098 - DNA, 601 bp, Human
caaaataaaatcttggcttcaacatgccaatcattaagcttgttcatgcacttcaaatcttaaaatagtcataatttagaatcagagtgatgtgtgtgtgtgagtgtgtgtatgtgtgtgtttcttatcactttcatttactgacctttttctaaagatttttggcagatgaacactaaaacaaccattgtattctcaggagaaagaggtaaaaactcacctatgcctcgttttacagtaaagaattataagacatcaggcaaatggaaaaacaaaagactgtacttttgttttctgtttyatttttcaaccttgtttaaatagaggctactaatacatcaaattgtatgcattcaacttggcaagtgacagatcatcattgtccatctgaaacacagaagccttgaattctgattctgtctcttcattgactgttgatctcaaaaacatcatttccccgagatgtttttcctcttgcatgaaaacaaaacattgcctttagtcttatctaacttacatgcttatttcaaggataaaataagttaaaggatgtgaaatcaacttatgaatgactagaacgctattcaaatataagtgattg

SEQ ID NO: 129099 - DNA, 601 bp, Human
agcacaataaaatcaattaagaaatgcgttatttttgaaaatgcaaacatttaaagtatataatacgaaaatataagcaatatttataaaatacttataataaactctattatatttaaaatggaaatgagtccaaaataaaatcttggcttcaacatgccaatcattaagcttgttcatgcacttcaaatcttaaaatagtcataatttagaatcagagtgatgtgtgtgtgtgagtgtgtgtatgtgtgtgtttcttatcactttcatttactgacctttttctaaagatttttggcakatgaacactaaaacaaccattgtattctcaggagaaagaggtaaaaactcacctatgcctcgttttacagtaaagaattataagacatcaggcaaatggaaaaacaaaagactgtacttttgttttctgttttatttttcaaccttgtttaaatagaggctactaatacatcaaattgtatgcattcaacttggcaagtgacagatcatcattgtccatctgaaacacagaagccttgaattctgattctgtctcttcattgactgttgatctcaaaaacatcatttccccgagatgttt

SEQ ID NO: 129100 - DNA, 601 bp, Human
tgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggtgagcggcgcggcgggtgggcgatgcgcgcaccctcacgcgctctctgcgcccaggccgcgtgcggctgagggtgggcttggcgctggcgcactccatgcagggtcccycgatgccccctcggccttagcctcgggccccctgcgggggctttcccccaagcgctctaattactgcacaccaagaacaaagctcctctgggactcccatttgagtgctccttgagctgctggttcctgctctacccaaaatgatcaaaggggcttgggggtagaaagggaagcaagtagctcttggttctgctcgtttgaaaacagggttcgatttttttctttgttaatcccgcaccgtatctccccctatcaccgccaccttcctcaccccacacccccagcctcgctgcgcgggca

SEQ ID NO: 129101 - DNA, 601 bp, Human
tgtgtttgctgaaaaggcaagtggggacagcttgtttcctcccaacctcaggtaccttcctctccaactgctgctcctaaatctcagaatatatggtgttgcttgcttctcctccgaaccgccccctcccctcagggtggggatagggcatggaaatggcctttggaagttaatgggattcttggggtcagattggattctccagaaccttggggaaaggaaagtcaggtttctagtaaataaataacatcctggaatggccctagcagaggctatttgtaggaggaaaggagagaagtasagaagcaaatcttgactatttcccccaagaagtgccaagtggttttggaacttttttttttcggttttgaacatttttaagggaaagtttatcctactctaccatatttaaatagcatacgctacaaagaacgacttgatttcctttaggccaaagagaagagatggccttgtttgttttcctagtgataagagtcgaggattaattgttaaatctctttttgaagactgagagatgccagggcaaggtggctcatgcctataaccccagttactcgggaggctgaggcaggagaattgc

SEQ ID NO: 129102 - DNA, 601 bp, Human
ctaccatatttaaatagcatacgctacaaagaacgacttgatttcctttaggccaaagagaagagatggccttgtttgttttcctagtgataagagtcgaggattaattgttaaatctctttttgaagactgagagatgccagggcaaggtggctcatgcctataaccccagttactcgggaggctgaggcaggagaattgcttgaacccagaaggcagaggttgaagtcagccaagattgtgccactgcactcccgcctgggtgacagagcaagaatccaccaaaaaaaaaaaaaaaaaaggaaaaggacttttagagggccaggcacggtgactcacacctataatcccaatattttgggaggccaaggaaggaggattgcttgagcccaggagttggagaccagcctgggcaacatggcaaaatgccatctctacaaaaaagtacaaaaattagcgtggtggtgcacatctgtagtcctagctactcaggagactgaggtgggaggatcacctgagcccagggaggtcgaggctgcagtgagccgtgatcgtgactctgcactccagcctgggcaacaagaatgagaccttgtctaaa

SEQ ID NO: 129103 - DNA, 601 bp, Human
aaaaggacttttagagggccaggcacggtgactcacacctataatcccaatattttgggaggccaaggaaggaggattgcttgagcccaggagttggagaccagcctgggcaacatggcaaaatgccatctctacaaaaaagtacaaaaattagcgtggtggtgcacatctgtagtcctagctactcaggagactgaggtgggaggatcacctgagcccagggaggtcgaggctgcagtgagccgtgatcgtgactctgcactccagcctgggcaacaagaatgagaccttgtctaaaaaraaaaaaaaaaaagactttgcaggataaacattggcttgagtctccctcctgattccctgtggaagtggagttatcctgccttttcagcatggggctctccagagatactcacttgctacccaagtgttgcacaccactcgtcagcatgcgattcactggagactggtttggagaaggttttaagcaattgttccctggcctttggaatcagttgcgtgaataagaagaagtacatgctcattttgcagacatggcctttggtctcagatgggcactttcctccaattttaatgtctgtga

SEQ ID NO: 129104 - DNA, 601 bp, Human
gtctccctcctgattccctgtggaagtggagttatcctgccttttcagcatggggctctccagagatactcacttgctacccaagtgttgcacaccactcgtcagcatgcgattcactggagactggtttggagaaggttttaagcaattgttccctggcctttggaatcagttgcgtgaataagaagaagtacatgctcattttgcagacatggcctttggtctcagatgggcactttcctccaattttaatgtctgtgagccccaagagcttagtttgagtacttttctccagaaaggraagtcaccacttaaaaatcaagtgcccagctgaaatcttcctagatatttgttccttcagatggcaacaaagggcagtcctgcttctggtctgagaagtctcaaacctagaccacccccgatatgcccattaacaggggtccttttcttgtcctttttcttcagagtactgggcctgagtggaaactcatacttgtttgtgtagtctgtaagggctgatttgtttaattgacagtgaaattccagtgacttataacagtggcactgagtctattcataaacccttgctagataatgatag

SEQ ID NO: 129105 - DNA, 601 bp, Human
atgacagagctggcaagcttattcattctaaattgttttctttggagcgctaaggaagcaatcatgcatagattctgattccattatctaaaatcagaaacagctccttcatggtcttagcaatacccttgcccagcctcgtgtctctaccctggagctcatgtagcgtgcatctggcagtgctaatttgagacgtggcataggctttcccgctttgtctgtgaagcccctgaggacagggcccagcggcggttcacgctggttccaggcccagcccctcacctgcatagaaccttggctyagcagtgtttaggaatatccctgtaataatcaacacttaagccattcattcatttaacagatatgtatcagacccccactgtgcaccagggattgttctacagccgggtcacacagcatgtcctcatgggacttaatgttcaagtagagagaggtagaccataaatagaatacataggtaacctactgtatagagcatgttagatgagaatagtgttctggagtagtatagagcagggagtgggctggcaaggtggggggttgcaattttaaacagggtgacaggggaggccatactgag

SEQ ID NO: 129106 - DNA, 601 bp, Human
ctgattccattatctaaaatcagaaacagctccttcatggtcttagcaatacccttgcccagcctcgtgtctctaccctggagctcatgtagcgtgcatctggcagtgctaatttgagacgtggcataggctttcccgctttgtctgtgaagcccctgaggacagggcccagcggcggttcacgctggttccaggcccagcccctcacctgcatagaaccttggctcagcagtgtttaggaatatccctgtaataatcaacacttaagccattcattcatttaacagatatgtatcagacmcccactgtgcaccagggattgttctacagccgggtcacacagcatgtcctcatgggacttaatgttcaagtagagagaggtagaccataaatagaatacataggtaacctactgtatagagcatgttagatgagaatagtgttctggagtagtatagagcagggagtgggctggcaaggtggggggttgcaattttaaacagggtgacaggggaggccatactgagaaggtgacagttgaatcaagacggaggagaggtgaaggaacaagttgcacaggtatctggggagcatcctagtt

SEQ ID NO: 129107 - DNA, 601 bp, Human
aaggtaggcagcaaacacctggctaagtgagtctggtgctcaggagacaaatgtggagtggagtgtcgacttaagacagcatgtcagggacctggttaaggctttgggaatgaatgaacctatcctgggagaaaagggagaagagaagaccaaagacagagttctggacaaccccaacattggaggtctgggaagagaaggggcccacaggagaaaccggacgtggtgtgatagaaattaagaacaggaacagtgatgggtgagaggctcgggggcaggagtgagagggtctgaggaggawgttcaacagcgttggggatacaaaggacagggatgtgaccttctgggcttttatttggaggcacttaggtgtgaaagaattcagagaaagtggaagtcacgtttaagatccagagagtatttttctttctttttttaagagacagggtctcgttttgttgcccaggctggtcttgaatgcctggcttcaagctgtcctcctgcctcagcctcccaaagtgctaggattacaagtgcaagccactgcactcagccttgttttgttttgtttttgtttgttttttgttttttaaggagactt

SEQ ID NO: 129108 - DNA, 601 bp, Human
acttaagacagcatgtcagggacctggttaaggctttgggaatgaatgaacctatcctgggagaaaagggagaagagaagaccaaagacagagttctggacaaccccaacattggaggtctgggaagagaaggggcccacaggagaaaccggacgtggtgtgatagaaattaagaacaggaacagtgatgggtgagaggctcgggggcaggagtgagagggtctgaggaggaagttcaacagcgttggggatacaaaggacagggatgtgaccttctgggcttttatttggaggcacttargtgtgaaagaattcagagaaagtggaagtcacgtttaagatccagagagtatttttctttctttttttaagagacagggtctcgttttgttgcccaggctggtcttgaatgcctggcttcaagctgtcctcctgcctcagcctcccaaagtgctaggattacaagtgcaagccactgcactcagccttgttttgttttgtttttgtttgttttttgttttttaaggagacttgagtctgactgaacctgaagagaagtgatcattaaaaataaaaatgcagctgagcatggtgactcatg

SEQ ID NO: 129109 - DNA, 601 bp, Human
taaaaatgcagctgagcatggtgactcatgtctgtaatcccagcactttgggaggtgaaggtgggaggactgcttgaggctaggagttcaagaccagcctgggcaacacagcaggacccctgtctctgcaaaataaaaattaaattagccaggcacgatggtgcgtgcctgtggccccaactactcaagaggctgatgtgggaagatcacatgaggccaggagttccaggctgcagggagcttgatcacatcattgtacactccagctgaggtgacagtgcaagatcctgtctctgaaaartaataataataaatgcagaagagagagaaaataatgaatgctgttgggtggagtgaggcctgggacagtagaagacagtgtgaaatggagggacctagttggggattggccagagaacgggactttatactcctgagatggaagggaggagttaagggtgaagcgttgtattcctttcctgtggctgccctaacaaattaccacaaaccgggtggttttaaaaaacagaaatttttttttgagacttaggtgtatccattactctgtgccaagaactgttctgagtgctatataggtatt

SEQ ID NO: 129110 - DNA, 601 bp, Human
tgcctgtggccccaactactcaagaggctgatgtgggaagatcacatgaggccaggagttccaggctgcagggagcttgatcacatcattgtacactccagctgaggtgacagtgcaagatcctgtctctgaaaaataataataataaatgcagaagagagagaaaataatgaatgctgttgggtggagtgaggcctgggacagtagaagacagtgtgaaatggagggacctagttggggattggccagagaacgggactttatactcctgagatggaagggaggagttaagggtgaagcrttgtattcctttcctgtggctgccctaacaaattaccacaaaccgggtggttttaaaaaacagaaatttttttttgagacttaggtgtatccattactctgtgccaagaactgttctgagtgctatataggtattaaatgatttaatctttccatcaagcatattttcaggaaacagaggcacagagaattaagaaacttgcccaaggtcgagggcagagccgggattcaaaccctggaagtctggctctagagcctctgcttctaaccactatcctctcccgctgctgtgtgatattat

SEQ ID NO: 129111 - DNA, 601 bp, Human
aacagaaatttttttttgagacttaggtgtatccattactctgtgccaagaactgttctgagtgctatataggtattaaatgatttaatctttccatcaagcatattttcaggaaacagaggcacagagaattaagaaacttgcccaaggtcgagggcagagccgggattcaaaccctggaagtctggctctagagcctctgcttctaaccactatcctctcccgctgctgtgtgatattattaccctatattctgatgtttctgcctccctcaccaattcaggaaccctaagggaaggamgtttgtgttgctcttctctgtgcccatagtacctatcacattgcacagtagggtgaatacatttgttgaattgctgagccatttatgacccagagagttagtaaaatgttgtccttgtttgtcaagggaacaaatgagcctaaagcttaaatcaaactctattacctccataaattctcctctgcctgtttcagccccctctgatctatgtcagcaacatagattaacacttgatgaatctatataaatatcaagcatgttgatcttttctttctcaaaactagattacagaccccttga

SEQ ID NO: 129112 - DNA, 601 bp, Human
tagaaatttgggagttgctagtgagttaagttcatctgcaaaaaaatatatatatatgtgtgtgtgtgtgtatatatatgatattgcttatactttctctaaaatactgagagatatgtggtctctgtctctgtatatattacatgtatacatacatatacatatgtatgtattatatacataatatatacatatatattatatatgtatatataatcttatatattatatataagattatatattatatatatataagattacatattatatatgtatatatatatctttttttttttttgagaacaagtctcactctgtcacctaggctggagtgcagtggcacgatcttggctcactgcaacccctgcctcccaggttcaagcgattcttctgccttagcctcccgagtagctgggattacaggtgcccaccaccacacccagcgaatttttgtatttttagtagagacaaagtttcaccatgttggccaggctggtctcgaactcctgacctcaggtgatccacccacgttggcctcccaaagtgctgggattacaggcatgagtcacggggcccagccatatattatgtatctcca

SEQ ID NO: 129113 - DNA, 601 bp, Human
tatatacatatatattatatatgtatatataatcttatatattatatataagattatatattatatatatataagattacatattatatatgtatatatatatctttttttttttttgagaacaagtctcactctgtcacctaggctggagtgcagtggcacgatcttggctcactgcaacccctgcctcccaggttcaagcgattcttctgccttagcctcccgagtagctgggattacaggtgcccaccaccacacccagcgaatttttgtatttttagtagagacaaagtttcaccaygttggccaggctggtctcgaactcctgacctcaggtgatccacccacgttggcctcccaaagtgctgggattacaggcatgagtcacggggcccagccatatattatgtatctccatctatcttatctccttagttaagtaccttagagaagagatccttctggcctcgccaaagttctacatattaaagaattaggaaaagaaactgggctttgaatgcttatgcctggtgttttcatttttgcaactaaatcagaatcagatttgaagcatcactgaaatgattctgatttttggttg

SEQ ID NO: 129114 - DNA, 601 bp, Human
gttttgttttgagacagagtctcactccgtcacccaggctggagtgtagtagtgtgatctcggcaactgcaacctccacctcccaggttcaaacaattttcctgctatcatcatgtgactctctgcttggtctgcatgttgaagcaatagcagactttgggactggaacttggcttcggaaacaccctcagagagggtccacatggccacatggtgtgtttattcttataatctctctgagacaactatttgggtataacacttccagatgtagttaaaactacagcactttggccaggtrcggtgctcacgcctgtaatcccagaactttgggaggccgaggtgggcagatcacctgaggtcaggagttcaagaccagcctgaccaacatggagaaaccccatctctactaaaaatacaaaattagccaggtatggtggtgcatgcctgtaatcccagctactggggaggctgaggcaggagaattgcttgaaccctggaggcagaggtcgcagtgagccgagatcacgccattgcactccagcctgggcaatgagagctaaactccatctccaaaacaaaacaaaacaaaacaaaacaa

SEQ ID NO: 129115 - DNA, 601 bp, Human
tactcagggggctgaggtgagaggatcacttgagcccgggaggttgagtctgcagtgagccaagatcacaccacagcactcctgcccgggtgatagaatgagaccctgtctccagaaaaaaaaaaaaaaaaaaaaaaaaagattccctgaagtatgagacattgagagagaaagtgagagtgacatattttctcccttgaaaagttctctttggctaaccaaccctaatatcaatatttattgagaatttaccacgagttttatgtacatttatctcccatttgaccctcagtacaatgarttagggggttcccattttaccagatgaggaaactgaaatttacaaggcttaggtcatgtagctgagcacacagagctaggattagcacccaggactgtctgattccaaagcttaggttactaattattaatcattaagcaagtcttcttccttcctagtaaaccttgatacacctacacctaattggtagttagaaccatacttggagacaggcttctttcttgcaaagtggccaaataaagcctattctcctccttcttgcttcatcctttctcagtcttgtagctcatctttattgcg

SEQ ID NO: 129116 - DNA, 601 bp, Human
tctcccatttgaccctcagtacaatgagttagggggttcccattttaccagatgaggaaactgaaatttacaaggcttaggtcatgtagctgagcacacagagctaggattagcacccaggactgtctgattccaaagcttaggttactaattattaatcattaagcaagtcttcttccttcctagtaaaccttgatacacctacacctaattggtagttagaaccatacttggagacaggcttctttcttgcaaagtggccaaataaagcctattctcctccttcttgcttcatcctttstcagtcttgtagctcatctttattgcgtgtggttagtcctttccgctacgcttctcctacataaaccttctgtttgagcttgaattctagtgaaactcatctagttgctttcccagaactgttgtactttcatgccctaatccttttgctcaaatgtttcactcactgttatcctgcctatccttgaagatggatttaattaccacttttatgttgtagacttctctgactgcagttggagataatctcccttctctacattcttaacccttgatttatatgcataaattatcaccatta

SEQ ID NO: 129117 - DNA, 601 bp, Human
atctccagataattctctgggctaattagagaaaatggaagatccatctctttttccataattgggctacagcttggcactgaatcaaccctggatggtagagccttttcagctacggtatttagcaactcttacaccattcattgaatttatttctggattttccccctccaagtgtcctttcacatccttatccaaattctgcccacttctctccctgtctggagattatttctatgataagaaattaattagcctgtctgtactacctgttccaggagactttgaacaactgcgtggrtaaacactagatgtggtcaccaaagagtcggaaaataagtttttactttttcattagcaaaagttaattgtcaaccaggagatgtaacaggcttgctccatttctgctgccgcttcttggatttctttcttgcatgtggagaatttcctgaggtttcaccagactgaagagattctgagttcttgaagtgatggagataaagatcttgttgtcataaaacagcaaagagcactgtgattgggtttgaaagatttttgattgtgttatggacagtgctcttactggtttttaaaaagttga

SEQ ID NO: 129118 - DNA, 601 bp, Human
tttaatatacctttcactgtgcaatcacaacaggaagattttctaaattagacatctttaccttgaagaagaaacttgtctgtttcagtgtctttttgtagcaagattgaccaaaacaagtggtaaataagtctgtaatatttaactgtcatgaaatacctttgctaataaggaaatggcctcggtttggattaggtggagtttcgtgtgtgcgatgtgggggtgtatgtgtacatatatttcttttttttttttttttttttttgagatacagcctcactatgtcgcccaggctggagtkcagcggcatgatcttggctcactgcaacctccgcctcccaggttcaagcgattctcctgcctcagcctcccaagtagctgggattacagatgtgcaacaccatgcctagctaatttttttgtatttttaataaagatggggtttcaccatgttggccaggctggtcttgaacttctgacctcaggtgatccacctgccttggcctcccaaagagctgggattacaggggtgagccaccgcacccggcccatatttcctttttttatactggatagcaatatagggtcttgtctttcacct

SEQ ID NO: 129119 - DNA, 601 bp, Human
tcaccatgttggccaggctggtcttgaacttctgacctcaggtgatccacctgccttggcctcccaaagagctgggattacaggggtgagccaccgcacccggcccatatttcctttttttatactggatagcaatatagggtcttgtctttcaccttttaagttcacagaacagtttgtcctgaccacacataagttaccagtataatgttttatgaaggtttagaaatgagctcccagaaaaataatattttaatatctacaaataaataatctgaggatgtttctcaattcagcatcmatgctgggttgtgccttgtggatttccattggctctacgtgcaaaagattaagttagttagaatgaggaagacatttttaattactgtgaaattctttgttgttgttgttgttgtttttctttttgttttgggaaggtgtctcacactgttacccaggctggagggcagtggcatgatcttggctcacttcaaccttcacctcctgggttcaagcaattctgctgcctcagcctcccgagtagctgggattataggcatgtgccaccacgcccagctaatttttgtacttttagtttttg

SEQ ID NO: 129120 - DNA, 601 bp, Human
gccagtgctttagaataacttgcattttaaagtacatttgcacattttacatataatgctatatggttgtgtttgggctttgtgtacagatgacttttgttattaagtggaaaaggcctgaaatatgctgttctatgttaagtaaattgatataacctaagaaaagatcttgttgccaattcagaaaccataaccttaaatagcatgcctgggtctcctctgtatctggtttaacatctgcattgaatattggtattttccaataatctccaactagcttatttattttgaaaaaaaaaaatagaaatctacgtctacttttgcttaagtggaaatacttgagtaatgcttggttgcttttttaacctcaagtcagtaactgtgaaagactggacttactgcacctaagatctagaaccctgaagttatctaattggtgctcatcactgagcttgtgtaggcttcctgaagcctattcagggccctgtgtactagggaaaagggttggcagatcacagtgtgtggagtatgcagccagtaattctttcttagattctctctcccctcttagaacctcccctcatttcccagggaacatctg

SEQ ID NO: 129121 - DNA, 601 bp, Human
ggctttgtgtacagatgacttttgttattaagtggaaaaggcctgaaatatgctgttctatgttaagtaaattgatataacctaagaaaagatcttgttgccaattcagaaaccataaccttaaatagcatgcctgggtctcctctgtatctggtttaacatctgcattgaatattggtattttccaataatctccaactagcttatttattttgaaaaaaaaaaatagaaatctacgtctacttttgcttaagtggaaatacttgagtaatgcttggttgcttttttaacctcaagtcartaactgtgaaagactggacttactgcacctaagatctagaaccctgaagttatctaattggtgctcatcactgagcttgtgtaggcttcctgaagcctattcagggccctgtgtactagggaaaagggttggcagatcacagtgtgtggagtatgcagccagtaattctttcttagattctctctcccctcttagaacctcccctcatttcccagggaacatctgttttccatgagggcagtactaagggggctgaagattcccacagacatataataaaaggttccaagagtaggctgg

SEQ ID NO: 129122 - DNA, 601 bp, Human
ggcagtactaagggggctgaagattcccacagacatataataaaaggttccaagagtaggctggcggcagtggctcacgcctgtaatcccagcacttcgggaggccgaggtgtgtgaatcactaggtcaggaaatggagaccatcctggataacatggtgaaaccccctctctattaaaaatacaaaaaaaaattagctgagcgtggtggtgggcacctgtagtcccagccacttgggaggttgaggcaggagaatggcgtgaacccgggaggtggaccttgcaagtgagccaaagtggcrccactgcactccagcctgggtgacacagcaagactctgtctcaaaaaagaaaaaaaaaaatagattccaagagtaaacaaaatcctcaagtgttactgtgcaaagattatactcaccatgtttgatttttttggtctctggtggtcatcccagatgcattcacagtcatttctggacctttaatgtaatccactgttgttattaaatgagctgatccacatggagttactttttgaaatcatgaagttccttatgaatgtttgttattgtgtcttaaattctttaaattcttaaaatatg

SEQ ID NO: 129123 - DNA, 601 bp, Human
taatcccagcacttcgggaggccgaggtgtgtgaatcactaggtcaggaaatggagaccatcctggataacatggtgaaaccccctctctattaaaaatacaaaaaaaaattagctgagcgtggtggtgggcacctgtagtcccagccacttgggaggttgaggcaggagaatggcgtgaacccgggaggtggaccttgcaagtgagccaaagtggcgccactgcactccagcctgggtgacacagcaagactctgtctcaaaaaagaaaaaaaaaaatagattccaagagtaaacaaaaycctcaagtgttactgtgcaaagattatactcaccatgtttgatttttttggtctctggtggtcatcccagatgcattcacagtcatttctggacctttaatgtaatccactgttgttattaaatgagctgatccacatggagttactttttgaaatcatgaagttccttatgaatgtttgttattgtgtcttaaattctttaaattcttaaaatatgtcttaactcacttaaagataaaagtaaatgtttctgtggtccttctgggagtggggaaagttacaactccacaaatgttaaga

SEQ ID NO: 129124 - DNA, 601 bp, Human
tgacacagcaagactctgtctcaaaaaagaaaaaaaaaaatagattccaagagtaaacaaaatcctcaagtgttactgtgcaaagattatactcaccatgtttgatttttttggtctctggtggtcatcccagatgcattcacagtcatttctggacctttaatgtaatccactgttgttattaaatgagctgatccacatggagttactttttgaaatcatgaagttccttatgaatgtttgttattgtgtcttaaattctttaaattcttaaaatatgtcttaactcacttaaagataraagtaaatgtttctgtggtccttctgggagtggggaaagttacaactccacaaatgttaagagagaagggtgaacagttagcagtcaggcagcatggttgggagtcatgaggaagagcattcaagatgacacaagttttgtaagcagacctaaggaacgggctgaagaatgttgtggagacccaggtacttagacttagcattctgagttcagagttcgcccaggagttccaggcttgtggcaggtttagaaaatccaggatgatcggccaccttctttctcccagaggtcgatctgatc

SEQ ID NO: 129125 - DNA, 601 bp, Human
cccaggtacttagacttagcattctgagttcagagttcgcccaggagttccaggcttgtggcaggtttagaaaatccaggatgatcggccaccttctttctcccagaggtcgatctgatcttaagttgtacctgactaaaacctgctgcaggagagatggtcagattttatttacacacagggagatggcttcctaagattgtgtagtgaaccaagaaggtgtttacaggcatgtgaaactggctattgtaaagaggcagtgatctgggacacgtgatgttagttaaagtggaggaaaagstgtacccttcaagcagaggattccagggcctctccaaaccgtacaagtctgagccaagggacagaaattccatcagtggcttggaagccaaatatttgccctgatactgaggaagggaaagagtggaacgtgaccgtgggatagataaagggtcttcacaggaatgcaaacaagatgataggtagaatcacccatgagattagcaaacaaatcactttaagaggaaaaaagtagaataaagagagtcaaccacaggtagaaaatgcaagactttggaatccacaagtcatagatatgtat

SEQ ID NO: 129126 - DNA, 601 bp, Human
ccacagcctctagctatataccagcaggaccatctcctgctgttcacacaagcctagccctaggcctctacatctagaaagcattgcccgtgcatctaccagcctttcttccatgcaaggagggcaaatgtggctggcggagaaggcacctagaataccagtggcagcttctctgtctccccactataatttaggactcttctaattgtaagcaacagaaaatccagttcaaacaggcttaatccagaaaggtgtaaggaggcgggggtgacatataaaatttatggctcagataccatargagtctagaaacagtacctggcttccagtacaggggtttaatatcatctggacctgttgtctccttacatacagtctctttacacctgtgtcattttcactcccaagcaagactcttccctggtgttgatacagctgccagcacaggtcaaggtttctttttcccagttccacacccagcaggagagataaagtttctgatccctattagttcaaacaagactccatggccttagccttaggctaactcagccctgagtcagagctccattcctcaatatagtcttgggaccaaaggaac

SEQ ID NO: 129127 - DNA, 601 bp, Human
tccctggtgttgatacagctgccagcacaggtcaaggtttctttttcccagttccacacccagcaggagagataaagtttctgatccctattagttcaaacaagactccatggccttagccttaggctaactcagccctgagtcagagctccattcctcaatatagtcttgggaccaaaggaacatggtgatctgattggctagaccagggtccctccctcatcctaccatgttcccccaagcttctggactacttagggcttcagctccaccgtaaacaaattgagagttagaaggtatsctgttcactgcagggacaagggatactgtcccttagcaagagcaacagacctgccttttatctgttatgttcttgagctatttcctgaaagcaatcaatacaacactcataagttaaattttattgaattcatagttacaaaagccaggaagtcgtttagttattaaccacatggtttgaaattgatggaattgagacagaaatcactttaaaaactgagagagggtgtcatagtctgttctggctgctgtaacaacatcccacagactacgtagcttataaacaacagacatttatttc

SEQ ID NO: 129128 - DNA, 601 bp, Human
gtcgtttagttattaaccacatggtttgaaattgatggaattgagacagaaatcactttaaaaactgagagagggtgtcatagtctgttctggctgctgtaacaacatcccacagactacgtagcttataaacaacagacatttatttcttatagttctggaggccaggatgtccaagatcaaggtgccattagattccgtgtctgctgagggcccacctcctggctcatgaatgatgccttctagctgtttcctcacacagtggaagtggcaaggcagctctctgggactctttcaaaarggcactaatcccattcaggagggctctcccctcacgacctaatcacctctcaagggccccaccttctaacaccatcacattgatgattaggtttcaaaatatgaatttgaaggaggacatacacattcataccatagcagaggagaagaaaaattaagcatgttttgccttaaactcttaagaattctacacacacacacacacacacacacacacacacactacactacactacagcttatatttaatgctgaaagtctgaatgctttccccctaagagcaggaataaggcaaaggtgt

SEQ ID NO: 129129 - DNA, 601 bp, Human
aaggaggacatacacattcataccatagcagaggagaagaaaaattaagcatgttttgccttaaactcttaagaattctacacacacacacacacacacacacacacacacactacactacactacagcttatatttaatgctgaaagtctgaatgctttccccctaagagcaggaataaggcaaaggtgtccattctcaccatttcttttgaatatctcactggaaacctgggccagtgcaacagggcaagaaaaagaaataaaaggcattttgaaaagaaagaaacaaaactgtccctrttcacagatggcatgattttctacacaggaaatcccaagaaattacaaaataaattttaagactaataagtgattttagcagggctgcaagatacaaggttaacacacaaaaatcacttgttatttctatatgttaacaatgtacaactgaaaatggaaatttaaatacattgtgtgacatagctccaaaaggtaaggattaggtatgtaacaaaatatatataggatctatactctgacaattataaaacactgatgaaagaaatcaatgaatgccaaagtaaatggagagacataagt

SEQ ID NO: 129130 - DNA, 601 bp, Human
gtccctattcacagatggcatgattttctacacaggaaatcccaagaaattacaaaataaattttaagactaataagtgattttagcagggctgcaagatacaaggttaacacacaaaaatcacttgttatttctatatgttaacaatgtacaactgaaaatggaaatttaaatacattgtgtgacatagctccaaaaggtaaggattaggtatgtaacaaaatatatataggatctatactctgacaattataaaacactgatgaaagaaatcaatgaatgccaaagtaaatggagagayataagttgttcatggattggatgactcaacatagtaatgatgtcagttctcccataattgatgtatagatttaatgcaattctgatctaaatcccagcagggatttttgtagatatatcagacaagctgattctaaaattcatatggaggcagggtgcggtggctcacacctgtaatcccagcacttcgggaggctgaggtgggcagattgcttgagctcaggaattgaacaccatcttgggcaacgtggcaaaactctacaaaaaaatacaaaacttagccaggcatggtggcatgcgc

SEQ ID NO: 129131 - DNA, 601 bp, Human
tccctattcacagatggcatgattttctacacaggaaatcccaagaaattacaaaataaattttaagactaataagtgattttagcagggctgcaagatacaaggttaacacacaaaaatcacttgttatttctatatgttaacaatgtacaactgaaaatggaaatttaaatacattgtgtgacatagctccaaaaggtaaggattaggtatgtaacaaaatatatataggatctatactctgacaattataaaacactgatgaaagaaatcaatgaatgccaaagtaaatggagagacrtaagttgttcatggattggatgactcaacatagtaatgatgtcagttctcccataattgatgtatagatttaatgcaattctgatctaaatcccagcagggatttttgtagatatatcagacaagctgattctaaaattcatatggaggcagggtgcggtggctcacacctgtaatcccagcacttcgggaggctgaggtgggcagattgcttgagctcaggaattgaacaccatcttgggcaacgtggcaaaactctacaaaaaaatacaaaacttagccaggcatggtggcatgcgcc

SEQ ID NO: 129132 - DNA, 601 bp, Human
aatcacttgttatttctatatgttaacaatgtacaactgaaaatggaaatttaaatacattgtgtgacatagctccaaaaggtaaggattaggtatgtaacaaaatatatataggatctatactctgacaattataaaacactgatgaaagaaatcaatgaatgccaaagtaaatggagagacataagttgttcatggattggatgactcaacatagtaatgatgtcagttctcccataattgatgtatagatttaatgcaattctgatctaaatcccagcagggatttttgtagatataycagacaagctgattctaaaattcatatggaggcagggtgcggtggctcacacctgtaatcccagcacttcgggaggctgaggtgggcagattgcttgagctcaggaattgaacaccatcttgggcaacgtggcaaaactctacaaaaaaatacaaaacttagccaggcatggtggcatgcgcctgtagtcccagctacttggtaggctgaggtgggaggattgcttgagcccgggagattgaagctgcagcgagccatgatcacgccactgcactcaagcctgggtgacagagtgagatc

SEQ ID NO: 129133 - DNA, 601 bp, Human
agctccaaaaggtaaggattaggtatgtaacaaaatatatataggatctatactctgacaattataaaacactgatgaaagaaatcaatgaatgccaaagtaaatggagagacataagttgttcatggattggatgactcaacatagtaatgatgtcagttctcccataattgatgtatagatttaatgcaattctgatctaaatcccagcagggatttttgtagatatatcagacaagctgattctaaaattcatatggaggcagggtgcggtggctcacacctgtaatcccagcacttygggaggctgaggtgggcagattgcttgagctcaggaattgaacaccatcttgggcaacgtggcaaaactctacaaaaaaatacaaaacttagccaggcatggtggcatgcgcctgtagtcccagctacttggtaggctgaggtgggaggattgcttgagcccgggagattgaagctgcagcgagccatgatcacgccactgcactcaagcctgggtgacagagtgagatcctgtctccaaaaaaaacaaacaacaaataaaactcatatggaaagataaaggcattagaagagctaaaat

SEQ ID NO: 129134 - DNA, 601 bp, Human
gaaatcaatgaatgccaaagtaaatggagagacataagttgttcatggattggatgactcaacatagtaatgatgtcagttctcccataattgatgtatagatttaatgcaattctgatctaaatcccagcagggatttttgtagatatatcagacaagctgattctaaaattcatatggaggcagggtgcggtggctcacacctgtaatcccagcacttcgggaggctgaggtgggcagattgcttgagctcaggaattgaacaccatcttgggcaacgtggcaaaactctacaaaaaamtacaaaacttagccaggcatggtggcatgcgcctgtagtcccagctacttggtaggctgaggtgggaggattgcttgagcccgggagattgaagctgcagcgagccatgatcacgccactgcactcaagcctgggtgacagagtgagatcctgtctccaaaaaaaacaaacaacaaataaaactcatatggaaagataaaggcattagaagagctaaaataattatgaaaaagaagaaagttggaggaatcatcctatcttatttcaatatggttttcaagatatcaagtgtaatattgg

SEQ ID NO: 129135 - DNA, 601 bp, Human
agcctgggtgacagagtgagatcctgtctccaaaaaaaacaaacaacaaataaaactcatatggaaagataaaggcattagaagagctaaaataattatgaaaaagaagaaagttggaggaatcatcctatcttatttcaatatggttttcaagatatcaagtgtaatattggtgaaaaggtagacatggcaaaaactgcaattacttttgcaccaacctaatagatgaatgaagcagaacagagattccagaaatagacccatagaaatatgcccagttggtcttttttatttttttttwaattgagacagggtctcactctgtctcccaggttggagtgcagcagcatgattgtagctcattgcagccttgaactcctgggctcaagaagtcctcctgcttcagactctcaaagtgctgagattgcaggtgtgagccactgtacctggccctccaattgatttttgacaaaggtgcaaaagctattcaaagagcaaaggatagtctttccaacaaatggtattggaacaactagacatcatatgcagaaaaaaaaatgaacctcaacctaaaatcacattacattcaaaaattaactcc

SEQ ID NO: 129136 - DNA, 601 bp, Human
aaatgttcagcatcgttggccgttagggaaaagtgaattaaaaccacaataagatgccagtaaatacctattagagtggctaaaaaaaaatacaacaccaagtgctgatgaggatgtggagcaactggtactattaaacactgctgatatgggaatataaaatggtacagccactctaaaaaacaatttggcactttcttatcaccttaaatacagctttatgatatggcacagcagtcccactcctgtgtataggtcctagagaaaggaaaacatgttcacacaaaaatctgtatgtgartgtttatagcagcactctgcataatcaatcaaaatgggagacgagtcaaatattcttcaataagtaaataaactactgtctatccataaaacgtgatctattcagcaagagaaaggaacataccattgatacgtacaaaactcagatgaatcttagaggcattatagtcagtgaaaaaaccagtctcacaacttacatagaatatgattccatctgcatgatagcctcaaaaagacaaaaccatagtggtggaaaacagactagtggttgctagaggttaggaatggagaaaggtgtgac

SEQ ID NO: 129137 - DNA, 601 bp, Human
acatagaatatgattccatctgcatgatagcctcaaaaagacaaaaccatagtggtggaaaacagactagtggttgctagaggttaggaatggagaaaggtgtgactagaaagatacagcatgagagagctctttggcgtgatggagctgttctatattctaattttgatggtggctataagaattttaacatgttaaccatagaactgtacactaaaatagtcaattttattgtatgatcaacacatgtacacacacatacaaacatgcccttaagagtcagttggtgcatacatgtccrgcatttgcaagagagggtctgtgtttactggtggggaattcctgttttctactgagttctcatccctgaaaagagcaaaaccttgagtggcctgatgctgccgtaattcccattgaggatatctgacctaattgttttgggtattgttgggcatggaaggttcactaacatcttaagataacattcacacggccagccagagcctccctggttatctggcttggggacgcacatgtcacatggatcttggaggaggttgggaaggctttccaaatacacttgggctgagttttgaagtca

SEQ ID NO: 129138 - DNA, 601 bp, Human
gggtgggtcagagagcttgcatgccaccctatgttaggggaccactgaaggggctttaagctggagagtgactccgccagatttgcatcctggaaagatagctctgacttagtttgcagaatgaactggcagagacaagattgtatgcagaaagagttttaggaagttgatgaagtagccttggtgagaaatgcagcggacctgaaccaagacagtgtcagaggccatcactcactttacattacattacattactttacattacagtgtaaaggccatcactcacttgtcttctgactgsgctggcaggattcaagcagccggggctcctgtatcccttttctcgctgactctctctctcctcttctctttctctctctctctcccccaacccccacccccactatactccctcttgctctggttttcccatgttgcctctccagcatggcagcttcaaggcagctggacttcttacatgatgcttcagggcttcaaagtgagtgtcccaagaagaaaactaatcagatgctggcctcttctaacctatctcagatttcacatagcctcactactgctgcattttgtctatcaaggtgat

SEQ ID NO: 129139 - DNA, 601 bp, Human
ctctctctcccccaacccccacccccactatactccctcttgctctggttttcccatgttgcctctccagcatggcagcttcaaggcagctggacttcttacatgatgcttcagggcttcaaagtgagtgtcccaagaagaaaactaatcagatgctggcctcttctaacctatctcagatttcacatagcctcactactgctgcattttgtctatcaaggtgatcacgaaggccaacccagcttcaagagacagggacagagcctccattttctgatgggaagagtatcagatattctayaggcctatttttaaagtaccaggggacccagaatgaaaagtctgaggttttctgaagggaggatagatacgtttatttttcctttgttgggtctcatgtgcaggtatccaggtagagtcccagcaggtaattgtatattgagtttgtcactggggaaacagcatgaggcaacagatagagatggaaatggaagctataaaaacagatgggatccctgtgggagagtgtgctgcccaagaagagggtggaagacaaacccttgatgaacatcaacatcagtgtgaagcacaatgtcaaagg

SEQ ID NO: 129140 - DNA, 601 bp, Human
cccaagaagaaaactaatcagatgctggcctcttctaacctatctcagatttcacatagcctcactactgctgcattttgtctatcaaggtgatcacgaaggccaacccagcttcaagagacagggacagagcctccattttctgatgggaagagtatcagatattctataggcctatttttaaagtaccaggggacccagaatgaaaagtctgaggttttctgaagggaggatagatacgtttatttttcctttgttgggtctcatgtgcaggtatccaggtagagtcccagcaggtaaytgtatattgagtttgtcactggggaaacagcatgaggcaacagatagagatggaaatggaagctataaaaacagatgggatccctgtgggagagtgtgctgcccaagaagagggtggaagacaaacccttgatgaacatcaacatcagtgtgaagcacaatgtcaaaggtggagagatgagaacttatccagctggctgagttcctctagacatccaactggttttcactcctagagtactgcagtctgagacttctctgggattcagtattctcttggtaaaagagtcatctttccagc

SEQ ID NO: 129141 - DNA, 601 bp, Human
gatattctataggcctatttttaaagtaccaggggacccagaatgaaaagtctgaggttttctgaagggaggatagatacgtttatttttcctttgttgggtctcatgtgcaggtatccaggtagagtcccagcaggtaattgtatattgagtttgtcactggggaaacagcatgaggcaacagatagagatggaaatggaagctataaaaacagatgggatccctgtgggagagtgtgctgcccaagaagagggtggaagacaaacccttgatgaacatcaacatcagtgtgaagcacartgtcaaaggtggagagatgagaacttatccagctggctgagttcctctagacatccaactggttttcactcctagagtactgcagtctgagacttctctgggattcagtattctcttggtaaaagagtcatctttccagcaggactgaacccttgcttgcccagatcaagggtcctcttccacctctcacagctggctgctgagtcagaacctcctaccttcctcccaaggccaggctgtgttgtggagccttctgtcctgtgtgtttccagtatgggacaaggcactagatcctccacc

SEQ ID NO: 129142 - DNA, 601 bp, Human
atagatacgtttatttttcctttgttgggtctcatgtgcaggtatccaggtagagtcccagcaggtaattgtatattgagtttgtcactggggaaacagcatgaggcaacagatagagatggaaatggaagctataaaaacagatgggatccctgtgggagagtgtgctgcccaagaagagggtggaagacaaacccttgatgaacatcaacatcagtgtgaagcacaatgtcaaaggtggagagatgagaacttatccagctggctgagttcctctagacatccaactggttttcactcytagagtactgcagtctgagacttctctgggattcagtattctcttggtaaaagagtcatctttccagcaggactgaacccttgcttgcccagatcaagggtcctcttccacctctcacagctggctgctgagtcagaacctcctaccttcctcccaaggccaggctgtgttgtggagccttctgtcctgtgtgtttccagtatgggacaaggcactagatcctccaccctcttcccagttagctatgttccctggagtaaaagagtctttgaacaagttgttaggaaagtttctcctctt

SEQ ID NO: 129143 - DNA, 601 bp, Human
gcttgcccagatcaagggtcctcttccacctctcacagctggctgctgagtcagaacctcctaccttcctcccaaggccaggctgtgttgtggagccttctgtcctgtgtgtttccagtatgggacaaggcactagatcctccaccctcttcccagttagctatgttccctggagtaaaagagtctttgaacaagttgttaggaaagtttctcctcttcaaccacttcaaaatgtccttttgagtgtaagccacatccaaataattagtcttcagttccagatcctgttagagagccacaytggtacaggagctttcctgattcctcttttgtgagttgccataaagaaagaggaaatgacctataatctatgaaagagccaggttctaaaacagatcattctgacttcagagctcagcccttcaccctaggcatccctccaagagacaccagcatgaacttacccagaacgggcctgaacatttgaacaactgaacacaatacaccccagctggctcctggcagattgcactccagtgtggtgagtttaatttgagcaagcagttgaaataaaacagggctggctgtggggatgtggcag

SEQ ID NO: 129144 - DNA, 601 bp, Human
gcactccagtgtggtgagtttaatttgagcaagcagttgaaataaaacagggctggctgtggggatgtggcagagccagaatggcttctcttgatcttttttttctctctgggaaacaagatgaattaatgaactgattcatactcccttttacccaaagtctgaaataaaccacccttatcatctcatcaaacctttacccgacccaaactatggatctgggattcttactcttctcttgccttcaatctatcccactcctgatgaagttccttcccaacttccaatcccatgggcttcrctttcctgcctataaacagctgtcaactgcctgatttccctatgctaatccattctacacattttaaccaggcttttctccaatctaggctggcttttacacaaacatgttcaatggctattcattatccttaaaaactaatctttgtatattatagtttaacacacggtttatctcattttatcctcacaatgaacccattatatggaagggaacttagggtcagagaagtataaattctcctccctggcattcaagggctttcatggtgtgccccaagtgatttcctagtcttggttt

SEQ ID NO: 129145 - DNA, 601 bp, Human
accacccttatcatctcatcaaacctttacccgacccaaactatggatctgggattcttactcttctcttgccttcaatctatcccactcctgatgaagttccttcccaacttccaatcccatgggcttcactttcctgcctataaacagctgtcaactgcctgatttccctatgctaatccattctacacattttaaccaggcttttctccaatctaggctggcttttacacaaacatgttcaatggctattcattatccttaaaaactaatctttgtatattatagtttaacacacggyttatctcattttatcctcacaatgaacccattatatggaagggaacttagggtcagagaagtataaattctcctccctggcattcaagggctttcatggtgtgccccaagtgatttcctagtcttggttttctaaaccacccctcaagcaccagccaaactactgactgaacacactcttatcacctctttatggaagaaacagaactttggtgtccaacagaactggatatcgaagctggccatgtgactttggacaagtttcctaacctgtgttacattattatctttatctgtaaat

SEQ ID NO: 129146 - DNA, 601 bp, Human
taccagaatgaaagatgacagccaggaggaagtttgcttgcagaggtatgtgggctgagctcacaaaatttaacaattgtttttagcttttgttcacattttaaaaattgggtggtctcacacaaagacctagatttttagtttctctttaaaaattcaggagaaaaggccaccatggaccctcactttcatgtgatggggcttgggcagagacatcaagaccaccacagacccatgggcctgcttccctcacttctgccctgatccctgtagccttgtacgtttgcagtctttgatgtcractgaaaattgttgaaatgtatttcaaccctatctttaagaatgaagttgtagccgagcacggtggctcacgcctgtaatcccagcactttgggaggctgagacaggtggatcacttgaggtcaggagttcaagaccagcctggccaacatggggaaactccatctctactaaaaataaataataaaaaaacttagccaagcatggtggtgggtgcctgtaatcccagctactcaggaggctgaggcaggagaattgctgaacctgggaggcagaggttgcagtgagccgagatctcacc

SEQ ID NO: 129147 - DNA, 601 bp, Human
gaaagatgacagccaggaggaagtttgcttgcagaggtatgtgggctgagctcacaaaatttaacaattgtttttagcttttgttcacattttaaaaattgggtggtctcacacaaagacctagatttttagtttctctttaaaaattcaggagaaaaggccaccatggaccctcactttcatgtgatggggcttgggcagagacatcaagaccaccacagacccatgggcctgcttccctcacttctgccctgatccctgtagccttgtacgtttgcagtctttgatgtcaactgaaaaktgttgaaatgtatttcaaccctatctttaagaatgaagttgtagccgagcacggtggctcacgcctgtaatcccagcactttgggaggctgagacaggtggatcacttgaggtcaggagttcaagaccagcctggccaacatggggaaactccatctctactaaaaataaataataaaaaaacttagccaagcatggtggtgggtgcctgtaatcccagctactcaggaggctgaggcaggagaattgctgaacctgggaggcagaggttgcagtgagccgagatctcaccattgcactc

SEQ ID NO: 129148 - DNA, 601 bp, Human
aggagaattgctgaacctgggaggcagaggttgcagtgagccgagatctcaccattgcactccagcctaggtgaaagagcgatactccccctcaaaaaaaaaaaaaaaaaaaaaaaaagaatgaagtccttactttttttttgattttaggacagatgaccaaggaggtgttacttccttgagtggtgaaaaggttcttctactgcatggggttttttgtggttttgttttttttttgtttttgagataaggtctcactctgtcacccaggctggagtgcagtggcatgatctcagctcartgaagcctcagcagcctgagctcaagcgatcatcccactttagcttccctaatagctgggattacacacgtgggccactgcgcctggcctacagtatggtttttaaatatctttgtgctctccctctgtagacatctttcatttgcttagaatctgtggtgatggaggcctcatgccctattccaactccagctgcctgtcaatgtagtgtctgtagcttctttcacatggagaagctatcagtcccattctgtccatcaaggtagagtgaaaaatatcaggtcactctgctgcctctac

SEQ ID NO: 129149 - DNA, 601 bp, Human
gagatctcaccattgcactccagcctaggtgaaagagcgatactccccctcaaaaaaaaaaaaaaaaaaaaaaaaagaatgaagtccttactttttttttgattttaggacagatgaccaaggaggtgttacttccttgagtggtgaaaaggttcttctactgcatggggttttttgtggttttgttttttttttgtttttgagataaggtctcactctgtcacccaggctggagtgcagtggcatgatctcagctcagtgaagcctcagcagcctgagctcaagcgatcatcccactttrgcttccctaatagctgggattacacacgtgggccactgcgcctggcctacagtatggtttttaaatatctttgtgctctccctctgtagacatctttcatttgcttagaatctgtggtgatggaggcctcatgccctattccaactccagctgcctgtcaatgtagtgtctgtagcttctttcacatggagaagctatcagtcccattctgtccatcaaggtagagtgaaaaatatcaggtcactctgctgcctctaccacctttcagcactgatggctccactccctgaggggagaggc

SEQ ID NO: 129150 - DNA, 601 bp, Human
aatatctttgtgctctccctctgtagacatctttcatttgcttagaatctgtggtgatggaggcctcatgccctattccaactccagctgcctgtcaatgtagtgtctgtagcttctttcacatggagaagctatcagtcccattctgtccatcaaggtagagtgaaaaatatcaggtcactctgctgcctctaccacctttcagcactgatggctccactccctgaggggagaggcacaagtgacagggaaggaagaaagaagaagaattttctcactttgtgatttattgcatttaatyctcaccctgagtctgagttgggtatcattccttcttgacttatagcaaaatcaaggcacatagaggctgtcctttatgctccatcccaaagctagaaaataaatgatgagtggtttgggcccggttgtgtctaattgtgtcatgttttttcactattctgtctgccttagggtctccaacccctttcagctgtatttataagactgatgtttgcagaactgtttattagtttgcaggactgtttattagacaactacaaacggagctgaaataaaactttggtttctgtttgctctaaag

SEQ ID NO: 129151 - DNA, 601 bp, Human
gtttattagtttgcaggactgtttattagacaactacaaacggagctgaaataaaactttggtttctgtttgctctaaagagaagtttctgttcaatcctccactgggagtgtgtctttaggcctctaaattttataccataactatttgtataatttgaatggtctccaatgaaatggatacaaataataataaatacattctaaaatagcaataatgcatgacattggtttagatcacagtgtttcctatgtacattttctctttgggttcacccaacattctcgagataccctcactsaagtttttagataaagcaatcaaaaagcaagaggatttaaatgacataggtaagtatgcatgtggtagaaatggaattagaatccagattcttagctcctcttttcattatctgatcctgcttggtttttactcacaccaggcaataattttgaaagctctgctctctctacttgtgatattattatctgttgttattattcaatcataaatatttattgagccttcctgcaggccaagggcagggctaagtcctgtgcattcattatttcacttaatgctcaggacagccatatgacat

SEQ ID NO: 129152 - DNA, 601 bp, Human
caaagggagcggccccacttgtttgcatgttgattgaaccataccttagtgtccagttgcttgaggcttgcagcagcatctttatgctcttcaaagtgagtgctgccattggtagcaaggtcttatggatgcccttgctaggcccatttccttctttgttattccaagtatacttctaatgaatcagaacctgcctcttttttttttttttttttttttgagatggagtcttactctgtcgcccaggctggagtgcagtggcacaatctcagctcactgcaagctctgcctcctgggttcrtgccattctcctgcctaagcctcccgagtagctgggactacaggcgcccaccaccacgcccggctaattttttgtattttctgtagagatggggtttcactgagttagccaggatggtctcgatctcctgaccttgtgatctgcccgcctcagcctcccaaagtgctgggattacaggtgtgagccaccacgcctggcctgaacctgccttttaacaagaccccaaggtgattcaaggcacatcaaagtttaagaagcatagatttacattatattctgtctatccctgcacatctcaca

SEQ ID NO: 129153 - DNA, 601 bp, Human
tggccaatgcattgtataaattaggtgatctgtaaatgattgttggctaattgatcctatgtgcatacatgggaatacttggaaaagcaatgattgttttaatataacaagttcttgatgtagcaagattgttcctatacattgtggaactctcaattttaatatttactgactccattatccatcttaaaatgggcatatcggaaagggtaaggaataaataattgatggtggtgtcacacatctagtaatatgatagttgagctaatatgaattggttctcccaccatctcaaacacawagaaatacaaaagtcccctccagaccaatgcagagccaaacccaaactcaaaagcaataaaggaaatgcccttgtgccagaaataaaaagggaactcaaagccagaagtataaacaagatctggtgctaaggtctagacctgtcttaatctgttttgtgtggctgtaatagaagacctgagactgggtaacttataaagaaaagatgtttatttaggtcacagctctgtaagttgggaagttcaagggcatggccctggcttctggtgaagactttcgagctgcatcaaaatatgataga

SEQ ID NO: 129154 - DNA, 601 bp, Human
gcattgtataaattaggtgatctgtaaatgattgttggctaattgatcctatgtgcatacatgggaatacttggaaaagcaatgattgttttaatataacaagttcttgatgtagcaagattgttcctatacattgtggaactctcaattttaatatttactgactccattatccatcttaaaatgggcatatcggaaagggtaaggaataaataattgatggtggtgtcacacatctagtaatatgatagttgagctaatatgaattggttctcccaccatctcaaacacatagaaatayaaaagtcccctccagaccaatgcagagccaaacccaaactcaaaagcaataaaggaaatgcccttgtgccagaaataaaaagggaactcaaagccagaagtataaacaagatctggtgctaaggtctagacctgtcttaatctgttttgtgtggctgtaatagaagacctgagactgggtaacttataaagaaaagatgtttatttaggtcacagctctgtaagttgggaagttcaagggcatggccctggcttctggtgaagactttcgagctgcatcaaaatatgatagagaaagtca

SEQ ID NO: 129155 - DNA, 601 bp, Human
tagaacagtctgaaataatatatactaaatatgtttagaataactaaagaaaaacaggtggaatagaaactagataatagaaaaatgatagtgtgaaaaggatactgtaagttctagaaatgaaacttagagtggaattaaaaattcagtgaatgaattaaacatccagtaaatgcaactgatgtaaggactggaaactgcaagataggtgtgagaaaaatcagtcaatgcatcacagagagataaaaaatggggaatatataaaaaccctccaaggacccatagatttggaaactgaaamtcatattttttcaaagaatttacagttcaaagaaaaaaatcacaacatagatttataagatatttagaactaaacaaaagtaaaaataccatataataattcacaggacaccaacacagaatttagaaggaaatgtcttatatgcatatactgaaaaacaaaaacaaagctataattccagcactttgggaggccgaagcaggagggtcagttgaggccaagagtttgagaccagcctaggcaacacagtgagaccctgtctctacaacaaaacaaaacaacaacaaaaaaactcacaaa

SEQ ID NO: 129156 - DNA, 601 bp, Human
aggccgaagcaggagggtcagttgaggccaagagtttgagaccagcctaggcaacacagtgagaccctgtctctacaacaaaacaaaacaacaacaaaaaaactcacaaagataatgataatgagctaagcgatcaactccaaaagggagaaaaataacatagtaaacctttaaaaattagatggaaagaatttattagataagagcagaatttagacatatagaaaacaaaatagggaatgtgatatggaatactgaacagcactttgaatgaactggatctacttgtattaatattaayaaatctcaaaaacacaaaagaatttcaaaaacacaaggcaagagaatacatccagactgataccatgtgagttagatttttcaagcacaaactgacgtgagtagtagatgtataaaggcatggacaaaaagtaggctcaaattaagtgattatctaatctatctaagagaagatggaattggggaggatgcaatggaccctcaaccataatgttttatttggaaaaaaagatctgtggaggatttgttcagtctgcgtggtggatgtatacatgtttatgtatttttacttttcattgaa

SEQ ID NO: 129157 - DNA, 601 bp, Human
agatggaaagaatttattagataagagcagaatttagacatatagaaaacaaaatagggaatgtgatatggaatactgaacagcactttgaatgaactggatctacttgtattaatattaataaatctcaaaaacacaaaagaatttcaaaaacacaaggcaagagaatacatccagactgataccatgtgagttagatttttcaagcacaaactgacgtgagtagtagatgtataaaggcatggacaaaaagtaggctcaaattaagtgattatctaatctatctaagagaagatggaaytggggaggatgcaatggaccctcaaccataatgttttatttggaaaaaaagatctgtggaggatttgttcagtctgcgtggtggatgtatacatgtttatgtatttttacttttcattgaaacatttcagaatactctttcaaagaatcaataattcagattctgtatactgaatagaattctaacaaaattacaattaagaaataaagttaatgccagtgttgcatgaggtttttactcatgtggtttggttgtagtaaggaatctacaatagttgtagtaggcagttctgagacggca

SEQ ID NO: 129158 - DNA, 601 bp, Human
ggctcaaattaagtgattatctaatctatctaagagaagatggaattggggaggatgcaatggaccctcaaccataatgttttatttggaaaaaaagatctgtggaggatttgttcagtctgcgtggtggatgtatacatgtttatgtatttttacttttcattgaaacatttcagaatactctttcaaagaatcaataattcagattctgtatactgaatagaattctaacaaaattacaattaagaaataaagttaatgccagtgttgcatgaggtttttactcatgtggtttggttgkagtaaggaatctacaatagttgtagtaggcagttctgagacggcacccaagattgctacttcttggcaaacataccctgcataatccccttactttaagtgtggatatgatgggatttcacattcataattagattacattctttggcaaaggtaaagagacttttgcaaatgtaattaaagtccctaatcagttgattttgagttaatcaaaacagatgatcctgggtaggcctgacttaatcaagtggaagcccttaaagagactgggcccatcctgctgactctgaagagggaagcc

SEQ ID NO: 129159 - DNA, 601 bp, Human
tcagaatactctttcaaagaatcaataattcagattctgtatactgaatagaattctaacaaaattacaattaagaaataaagttaatgccagtgttgcatgaggtttttactcatgtggtttggttgtagtaaggaatctacaatagttgtagtaggcagttctgagacggcacccaagattgctacttcttggcaaacataccctgcataatccccttactttaagtgtggatatgatgggatttcacattcataattagattacattctttggcaaaggtaaagagacttttgcaaaygtaattaaagtccctaatcagttgattttgagttaatcaaaacagatgatcctgggtaggcctgacttaatcaagtggaagcccttaaagagactgggcccatcctgctgactctgaagagggaagccactgtgttgtcagagggccacatggcaaggaacagtaggacttgcaggagccgagaggagcccctgttgacagccagtaagaaatcctacaactaccaggaagtgaatcctgagaacagcatcatgagcctggaagagaaccctaagctccaggaaggaatacagcctaatt

SEQ ID NO: 129160 - DNA, 601 bp, Human
tactctttcaaagaatcaataattcagattctgtatactgaatagaattctaacaaaattacaattaagaaataaagttaatgccagtgttgcatgaggtttttactcatgtggtttggttgtagtaaggaatctacaatagttgtagtaggcagttctgagacggcacccaagattgctacttcttggcaaacataccctgcataatccccttactttaagtgtggatatgatgggatttcacattcataattagattacattctttggcaaaggtaaagagacttttgcaaatgtaatkaaagtccctaatcagttgattttgagttaatcaaaacagatgatcctgggtaggcctgacttaatcaagtggaagcccttaaagagactgggcccatcctgctgactctgaagagggaagccactgtgttgtcagagggccacatggcaaggaacagtaggacttgcaggagccgagaggagcccctgttgacagccagtaagaaatcctacaactaccaggaagtgaatcctgagaacagcatcatgagcctggaagagaaccctaagctccaggaaggaatacagcctaattgacacc

SEQ ID NO: 129161 - DNA, 601 bp, Human
ttctgagacggcacccaagattgctacttcttggcaaacataccctgcataatccccttactttaagtgtggatatgatgggatttcacattcataattagattacattctttggcaaaggtaaagagacttttgcaaatgtaattaaagtccctaatcagttgattttgagttaatcaaaacagatgatcctgggtaggcctgacttaatcaagtggaagcccttaaagagactgggcccatcctgctgactctgaagagggaagccactgtgttgtcagagggccacatggcaaggaasagtaggacttgcaggagccgagaggagcccctgttgacagccagtaagaaatcctacaactaccaggaagtgaatcctgagaacagcatcatgagcctggaagagaaccctaagctccaggaaggaatacagcctaattgacaccttactgaagccttgtgagaccctgagcagaggactcagtgtagctgtgctcagactcctgatccatggaaattttgaaatattacccgtgtgttgttttaagctactaaatttgtggtgatttgttacacagcaatagaaaactaatgcagtagc

SEQ ID NO: 129162 - DNA, 601 bp, Human
gtccctaatcagttgattttgagttaatcaaaacagatgatcctgggtaggcctgacttaatcaagtggaagcccttaaagagactgggcccatcctgctgactctgaagagggaagccactgtgttgtcagagggccacatggcaaggaacagtaggacttgcaggagccgagaggagcccctgttgacagccagtaagaaatcctacaactaccaggaagtgaatcctgagaacagcatcatgagcctggaagagaaccctaagctccaggaaggaatacagcctaattgacaccttaytgaagccttgtgagaccctgagcagaggactcagtgtagctgtgctcagactcctgatccatggaaattttgaaatattacccgtgtgttgttttaagctactaaatttgtggtgatttgttacacagcaatagaaaactaatgcagtagctctatctaccctgttgtatgaaagcagtttgtaaattgacatgctatataaacagtgctggttttgttatggcattgattattcacattttatctgagtactatgatcaatacactagactgttatggtatactacatttgccattctg

SEQ ID NO: 129163 - DNA, 601 bp, Human
acatgctatataaacagtgctggttttgttatggcattgattattcacattttatctgagtactatgatcaatacactagactgttatggtatactacatttgccattctgctataccttctcttagagcacaattttgatggagataatcaaaccaggttctcattttagataaaatttccacaaaagatctacagaaattgtttctaagcttatattacaaaaatggcagcacctatccaatgctaatgtctatgcgaacatctctattatatggagtttgagttttgagaccattttsttaccgttttgaagccatactatggggctcacttcactgatctagtagatgttctgggtatctgtcatggcaaagtggtaagtcttctgaaaagaagtggcatctcaacttgaactttagaaaatgcaagaaataaaaccctcctgaagtaagaccaggagcacatcagaagactcccttattggggtcacaaactaagaacgaaagaatacccacctcttgttactcagcttattctgtgcatgttatcctctgtgtttatttccctctcgtcaccccctagtttttagtaaagtctca

SEQ ID NO: 129164 - DNA, 601 bp, Human
tggcatctcaacttgaactttagaaaatgcaagaaataaaaccctcctgaagtaagaccaggagcacatcagaagactcccttattggggtcacaaactaagaacgaaagaatacccacctcttgttactcagcttattctgtgcatgttatcctctgtgtttatttccctctcgtcaccccctagtttttagtaaagtctcatttaaaccttctagtgtagcttctgttatgccagggatattaggagcatggacactttgatgcataccacgatgcggtgatgacagtgctaattgatsagagtctccccaagggaaagacatctgcaggaacaagacacaaaactgtacagcccacctccccttctcacaagaagatacttcctgcatggaaaatcttggaggactggagtttgattttattaaaaatgcaagttaggaggtgggcacagtggctcatgcctgtaatcccagcactttgggaggccgaggcaggcagatcacggggtcaggagatcaggaccatcctggctaacatggtgaaaccccgtctctactaaaaatacaaaaacaaaattagctgggcatggtggccggtgc

SEQ ID NO: 129165 - DNA, 601 bp, Human
gtttttagtaaagtctcatttaaaccttctagtgtagcttctgttatgccagggatattaggagcatggacactttgatgcataccacgatgcggtgatgacagtgctaattgatcagagtctccccaagggaaagacatctgcaggaacaagacacaaaactgtacagcccacctccccttctcacaagaagatacttcctgcatggaaaatcttggaggactggagtttgattttattaaaaatgcaagttaggaggtgggcacagtggctcatgcctgtaatcccagcactttgggakgccgaggcaggcagatcacggggtcaggagatcaggaccatcctggctaacatggtgaaaccccgtctctactaaaaatacaaaaacaaaattagctgggcatggtggccggtgcctgtagtcccagctactcgggagactgaggcaggagaatggcgtgaacccgggaggcggaggttgcagtgagccaagatcacgccactgcactccagcctgggagacagagcaagactccgtctcaaaaaacaaacaaacaaaaaaatgcaagttagattttcttatagtttgagagtattctgg

SEQ ID NO: 129166 - DNA, 601 bp, Human
ttgattttattaaaaatgcaagttaggaggtgggcacagtggctcatgcctgtaatcccagcactttgggaggccgaggcaggcagatcacggggtcaggagatcaggaccatcctggctaacatggtgaaaccccgtctctactaaaaatacaaaaacaaaattagctgggcatggtggccggtgcctgtagtcccagctactcgggagactgaggcaggagaatggcgtgaacccgggaggcggaggttgcagtgagccaagatcacgccactgcactccagcctgggagacagagcargactccgtctcaaaaaacaaacaaacaaaaaaatgcaagttagattttcttatagtttgagagtattctggtttaagaaggtgggaagaagtaaaattggttgaggatctaaggtataaagagatgataccagaggtttgataaattgagccctaaccttaacagtacatgcttctcagtctacattccgagttggctgtaatatatgcggcctcatccactcttacctttctttgtgacactgataccctaatcaacacacttcatccacgtctctttcttgtgctctatacacacata

SEQ ID NO: 129167 - DNA, 601 bp, Human
cagtgagccaagatcacgccactgcactccagcctgggagacagagcaagactccgtctcaaaaaacaaacaaacaaaaaaatgcaagttagattttcttatagtttgagagtattctggtttaagaaggtgggaagaagtaaaattggttgaggatctaaggtataaagagatgataccagaggtttgataaattgagccctaaccttaacagtacatgcttctcagtctacattccgagttggctgtaatatatgcggcctcatccactcttacctttctttgtgacactgataccctwatcaacacacttcatccacgtctctttcttgtgctctatacacacatatccgtgtcttcattaagcatcttcccctcagtgtcccatccaaaactgaactcatcatctttagaactatccatattacccactttggtaggtatcaccatccaccctgttacccaagctagaaaacaagaaccccagaacttcactttcttcctcatctctactgccttccaccttcagacatataatttatcaccaaatactaactcgtccacctcctaaatttgttccccttctccactctttaacacc

SEQ ID NO: 129168 - DNA, 601 bp, Human
cagctgtctttgtagtcacacagtgtgccatgatgcctatttctgtaggtgctcaataagtgtttgatgtgtatttattaggataatatacctatgtatgagtgaacaaatgaatatgcagatgaatgaataagtgtaaggaggaatgaaggatgaattagataattaaaagcctctgccaccagtcaaaatgaaactttttttgtgtgtgtgtgtgtgttgtagagatggtgtctcattatgttgcccaggctgatctcaaattcctgggctcccaccttggcttcacaaagtactggarttacaggtgtgagccaccatacctggactcatttttaaaatatatatatacttgattacttcaccacaatagtgtccttttgctcatggcccatgggcctagtcccttttagagttctcagtcacctgtaagatacatgccttgaatgctaccaggtgataaatttgagttggacaatgaagaaaatattgtacatgtattttcttatttatttagaccaaataggctgagagagtaacttgaatatttaagagcttccttaaaatgcaccataaataatggaaagtgaatgacttgatt

SEQ ID NO: 129169 - DNA, 601 bp, Human
aagtgtaaggaggaatgaaggatgaattagataattaaaagcctctgccaccagtcaaaatgaaactttttttgtgtgtgtgtgtgtgttgtagagatggtgtctcattatgttgcccaggctgatctcaaattcctgggctcccaccttggcttcacaaagtactggagttacaggtgtgagccaccatacctggactcatttttaaaatatatatatacttgattacttcaccacaatagtgtccttttgctcatggcccatgggcctagtcccttttagagttctcagtcacctgtargatacatgccttgaatgctaccaggtgataaatttgagttggacaatgaagaaaatattgtacatgtattttcttatttatttagaccaaataggctgagagagtaacttgaatatttaagagcttccttaaaatgcaccataaataatggaaagtgaatgacttgattacttcccttatttttctcttatttttatttgggttgataggaaggaggaggtttgtggagggggagaaaatataaaacagtggaacatgcaaaaagagggcccaattcttccctttctctcaatttccatg

SEQ ID NO: 129170 - DNA, 601 bp, Human
tgacaaaacagtgcaaaccacatttcctgttgatggtggagtcacccatgacggaaaacatttttattgctttaataacacaattatattattttttaactcttccccttcaaatcctctagcacttaatatagtgcttgggatatatttggatattaataaatgcaaaagtgttattgcctctttttgaattaacatactacaaagaatgtgtttactgtactttcttaccttaaaacttaaacctaaaaatgtatgctaatatgaacctttgcttgatatttcatgcttgcctctttgstcgctaggaaaagtcagcaacattcagcaaaactgtcaaggattggagcatttaatagttggctgatggtccacaggcaagtccatccaaacagccaaagttgtattactcagtgtttttaaaagatgaagatttggggtggagccaagatggccaaataggaagagctccagtctacagctcccagcgtgagtgactcagaagatgggtgatttctgcatttccaactgagataccaggttcatctcactggggagtgtcggaaagtgggtgcaggacagtgggtgcagtgcaccgtgc

SEQ ID NO: 129171 - DNA, 601 bp, Human
cagcaacattcagcaaaactgtcaaggattggagcatttaatagttggctgatggtccacaggcaagtccatccaaacagccaaagttgtattactcagtgtttttaaaagatgaagatttggggtggagccaagatggccaaataggaagagctccagtctacagctcccagcgtgagtgactcagaagatgggtgatttctgcatttccaactgagataccaggttcatctcactggggagtgtcggaaagtgggtgcaggacagtgggtgcagtgcaccgtgcgtgagccgaagcagrgcgaggcatcgcctcacccgggaagcacaaggggtcagggaattccctttcctagtcaaagaaaggggtgacagatggcacctggaaaatcgggtcactcccaccctaatattgcacttttccaacggtcttagcaaatggtacactgggagattatatcctgcgcctggctcagagggtcctacgcccgcagagactcactcattgctagcacagcagtctgagatcaaactgcaaggcagcagcgagactgggggaggggcgcccatcactgtccaggcttgagtaggtaaacaaagc

SEQ ID NO: 129172 - DNA, 601 bp, Human
gggagattatatcctgcgcctggctcagagggtcctacgcccgcagagactcactcattgctagcacagcagtctgagatcaaactgcaaggcagcagcgagactgggggaggggcgcccatcactgtccaggcttgagtaggtaaacaaagcagccgggaagctcgaactgggtggagcccactgcccctcaaggaggcctgcctgcctctgtacactccacctctaggggcagggcagtgccaaacaaaaggcagcagaatcctctgcagacttaaatgtctctgtctgacagccttgragagaatagtggttctcccagcacacagctggacatctgagaacaggcagacagcctcctcaagtgggtccctgacccccgagtagcctaactgggaggcaccccccagtaggggcagactgacacctcacatggcagggtaaccctctgagacaaaatttccagagaaatgatcaggaagcaacatctgctgttcaccaatatccactgttctgcagtctccgctgctgatacacaggcaaagagggtctggagtggacctcaagcaaactccaacagacctgcagctgagggtcctga

SEQ ID NO: 129173 - DNA, 601 bp, Human
aacaaagcagccgggaagctcgaactgggtggagcccactgcccctcaaggaggcctgcctgcctctgtacactccacctctaggggcagggcagtgccaaacaaaaggcagcagaatcctctgcagacttaaatgtctctgtctgacagccttggagagaatagtggttctcccagcacacagctggacatctgagaacaggcagacagcctcctcaagtgggtccctgacccccgagtagcctaactgggaggcaccccccagtaggggcagactgacacctcacatggcagggtaacsctctgagacaaaatttccagagaaatgatcaggaagcaacatctgctgttcaccaatatccactgttctgcagtctccgctgctgatacacaggcaaagagggtctggagtggacctcaagcaaactccaacagacctgcagctgagggtcctgaccgttagaaggaaaactaacaaacagaaaggacatccacaccaaaaccccatctgtacatcaccatcatcaaagaccaaaggtagataaaaccacaaagatggggaaaaaacagagcagaaaaactggaaactctaaaaatcaga

SEQ ID NO: 129174 - DNA, 601 bp, Human
ctctgcagacttaaatgtctctgtctgacagccttggagagaatagtggttctcccagcacacagctggacatctgagaacaggcagacagcctcctcaagtgggtccctgacccccgagtagcctaactgggaggcaccccccagtaggggcagactgacacctcacatggcagggtaaccctctgagacaaaatttccagagaaatgatcaggaagcaacatctgctgttcaccaatatccactgttctgcagtctccgctgctgatacacaggcaaagagggtctggagtggacctcmagcaaactccaacagacctgcagctgagggtcctgaccgttagaaggaaaactaacaaacagaaaggacatccacaccaaaaccccatctgtacatcaccatcatcaaagaccaaaggtagataaaaccacaaagatggggaaaaaacagagcagaaaaactggaaactctaaaaatcagagcgcctctcctcctccaaaggaacgcagctccttaccagcaatggaacaaagctggagggagaatgagaatgacgttgacgagttgagagaagaaggcttcagatgatcaaactactct

SEQ ID NO: 129175 - DNA, 601 bp, Human
gaagagagtgggggccaatatgcaacattcttatagaaaagaattttcaacccagaatttcatatccagccaaactaagcttcataagtgaaggagaaataaaatactttacagacaagcaaatgctgagagattttgtcaccactaggcctgccttacaagagctcctgaaagaagcactaaacatggaaaggaaaaaccggtgccagccactgcaaaaacacaccaaattgtgaagaccagagaggctaggaagaaactgcatcaactaacgagcaaaataaccagctaagatcataayggcaggatcaaattcacacatagcaatattaaccttaaatgtaaatgggctaaatgctccaattaaaagacacagactggcaaattggataaagagtcaagacccatcagtgtgctgtattcaggaaacccatctcatgggcagagacacaaataggctcaaaataaagggatggaggaagatctaccaagcaaatggaaaacaaaaaaaggcaggggttgcaatcctagtctcggataaaacagactttaaaccaacaaagatcaaaagagacaaagaaggccattacataatggtaaa

SEQ ID NO: 129176 - DNA, 601 bp, Human
actataaacacctctacacaaataaaccaggaaaatctagaagaaatggataaattcctggacacatacaccctcccaagactaaaccagcaagaagttgaatctctgaatagaccaataacaggctctgaaattgaggcaataattaatagcttaccaaccaaaaaaagtccaggaccagatggattcacagccgaattctaccagaggtacaaggaggtgctggtaccattccttctgaaactattccaatcaatagaaaaagagggaatcctccctaactcattttatgaggccagcwtcatcctgctaccaaagcctggcagagacacaacaaagaaagagaattttagaccaatatccctgatgaacatcgatgcaaaaatcctcagtaaaatactggcaaaccaaatccagcagcacatcaagaagcttatccaccatgatctagtgggattcatcactgggatgcaaggctggttcaacatatgcaaatcaataaacataatccagcatataaacagaaccaacaacaaaaaccatatgattatcttaatagatgcagaaaaggcctttgacaaaattcaacaacccttcattc

SEQ ID NO: 129177 - DNA, 601 bp, Human
aaaaaaagtccaggaccagatggattcacagccgaattctaccagaggtacaaggaggtgctggtaccattccttctgaaactattccaatcaatagaaaaagagggaatcctccctaactcattttatgaggccagcttcatcctgctaccaaagcctggcagagacacaacaaagaaagagaattttagaccaatatccctgatgaacatcgatgcaaaaatcctcagtaaaatactggcaaaccaaatccagcagcacatcaagaagcttatccaccatgatctagtgggattcatcmctgggatgcaaggctggttcaacatatgcaaatcaataaacataatccagcatataaacagaaccaacaacaaaaaccatatgattatcttaatagatgcagaaaaggcctttgacaaaattcaacaacccttcattctaaaaactctcaataaattaggtattgatgggacgtatctcaaaataataagagctatctatgacaaacccacagccaatatcatactgaatgggcaaaaattggaagcattccctttgaaaattggcacaagacagagatgacctctctcaccactcctat

SEQ ID NO: 129178 - DNA, 601 bp, Human
cagaaaagtagattagtggttaccaggagcccttgggggtagggagaagtggggagtgactaacaggtgtggaattttgggggggtaatggaaatactggaactagacattggtgacagttgtacaacattgtatgttaaaaaccatggaattatatactttaaaatggtaaattttatgttatatgaatttgatctcaaaaaaaatttacaaaaaactacatatatagccattaaaaattatgagatatttcagcagaatacagattgtaaataattttttaaattataagagataatayaaaagacaattcatttgaaatgtttagttcaaggcctgacatatagtatgtgtttagtatatctgagacaggtctcagttaattaagaaagcttattttgccaaagttaaggactcacctgtgacagcctcaggaggtcctgaggacatgtgcccaaggtggtcagggcacagcttggttttgtacattttagggagatatgagatatcaatcagtacatgtaagatttacattggttcagtccagaaaaggcgtgacaacttgaagcaggcaggcagcttccaggtgacagttaggtaa

SEQ ID NO: 129179 - DNA, 601 bp, Human
tgggaggaagatttgccctaagcagttgccagcttgacttttccctttagcttagggattttggggctccaagatttattttcctttcacagctgcaatatataaggaaaaatagaaacaatacaaccttggatgtatttgagttgattagtttgtggatgaatttttgcatttatttttattgcaggcagagctgctataatatattgccagtatagtaaatactttatttaaaggatttgaaaataaaaaataaaagctttatggactccagcatctgtgctttgagccggaattcccrtgaagagcctgtattggtggagctactcagctctttagggaggcaggaagagatgagaaagggatacagattattacagcctaagggcaggatggagaaactatccgtctatttatccactgaatgcatgtagtcatttgtcagtaagtgttcttctaaacttatttactcatcatcaacgttcatcttagattagctcccaaagggcaaaaagacacataattaatttgcttaatgtagtgcctagcatgatgacatggtgagatatgttttagcaataattaaaaatactttttcctt

SEQ ID NO: 129180 - DNA, 601 bp, Human
aataaaatcctccacattcaccacccttcaattcattcatgtgacctgattattcctggacaccaaacaagagctcgggtgccatgggtgaggatgctaaaggctgtcacactgaccctgtgctctcggtagagagcaactgtctcatgcaaaaaggcagagggcccactgaactgttgacacttaagccgtccgtggatggcaaaagctaaaagagcgctgactaaaacacatgccctctgggccttcaggggtaatgggcacccactagacactgcctcaggactctgcacggagttcrctccagctgatgcccagaagcactcaccctggctcctgtacctgctcacctgtggactcccttctgcaaggggtgaagtgcaacgggtccaagtgagtggagtttgcccctgccagtgacaaagcggccagctagatccagcacccgtgcactgcagttcccacctgcaacggtgtcagggaaatttcctgcttcaaaagcacaggcagctttcttggaaatgagataatgtgatctcattttaaagttgaggacatcaaggctcagaggtgattagaggcattagaagggacttctgaa

SEQ ID NO: 129181 - DNA, 601 bp, Human
attcattcatgtgacctgattattcctggacaccaaacaagagctcgggtgccatgggtgaggatgctaaaggctgtcacactgaccctgtgctctcggtagagagcaactgtctcatgcaaaaaggcagagggcccactgaactgttgacacttaagccgtccgtggatggcaaaagctaaaagagcgctgactaaaacacatgccctctgggccttcaggggtaatgggcacccactagacactgcctcaggactctgcacggagttcactccagctgatgcccagaagcactcacccyggctcctgtacctgctcacctgtggactcccttctgcaaggggtgaagtgcaacgggtccaagtgagtggagtttgcccctgccagtgacaaagcggccagctagatccagcacccgtgcactgcagttcccacctgcaacggtgtcagggaaatttcctgcttcaaaagcacaggcagctttcttggaaatgagataatgtgatctcattttaaagttgaggacatcaaggctcagaggtgattagaggcattagaagggacttctgaagacagctaatctaacccttgaaaataggag

SEQ ID NO: 129182 - DNA, 601 bp, Human
aagcaagtatttaacattccatcctagttagtgtgataaccatgaagcctttgtgtgaaagaggaaagagggaggctagtctataatgaagatccatacttagagagaaagggtcttccctggcaccctttagtaatttataacactttaccaaacaatgtaggtaaggaaaaggctaatctataatcagagaaacaaaggttacagctgcctatttatgtgactcaggttccataatcacattcccttaaggctcaaaataaagtttcaacggctgagattttcaattatttattttcayaatctttacctttcttagttctgggagtggccttaccaggtgggcctggcctgcgtactcccagaagggcagttattcctagcagcctttggctttgggaacctctccataattcttaatccagcccaaggttctgactctgttaatgggtaaagaaaggttatgccctatgagactctgacctcttcttgggacctggaaaatcttctggtgattttcctcatcccgaatctgctgtttctaaactgcttgagaccaagataaagcacaccaatttacaaggcataactcctaggtgag

SEQ ID NO: 129183 - DNA, 601 bp, Human
caaggttctgactctgttaatgggtaaagaaaggttatgccctatgagactctgacctcttcttgggacctggaaaatcttctggtgattttcctcatcccgaatctgctgtttctaaactgcttgagaccaagataaagcacaccaatttacaaggcataactcctaggtgaggtcattcactagccatttcttgtatttgagggtctcagtgtgacatcccaacttcatttccagcactagattggtatttctattcttctttttagaaaggaaaggagaggggaggggaaaaggaaarggagagacacggagggagggaggaaggaaggaaggaatattggagtacaatttgtggcactcaatttcaagaacaagcttgatagaaagttgtaattgccaaatacagtaacctacttggggtacatgtcaccttttattgctttcaagctactgtacctggcaactcttatttctccctttaaaaaaatcctgtatctggctaaaggctgaaaaatagcaagtacatatctttctaatgaccctacattaatttagcatagagataattagaggcacagttaatcattagtaatataag

SEQ ID NO: 129184 - DNA, 601 bp, Human
gttctgactctgttaatgggtaaagaaaggttatgccctatgagactctgacctcttcttgggacctggaaaatcttctggtgattttcctcatcccgaatctgctgtttctaaactgcttgagaccaagataaagcacaccaatttacaaggcataactcctaggtgaggtcattcactagccatttcttgtatttgagggtctcagtgtgacatcccaacttcatttccagcactagattggtatttctattcttctttttagaaaggaaaggagaggggaggggaaaaggaaagggaragacacggagggagggaggaaggaaggaaggaatattggagtacaatttgtggcactcaatttcaagaacaagcttgatagaaagttgtaattgccaaatacagtaacctacttggggtacatgtcaccttttattgctttcaagctactgtacctggcaactcttatttctccctttaaaaaaatcctgtatctggctaaaggctgaaaaatagcaagtacatatctttctaatgaccctacattaatttagcatagagataattagaggcacagttaatcattagtaatataagccct

SEQ ID NO: 129185 - DNA, 601 bp, Human
tgttaatgggtaaagaaaggttatgccctatgagactctgacctcttcttgggacctggaaaatcttctggtgattttcctcatcccgaatctgctgtttctaaactgcttgagaccaagataaagcacaccaatttacaaggcataactcctaggtgaggtcattcactagccatttcttgtatttgagggtctcagtgtgacatcccaacttcatttccagcactagattggtatttctattcttctttttagaaaggaaaggagaggggaggggaaaaggaaagggagagacacggasggagggaggaaggaaggaaggaatattggagtacaatttgtggcactcaatttcaagaacaagcttgatagaaagttgtaattgccaaatacagtaacctacttggggtacatgtcaccttttattgctttcaagctactgtacctggcaactcttatttctccctttaaaaaaatcctgtatctggctaaaggctgaaaaatagcaagtacatatctttctaatgaccctacattaatttagcatagagataattagaggcacagttaatcattagtaatataagccctgagattgggg

SEQ ID NO: 129186 - DNA, 601 bp, Human
ctggtgattttcctcatcccgaatctgctgtttctaaactgcttgagaccaagataaagcacaccaatttacaaggcataactcctaggtgaggtcattcactagccatttcttgtatttgagggtctcagtgtgacatcccaacttcatttccagcactagattggtatttctattcttctttttagaaaggaaaggagaggggaggggaaaaggaaagggagagacacggagggagggaggaaggaaggaaggaatattggagtacaatttgtggcactcaatttcaagaacaagcttsatagaaagttgtaattgccaaatacagtaacctacttggggtacatgtcaccttttattgctttcaagctactgtacctggcaactcttatttctccctttaaaaaaatcctgtatctggctaaaggctgaaaaatagcaagtacatatctttctaatgaccctacattaatttagcatagagataattagaggcacagttaatcattagtaatataagccctgagattggggcacatgggtttctcttgctattcaacagagtccttgtgtggctagtgtttgagtacagacacatctt

SEQ ID NO: 129187 - DNA, 601 bp, Human
ggtgattttcctcatcccgaatctgctgtttctaaactgcttgagaccaagataaagcacaccaatttacaaggcataactcctaggtgaggtcattcactagccatttcttgtatttgagggtctcagtgtgacatcccaacttcatttccagcactagattggtatttctattcttctttttagaaaggaaaggagaggggaggggaaaaggaaagggagagacacggagggagggaggaaggaaggaaggaatattggagtacaatttgtggcactcaatttcaagaacaagcttgayagaaagttgtaattgccaaatacagtaacctacttggggtacatgtcaccttttattgctttcaagctactgtacctggcaactcttatttctccctttaaaaaaatcctgtatctggctaaaggctgaaaaatagcaagtacatatctttctaatgaccctacattaatttagcatagagataattagaggcacagttaatcattagtaatataagccctgagattggggcacatgggtttctcttgctattcaacagagtccttgtgtggctagtgtttgagtacagacacatcttta

SEQ ID NO: 129188 - DNA, 601 bp, Human
catacaagccaaaaatttacttgaagcaacctgaatagtatgagagagaatatttgttttttaaagtcctgggaattacagcgtatccttagggcataatataggtatgttcatatagaacagctgaacacaggcagtttataaagcaggaagtgagcacatcgtactttttaaatttatttaaaatactttgaattcttggtgttcttatccattcaagagtctctaacactagggttgtaaaatagaaaccaaatagcattgataatagagttttgtttcatctttgtcttagctacartttgggaaatgtttatatgtttgttccaaaaatgatttaaaattgtgtattcacaatgcagtagtgtgtaaacactactgaatcaccagaaatgcatccagtagtgcatgcacaaaatagagatcaaggcaaaggtagaatagggaaataaaattaagctaaggataaggttagtatacaaaatgcatcttgtgaggttcatctatttggtctactagtgggcatgggaaggatgcctgaatttaaatgaaaattctagtactgattataattcacatattctttcattgccctagagtt

SEQ ID NO: 129189 - DNA, 601 bp, Human
atagagatcaaggcaaaggtagaatagggaaataaaattaagctaaggataaggttagtatacaaaatgcatcttgtgaggttcatctatttggtctactagtgggcatgggaaggatgcctgaatttaaatgaaaattctagtactgattataattcacatattctttcattgccctagagtttttaattgtgcccaaataagtcttggtattcacaaactaattacttgagtttttaggttcacataccagtgatatcctccttgaatctttctgccacttagtcattttacttccaartatcatgacatccaacagaggccgatgaaggaaaaaagatgcaaaagtcatcccatttatttttctgccttaaaataagagtgtgtatattgggagaaggaaagggtaaagcagttagatgttattagaaatacttggaagagaatagaaataaaaatttgtgatttttagttattaaagtcatcattaaattgtgttatccatacaactgaaggatttcaatatgggcatcttgttaaggaaaagctttcagagaatggtaacatttcttaatagtgaacatgtccctacactcacata

SEQ ID NO: 129190 - DNA, 601 bp, Human
aatgcatcttgtgaggttcatctatttggtctactagtgggcatgggaaggatgcctgaatttaaatgaaaattctagtactgattataattcacatattctttcattgccctagagtttttaattgtgcccaaataagtcttggtattcacaaactaattacttgagtttttaggttcacataccagtgatatcctccttgaatctttctgccacttagtcattttacttccaaatatcatgacatccaacagaggccgatgaaggaaaaaagatgcaaaagtcatcccatttatttttytgccttaaaataagagtgtgtatattgggagaaggaaagggtaaagcagttagatgttattagaaatacttggaagagaatagaaataaaaatttgtgatttttagttattaaagtcatcattaaattgtgttatccatacaactgaaggatttcaatatgggcatcttgttaaggaaaagctttcagagaatggtaacatttcttaatagtgaacatgtccctacactcacataattataagacttcatgtacaaggtactcaaaatcagaaactttgtaaaaagccttttaatcagat

SEQ ID NO: 129191 - DNA, 601 bp, Human
ctcaactctagagaaattctactttgcttttcctggagaaattctaatgcggatgctgaaactcatcattttgccattaattatatccagcatgattacaggtaccttgagaaaacagatgttctctatattagtccattttcatactgctgtaaagaacttcctgagactaggtaatttataaaggaaagaggtttaattgactcacagttcatcctggctcagaaggtctcaggaaactcacaatcatggcggaaggcaaaggggaagcaagacaacctccttcacaaggtggcaggamggagaaaggctgggcgaagcaggaagagcccgttataaaaccataagatctcgtgagaactcactcactatcacgagaacagcatgggagaaactgccactatgattcaattacctccacctggtctctcccttgacacctggggattatggggattacaattcaagatgagatttgggtgggaacacaaagcctaaccatgtcattctctatgattatttaaaaagctttcacctaagttgttcttttctaattacgggaaaaattgaaatacattagatgtctctctctctctctctc

SEQ ID NO: 129192 - DNA, 601 bp, Human
acatataaacaaaacgttatctggggcatgggaaaaaaaagcatatttggtcactgaaatgtcagctagtgtcctcaggaaaaatatagttgtcaattttgatcatgttttcagccattcactcatttatttcccaactgcagctgtgctgcccccagcctctcagcagctgccttcagggtctctgcactccttacccactttctactcaaagccagaacttgctatgtgtctgccctgcatatttgctgtggggaccagcagtcaagttctgtgagaagggtttaaatatggaagtgcrccatattcgaaaagcctagtatttttaaaacttgtgacacagttgcatttggaaatgacttttcccttattgatcattacattgcagggctcctttgaagaggaagcttccttaggtagatagagatgaatttggtttacaaaaatgtcatttgtctggctgtgataagtttctctgcattgcagtttcttgtacttaactctggcaattagtaaaatgtggcatgacagtagctggtggtgttagattgaaaatcaaggttttatgtaaacatgcaattagaagtcgtgacatgtcccc

SEQ ID NO: 129193 - DNA, 601 bp, Human
ctgcactccttacccactttctactcaaagccagaacttgctatgtgtctgccctgcatatttgctgtggggaccagcagtcaagttctgtgagaagggtttaaatatggaagtgcaccatattcgaaaagcctagtatttttaaaacttgtgacacagttgcatttggaaatgacttttcccttattgatcattacattgcagggctcctttgaagaggaagcttccttaggtagatagagatgaatttggtttacaaaaatgtcatttgtctggctgtgataagtttctctgcattgccgtttcttgtacttaactctggcaattagtaaaatgtggcatgacagtagctggtggtgttagattgaaaatcaaggttttatgtaaacatgcaattagaagtcgtgacatgtccccttctagaacatttttctccactgccactgtaaaggtctgggactggccctggtagagtactggacgttggtgggggcacgggagggtgggggtcaggatctgctgcattcagggactgcattgcttgaagagctgtcacatttggcctttgaatttcccaaatgccaaactcgaattagactag

SEQ ID NO: 129194 - DNA, 601 bp, Human
agcctagtatttttaaaacttgtgacacagttgcatttggaaatgacttttcccttattgatcattacattgcagggctcctttgaagaggaagcttccttaggtagatagagatgaatttggtttacaaaaatgtcatttgtctggctgtgataagtttctctgcattgcagtttcttgtacttaactctggcaattagtaaaatgtggcatgacagtagctggtggtgttagattgaaaatcaaggttttatgtaaacatgcaattagaagtcgtgacatgtccccttctagaacattyttctccactgccactgtaaaggtctgggactggccctggtagagtactggacgttggtgggggcacgggagggtgggggtcaggatctgctgcattcagggactgcattgcttgaagagctgtcacatttggcctttgaatttcccaaatgccaaactcgaattagactagagtcccttgggagctttgtccttaaatggtcttgatgttctcggcttatgagaaacctaaagagaacatttaattatttttatgaatgtatttaattacgtttggaaatgcctggttccttttaaccct

SEQ ID NO: 129195 - DNA, 601 bp, Human
ggtctgggactggccctggtagagtactggacgttggtgggggcacgggagggtgggggtcaggatctgctgcattcagggactgcattgcttgaagagctgtcacatttggcctttgaatttcccaaatgccaaactcgaattagactagagtcccttgggagctttgtccttaaatggtcttgatgttctcggcttatgagaaacctaaagagaacatttaattatttttatgaatgtatttaattacgtttggaaatgcctggttccttttaaccctagcaacctgattgacacagcmgcagaccaattatttgtcccatgtaatatttgtttatttgtttaaattgtcataagcatttaaaattggaaagatttcatgtaaatatccaaattgctggctttctctgaaaaaaaaaaatgaagatctgggaacactggcccagtatttccacctatcaacggtggtctgaaaccaagagacaactactccatttagctggagcaaatgcatttgagaatgccatagtctccactactcccgattgcccagtactttgtccacttcactcttacgttacctgcctggccgccgtaagga

SEQ ID NO: 129196 - DNA, 601 bp, Human
ttggaacaaactttctggagaacagtttggagcatgttctgatctcttcacccagtaattctgtttctcagaattgatcataaagaaataatcagagatatgttcaaactcctaagtacaaggatattcatggtagcatttttttgtaatggtgataaattataagcaacctaaatgtatacaaatttatattgtatacatatgtatacaaatttatcttttatactatgtatacatagtatacaaattttcatactaagcaactattaaaaacttgtcttagaatcatatttaattacakgtgggaacattcccaatacagtataaagtgggaaaataaaattacacaacaggatagtgtatacaatccaaattttattaaaatgtatatacatttttaaaagttgtgatcaaaaccaaaaggttaacatccagaaagtaagaaaacatgatctgttctgctttctttacattttcaactgaacctgtgtttttgtttggtttgtatttttaatgaaagagatggggatggagtctggcctgagatcctccaattttgcctctggtcgcttctctgcctcatctctgctcccttcccctg

SEQ ID NO: 129197 - DNA, 601 bp, Human
atctttaatgagccaggctctgctagacacacaaggtgtaaaattaagtcttatctcagcaagaaagagtacattacaatgctgtgtgataagcactttctgggaatgaggtcagtgcaggggacattggaaggagccattttgaaggaagcatagaaatcaagtgaaaggaagagggtgggtattccaggcaagagaaaatagcatctttgtcctcccaaaatagcatcttgggaggacagtgagacttgaagtgcgatgctggaaacgtgggcaagaggaatgggatggaaagggggascacaagggtttactggcctcgtgtgccttgccaaggggactggacttgagcctgcaggcgagggaagcaattctagcagtgactcccacctgtgccattctctacagagggacacctgaataagtatccatcctagaggggcaggagagtccagtggttaagagtacagacaggagccacactgcctgggtttgaatcctggttctgccatggattagctgtgaaaccttggattttacttaacttgtcctcagctttaaaatatggataataataatgtttcatagaacatctagaatg

SEQ ID NO: 129198 - DNA, 601 bp, Human
cggggattttatccctgtttctaggccacagccgagcctcaaaactgtcccaggttctaatggataaccctgggttcacagggaactggaatcgtgctcttctttttctgcccaattcaggtgccacctgttccatcaagcctctcctgctcatctcaatctggtgacagttcaggctcctctgaaagcccacagtaactggtctccgcaccagggcttcacaaaacatctagtttttaaactggatggagcaaatccagttgttaaaatttctgatctgttacagatcaataaccttcgwaaactatagttagagcaaattactagaaaagttatattaaaaatagacatacaaaatactagccctattttttttttttttgagatggagtttcactcctgttgcccaggctgaagtgcagtggcatgatatcggctcactgcaacctccacctcccaggttcaagagattctcctgcctcagcctcctgagtagctgggattgcaggtgcacaccatcacacccagcaaatttgtgtgtgtgtgtggttttgtttttgtttttttgtttttttaagtagagatggggtttcaccatgtt

SEQ ID NO: 129199 - DNA, 601 bp, Human
tagaatttcagaggggtggtgattaggaaaacggctttggggggtggttttgcacaacaacaacaacaataaaacaaggttgaaaaagactgagatgttacatgtgttcccctgtggagtcttttatggctgaaaagtgttctcgttggctgccctgggaaccaaactaaaccaccatgtataagcggtttctaaggggactacctgctgaggtccaagtttcggacccagaaatggatctttgaaatggggtcatttgtaagcagacgattacttgcaaaaatgcagctctttctgtcaygtggaaagcttcaagtacaaacattcgtagagcaccttatttaaggcactgggggcccagtgaagaataagcttcaggccttacagccatatgatcagtgcagtgatggaactacgtgccaggagatttgcgcgtagcatcttcctttcccctgcccatgcttgcaaggcaaagagcttttcctgaatttgataatggagttaagctatagtttgttcattcgacattgtcgagcacccactaaatgctaaacactggtagggtctagagagattgggctgtccaatatgatagccatta

SEQ ID NO: 129200 - DNA, 601 bp, Human
atgtggccccgggaccatttaaagatccagcaataagtggatcattaaatacattctggtacagccacatgacagattactgagccattaaaattatcctcagggtgagtttgtaacaatgtgggaaaatgcttacaactataatattaagaagaagagagagggttagaaactataaaattctcccagctgtttacaaaaaattgagaaaaatattagaagaaaatcaccagaatattaacttggttgatgagatgatgtgatttttgttgtcatctttaccttttctcctttttcagayagttgtaatgaatatatattacttttataattgtatataaacattattttttccagttaagcctaagcttcctgacagaaaaggcagaaaggaaaactatcatgagttacatgattctcaagtgttaaaaaaaaaaaaaatctcaggcaggacatgatgactcacacctgtaatcccagcactttgggaggccaaggttgtggatcacctgaggtcaggagttcgagacaagcctggccaacatggtggaacctcatctctactaacaatacaaaaattagctgggtgtggtggtgtgca

SEQ ID NO: 129201 - DNA, 601 bp, Human
ggcaggacatgatgactcacacctgtaatcccagcactttgggaggccaaggttgtggatcacctgaggtcaggagttcgagacaagcctggccaacatggtggaacctcatctctactaacaatacaaaaattagctgggtgtggtggtgtgcacctgtaatcccagctactcgggaagctgaggaaggagaatcgcttgaacccaggagatggaggttgtaatgagccgagatcacaccattgcactccagcctgggtgacagagtaagactctgtctcaaaacaaacaaacaaacaaacaacaacaacaacaaacgatctcagttctttgagataaatttttcctagataactgaattccaaaggaggtttatcacaagggatgttgaatgatataatacaaatcttggtaaagttcttagtgcaaatgtgggacagggactccttatgattatttcctgaccaactccaggaagatctgaaggcaggacactcctggaggtgaaggctgtgggaagctgcctgcaggggaacttgcacctgactgggcttccctctcttaaatctgtttggaattttgaagtgttgcttttgcccat

SEQ ID NO: 129202 - DNA, 601 bp, Human
ttttaaatagagacagggtttcaccatgttggccaggctggtcttgaactcctgacctcaggtgatctacctgccttggcctcccaaagtgctgggattacaggtgtgagccaccatgcccagccacttacataattcttaaagtggatgattggtctataatagtggagttgagtataattataaaatatttccagaaatatagcattttagtgcatttcacgtagtaacaagagctaacagctaatagatccttgttaaggataaatcccacttgtaagagggagaaaattctaataarggaggagctgctcttatacccttagcatagttttttgaagaatgcttggtctttgtaaccctgagtgacattttaagaagaatgcccaattcccacctatgagtgagaatatgtggtgtttggttttttgttcttgcaatagtttactgagaatgatgatttccaatttcaaccatgtccctacaaaggacatgaactcatcatttttatggctgcatagtattccatggtgtatatgtgccacattttcttaatccagtctatcattgttggacatttgggttggttccaagtctttgc

SEQ ID NO: 129203 - DNA, 601 bp, Human
catgcccagccacttacataattcttaaagtggatgattggtctataatagtggagttgagtataattataaaatatttccagaaatatagcattttagtgcatttcacgtagtaacaagagctaacagctaatagatccttgttaaggataaatcccacttgtaagagggagaaaattctaataagggaggagctgctcttatacccttagcatagttttttgaagaatgcttggtctttgtaaccctgagtgacattttaagaagaatgcccaattcccacctatgagtgagaatatgyggtgtttggttttttgttcttgcaatagtttactgagaatgatgatttccaatttcaaccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttagatcacatggacacaggaaggggaacatcacactctggggact

SEQ ID NO: 129204 - DNA, 601 bp, Human
atgcccagccacttacataattcttaaagtggatgattggtctataatagtggagttgagtataattataaaatatttccagaaatatagcattttagtgcatttcacgtagtaacaagagctaacagctaatagatccttgttaaggataaatcccacttgtaagagggagaaaattctaataagggaggagctgctcttatacccttagcatagttttttgaagaatgcttggtctttgtaaccctgagtgacattttaagaagaatgcccaattcccacctatgagtgagaatatgtrgtgtttggttttttgttcttgcaatagtttactgagaatgatgatttccaatttcaaccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttagatcacatggacacaggaaggggaacatcacactctggggactg

SEQ ID NO: 129205 - DNA, 601 bp, Human
atgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttagatcacatggacacaggaaggggaacatcacactctggggactgttgtggggtggggggaggggagagggatagcattgggagatatacctaatgctagatgatgagttagtgggtgcagygcaccagcatggcacatgtatacatatgtaactaacctgcacaatgtgcacatataccctaaaacttaaagtataataataaaagaaaaaaaaagagagagagagaaaaaaaaaaaagaagaatgcccagagggggaagacagaaggagcatatactcagatgtggcagcagctcggcccttgtagccctgcttcaatgagctgataagaaggggtgggatgtggtgaggctttagtggtattaggccaagggacccaggagggcttgaactgtaccataaaacaaaaccacatcatctc

SEQ ID NO: 129206 - DNA, 601 bp, Human
ctatttgtcctcattccacccccggaacagcattttcctacatgactgctttctagatacttgaagacctacggtatggaaggaaggcaaggcttgttttgtatgatcctcaggagaataaccagcatctgggtaaaagttgcagaaagacatcagatgcattctctgggctagaaaatggatcatccttaccctaacaccttcctaggctggtctcataagttcaagaaaaagaatattctcatcagcaggtgtttccagaagcaattctgggatgcagccccttcatttaaaacacacmtacacacacacagacgcacacgcacgcacgcaagcacatggagttctttctgcttactcatttaaatggaagagtaattaaggtggctgctgaggttccagaggaggctcagcattttggctggacctcagggtcctccccatcacactattgcctggtacaaccatgcccattgttctaaaggtgccagctgtgccaggtgccctggaaggttcctaatgctctgtggacgctgttcttggccacaggtattgtgctggtggtgagcatcaagcctggtgtcacccagaaagtgggtga

SEQ ID NO: 129207 - DNA, 601 bp, Human
attccacccccggaacagcattttcctacatgactgctttctagatacttgaagacctacggtatggaaggaaggcaaggcttgttttgtatgatcctcaggagaataaccagcatctgggtaaaagttgcagaaagacatcagatgcattctctgggctagaaaatggatcatccttaccctaacaccttcctaggctggtctcataagttcaagaaaaagaatattctcatcagcaggtgtttccagaagcaattctgggatgcagccccttcatttaaaacacacatacacacacaccgacgcacacgcacgcacgcaagcacatggagttctttctgcttactcatttaaatggaagagtaattaaggtggctgctgaggttccagaggaggctcagcattttggctggacctcagggtcctccccatcacactattgcctggtacaaccatgcccattgttctaaaggtgccagctgtgccaggtgccctggaaggttcctaatgctctgtggacgctgttcttggccacaggtattgtgctggtggtgagcatcaagcctggtgtcacccagaaagtgggtgaaattgcgaggac

SEQ ID NO: 129208 - DNA, 601 bp, Human
catggagttctttctgcttactcatttaaatggaagagtaattaaggtggctgctgaggttccagaggaggctcagcattttggctggacctcagggtcctccccatcacactattgcctggtacaaccatgcccattgttctaaaggtgccagctgtgccaggtgccctggaaggttcctaatgctctgtggacgctgttcttggccacaggtattgtgctggtggtgagcatcaagcctggtgtcacccagaaagtgggtgaaattgcgaggacaggcagcacccctgaagtcagtacrgtggatgccatgttagatctcatcaggtgagtgttttgccacaaggtggcttcaagggcatgcggatagcagcacaaggccttgtatgtggtttaatattctgctgttactgtattgaaatttttaataacttttgaattattgtgcactttcattttgcccaggaacccacaaattacatagccagtactgtttgccaagtcttggttccaagagggaagggaagaaacaggcttccgcatcaggatttaggatgaacagagatgcagctacatgttccagagagatgctgggatggat

SEQ ID NO: 129209 - DNA, 601 bp, Human
gaggaggctcagcattttggctggacctcagggtcctccccatcacactattgcctggtacaaccatgcccattgttctaaaggtgccagctgtgccaggtgccctggaaggttcctaatgctctgtggacgctgttcttggccacaggtattgtgctggtggtgagcatcaagcctggtgtcacccagaaagtgggtgaaattgcgaggacaggcagcacccctgaagtcagtacggtggatgccatgttagatctcatcaggtgagtgttttgccacaaggtggcttcaagggcatgcrgatagcagcacaaggccttgtatgtggtttaatattctgctgttactgtattgaaatttttaataacttttgaattattgtgcactttcattttgcccaggaacccacaaattacatagccagtactgtttgccaagtcttggttccaagagggaagggaagaaacaggcttccgcatcaggatttaggatgaacagagatgcagctacatgttccagagagatgctgggatggattggtagtcagttctgaagcgcacttagaaaaatacatcttttaattgtacaggagaaactctct

SEQ ID NO: 129210 - DNA, 601 bp, Human
tgcaaatctttccagtttttctttttaatttcaataatcttcccatacctaatctaaccataaaaattttagtcactggcctttattgagtttccaggtatgtggcttagattttatagaaaccataccttctttttatgctcatatttcactggtttacataatatgaaatgcagtaattatgatgatatttgcaactggtataaagaatttgggaacaaataaaatgaacccttggtaagtgtattagtccattttcacactgctataaagaactacctgggactgggtaatttataaygggaagaggcttaattaagtcacagttcctcacggctggggaggcctcaagaaacttacaatcatggcagaaggcaaaggggaagcaaggcacatcttacatggctgcaggagagagagcaagggcgaagggagaagtgccacacactttctaacaaccagatcttgtgagaactcactcatgatcatgagaatagcatgggagaaaccaccccccatgatccaatcacctcccacaaggcccctcccctgacatgtggggattacaatttgacatgagatttgggtggggacacagagc

SEQ ID NO: 129211 - DNA, 601 bp, Human
ataatcttcccatacctaatctaaccataaaaattttagtcactggcctttattgagtttccaggtatgtggcttagattttatagaaaccataccttctttttatgctcatatttcactggtttacataatatgaaatgcagtaattatgatgatatttgcaactggtataaagaatttgggaacaaataaaatgaacccttggtaagtgtattagtccattttcacactgctataaagaactacctgggactgggtaatttataacgggaagaggcttaattaagtcacagttcctcayggctggggaggcctcaagaaacttacaatcatggcagaaggcaaaggggaagcaaggcacatcttacatggctgcaggagagagagcaagggcgaagggagaagtgccacacactttctaacaaccagatcttgtgagaactcactcatgatcatgagaatagcatgggagaaaccaccccccatgatccaatcacctcccacaaggcccctcccctgacatgtggggattacaatttgacatgagatttgggtggggacacagagccaaaccatatcagtaagcatacaacctcattga

SEQ ID NO: 129212 - DNA, 601 bp, Human
ataaagaatttgggaacaaataaaatgaacccttggtaagtgtattagtccattttcacactgctataaagaactacctgggactgggtaatttataacgggaagaggcttaattaagtcacagttcctcacggctggggaggcctcaagaaacttacaatcatggcagaaggcaaaggggaagcaaggcacatcttacatggctgcaggagagagagcaagggcgaagggagaagtgccacacactttctaacaaccagatcttgtgagaactcactcatgatcatgagaatagcatggragaaaccaccccccatgatccaatcacctcccacaaggcccctcccctgacatgtggggattacaatttgacatgagatttgggtggggacacagagccaaaccatatcagtaagcatacaacctcattgatgaaaacagaagtgttcagaatattaaagaataaatagtctcttgactgtgagtgtccatttcaccaaggagcgtaagcatgtcagttactcagtgaatcaattaagtgatggttgattacagagctttctatacttgggtgaagctcagcaggaaaaaagaaatctca

SEQ ID NO: 129213 - DNA, 601 bp, Human
gagaaccatagtatatttgtactgaagtttaaactttctgcagaaaaaaggtagctctctatctcctctttgcttttcctctggtattagaacccaggatctaaccctcatggtgtggtccacatctgggttcagtcttctccttaatcattgtgtcccagagaggcgtggaagctcacacctgtaatcccagcactttgggaggccaaggtgggcagatcccttgagctcaggagttccagactagcctgggcaacatggcaagaccatgtctctaaaaagaaataatttaaaaaaaaawataaaaaatcgttgtatccccattgctggagctctacaatgcagtgtaacaaagccatgatttttttttctgtaggaaaattgaacaatctcttcactccatttacttcaagcctttccctcctatttatctatgtgctttaagacagctgagtccatcacaaactgctgtattcattcacataagttacatgaacacagacttctgtgtataccaacaaaaatggcaactctgttgctctctgccggcctccacgagggacagaacctcctctattacagggggcctttgcagatcagt

SEQ ID NO: 129214 - DNA, 601 bp, Human
cccagagaggcgtggaagctcacacctgtaatcccagcactttgggaggccaaggtgggcagatcccttgagctcaggagttccagactagcctgggcaacatggcaagaccatgtctctaaaaagaaataatttaaaaaaaaaaataaaaaatcgttgtatccccattgctggagctctacaatgcagtgtaacaaagccatgatttttttttctgtaggaaaattgaacaatctcttcactccatttacttcaagcctttccctcctatttatctatgtgctttaagacagctgagtcyatcacaaactgctgtattcattcacataagttacatgaacacagacttctgtgtataccaacaaaaatggcaactctgttgctctctgccggcctccacgagggacagaacctcctctattacagggggcctttgcagatcagtcacagtggttgtttgtaaggttctcagtgttggcagagcctggtagtgggggacatttatgcctggtgtaataatatactcactctttcttaaatccccatgtggaagctccacagaaccaaacagggctgaaagaagagaattcaactgcagtct

SEQ ID NO: 129215 - DNA, 601 bp, Human
gtgggggacatttatgcctggtgtaataatatactcactctttcttaaatccccatgtggaagctccacagaaccaaacagggctgaaagaagagaattcaactgcagtctcactcactgaatagccccaaggggactgttgattttggaacaaccatatcgttaaacctttcttgatgcttattaaagttgtagtgatgttatcaaagtaatgaagtgtgtttgctcagattaaaaatcatttattaattaataaaaacaaaaatgattgacaggaatccttacagagtctgtctctgasagcacctgcagatcaagcctgtactttcttttgtattattcttctatcaacttgtcgtttattgtgaaagtgaaggaacattttgacataattgaatggtgatcgtgggagtcaggggtttaaatttctgcctcgcttttagttccaaaacctgatgggaggtaccgttgacaactggagccaacagaggcattggatgtagatcccttcagtggcactgtttggccaaaataacatgttcctgtgatttagtctcaaaagcttaaaaaaaattctttttttgtttgcttgtccttgatt

SEQ ID NO: 129216 - DNA, 601 bp, Human
gctggaaacaagtgtcccttttgcagtgtgtttagtgtcatattttttgcatttttgtgatttttcttgctgatttcgctgtttgaaatggaccaaggtggggttcagtgactcatgtctgtaatcccagcatgctgggatgccgaggcgggaggatcgcttgagcccaggagttccagaccagtctgcgcaacatagtgacacctcacctctacaaaaaatgaaaaatagccgggtgtgatggtgcacacctattgtcccagctactcgggaggctgaagtgggaggattgcttgttccrgggaattcaaggctgcagtgagccatgattgaatcattgcacttcagcctgggtagcagactgagaccctgtctcaaaaaaaaaaaaaaaggaccaggctgggcatggtggctcacacttgtaatctcagtactttgggaggccaagacaggtggatcgcttgaaaccaggagtttgagaccggcctgggaaatatagtgagaccccatatgcacaaaacattttaatattacccaggtgtggtggcacatgcctgtagtcccagatacttgagaggctgaggcaggaggatcgtttgag

SEQ ID NO: 129217 - DNA, 601 bp, Human
aacttatcaataaaatcaacatgctttgagagcttttgggatttcagaattggagatcagaatgtgtgggcctgcattggtacctctgtaagcctgtagcagatttctcccgaatgttctctcaacttcacacaggaaggaatgatttaaggagaaaaggagtgttcattagacttaagaattcaaattaaataaaccaccgttggctccctgcttcctactgcagaaagccttaactcctctggctgagttcagaggccctgcatgacctggcttctctctagttttcacagcttacttycagtgggcacctctcttctttccagattcacctcctccatcactccttattcctgccttttgatgttgttccacaaatactttctgagcaccctctataccccaggccctgctgggcattgggattataatggtgaaaagacagatgccaggcctctgtcctcacacaaagaatgatgagtattataatcaggaagaatgggatgtttgggaggcattcagcaagggatgttaaattagtctggaggccataatgaatgagcaagaattattcaagcagggtgcaaaggcccagtgcatg

SEQ ID NO: 129218 - DNA, 601 bp, Human
ggctcacacctgtaatcccagcactttgagaggctgaggtgggcggatcacctgaggtcaggagttcgagaccaccctggccaacacggcgaaaccctgtctctactaaaaatacaaaaaattaattgggtgtgggggcggatgcctgtaatcccagctactagggaggctgaggcaggagaattgcttgaacccgggaggtggaggttgcagtgaactgagataccaccactgcactccagcctgggtaacagagcgagactccatctcagaaaaaataaataaataaataaataaataatcctattggtcatccaagaccgcaggcataaagagtgttactgtgcttcattatcagggtaaaacagaaggtaaaatgtcctaaaagtgttcacactggtaagtattctgtacttcctgcattattaattcctgtgtttttttaagcagactccaaatgtagctagcagttaaaatgaccctgaaaagtgccttcaatctaaaattcataataaaaatataaaccattccagaataagaaatctttataagaaatattcaaatatggacttgttgaaagaagagaaagcattttaacttc

SEQ ID NO: 129219 - DNA, 601 bp, Human
tgttttcttggttttgatccacagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtggtgagcagacactgtttaatgtcattttgcttcccctgacaattctgtctcctcaaaattagaaagaagaggttttatgtttgtcaactgaygaagctagagaagttggacatttaatattgaaccaccagagtattttgtgggggcttttgttgctgttctttgtttttgttttagaggcagagtctcactctgtcaccccagggtggagtgcagtggtgcaatctcggctcactgcagcctcaacttcctgtgctcaagcgatcctcccgtctcagctacctgagtagctgggactataggcatgtaccaccatgcccagctatttttttgtattttttgtagagacagggttttgccatgttgcccaggctgatctcaaactcctaggc

SEQ ID NO: 129220 - DNA, 601 bp, Human
gagtattaaataattccacatattacccaggagttagttcatgaacagaagtctagctatcaaccattgtcttttccctcaaagccttgggagatcatcttgcactcaaccagccttcgtgtaagaagtaattctttaaaaaatgatttgaaggatttcactgtacatgagaacacaaagtgctttccctattgcaccccatgcaaaagtgagtttcaaaatatttataactggcactgcatgggcactaacccatctgaatgaaagctaccatccgtgagcataccagtgacaccatttsagtgtctgtcctctccctgaaaatgccaaaaagtccacctttcttaggatgcatctgtctcacttacctcatatttaatttgttcaacattatttaatccaaagtgtagatactgacagtgatgtaaagggttcagtaaaaatggcaaggcaggtcacttaatactgcagaaacctcagcttcatcatctgttaaaaaggataataaaagctacccccagggataggagaagtacattaaatgaaatgatgcatgtaaaatactttccctcatgcaagatacaacgatagctccacaaat

SEQ ID NO: 129221 - DNA, 601 bp, Human
ggttcagtaaaaatggcaaggcaggtcacttaatactgcagaaacctcagcttcatcatctgttaaaaaggataataaaagctacccccagggataggagaagtacattaaatgaaatgatgcatgtaaaatactttccctcatgcaagatacaacgatagctccacaaatagagctattatgatcacttccagtactaatactatcgcctctattgctgatacctgggaaacagatgaccgtggctagaaagagccatatttggcagtgagggtcaagctcaagtgagatctgcagatakgacaatcagcaggatatatatgcactaggaacacggcatgaggtgcgcacccatctaaccacatgttcttgccaagtttgcaaactaccctatggtagtttggatgggtagaatttaaggtgcacacaggtactaaaaactagagccaatattgttcacccaggacttgaaacaactcttagcttcaattcccatcctgtgctccaccaagtgtgcatgccaagctgagggtgcccacactggagtgttccttccccaccaacctagcatgagaaagcacttgatgacggaatcacgcct

SEQ ID NO: 129222 - DNA, 601 bp, Human
cccaggacttgaaacaactcttagcttcaattcccatcctgtgctccaccaagtgtgcatgccaagctgagggtgcccacactggagtgttccttccccaccaacctagcatgagaaagcacttgatgacggaatcacgcctctgttgtgcttcctttccagttatatgccactaggtattttgttcctgattgctgggaagatcatagaagttgaagactgggaaatattccgcaagctgggcctttacatggccacagtcctgactgggtatgtcagactcaagagaagagacagaaasctcctttgatctaataggatggccgctgagaggttgggtttcagttggttaaaactggcttctgccctatgtgctgggaaagatagggttcagagataagacagcagggggaggagggctgccctttaacagctgtactgtaggtggatcatgctgtgctaattgtcagctcttggcagaacagcctggaccaggctttgtcactgcctttattggttatgttaaaataattttttacaacaagagagaaacccactcgtagcctcccttggctctctcctggccttcatttccttaaga

SEQ ID NO: 129223 - DNA, 601 bp, Human
tcctgtgctccaccaagtgtgcatgccaagctgagggtgcccacactggagtgttccttccccaccaacctagcatgagaaagcacttgatgacggaatcacgcctctgttgtgcttcctttccagttatatgccactaggtattttgttcctgattgctgggaagatcatagaagttgaagactgggaaatattccgcaagctgggcctttacatggccacagtcctgactgggtatgtcagactcaagagaagagacagaaacctcctttgatctaataggatggccgctgagaggttkggtttcagttggttaaaactggcttctgccctatgtgctgggaaagatagggttcagagataagacagcagggggaggagggctgccctttaacagctgtactgtaggtggatcatgctgtgctaattgtcagctcttggcagaacagcctggaccaggctttgtcactgcctttattggttatgttaaaataattttttacaacaagagagaaacccactcgtagcctcccttggctctctcctggccttcatttccttaagaatgtaaactagccaagcaagcaagaatagcctccat

SEQ ID NO: 129224 - DNA, 601 bp, Human
gaacttgatcgtattggagatttccaacacagcgcatttggttcttaatctgtgtttgccaaaaacacagccctgccagccaacacagaggcagatttggtccctacagtgtgaggcccctggcgctaagggaggtgggacctccaattcactggaggccaccctgctgtagggctgctgaaacaggcagtgccagggatcgtgtctcagcagtgacgtggctggggtgtatgagctgagccatttcataaccgagttctgctggtttctattctcttaccccagctaggtgtctaacagraaactaaaagtcagttcctcatggtttttagctacaagctctctatcaagaagatcctctcgccagaactccaggatctatatttttgatggccatttcctatttcaaacacacataactgatctgtaaactctaagctgccagttacatatatatctatctgtgaaatgagtctcatttcttaagcctcctagttcatgtaacctgtgtatttccatgtgaaacaatgaacagtttgagaaggcaggaataacaaagaaagaaataatcctaaagtatggctgtggaagagctgagact

SEQ ID NO: 129225 - DNA, 601 bp, Human
tgctgtagggctgctgaaacaggcagtgccagggatcgtgtctcagcagtgacgtggctggggtgtatgagctgagccatttcataaccgagttctgctggtttctattctcttaccccagctaggtgtctaacaggaaactaaaagtcagttcctcatggtttttagctacaagctctctatcaagaagatcctctcgccagaactccaggatctatatttttgatggccatttcctatttcaaacacacataactgatctgtaaactctaagctgccagttacatatatatctatctgygaaatgagtctcatttcttaagcctcctagttcatgtaacctgtgtatttccatgtgaaacaatgaacagtttgagaaggcaggaataacaaagaaagaaataatcctaaagtatggctgtggaagagctgagacttttttccttactgtaactctgacttccctcttagacagtgggcgccaccagcaagacagcagcttggtgcagggaatggagtgggtgaggactgagcgctgtgataaggggtataatgaggtataaggtagtggtgacatacagggtgccaaggaaggaaggct

SEQ ID NO: 129226 - DNA, 601 bp, Human
acaaagaaagaaataatcctaaagtatggctgtggaagagctgagacttttttccttactgtaactctgacttccctcttagacagtgggcgccaccagcaagacagcagcttggtgcagggaatggagtgggtgaggactgagcgctgtgataaggggtataatgaggtataaggtagtggtgacatacagggtgccaaggaaggaaggctcagccctacctgaggaagtgagggaaggcttcctggaggaagggggatgcctatctgagtcttaagaggagaagaactgagcagcaacrgaaggaaaaaagggcacttttgtgcatgtggcaggaatagcacacacaggggtgtggcagcatgatataattctgttctgtgaagccttgaatttggattcagctactggctttgtcattaactctgacaagatgcttcatgtgctgagagagcctctaaaccctcatacatggaatgggacgtatattcctgccctactcccatttcttattgggccattatgaaagtcaaacaattttataaattaaaaagatgtttgataaaaggattaagtgtggggaggtggtattatctttgaa

SEQ ID NO: 129227 - DNA, 601 bp, Human
tctatttttatcacacagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcaggtggggcatggtgtcacattcattgtcatcactgatacagggattaccgccagtaaaaattgtccatgaagggacaccaagaatgtcscagtgatgaattctttttcttgatctataaagtcccttcccaagattaaatacgactatatcctggtatgcaagatttctgcttcggggtctgggtagccaaagccatcactctgtgctcagtttactgaagccagtaggatctaggcacaggctagcacaaagactcaaggctgagtaagggccagtccctgctttcaaactatccctgctagatgggcatgcacatatccaaatgaatgctgaagaccatgatgagggatgtaagagaactctgtatggtgttcacagaggactccag

SEQ ID NO: 129228 - DNA, 601 bp, Human
ggcattgggcagatcatcaccatcaggtggggcatggtgtcacattcattgtcatcactgatacagggattaccgccagtaaaaattgtccatgaagggacaccaagaatgtcccagtgatgaattctttttcttgatctataaagtcccttcccaagattaaatacgactatatcctggtatgcaagatttctgcttcggggtctgggtagccaaagccatcactctgtgctcagtttactgaagccagtaggatctaggcacaggctagcacaaagactcaaggctgagtaagggccastccctgctttcaaactatccctgctagatgggcatgcacatatccaaatgaatgctgaagaccatgatgagggatgtaagagaactctgtatggtgttcacagaggactccagagagggaagggctggttctagctgggaaggtgaacgatggcttcccagaggaggggaacatttagctgaatcttagaagaataggaatttagcaggcaaaagaaaagctaggagcatttggagtggcagaaatagcttgtgatgcagccatgggctagttacagcatacagatttcttgctatggct

SEQ ID NO: 129229 - DNA, 601 bp, Human
tgaagggacaccaagaatgtcccagtgatgaattctttttcttgatctataaagtcccttcccaagattaaatacgactatatcctggtatgcaagatttctgcttcggggtctgggtagccaaagccatcactctgtgctcagtttactgaagccagtaggatctaggcacaggctagcacaaagactcaaggctgagtaagggccagtccctgctttcaaactatccctgctagatgggcatgcacatatccaaatgaatgctgaagaccatgatgagggatgtaagagaactctgtayggtgttcacagaggactccagagagggaagggctggttctagctgggaaggtgaacgatggcttcccagaggaggggaacatttagctgaatcttagaagaataggaatttagcaggcaaaagaaaagctaggagcatttggagtggcagaaatagcttgtgatgcagccatgggctagttacagcatacagatttcttgctatggctggcataaaggatacataaacattcctttatgtttaaacgaatgaggaggcaggggtcatgtcatgaaaggttttgtacgaagagcttgtgga

SEQ ID NO: 129230 - DNA, 601 bp, Human
tttcaaactatccctgctagatgggcatgcacatatccaaatgaatgctgaagaccatgatgagggatgtaagagaactctgtatggtgttcacagaggactccagagagggaagggctggttctagctgggaaggtgaacgatggcttcccagaggaggggaacatttagctgaatcttagaagaataggaatttagcaggcaaaagaaaagctaggagcatttggagtggcagaaatagcttgtgatgcagccatgggctagttacagcatacagatttcttgctatggctggcataamggatacataaacattcctttatgtttaaacgaatgaggaggcaggggtcatgtcatgaaaggttttgtacgaagagcttgtggaaagctcttagatgctttgtcatattatggacagatttgcattttatgtatttatttattttttgagatggagttttgctctgtcgcccaggctggagtgcagtggcacaatctcggctcaccacaacctccgcctccagggttcaagcaattctcctgcctcagcctcctgagtagctgggactacaggcgtgcaccaccacacctggctaatttt

SEQ ID NO: 129231 - DNA, 601 bp, Human
tttatgtttaaacgaatgaggaggcaggggtcatgtcatgaaaggttttgtacgaagagcttgtggaaagctcttagatgctttgtcatattatggacagatttgcattttatgtatttatttattttttgagatggagttttgctctgtcgcccaggctggagtgcagtggcacaatctcggctcaccacaacctccgcctccagggttcaagcaattctcctgcctcagcctcctgagtagctgggactacaggcgtgcaccaccacacctggctaatttttgaatttttagtagagaygggtttcaccatgttggccaggctggtcttgaactcctgacctcaggtgatttgcccacctcagactcccaaagtgccgggattataggtgtgagccaccacgcccggcagatttgcattttacaaagataagcagcaatatggcagatatattggatgggagcagggaccaaatctaggaaaccagttaggagaccactgcagaagtccaggcagggtattagaaggcactgacactgaggttggagaagagctaatgaattgaagcagcatcagctggattcagggtgaaaggcgagg

SEQ ID NO: 129232 - DNA, 601 bp, Human
atggagttttgctctgtcgcccaggctggagtgcagtggcacaatctcggctcaccacaacctccgcctccagggttcaagcaattctcctgcctcagcctcctgagtagctgggactacaggcgtgcaccaccacacctggctaatttttgaatttttagtagagatgggtttcaccatgttggccaggctggtcttgaactcctgacctcaggtgatttgcccacctcagactcccaaagtgccgggattataggtgtgagccaccacgcccggcagatttgcattttacaaagataascagcaatatggcagatatattggatgggagcagggaccaaatctaggaaaccagttaggagaccactgcagaagtccaggcagggtattagaaggcactgacactgaggttggagaagagctaatgaattgaagcagcatcagctggattcagggtgaaaggcgagggaatgccaggatgactcccaggattggcagatgattctaaattggtgggtggggcttaccagaacaggaacgagtgtaagagaagcacatataggtgggaaagataaatagtaaatactttttgacagattga

SEQ ID NO: 129233 - DNA, 601 bp, Human
tctgtcgcccaggctggagtgcagtggcacaatctcggctcaccacaacctccgcctccagggttcaagcaattctcctgcctcagcctcctgagtagctgggactacaggcgtgcaccaccacacctggctaatttttgaatttttagtagagatgggtttcaccatgttggccaggctggtcttgaactcctgacctcaggtgatttgcccacctcagactcccaaagtgccgggattataggtgtgagccaccacgcccggcagatttgcattttacaaagataagcagcaatatggmagatatattggatgggagcagggaccaaatctaggaaaccagttaggagaccactgcagaagtccaggcagggtattagaaggcactgacactgaggttggagaagagctaatgaattgaagcagcatcagctggattcagggtgaaaggcgagggaatgccaggatgactcccaggattggcagatgattctaaattggtgggtggggcttaccagaacaggaacgagtgtaagagaagcacatataggtgggaaagataaatagtaaatactttttgacagattgaatttgaaatgcc

SEQ ID NO: 129234 - DNA, 601 bp, Human
cacctggctaatttttgaatttttagtagagatgggtttcaccatgttggccaggctggtcttgaactcctgacctcaggtgatttgcccacctcagactcccaaagtgccgggattataggtgtgagccaccacgcccggcagatttgcattttacaaagataagcagcaatatggcagatatattggatgggagcagggaccaaatctaggaaaccagttaggagaccactgcagaagtccaggcagggtattagaaggcactgacactgaggttggagaagagctaatgaattgaagmagcatcagctggattcagggtgaaaggcgagggaatgccaggatgactcccaggattggcagatgattctaaattggtgggtggggcttaccagaacaggaacgagtgtaagagaagcacatataggtgggaaagataaatagtaaatactttttgacagattgaatttgaaatgcctttaagacttccagttgcacatatgcaatgagaaatataggtctggctgcagatacagacatcaggaacatgggcttaataatggtcttcaaatgtgtaagtcacaagttattgcttgtattg

SEQ ID NO: 129235 - DNA, 601 bp, Human
atgcatataaaatgtttataactgtgcctatgtagtgagtactcagtgaatgttgaaaatggatgacatgacgtagggagagtttgcagagaagagaaggagattaaggactgaggcttggaaaaatcctaatactagaagcaggtagagaagggaaaacccaagagggagagggagaaggacagagagatgggagggaagccagtaaaccttggtatcatggaaacccagaaaagagagattttcaagggtgaaatggtccacagagtcagaagctgcagagaattctagtgaaatgagsatagacattgtctgcccaagtagatggtagaactgtcattagtggattttgccagatttgtttctctaggacagcactattcaatatggtaaccactagccatgtggcccactgaattggatagcacagacacagaatagtttcatcattgcagaaagttcttttggacagcactatgttagagtgataggctgggattagagttaacctgaagacttttgttcagtttagaatggaagtttaagactaaactggtccctaggcctgctcaaggttgaatctgaactttttagagttaat

SEQ ID NO: 129236 - DNA, 601 bp, Human
agagatgggagggaagccagtaaaccttggtatcatggaaacccagaaaagagagattttcaagggtgaaatggtccacagagtcagaagctgcagagaattctagtgaaatgaggatagacattgtctgcccaagtagatggtagaactgtcattagtggattttgccagatttgtttctctaggacagcactattcaatatggtaaccactagccatgtggcccactgaattggatagcacagacacagaatagtttcatcattgcagaaagttcttttggacagcactatgttagagwgataggctgggattagagttaacctgaagacttttgttcagtttagaatggaagtttaagactaaactggtccctaggcctgctcaaggttgaatctgaactttttagagttaattcattcttgtgtcccagcctaaacataaattctagggataaaatcagagtttgttaactaacaatgttctaatacaatgcattttttaaatcctccccaaccctaaatcgcaaagtatttctgttggctgaagacaagtgcaaaatacaccatttggcacaccagctggggaactatcccaatgc

SEQ ID NO: 129237 - DNA, 601 bp, Human
gtgatcatgccactgaactccagcctgggcaacagagtgagaccttgtctctggaaaaaaaaaaaatgtgtgtgtgtgtgtgtgtgtgtgtgtgtgtgtgtgtgtgtgtgtgtgtgtgtgtgtgtatgtgtgtgtgtgtatataaggaataaagaagaaagacaattgtaggatttggggcctagaaagagctgagagaaaaaaaaagtagcagtagtaatagtagtagtagtagttgttgtaatagttgttgttttggttgctgcagtagcagtagtaataataccagtggcagcagcgmcagcagcaatagaggaagcattagcagcaactgctgttgttgcagaagtagcagcagaaatggcacgtttttaatctttttgtttgttttttgttttattttactttaagctctgggatacgtgtgcagaacatgcaggtttgttacataggtatacgtgtggaaatggcatgtttttaagcatctactatacaagtgctatcccagatgccttacgtgtattaacctcatttaatcttcccagcagcttgcagtagacatactgtccccatcttacaggcaaggaattgagattcagag

SEQ ID NO: 129238 - DNA, 601 bp, Human
ctataatttggtggtcaaaaccactgaatgaaaatacacttgtcaaaaaactctggcctgtgtttgactgtaccctcaaatgctttctgcaacacctcagtaggcagatgaatgggcagtagaatcagcttcctaagaactctggctttttttagccccaaagaatatgaatgtgtggatagaatcagggattcttccagtttaaattgccaatttttacattttcacctttcaacacagtggaacccgggcaacagttcaggccttggcccaagggcaaggacttgtctccagaaagcaytgtaggtgtggcctccagcttatccaagtcaagggatttttcagggcatgttgaacccttgtttccttcagaatgatccaattaaaataaggaagatgttgctgataaagagactgcacattacaaagaaaaaaatccctactgcctcagctgatcttaccaagagggatctttttaaatacctggtaataaagttcacctggctgcccctcctggattccagatctttctttcccacaaagtgcatctactggcaaaaaggagcagtcaggagtaaatgcttgtaccttggacaggatc

SEQ ID NO: 129239 - DNA, 601 bp, Human
ccttcagggcaacttaaattcctgccatatattaggtgctcagtaaattattgggtggtgagtagatggaacaagggagtaggaaggcaggtgcagaggtacctggcacttatttaggatgagtgtatgtatacatagatgagtacacgaagcctcctattaacaccccatttagtaaactcctgctttcctcttgagtatctctcttacttattttttggtgccacttatgcagttcttccttgcattagagtgatgtgccatatctccgtctgcaaggagatggcatcatacccctcayagtccccctccccccacagctctaatcctgtaatgaggcagagctggggctcagcaagtcacagattctaactacccaatttagggacacagcagtaatagccatcgggactaagcgggagtaaccatttcaggccagggctttaacgggagaggtaagtgtctaactcctttcctgctggtatgtttctgcagtatcacggccacatctgccagcatcggagctgctggcgtgccccaggctggcctggtgaccatggtgattgtgctgagtgccgtgggcctgcccgccgaggatgtc

SEQ ID NO: 129240 - DNA, 601 bp, Human
ttgctgctttaattttcctctgaccaggccatctgataacatgcctaaaaattaactcctcataacgtggagcagtgattttaaaaagccggtgagctccattagctcattatacctggtaacactcaagcttaggagctgggtgtgggacagagataaacacagaacaaggtgagaagccaggcagggccccagagccatcctgacctatcccagccctggttcagcatcataggctcagaaccacctagttcaaaatcagtccgtcttcctaagcatcttccgaaccatcagggacagwggcacaagcacttgggtttgaatctccgtcctgtgtcttaccagcttcttgacctcgagcaagtttccttaacctgaggcccagttgcataatctgtgagatgggaaaaaatctgcctatgtcattgggttgttttaaggactgagtgagctcatgtgagtggagcatctagaacagcgtctggcagcccatacatgctcaataaatggcaagttttattgttatgattagaatgagttggaccattcaggccccaatcaacaacacttctctctctctctctctctctctctctctctc

SEQ ID NO: 129241 - DNA, 601 bp, Human
cagtggcacaagcacttgggtttgaatctccgtcctgtgtcttaccagcttcttgacctcgagcaagtttccttaacctgaggcccagttgcataatctgtgagatgggaaaaaatctgcctatgtcattgggttgttttaaggactgagtgagctcatgtgagtggagcatctagaacagcgtctggcagcccatacatgctcaataaatggcaagttttattgttatgattagaatgagttggaccattcaggccccaatcaacaacacttctctctctctctctctctctctctctcwctcacacacacacacacacacacacacatatggaatacagcagaacatctgggtgagaaagtaccttcagtgaccctcaaggttaaagttagaaccagcctggctccaagctttacccttgatgcccacttctgtgcatggatcttacagcatttaggtctggctctgtcccctggcattgcaggtaagtattgctccacatggagcctttgctcagaaccagctcaggctcactggggagtccagtgctatgtactgtagtttgcaggtgacagatgagatggaaagggaagcagagac

SEQ ID NO: 129242 - DNA, 601 bp, Human
gtggcacaagcacttgggtttgaatctccgtcctgtgtcttaccagcttcttgacctcgagcaagtttccttaacctgaggcccagttgcataatctgtgagatgggaaaaaatctgcctatgtcattgggttgttttaaggactgagtgagctcatgtgagtggagcatctagaacagcgtctggcagcccatacatgctcaataaatggcaagttttattgttatgattagaatgagttggaccattcaggccccaatcaacaacacttctctctctctctctctctctctctctctcwcacacacacacacacacacacacacatatggaatacagcagaacatctgggtgagaaagtaccttcagtgaccctcaaggttaaagttagaaccagcctggctccaagctttacccttgatgcccacttctgtgcatggatcttacagcatttaggtctggctctgtcccctggcattgcaggtaagtattgctccacatggagcctttgctcagaaccagctcaggctcactggggagtccagtgctatgtactgtagtttgcaggtgacagatgagatggaaagggaagcagagacat

SEQ ID NO: 129243 - DNA, 601 bp, Human
gcacaagcacttgggtttgaatctccgtcctgtgtcttaccagcttcttgacctcgagcaagtttccttaacctgaggcccagttgcataatctgtgagatgggaaaaaatctgcctatgtcattgggttgttttaaggactgagtgagctcatgtgagtggagcatctagaacagcgtctggcagcccatacatgctcaataaatggcaagttttattgttatgattagaatgagttggaccattcaggccccaatcaacaacacttctctctctctctctctctctctctctctctcatacacacacacacacacacacacatatggaatacagcagaacatctgggtgagaaagtaccttcagtgaccctcaaggttaaagttagaaccagcctggctccaagctttacccttgatgcccacttctgtgcatggatcttacagcatttaggtctggctctgtcccctggcattgcaggtaagtattgctccacatggagcctttgctcagaaccagctcaggctcactggggagtccagtgctatgtactgtagtttgcaggtgacagatgagatggaaagggaagcagagacatcct

SEQ ID NO: 129244 - DNA, 601 bp, Human
tccgtcctgtgtcttaccagcttcttgacctcgagcaagtttccttaacctgaggcccagttgcataatctgtgagatgggaaaaaatctgcctatgtcattgggttgttttaaggactgagtgagctcatgtgagtggagcatctagaacagcgtctggcagcccatacatgctcaataaatggcaagttttattgttatgattagaatgagttggaccattcaggccccaatcaacaacacttctctctctctctctctctctctctctctctcacacacacacacacacacacacacctatggaatacagcagaacatctgggtgagaaagtaccttcagtgaccctcaaggttaaagttagaaccagcctggctccaagctttacccttgatgcccacttctgtgcatggatcttacagcatttaggtctggctctgtcccctggcattgcaggtaagtattgctccacatggagcctttgctcagaaccagctcaggctcactggggagtccagtgctatgtactgtagtttgcaggtgacagatgagatggaaagggaagcagagacatcctattgggcttgaaaacacagattc

SEQ ID NO: 129245 - DNA, 601 bp, Human
cagccttttctgttctgcaggtgtagttttcacaagattccccctgcatgcagttcctgtcaacaaagtgccagtatcaaaatggatcctctcctctgcagtgtgccttctctacctgtcttcctgccaccagtctcttccccaggctctctggaaattaagactggatgagggtggcccacagagaaatccattcctgggctgacctgtgttttctgaccccgtgctctgcaccatgcctcctggtttgctcataagtagagtgacctagattggtaaataaacaagtacaccatggacytgaacaaacacatacataccccacatgcacatggtacatactccacccacaaaacacccaagttctctgacctttgcccaaagagagcccacaatggcatttgcattgaatctagaaaatcccaagatagaggttagggctgaaaaacttactgaattctgaacctccctcagtcccccaaaaaatatctggaacgactctattcatgtttctttgggagaagaggaaggaatttagggagacttaggggagtcattgctactttgggggagctcatgctgtgcctttatgaacaacccc

SEQ ID NO: 129246 - DNA, 601 bp, Human; identical to SEQ ID NO: 20433

SEQ ID NO: 129247 - DNA, 601 bp, Human; identical to SEQ ID NO: 20434

SEQ ID NO: 129248 - DNA, 601 bp, Human; identical to SEQ ID NO: 20435

SEQ ID NO: 129249 - DNA, 601 bp, Human; identical to SEQ ID NO: 20436

SEQ ID NO: 129250 - DNA, 601 bp, Human; identical to SEQ ID NO: 20437

SEQ ID NO: 129251 - DNA, 601 bp, Human
cacctgccaccattcctggctaggttgtgggttttttgttttttttgtttttttttgttttttttttttgtagagacagggtctcactatgttgcccaagcttggtcttgaactcctgagatcaagcagtcctcctacttgtcttcccaaagtgctgggattacaggcatgagccactgcacccagtcttggatattctttacttggatttttgttattcactgaactttgcaaaaaaatgacgggaaaatatctggcaattctaggttatagtctaatatcctgaatctgtgccctttgstttttttttttttttgtatcgttttttgatggatttttttgctctgggtcacaagagcaatgactagacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctc

SEQ ID NO: 129252 - DNA, 601 bp, Human
agacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgaytactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctca

SEQ ID NO: 129253 - DNA, 601 bp, Human
tcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgaacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgtaatcccagcactttgggaggctgaggcgggcagatcacctgaggtcgagagttcaagaccagcctgaccaacatggagaaaaccca

SEQ ID NO: 129254 - DNA, 601 bp, Human
cagaaggctgtttcaaatctgtttggtgttacatatttaaaatctgagcatctaggatttaaatatttatgatgtacataaaatgatgtttatgtatactttaaattaacttgcctatatgtgtaatgcatcagtatgaaagattacaccagacctaaagtaaaacaaataccacttaagaaataacaacttaaggcagggatcaaaatgcttcaaagtattattcatcgcttatttaccctataaggtcatcaaaaacttagagttataaaacttgtatgtgattttgcagacttttccrtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccac

SEQ ID NO: 129255 - DNA, 601 bp, Human
taactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcayaaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctg

SEQ ID NO: 129256 - DNA, 601 bp, Human
atatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatrcgttctttctgttcaaaacatcctagatgggccacatattagtcaggccttctccagagaacagaaccaatggtatatgtatataaagtctcagtatccaaaggcccaagaacctggagttctgatgtctaagaacaggagaaggtggatgtcccagttccagaagaaacagaggatttcccctccctctgcctcttgttttatctaggccctcaacagattggatgatgctcagccacaatggtggtagagtgtggatcttctctactcagtccactgattcaaatgccactcttttcc

SEQ ID NO: 129257 - DNA, 601 bp, Human
aactgcatattgtaaaattcaatttatatgaaatttctataagaagcaaaactataggggcagaagacaaatattggttgcctgaggctggagatgaagcagggattggctgcaaatgggcataaggggacttcttggggtaatggaagtgttctaaaattggactgtgacaaattctcagctttttggctaaagatcaagtgtaaattggattgtggtgatggttgcacaactgtgtaaatttaccaaaaattaatcgggtgaattttatggtatacaaattaataacccaaagccgttaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaattatttcaggat

SEQ ID NO: 129258 - DNA, 601 bp, Human
caaagccgttaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaatkatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtcaagagccaggacgggcgttttggctcacgtctataatcccagcactttgggaggccgaggcaggtggctcacgaggt

SEQ ID NO: 129259 - DNA, 601 bp, Human
tcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgyttcctgtaaagaaaagcctaccatcagggacaccttagtttgtaaacctagctaatctgcactcacccttgccagtaccccttttctcacctctgattaatcccttaaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgag

SEQ ID NO: 129260 - DNA, 601 bp, Human
attgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccawcagggacaccttagtttgtaaacctagctaatctgcactcacccttgccagtaccccttttctcacctctgattaatcccttaaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttc

SEQ ID NO: 129261 - DNA, 601 bp, Human
ctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttaaagtaagtaagtcagaggtctgcatcaggagaatgactagatccttggtattcaatgygtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatt

SEQ ID NO: 129262 - DNA, 601 bp, Human
gtaaaaaatagagtggctggctgggcgcagtggctcacggctgtaatcccagcactttgggaggccaaggcaggcgaatcaccaggtcaggagatcaagaccatcctggccaacgtggtgaaaccccatctctactaaaaatacaaaaaaattagctgggcgtggtggtgcccgcctgtagtcccagctactcgggaggctgaggcaggagtatcacttgaacccaggaggtggaggttgcaatgagccaagatcgcaccactgcactccggcctgggcggcagagtgagattctgtctcaaaaaaaaaaaagagtggccatggggtgagagttttcagtgaagtcgaggaacaggtgtagagggaataaagaaatgaaacaaacaaacaaacaaaaaacacttctaagaatcagaagattcttattggagaggggggttactcgagatgaagatttcagaggtacaactgttctgggtgatgagaacattaagatgtcgtcatgaaaatgtgtagactaatgtgaagtgaaggtgaaagttaggagagttcagatggtcaagaaattcttaagctagagtgtagcagaggttgtccacag

SEQ ID NO: 129263 - DNA, 601 bp, Human
ttcttaagctagagtgtagcagaggttgtccacagggtctctgatgttacatatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgrgattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagagg

SEQ ID NO: 129264 - DNA, 601 bp, Human
acaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcarccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccatt

SEQ ID NO: 129265 - DNA, 601 bp, Human
ctcccaccagtcaacaacaggcagggctcccagcatgccgaaaccttgagagctacctcttcctcctttatcccttcttcagagggtagcctacctgtccacaccggcagagagtcactctgcatgtcagtcctctttcggttgcctcttttgtcaaaaacgtcacctactttcactgcctgggacacagctcagaacctgactcaaatatttgttgaatggccaacggaatgaatgaattgccctctctcctctaccttcaactggtagctcccccttcattcccagagcatcctatacrctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatgtcagatttctcagt

SEQ ID NO: 129266 - DNA, 601 bp, Human
acagctcagaacctgactcaaatatttgttgaatggccaacggaatgaatgaattgccctctctcctctaccttcaactggtagctcccccttcattcccagagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacraaactattgatgcctatgcaaggtgacttgtaagcatacctaatacacaaatatagctgcctcaaggaaacgttttcagtctagctaggtcctgcttatgtcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttt

SEQ ID NO: 129267 - DNA, 601 bp, Human
agagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatctcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaac

SEQ ID NO: 129268 - DNA, 601 bp, Human
agttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaactgtggtttgttytgaattcctcccttctcaataatttatttcttctctcttttaacactctgtgttcttcttctcttgaacaccattatttagctaagtgttgctgttcttcaacaaccaccatcctctaaaactcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacact

SEQ ID NO: 129269 - DNA, 601 bp, Human
tcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacactgagtaagtttgagaattgaaaatgagacctgagcatcacaaaacaacctttcatatctagatatagttaccatctaggagttcacgtgcattataaaagaaatggtcttgtttaagatgaaaycctgcaagctctgtgagggcagggattatgtctgtttatcacaccatggtatgttcagttcctaagagtgtcgggtatatagaggccgtcaatatttgttgaaattaaatgaaaagtttcagtcttttcatgcttcacaagaagaaaatcttttggagaaagccaatgatttaacataatcttctggatcttctatgacagaaaatagctatttaatccgtaaaaaatataaacatatggagccaaatactgccttgtgccaatcaaatgtttggtttattaatagttactaaatttatt

SEQ ID NO: 129270 - DNA, 601 bp, Human
cagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggatttacaacagaaggttsggtcagaaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactt

SEQ ID NO: 129271 - DNA, 601 bp, Human
aaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactttgggagrctgaggcgggtggatcacgaggtcaggagtttgagaccagcctggccaacatggtgaaaccccgtctctactaaaatacaaaaattagcctggcgtggcagtgggtgcctgtaatcccagctacttgggaggctgaggcaggagaattgcttgaacctgggaggtggaggttgcagtgagccgagatcgtgccattgcactccagcctaggcaacagaatgagactctgtctcaaaaaaaaaaaaaaaaaaggaatagtcaacggaggaattttgtcatggcactgggggtatatatgtg

SEQ ID NO: 129272 - DNA, 601 bp, Human
ggaggctgaggcaggagaatcgcttgaacccgggaggcagaggttgcagtgagcagatatcgcgccattgcactgcagcctgggggacaagagtgagacttcatctcaaaaaaaaaaaaaacaaattaaacccatataatagtactacagcacaaaactttatgctatctattttgttcatttgctgtttgtgactatcatatttatgtcaactttaccctgttttattgacaagtacccaggagcacttgaaaatgtagaaattcctttaaaccctcccccctccaccagaaaacaagcytccagggaatgcacatatataaatattaagatagttgttgtgtatagtgcccaaaatcctattttcagttagcaaactattggtaatgttggaaagcaaggcatccagataagaaaggggagatcttgtggcttggaggccattcaaaggcagacttaaggttgcgtcttcttaagggagacatgtagtgggggtcccgtgtaactggaatttcaccatgtctaatcgtgtctagcagaccaatggaatgctgtgcctcaagtttcttctgagaggcctatgagcctcatgagatatcaa

SEQ ID NO: 129273 - DNA, 601 bp, Human
attgctctgtgatgtcgtgacagaagctttcatttccccagaaagaggaagaaaacagaagtgccccctccaaatggcatagccttcacaacattcagtttaaatgtttttaagtatcttaaaagagaagagttatatattgctaagtgtgttcttagaatgtctgtagttagcacttctttcaggctctagttttctggtttttcactttacataataatcctctatgtatttaggatctttatttttcacctttcccgttaccatatttttatttccttcaaaattcgagggaattgcttttttctctctaccttttttagatcagtttcctagtctttaactgaggtgttaaagttggagtttttactggcaagtcttgactgagcacagtgttaggctctgtgagagagaatatgcattttctattttcacagagccacagtccaggtgaggagataatgaatttgcatgcaaaaaatgaatatgttgtgagctgatacagacttttgtcaggccagtctttcataaagaagtatttggaatgggctttgaaaatgcctgaaattccaaaatgaaataatatgaaataatatttatt

SEQ ID NO: 129274 - DNA, 601 bp, Human
gaaaaccataaggtgtctcacagaaactgaatatactcatttaactgtgacagatggctcatgcgagaaagtagcaaaggagaagcttcattcgttctattagtgttagaatgtgctatagaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagrgtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagc

SEQ ID NO: 129275 - DNA, 601 bp, Human
atattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttckgagatagtctctctctgtcacccaggctggagtgcagtggcgctgtcttggttcactgcaacctccacctcccgagttcaagcgattctcctgctttagcctcctgagtagctgggactacaggtgcctgccaccatgggcagctaatttttgtatttttagtagagttggtgtttcatcatgttggccaggctggtattggactcccaaagtgctggaattacaggcgtgagccactgtgccctgccaagcttttataatttaacctgggaaatgtcaagccactgacatttttcagca

SEQ ID NO: 129276 - DNA, 601 bp, Human
tcttttgttttcattgcaaaacagttcaacttgtatgagactcaaagtggggagggcaggagcagaattttctctgttccgggtatagacattatgggtattgggccatattctcctcttcgttggtaataattcctattttatacatctttctatcaattgcagctcctaccagagtcaacgtcttgattgtaaatactcagtgttggttgatttgcattttcatcatagtcctgaaagataaaagtggacctaagaaaaactaataagcttacagccagttttataatgacagactctrtataaacaaatgcaaattggatgtcaaatttgaattacaaaatttatttgagcaaggtccaggaagtaataacagtgtcttcagatcttttctaaaatgataaaaattcattaacaatcttccatggcttggagtctcagagactttcaaaagtcacagcactttgaagagcagagttggcaactaaagttatcagagtgaagaatggcatgctaacctcaggtgcaggatggccaactcaaagtagacctctattctttgttcttctgagataggaactagccagaaacttagttattc

SEQ ID NO: 129277 - DNA, 601 bp, Human; identical to SEQ ID NO: 20438

SEQ ID NO: 129278 - DNA, 601 bp, Human; identical to SEQ ID NO: 20439

SEQ ID NO: 129279 - DNA, 601 bp, Human
ggcgcaatcttgggtcactgcaacctccgcctccctggttcaagcaattctcccagcctcggcctcctgagtacctgggattacaggtgcccgccaccgcgcccagctaatttttgtatttttagtagagacggggtttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacrttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataa

SEQ ID NO: 129280 - DNA, 601 bp, Human
gcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctccttttagaaaggg

SEQ ID NO: 129281 - DNA, 601 bp, Human
gagttctgaggtattctgattatctgaagagattacttaatgacacaatgctatctcaaagaacagaagtagggagattcaagacaattctattccttacagaggtacaaatttctatgctaggaaaacaatacgaaagatacacatggcccataaacataaccattcccattcacaaaatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatga

SEQ ID NO: 129282 - DNA, 601 bp, Human
gtaatgtgtatgtgtgtgtgcctattgcaaatgagattgtgttcttgatttggctctcagcttgaacattattggtaaatagatatgccaccaatttttattcatggattttgtatcctgaaatttttgtgaagttgtttatgagttccaggagccctttggcagagtcttcaggattttctaggtatagaatcatatcattagtgaaaagagagagtttgacttcttttcctatttggatgccttctctttcgttcttttgcctgattgattgatctaggtaggacttccagtactgtgytgaataggagtggggagaatggacgtctttgtcgtgtttctgttctcaaggggaatgcttccacattttgcctatccagtatgatgttggctgtgggtttgttatggatagttcttattattttgaggtatgtttctgcaatgcctagtttactaagggtttttattatgaaaggacattgggttttattgagacttttcccacatctattgagatagcccaatggtatttgtttttaattctgttgatgtggtgaaattgattaggatcttaatgcagattcacagatgaaaaattgtt

SEQ ID NO: 129283 - DNA, 601 bp, Human
atattctgtaaaaggttagtaatacaactattctatagtttacttttgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccaygaatagttgagaaaatgactatgaaaaagagatttggtaaagaaatgtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccact

SEQ ID NO: 129284 - DNA, 601 bp, Human
tgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccatgaatagttgagaaaatgactatgaaaaagagatttggtaaagaaaygtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaag

SEQ ID NO: 129285 - DNA, 601 bp, Human
catagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaagtaaaataaaataaaaaaagaaatgtattattattcagcgaaaaaattagtatatgttattgcttatcaagtgttttgcaactcattctaatcaaggcaaaataacyttattgaaaattgaaaattacagtctccataaccaagtggttatacattacttagtactttcaaagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtgg

SEQ ID NO: 129286 - DNA, 601 bp, Human; identical to SEQ ID NO: 20440

SEQ ID NO: 129287 - DNA, 601 bp, Human; identical to SEQ ID NO: 20441

SEQ ID NO: 129288 - DNA, 601 bp, Human; identical to SEQ ID NO: 20442

SEQ ID NO: 129289 - DNA, 601 bp, Human; identical to SEQ ID NO: 20443

SEQ ID NO: 129290 - DNA, 601 bp, Human; identical to SEQ ID NO: 20444

SEQ ID NO: 129291 - DNA, 601 bp, Human; identical to SEQ ID NO: 20445

SEQ ID NO: 129292 - DNA, 601 bp, Human; identical to SEQ ID NO: 20446

SEQ ID NO: 129293 - DNA, 601 bp, Human; identical to SEQ ID NO: 20447

SEQ ID NO: 129294 - DNA, 601 bp, Human
gaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatatyctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagcca

SEQ ID NO: 129295 - DNA, 601 bp, Human
gactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaamgtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatc

SEQ ID NO: 129296 - DNA, 601 bp, Human
ccatgagcttctgatgatcacaaatgcaatatgaattctaaggtcttctctgctatatggagccagctttcctttctttcctatagtctgcctgtataccagatacaaaggttcaaaactctagctgcacatgataatcacctggggaacattttaaaaaacactgattccccagctcaagcaccctagaatgtgatgtaattgttctgtagctggaacccagatactggtattctttttaagtaccacccaccaagtgagaacccctgagttagtgttatttcccttttgtgtgatatcrttcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgaca

SEQ ID NO: 129297 - DNA, 601 bp, Human
aaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttctttta

SEQ ID NO: 129298 - DNA, 601 bp, Human; identical to SEQ ID NO: 20448

SEQ ID NO: 129299 - DNA, 601 bp, Human; identical to SEQ ID NO: 20449

SEQ ID NO: 129300 - DNA, 601 bp, Human; identical to SEQ ID NO: 20450

SEQ ID NO: 129301 - DNA, 601 bp, Human; identical to SEQ ID NO: 20451

SEQ ID NO: 129302 - DNA, 601 bp, Human; identical to SEQ ID NO: 20452

SEQ ID NO: 129303 - DNA, 601 bp, Human; identical to SEQ ID NO: 20453

SEQ ID NO: 129304 - DNA, 601 bp, Human; identical to SEQ ID NO: 20454

SEQ ID NO: 129305 - DNA, 601 bp, Human; identical to SEQ ID NO: 20455

SEQ ID NO: 129306 - DNA, 601 bp, Human; identical to SEQ ID NO: 20456

SEQ ID NO: 129307 - DNA, 601 bp, Human; identical to SEQ ID NO: 20457

SEQ ID NO: 129308 - DNA, 601 bp, Human; identical to SEQ ID NO: 20458

SEQ ID NO: 129309 - DNA, 601 bp, Human; identical to SEQ ID NO: 20459

SEQ ID NO: 129310 - DNA, 601 bp, Human; identical to SEQ ID NO: 20460

SEQ ID NO: 129311 - DNA, 601 bp, Human; identical to SEQ ID NO: 20461

SEQ ID NO: 129312 - DNA, 601 bp, Human; identical to SEQ ID NO: 20462

SEQ ID NO: 129313 - DNA, 601 bp, Human; identical to SEQ ID NO: 20463

SEQ ID NO: 129314 - DNA, 601 bp, Human; identical to SEQ ID NO: 20464

SEQ ID NO: 129315 - DNA, 601 bp, Human; identical to SEQ ID NO: 20465

SEQ ID NO: 129316 - DNA, 601 bp, Human; identical to SEQ ID NO: 20466

SEQ ID NO: 129317 - DNA, 601 bp, Human; identical to SEQ ID NO: 20433

SEQ ID NO: 129318 - DNA, 601 bp, Human; identical to SEQ ID NO: 20434

SEQ ID NO: 129319 - DNA, 601 bp, Human; identical to SEQ ID NO: 20435

SEQ ID NO: 129320 - DNA, 601 bp, Human; identical to SEQ ID NO: 20436

SEQ ID NO: 129321 - DNA, 601 bp, Human; identical to SEQ ID NO: 20437

SEQ ID NO: 129322 - DNA, 601 bp, Human; identical to SEQ ID NO: 129251

SEQ ID NO: 129323 - DNA, 601 bp, Human; identical to SEQ ID NO: 129252

SEQ ID NO: 129324 - DNA, 601 bp, Human; identical to SEQ ID NO: 129253

SEQ ID NO: 129325 - DNA, 601 bp, Human; identical to SEQ ID NO: 129254

SEQ ID NO: 129326 - DNA, 601 bp, Human; identical to SEQ ID NO: 129255

SEQ ID NO: 129327 - DNA, 601 bp, Human; identical to SEQ ID NO: 129256

SEQ ID NO: 129328 - DNA, 601 bp, Human; identical to SEQ ID NO: 129257

SEQ ID NO: 129329 - DNA, 601 bp, Human; identical to SEQ ID NO: 129258

SEQ ID NO: 129330 - DNA, 601 bp, Human; identical to SEQ ID NO: 129259

SEQ ID NO: 129331 - DNA, 601 bp, Human; identical to SEQ ID NO: 129260

SEQ ID NO: 129332 - DNA, 601 bp, Human; identical to SEQ ID NO: 129261

SEQ ID NO: 129333 - DNA, 601 bp, Human; identical to SEQ ID NO: 129262

SEQ ID NO: 129334 - DNA, 601 bp, Human; identical to SEQ ID NO: 129263

SEQ ID NO: 129335 - DNA, 601 bp, Human; identical to SEQ ID NO: 129264

SEQ ID NO: 129336 - DNA, 601 bp, Human; identical to SEQ ID NO: 129265

SEQ ID NO: 129337 - DNA, 601 bp, Human; identical to SEQ ID NO: 129266

SEQ ID NO: 129338 - DNA, 601 bp, Human; identical to SEQ ID NO: 129267

SEQ ID NO: 129339 - DNA, 601 bp, Human; identical to SEQ ID NO: 129268

SEQ ID NO: 129340 - DNA, 601 bp, Human; identical to SEQ ID NO: 129269

SEQ ID NO: 129341 - DNA, 601 bp, Human; identical to SEQ ID NO: 129270

SEQ ID NO: 129342 - DNA, 601 bp, Human; identical to SEQ ID NO: 129271

SEQ ID NO: 129343 - DNA, 601 bp, Human; identical to SEQ ID NO: 129272

SEQ ID NO: 129344 - DNA, 601 bp, Human; identical to SEQ ID NO: 129273

SEQ ID NO: 129345 - DNA, 601 bp, Human; identical to SEQ ID NO: 129274

SEQ ID NO: 129346 - DNA, 601 bp, Human; identical to SEQ ID NO: 129275

SEQ ID NO: 129347 - DNA, 601 bp, Human; identical to SEQ ID NO: 129276

SEQ ID NO: 129348 - DNA, 601 bp, Human; identical to SEQ ID NO: 20438

SEQ ID NO: 129349 - DNA, 601 bp, Human; identical to SEQ ID NO: 20439

SEQ ID NO: 129350 - DNA, 601 bp, Human; identical to SEQ ID NO: 129279

SEQ ID NO: 129351 - DNA, 601 bp, Human; identical to SEQ ID NO: 129280

SEQ ID NO: 129352 - DNA, 601 bp, Human; identical to SEQ ID NO: 129281

SEQ ID NO: 129353 - DNA, 601 bp, Human; identical to SEQ ID NO: 129282

SEQ ID NO: 129354 - DNA, 601 bp, Human; identical to SEQ ID NO: 129283

SEQ ID NO: 129355 - DNA, 601 bp, Human; identical to SEQ ID NO: 129284

SEQ ID NO: 129356 - DNA, 601 bp, Human; identical to SEQ ID NO: 129285

SEQ ID NO: 129357 - DNA, 601 bp, Human; identical to SEQ ID NO: 20440

SEQ ID NO: 129358 - DNA, 601 bp, Human; identical to SEQ ID NO: 20441

SEQ ID NO: 129359 - DNA, 601 bp, Human; identical to SEQ ID NO: 20442

SEQ ID NO: 129360 - DNA, 601 bp, Human; identical to SEQ ID NO: 20443

SEQ ID NO: 129361 - DNA, 601 bp, Human; identical to SEQ ID NO: 20444

SEQ ID NO: 129362 - DNA, 601 bp, Human; identical to SEQ ID NO: 20445

SEQ ID NO: 129363 - DNA, 601 bp, Human; identical to SEQ ID NO: 20446

SEQ ID NO: 129364 - DNA, 601 bp, Human; identical to SEQ ID NO: 20447

SEQ ID NO: 129365 - DNA, 601 bp, Human; identical to SEQ ID NO: 129294

SEQ ID NO: 129366 - DNA, 601 bp, Human; identical to SEQ ID NO: 129295

SEQ ID NO: 129367 - DNA, 601 bp, Human; identical to SEQ ID NO: 129296

SEQ ID NO: 129368 - DNA, 601 bp, Human; identical to SEQ ID NO: 129297

SEQ ID NO: 129369 - DNA, 601 bp, Human; identical to SEQ ID NO: 20448

SEQ ID NO: 129370 - DNA, 601 bp, Human; identical to SEQ ID NO: 20449

SEQ ID NO: 129371 - DNA, 601 bp, Human; identical to SEQ ID NO: 20450

SEQ ID NO: 129372 - DNA, 601 bp, Human; identical to SEQ ID NO: 20451

SEQ ID NO: 129373 - DNA, 601 bp, Human; identical to SEQ ID NO: 20452

SEQ ID NO: 129374 - DNA, 601 bp, Human; identical to SEQ ID NO: 20453

SEQ ID NO: 129375 - DNA, 601 bp, Human; identical to SEQ ID NO: 20454

SEQ ID NO: 129376 - DNA, 601 bp, Human; identical to SEQ ID NO: 20455

SEQ ID NO: 129377 - DNA, 601 bp, Human; identical to SEQ ID NO: 20456

SEQ ID NO: 129378 - DNA, 601 bp, Human; identical to SEQ ID NO: 20457

SEQ ID NO: 129379 - DNA, 601 bp, Human; identical to SEQ ID NO: 20458

SEQ ID NO: 129380 - DNA, 601 bp, Human; identical to SEQ ID NO: 20459

SEQ ID NO: 129381 - DNA, 601 bp, Human; identical to SEQ ID NO: 20460

SEQ ID NO: 129382 - DNA, 601 bp, Human; identical to SEQ ID NO: 20461

SEQ ID NO: 129383 - DNA, 601 bp, Human; identical to SEQ ID NO: 20462

SEQ ID NO: 129384 - DNA, 601 bp, Human; identical to SEQ ID NO: 20463

SEQ ID NO: 129385 - DNA, 601 bp, Human; identical to SEQ ID NO: 20464

SEQ ID NO: 129386 - DNA, 601 bp, Human; identical to SEQ ID NO: 20465

SEQ ID NO: 129387 - DNA, 601 bp, Human; identical to SEQ ID NO: 20466

SEQ ID NO: 129388 - DNA, 601 bp, Human; identical to SEQ ID NO: 20433

SEQ ID NO: 129389 - DNA, 601 bp, Human; identical to SEQ ID NO: 20434

SEQ ID NO: 129390 - DNA, 601 bp, Human; identical to SEQ ID NO: 20435

SEQ ID NO: 129391 - DNA, 601 bp, Human; identical to SEQ ID NO: 20436

SEQ ID NO: 129392 - DNA, 601 bp, Human; identical to SEQ ID NO: 20437

SEQ ID NO: 129393 - DNA, 601 bp, Human; identical to SEQ ID NO: 129251

SEQ ID NO: 129394 - DNA, 601 bp, Human; identical to SEQ ID NO: 129252

SEQ ID NO: 129395 - DNA, 601 bp, Human; identical to SEQ ID NO: 129253

SEQ ID NO: 129396 - DNA, 601 bp, Human; identical to SEQ ID NO: 129254

SEQ ID NO: 129397 - DNA, 601 bp, Human; identical to SEQ ID NO: 129255

SEQ ID NO: 129398 - DNA, 601 bp, Human; identical to SEQ ID NO: 129256

SEQ ID NO: 129399 - DNA, 601 bp, Human; identical to SEQ ID NO: 129257

SEQ ID NO: 129400 - DNA, 601 bp, Human; identical to SEQ ID NO: 129258

SEQ ID NO: 129401 - DNA, 601 bp, Human; identical to SEQ ID NO: 129259

SEQ ID NO: 129402 - DNA, 601 bp, Human; identical to SEQ ID NO: 129260

SEQ ID NO: 129403 - DNA, 601 bp, Human; identical to SEQ ID NO: 129261

SEQ ID NO: 129404 - DNA, 601 bp, Human; identical to SEQ ID NO: 129262

SEQ ID NO: 129405 - DNA, 601 bp, Human; identical to SEQ ID NO: 129263

SEQ ID NO: 129406 - DNA, 601 bp, Human; identical to SEQ ID NO: 129264

SEQ ID NO: 129407 - DNA, 601 bp, Human; identical to SEQ ID NO: 129265

SEQ ID NO: 129408 - DNA, 601 bp, Human; identical to SEQ ID NO: 129266

SEQ ID NO: 129409 - DNA, 601 bp, Human; identical to SEQ ID NO: 129267

SEQ ID NO: 129410 - DNA, 601 bp, Human; identical to SEQ ID NO: 129268

SEQ ID NO: 129411 - DNA, 601 bp, Human; identical to SEQ ID NO: 129269

SEQ ID NO: 129412 - DNA, 601 bp, Human; identical to SEQ ID NO: 129270

SEQ ID NO: 129413 - DNA, 601 bp, Human; identical to SEQ ID NO: 129271

SEQ ID NO: 129414 - DNA, 601 bp, Human; identical to SEQ ID NO: 129272

SEQ ID NO: 129415 - DNA, 601 bp, Human; identical to SEQ ID NO: 129273

SEQ ID NO: 129416 - DNA, 601 bp, Human; identical to SEQ ID NO: 129274

SEQ ID NO: 129417 - DNA, 601 bp, Human; identical to SEQ ID NO: 129275

SEQ ID NO: 129418 - DNA, 601 bp, Human; identical to SEQ ID NO: 129276

SEQ ID NO: 129419 - DNA, 601 bp, Human; identical to SEQ ID NO: 20438

SEQ ID NO: 129420 - DNA, 601 bp, Human; identical to SEQ ID NO: 20439

SEQ ID NO: 129421 - DNA, 601 bp, Human; identical to SEQ ID NO: 129279

SEQ ID NO: 129422 - DNA, 601 bp, Human; identical to SEQ ID NO: 129280

SEQ ID NO: 129423 - DNA, 601 bp, Human; identical to SEQ ID NO: 129281

SEQ ID NO: 129424 - DNA, 601 bp, Human; identical to SEQ ID NO: 129282

SEQ ID NO: 129425 - DNA, 601 bp, Human; identical to SEQ ID NO: 129283

SEQ ID NO: 129426 - DNA, 601 bp, Human; identical to SEQ ID NO: 129284

SEQ ID NO: 129427 - DNA, 601 bp, Human; identical to SEQ ID NO: 129285

SEQ ID NO: 129428 - DNA, 601 bp, Human; identical to SEQ ID NO: 20440

SEQ ID NO: 129429 - DNA, 601 bp, Human; identical to SEQ ID NO: 20441

SEQ ID NO: 129430 - DNA, 601 bp, Human; identical to SEQ ID NO: 20442

SEQ ID NO: 129431 - DNA, 601 bp, Human; identical to SEQ ID NO: 20443

SEQ ID NO: 129432 - DNA, 601 bp, Human; identical to SEQ ID NO: 20444

SEQ ID NO: 129433 - DNA, 601 bp, Human; identical to SEQ ID NO: 20445

SEQ ID NO: 129434 - DNA, 601 bp, Human; identical to SEQ ID NO: 20446

SEQ ID NO: 129435 - DNA, 601 bp, Human; identical to SEQ ID NO: 20447

SEQ ID NO: 129436 - DNA, 601 bp, Human; identical to SEQ ID NO: 129294

SEQ ID NO: 129437 - DNA, 601 bp, Human; identical to SEQ ID NO: 129295

SEQ ID NO: 129438 - DNA, 601 bp, Human; identical to SEQ ID NO: 129296

SEQ ID NO: 129439 - DNA, 601 bp, Human; identical to SEQ ID NO: 129297

SEQ ID NO: 129440 - DNA, 601 bp, Human; identical to SEQ ID NO: 20448

SEQ ID NO: 129441 - DNA, 601 bp, Human; identical to SEQ ID NO: 20449

SEQ ID NO: 129442 - DNA, 601 bp, Human; identical to SEQ ID NO: 20450

SEQ ID NO: 129443 - DNA, 601 bp, Human; identical to SEQ ID NO: 20451

SEQ ID NO: 129444 - DNA, 601 bp, Human; identical to SEQ ID NO: 20452

SEQ ID NO: 129445 - DNA, 601 bp, Human; identical to SEQ ID NO: 20453

SEQ ID NO: 129446 - DNA, 601 bp, Human; identical to SEQ ID NO: 20454

SEQ ID NO: 129447 - DNA, 601 bp, Human; identical to SEQ ID NO: 20455

SEQ ID NO: 129448 - DNA, 601 bp, Human; identical to SEQ ID NO: 20456

SEQ ID NO: 129449 - DNA, 601 bp, Human; identical to SEQ ID NO: 20457

SEQ ID NO: 129450 - DNA, 601 bp, Human; identical to SEQ ID NO: 20458

SEQ ID NO: 129451 - DNA, 601 bp, Human; identical to SEQ ID NO: 20459

SEQ ID NO: 129452 - DNA, 601 bp, Human; identical to SEQ ID NO: 20460

SEQ ID NO: 129453 - DNA, 601 bp, Human; identical to SEQ ID NO: 20461

SEQ ID NO: 129454 - DNA, 601 bp, Human; identical to SEQ ID NO: 20462

SEQ ID NO: 129455 - DNA, 601 bp, Human; identical to SEQ ID NO: 20463

SEQ ID NO: 129456 - DNA, 601 bp, Human; identical to SEQ ID NO: 20464

SEQ ID NO: 129457 - DNA, 601 bp, Human; identical to SEQ ID NO: 20465

SEQ ID NO: 129458 - DNA, 601 bp, Human; identical to SEQ ID NO: 20466

SEQ ID NO: 129459 - DNA, 601 bp, Human; identical to SEQ ID NO: 20433

SEQ ID NO: 129460 - DNA, 601 bp, Human; identical to SEQ ID NO: 20434

SEQ ID NO: 129461 - DNA, 601 bp, Human; identical to SEQ ID NO: 20435

SEQ ID NO: 129462 - DNA, 601 bp, Human; identical to SEQ ID NO: 20436

SEQ ID NO: 129463 - DNA, 601 bp, Human; identical to SEQ ID NO: 20437

SEQ ID NO: 129464 - DNA, 601 bp, Human; identical to SEQ ID NO: 129251

SEQ ID NO: 129465 - DNA, 601 bp, Human; identical to SEQ ID NO: 129252

SEQ ID NO: 129466 - DNA, 601 bp, Human; identical to SEQ ID NO: 129253

SEQ ID NO: 129467 - DNA, 601 bp, Human; identical to SEQ ID NO: 129254

SEQ ID NO: 129468 - DNA, 601 bp, Human; identical to SEQ ID NO: 129255

SEQ ID NO: 129469 - DNA, 601 bp, Human; identical to SEQ ID NO: 129256

SEQ ID NO: 129470 - DNA, 601 bp, Human; identical to SEQ ID NO: 129257

SEQ ID NO: 129471 - DNA, 601 bp, Human; identical to SEQ ID NO: 129258

SEQ ID NO: 129472 - DNA, 601 bp, Human; identical to SEQ ID NO: 129259

SEQ ID NO: 129473 - DNA, 601 bp, Human; identical to SEQ ID NO: 129260

SEQ ID NO: 129474 - DNA, 601 bp, Human; identical to SEQ ID NO: 129261

SEQ ID NO: 129475 - DNA, 601 bp, Human; identical to SEQ ID NO: 129262

SEQ ID NO: 129476 - DNA, 601 bp, Human; identical to SEQ ID NO: 129263

SEQ ID NO: 129477 - DNA, 601 bp, Human; identical to SEQ ID NO: 129264

SEQ ID NO: 129478 - DNA, 601 bp, Human; identical to SEQ ID NO: 129265

SEQ ID NO: 129479 - DNA, 601 bp, Human; identical to SEQ ID NO: 129266

SEQ ID NO: 129480 - DNA, 601 bp, Human; identical to SEQ ID NO: 129267

SEQ ID NO: 129481 - DNA, 601 bp, Human; identical to SEQ ID NO: 129268

SEQ ID NO: 129482 - DNA, 601 bp, Human; identical to SEQ ID NO: 129269

SEQ ID NO: 129483 - DNA, 601 bp, Human; identical to SEQ ID NO: 129270

SEQ ID NO: 129484 - DNA, 601 bp, Human; identical to SEQ ID NO: 129271

SEQ ID NO: 129485 - DNA, 601 bp, Human; identical to SEQ ID NO: 129272

SEQ ID NO: 129486 - DNA, 601 bp, Human; identical to SEQ ID NO: 129273

SEQ ID NO: 129487 - DNA, 601 bp, Human; identical to SEQ ID NO: 129274

SEQ ID NO: 129488 - DNA, 601 bp, Human; identical to SEQ ID NO: 129275

SEQ ID NO: 129489 - DNA, 601 bp, Human; identical to SEQ ID NO: 129276

SEQ ID NO: 129490 - DNA, 601 bp, Human; identical to SEQ ID NO: 20438

SEQ ID NO: 129491 - DNA, 601 bp, Human; identical to SEQ ID NO: 20439

SEQ ID NO: 129492 - DNA, 601 bp, Human; identical to SEQ ID NO: 129279

SEQ ID NO: 129493 - DNA, 601 bp, Human; identical to SEQ ID NO: 129280

SEQ ID NO: 129494 - DNA, 601 bp, Human; identical to SEQ ID NO: 129281

SEQ ID NO: 129495 - DNA, 601 bp, Human; identical to SEQ ID NO: 129282

SEQ ID NO: 129496 - DNA, 601 bp, Human; identical to SEQ ID NO: 129283

SEQ ID NO: 129497 - DNA, 601 bp, Human; identical to SEQ ID NO: 129284

SEQ ID NO: 129498 - DNA, 601 bp, Human; identical to SEQ ID NO: 129285

SEQ ID NO: 129499 - DNA, 601 bp, Human; identical to SEQ ID NO: 20440

SEQ ID NO: 129500 - DNA, 601 bp, Human; identical to SEQ ID NO: 20441

SEQ ID NO: 129501 - DNA, 601 bp, Human; identical to SEQ ID NO: 20442

SEQ ID NO: 129502 - DNA, 601 bp, Human; identical to SEQ ID NO: 20443

SEQ ID NO: 129503 - DNA, 601 bp, Human; identical to SEQ ID NO: 20444

SEQ ID NO: 129504 - DNA, 601 bp, Human; identical to SEQ ID NO: 20445

SEQ ID NO: 129505 - DNA, 601 bp, Human; identical to SEQ ID NO: 20446

SEQ ID NO: 129506 - DNA, 601 bp, Human; identical to SEQ ID NO: 20447

SEQ ID NO: 129507 - DNA, 601 bp, Human; identical to SEQ ID NO: 129294

SEQ ID NO: 129508 - DNA, 601 bp, Human; identical to SEQ ID NO: 129295

SEQ ID NO: 129509 - DNA, 601 bp, Human; identical to SEQ ID NO: 129296

SEQ ID NO: 129510 - DNA, 601 bp, Human; identical to SEQ ID NO: 129297

SEQ ID NO: 129511 - DNA, 601 bp, Human; identical to SEQ ID NO: 20448

SEQ ID NO: 129512 - DNA, 601 bp, Human; identical to SEQ ID NO: 20449

SEQ ID NO: 129513 - DNA, 601 bp, Human; identical to SEQ ID NO: 20450

SEQ ID NO: 129514 - DNA, 601 bp, Human; identical to SEQ ID NO: 20451

SEQ ID NO: 129515 - DNA, 601 bp, Human; identical to SEQ ID NO: 20452

SEQ ID NO: 129516 - DNA, 601 bp, Human; identical to SEQ ID NO: 20453

SEQ ID NO: 129517 - DNA, 601 bp, Human; identical to SEQ ID NO: 20454

SEQ ID NO: 129518 - DNA, 601 bp, Human; identical to SEQ ID NO: 20455

SEQ ID NO: 129519 - DNA, 601 bp, Human; identical to SEQ ID NO: 20456

SEQ ID NO: 129520 - DNA, 601 bp, Human; identical to SEQ ID NO: 20457

SEQ ID NO: 129521 - DNA, 601 bp, Human; identical to SEQ ID NO: 20458

SEQ ID NO: 129522 - DNA, 601 bp, Human; identical to SEQ ID NO: 20459

SEQ ID NO: 129523 - DNA, 601 bp, Human; identical to SEQ ID NO: 20460

SEQ ID NO: 129524 - DNA, 601 bp, Human; identical to SEQ ID NO: 20461

SEQ ID NO: 129525 - DNA, 601 bp, Human; identical to SEQ ID NO: 20462

SEQ ID NO: 129526 - DNA, 601 bp, Human; identical to SEQ ID NO: 20463

SEQ ID NO: 129527 - DNA, 601 bp, Human; identical to SEQ ID NO: 20464

SEQ ID NO: 129528 - DNA, 601 bp, Human; identical to SEQ ID NO: 20465

SEQ ID NO: 129529 - DNA, 601 bp, Human; identical to SEQ ID NO: 20466

SEQ ID NO: 129530 - DNA, 601 bp, Human; identical to SEQ ID NO: 20433

SEQ ID NO: 129531 - DNA, 601 bp, Human; identical to SEQ ID NO: 20434

SEQ ID NO: 129532 - DNA, 601 bp, Human; identical to SEQ ID NO: 20435

SEQ ID NO: 129533 - DNA, 601 bp, Human; identical to SEQ ID NO: 20436

SEQ ID NO: 129534 - DNA, 601 bp, Human; identical to SEQ ID NO: 20437

SEQ ID NO: 129535 - DNA, 601 bp, Human; identical to SEQ ID NO: 129251

SEQ ID NO: 129536 - DNA, 601 bp, Human; identical to SEQ ID NO: 129252

SEQ ID NO: 129537 - DNA, 601 bp, Human; identical to SEQ ID NO: 129253

SEQ ID NO: 129538 - DNA, 601 bp, Human; identical to SEQ ID NO: 129254

SEQ ID NO: 129539 - DNA, 601 bp, Human; identical to SEQ ID NO: 129255

SEQ ID NO: 129540 - DNA, 601 bp, Human; identical to SEQ ID NO: 129256

SEQ ID NO: 129541 - DNA, 601 bp, Human; identical to SEQ ID NO: 129257

SEQ ID NO: 129542 - DNA, 601 bp, Human; identical to SEQ ID NO: 129258

SEQ ID NO: 129543 - DNA, 601 bp, Human; identical to SEQ ID NO: 129259

SEQ ID NO: 129544 - DNA, 601 bp, Human; identical to SEQ ID NO: 129260

SEQ ID NO: 129545 - DNA, 601 bp, Human; identical to SEQ ID NO: 129261

SEQ ID NO: 129546 - DNA, 601 bp, Human; identical to SEQ ID NO: 129262

SEQ ID NO: 129547 - DNA, 601 bp, Human; identical to SEQ ID NO: 129263

SEQ ID NO: 129548 - DNA, 601 bp, Human; identical to SEQ ID NO: 129264

SEQ ID NO: 129549 - DNA, 601 bp, Human; identical to SEQ ID NO: 129265

SEQ ID NO: 129550 - DNA, 601 bp, Human; identical to SEQ ID NO: 129266

SEQ ID NO: 129551 - DNA, 601 bp, Human; identical to SEQ ID NO: 129267

SEQ ID NO: 129552 - DNA, 601 bp, Human; identical to SEQ ID NO: 129268

SEQ ID NO: 129553 - DNA, 601 bp, Human; identical to SEQ ID NO: 129269

SEQ ID NO: 129554 - DNA, 601 bp, Human; identical to SEQ ID NO: 129270

SEQ ID NO: 129555 - DNA, 601 bp, Human; identical to SEQ ID NO: 129271

SEQ ID NO: 129556 - DNA, 601 bp, Human; identical to SEQ ID NO: 129272

SEQ ID NO: 129557 - DNA, 601 bp, Human; identical to SEQ ID NO: 129273

SEQ ID NO: 129558 - DNA, 601 bp, Human; identical to SEQ ID NO: 129274

SEQ ID NO: 129559 - DNA, 601 bp, Human; identical to SEQ ID NO: 129275

SEQ ID NO: 129560 - DNA, 601 bp, Human; identical to SEQ ID NO: 129276

SEQ ID NO: 129561 - DNA, 601 bp, Human; identical to SEQ ID NO: 20438

SEQ ID NO: 129562 - DNA, 601 bp, Human; identical to SEQ ID NO: 20439

SEQ ID NO: 129563 - DNA, 601 bp, Human; identical to SEQ ID NO: 129279

SEQ ID NO: 129564 - DNA, 601 bp, Human; identical to SEQ ID NO: 129280

SEQ ID NO: 129565 - DNA, 601 bp, Human; identical to SEQ ID NO: 129281

SEQ ID NO: 129566 - DNA, 601 bp, Human; identical to SEQ ID NO: 129282

SEQ ID NO: 129567 - DNA, 601 bp, Human; identical to SEQ ID NO: 129283

SEQ ID NO: 129568 - DNA, 601 bp, Human; identical to SEQ ID NO: 129284

SEQ ID NO: 129569 - DNA, 601 bp, Human; identical to SEQ ID NO: 129285

SEQ ID NO: 129570 - DNA, 601 bp, Human; identical to SEQ ID NO: 20440

SEQ ID NO: 129571 - DNA, 601 bp, Human; identical to SEQ ID NO: 20441

SEQ ID NO: 129572 - DNA, 601 bp, Human; identical to SEQ ID NO: 20442

SEQ ID NO: 129573 - DNA, 601 bp, Human; identical to SEQ ID NO: 20443

SEQ ID NO: 129574 - DNA, 601 bp, Human; identical to SEQ ID NO: 20444

SEQ ID NO: 129575 - DNA, 601 bp, Human; identical to SEQ ID NO: 20445

SEQ ID NO: 129576 - DNA, 601 bp, Human; identical to SEQ ID NO: 20446

SEQ ID NO: 129577 - DNA, 601 bp, Human; identical to SEQ ID NO: 20447

SEQ ID NO: 129578 - DNA, 601 bp, Human; identical to SEQ ID NO: 129294

SEQ ID NO: 129579 - DNA, 601 bp, Human; identical to SEQ ID NO: 129295

SEQ ID NO: 129580 - DNA, 601 bp, Human; identical to SEQ ID NO: 129296

SEQ ID NO: 129581 - DNA, 601 bp, Human; identical to SEQ ID NO: 129297

SEQ ID NO: 129582 - DNA, 601 bp, Human; identical to SEQ ID NO: 20448

SEQ ID NO: 129583 - DNA, 601 bp, Human; identical to SEQ ID NO: 20449

SEQ ID NO: 129584 - DNA, 601 bp, Human; identical to SEQ ID NO: 20450

SEQ ID NO: 129585 - DNA, 601 bp, Human; identical to SEQ ID NO: 20451

SEQ ID NO: 129586 - DNA, 601 bp, Human; identical to SEQ ID NO: 20452

SEQ ID NO: 129587 - DNA, 601 bp, Human; identical to SEQ ID NO: 20453

SEQ ID NO: 129588 - DNA, 601 bp, Human; identical to SEQ ID NO: 20454

SEQ ID NO: 129589 - DNA, 601 bp, Human; identical to SEQ ID NO: 20455

SEQ ID NO: 129590 - DNA, 601 bp, Human; identical to SEQ ID NO: 20456

SEQ ID NO: 129591 - DNA, 601 bp, Human; identical to SEQ ID NO: 20457

SEQ ID NO: 129592 - DNA, 601 bp, Human; identical to SEQ ID NO: 20458

SEQ ID NO: 129593 - DNA, 601 bp, Human; identical to SEQ ID NO: 20459

SEQ ID NO: 129594 - DNA, 601 bp, Human; identical to SEQ ID NO: 20460

SEQ ID NO: 129595 - DNA, 601 bp, Human; identical to SEQ ID NO: 20461

SEQ ID NO: 129596 - DNA, 601 bp, Human; identical to SEQ ID NO: 20462

SEQ ID NO: 129597 - DNA, 601 bp, Human; identical to SEQ ID NO: 20463

SEQ ID NO: 129598 - DNA, 601 bp, Human; identical to SEQ ID NO: 20464

SEQ ID NO: 129599 - DNA, 601 bp, Human; identical to SEQ ID NO: 20465

SEQ ID NO: 129600 - DNA, 601 bp, Human; identical to SEQ ID NO: 20466

SEQ ID NO: 129601 - DNA, 601 bp, Human; identical to SEQ ID NO: 20433

SEQ ID NO: 129602 - DNA, 601 bp, Human; identical to SEQ ID NO: 20434

SEQ ID NO: 129603 - DNA, 601 bp, Human; identical to SEQ ID NO: 20435

SEQ ID NO: 129604 - DNA, 601 bp, Human; identical to SEQ ID NO: 20436

SEQ ID NO: 129605 - DNA, 601 bp, Human; identical to SEQ ID NO: 20437

SEQ ID NO: 129606 - DNA, 601 bp, Human; identical to SEQ ID NO: 129251

SEQ ID NO: 129607 - DNA, 601 bp, Human; identical to SEQ ID NO: 129252

SEQ ID NO: 129608 - DNA, 601 bp, Human; identical to SEQ ID NO: 129253

SEQ ID NO: 129609 - DNA, 601 bp, Human; identical to SEQ ID NO: 129254

SEQ ID NO: 129610 - DNA, 601 bp, Human; identical to SEQ ID NO: 129255

SEQ ID NO: 129611 - DNA, 601 bp, Human; identical to SEQ ID NO: 129256

SEQ ID NO: 129612 - DNA, 601 bp, Human; identical to SEQ ID NO: 129257

SEQ ID NO: 129613 - DNA, 601 bp, Human; identical to SEQ ID NO: 129258

SEQ ID NO: 129614 - DNA, 601 bp, Human; identical to SEQ ID NO: 129259

SEQ ID NO: 129615 - DNA, 601 bp, Human; identical to SEQ ID NO: 129260

SEQ ID NO: 129616 - DNA, 601 bp, Human; identical to SEQ ID NO: 129261

SEQ ID NO: 129617 - DNA, 601 bp, Human; identical to SEQ ID NO: 129262

SEQ ID NO: 129618 - DNA, 601 bp, Human; identical to SEQ ID NO: 129263

SEQ ID NO: 129619 - DNA, 601 bp, Human; identical to SEQ ID NO: 129264

SEQ ID NO: 129620 - DNA, 601 bp, Human; identical to SEQ ID NO: 129265

SEQ ID NO: 129621 - DNA, 601 bp, Human; identical to SEQ ID NO: 129266

SEQ ID NO: 129622 - DNA, 601 bp, Human; identical to SEQ ID NO: 129267

SEQ ID NO: 129623 - DNA, 601 bp, Human; identical to SEQ ID NO: 129268

SEQ ID NO: 129624 - DNA, 601 bp, Human; identical to SEQ ID NO: 129269

SEQ ID NO: 129625 - DNA, 601 bp, Human; identical to SEQ ID NO: 129270

SEQ ID NO: 129626 - DNA, 601 bp, Human; identical to SEQ ID NO: 129271

SEQ ID NO: 129627 - DNA, 601 bp, Human; identical to SEQ ID NO: 129272

SEQ ID NO: 129628 - DNA, 601 bp, Human; identical to SEQ ID NO: 129273

SEQ ID NO: 129629 - DNA, 601 bp, Human; identical to SEQ ID NO: 129274

SEQ ID NO: 129630 - DNA, 601 bp, Human; identical to SEQ ID NO: 129275

SEQ ID NO: 129631 - DNA, 601 bp, Human; identical to SEQ ID NO: 129276

SEQ ID NO: 129632 - DNA, 601 bp, Human; identical to SEQ ID NO: 20438

SEQ ID NO: 129633 - DNA, 601 bp, Human; identical to SEQ ID NO: 20439

SEQ ID NO: 129634 - DNA, 601 bp, Human; identical to SEQ ID NO: 129279

SEQ ID NO: 129635 - DNA, 601 bp, Human; identical to SEQ ID NO: 129280

SEQ ID NO: 129636 - DNA, 601 bp, Human; identical to SEQ ID NO: 129281

SEQ ID NO: 129637 - DNA, 601 bp, Human; identical to SEQ ID NO: 129282

SEQ ID NO: 129638 - DNA, 601 bp, Human; identical to SEQ ID NO: 129283

SEQ ID NO: 129639 - DNA, 601 bp, Human; identical to SEQ ID NO: 129284

SEQ ID NO: 129640 - DNA, 601 bp, Human; identical to SEQ ID NO: 129285

SEQ ID NO: 129641 - DNA, 601 bp, Human; identical to SEQ ID NO: 20440

SEQ ID NO: 129642 - DNA, 601 bp, Human; identical to SEQ ID NO: 20441

SEQ ID NO: 129643 - DNA, 601 bp, Human; identical to SEQ ID NO: 20442

SEQ ID NO: 129644 - DNA, 601 bp, Human; identical to SEQ ID NO: 20443

SEQ ID NO: 129645 - DNA, 601 bp, Human; identical to SEQ ID NO: 20444

SEQ ID NO: 129646 - DNA, 601 bp, Human; identical to SEQ ID NO: 20445

SEQ ID NO: 129647 - DNA, 601 bp, Human; identical to SEQ ID NO: 20446

SEQ ID NO: 129648 - DNA, 601 bp, Human; identical to SEQ ID NO: 20447

SEQ ID NO: 129649 - DNA, 601 bp, Human; identical to SEQ ID NO: 129294

SEQ ID NO: 129650 - DNA, 601 bp, Human; identical to SEQ ID NO: 129295

SEQ ID NO: 129651 - DNA, 601 bp, Human; identical to SEQ ID NO: 129296

SEQ ID NO: 129652 - DNA, 601 bp, Human; identical to SEQ ID NO: 129297

SEQ ID NO: 129653 - DNA, 601 bp, Human; identical to SEQ ID NO: 20448

SEQ ID NO: 129654 - DNA, 601 bp, Human; identical to SEQ ID NO: 20449

SEQ ID NO: 129655 - DNA, 601 bp, Human; identical to SEQ ID NO: 20450

SEQ ID NO: 129656 - DNA, 601 bp, Human; identical to SEQ ID NO: 20451

SEQ ID NO: 129657 - DNA, 601 bp, Human; identical to SEQ ID NO: 20452

SEQ ID NO: 129658 - DNA, 601 bp, Human; identical to SEQ ID NO: 20453

SEQ ID NO: 129659 - DNA, 601 bp, Human; identical to SEQ ID NO: 20454

SEQ ID NO: 129660 - DNA, 601 bp, Human; identical to SEQ ID NO: 20455

SEQ ID NO: 129661 - DNA, 601 bp, Human; identical to SEQ ID NO: 20456

SEQ ID NO: 129662 - DNA, 601 bp, Human; identical to SEQ ID NO: 20457

SEQ ID NO: 129663 - DNA, 601 bp, Human; identical to SEQ ID NO: 20458

SEQ ID NO: 129664 - DNA, 601 bp, Human; identical to SEQ ID NO: 20459

SEQ ID NO: 129665 - DNA, 601 bp, Human; identical to SEQ ID NO: 20460

SEQ ID NO: 129666 - DNA, 601 bp, Human; identical to SEQ ID NO: 20461

SEQ ID NO: 129667 - DNA, 601 bp, Human; identical to SEQ ID NO: 20462

SEQ ID NO: 129668 - DNA, 601 bp, Human; identical to SEQ ID NO: 20463

SEQ ID NO: 129669 - DNA, 601 bp, Human; identical to SEQ ID NO: 20464

SEQ ID NO: 129670 - DNA, 601 bp, Human; identical to SEQ ID NO: 20465

SEQ ID NO: 129671 - DNA, 601 bp, Human; identical to SEQ ID NO: 20466

SEQ ID NO: 129672 - DNA, 601 bp, Human; identical to SEQ ID NO: 20433

SEQ ID NO: 129673 - DNA, 601 bp, Human; identical to SEQ ID NO: 20434

SEQ ID NO: 129674 - DNA, 601 bp, Human; identical to SEQ ID NO: 20435

SEQ ID NO: 129675 - DNA, 601 bp, Human; identical to SEQ ID NO: 20436

SEQ ID NO: 129676 - DNA, 601 bp, Human; identical to SEQ ID NO: 20437

SEQ ID NO: 129677 - DNA, 601 bp, Human; identical to SEQ ID NO: 129251

SEQ ID NO: 129678 - DNA, 601 bp, Human; identical to SEQ ID NO: 129252

SEQ ID NO: 129679 - DNA, 601 bp, Human; identical to SEQ ID NO: 129253

SEQ ID NO: 129680 - DNA, 601 bp, Human; identical to SEQ ID NO: 129254

SEQ ID NO: 129681 - DNA, 601 bp, Human; identical to SEQ ID NO: 129255

SEQ ID NO: 129682 - DNA, 601 bp, Human; identical to SEQ ID NO: 129256

SEQ ID NO: 129683 - DNA, 601 bp, Human; identical to SEQ ID NO: 129257

SEQ ID NO: 129684 - DNA, 601 bp, Human; identical to SEQ ID NO: 129258

SEQ ID NO: 129685 - DNA, 601 bp, Human; identical to SEQ ID NO: 129259

SEQ ID NO: 129686 - DNA, 601 bp, Human; identical to SEQ ID NO: 129260

SEQ ID NO: 129687 - DNA, 601 bp, Human; identical to SEQ ID NO: 129261

SEQ ID NO: 129688 - DNA, 601 bp, Human; identical to SEQ ID NO: 129262

SEQ ID NO: 129689 - DNA, 601 bp, Human; identical to SEQ ID NO: 129263

SEQ ID NO: 129690 - DNA, 601 bp, Human; identical to SEQ ID NO: 129264

SEQ ID NO: 129691 - DNA, 601 bp, Human; identical to SEQ ID NO: 129265

SEQ ID NO: 129692 - DNA, 601 bp, Human; identical to SEQ ID NO: 129266

SEQ ID NO: 129693 - DNA, 601 bp, Human; identical to SEQ ID NO: 129267

SEQ ID NO: 129694 - DNA, 601 bp, Human; identical to SEQ ID NO: 129268

SEQ ID NO: 129695 - DNA, 601 bp, Human; identical to SEQ ID NO: 129269

SEQ ID NO: 129696 - DNA, 601 bp, Human; identical to SEQ ID NO: 129270

SEQ ID NO: 129697 - DNA, 601 bp, Human; identical to SEQ ID NO: 129271

SEQ ID NO: 129698 - DNA, 601 bp, Human; identical to SEQ ID NO: 129272

SEQ ID NO: 129699 - DNA, 601 bp, Human; identical to SEQ ID NO: 129273

SEQ ID NO: 129700 - DNA, 601 bp, Human; identical to SEQ ID NO: 129274

SEQ ID NO: 129701 - DNA, 601 bp, Human; identical to SEQ ID NO: 129275

SEQ ID NO: 129702 - DNA, 601 bp, Human; identical to SEQ ID NO: 129276

SEQ ID NO: 129703 - DNA, 601 bp, Human; identical to SEQ ID NO: 20438

SEQ ID NO: 129704 - DNA, 601 bp, Human; identical to SEQ ID NO: 20439

SEQ ID NO: 129705 - DNA, 601 bp, Human; identical to SEQ ID NO: 129279

SEQ ID NO: 129706 - DNA, 601 bp, Human; identical to SEQ ID NO: 129280

SEQ ID NO: 129707 - DNA, 601 bp, Human; identical to SEQ ID NO: 129281

SEQ ID NO: 129708 - DNA, 601 bp, Human; identical to SEQ ID NO: 129282

SEQ ID NO: 129709 - DNA, 601 bp, Human; identical to SEQ ID NO: 129283

SEQ ID NO: 129710 - DNA, 601 bp, Human; identical to SEQ ID NO: 129284

SEQ ID NO: 129711 - DNA, 601 bp, Human; identical to SEQ ID NO: 129285

SEQ ID NO: 129712 - DNA, 601 bp, Human; identical to SEQ ID NO: 20440

SEQ ID NO: 129713 - DNA, 601 bp, Human; identical to SEQ ID NO: 20441

SEQ ID NO: 129714 - DNA, 601 bp, Human; identical to SEQ ID NO: 20442

SEQ ID NO: 129715 - DNA, 601 bp, Human; identical to SEQ ID NO: 20443

SEQ ID NO: 129716 - DNA, 601 bp, Human; identical to SEQ ID NO: 20444

SEQ ID NO: 129717 - DNA, 601 bp, Human; identical to SEQ ID NO: 20445

SEQ ID NO: 129718 - DNA, 601 bp, Human; identical to SEQ ID NO: 20446

SEQ ID NO: 129719 - DNA, 601 bp, Human; identical to SEQ ID NO: 20447

SEQ ID NO: 129720 - DNA, 601 bp, Human; identical to SEQ ID NO: 129294

SEQ ID NO: 129721 - DNA, 601 bp, Human; identical to SEQ ID NO: 129295

SEQ ID NO: 129722 - DNA, 601 bp, Human; identical to SEQ ID NO: 129296

SEQ ID NO: 129723 - DNA, 601 bp, Human; identical to SEQ ID NO: 129297

SEQ ID NO: 129724 - DNA, 601 bp, Human; identical to SEQ ID NO: 20448

SEQ ID NO: 129725 - DNA, 601 bp, Human; identical to SEQ ID NO: 20449

SEQ ID NO: 129726 - DNA, 601 bp, Human; identical to SEQ ID NO: 20450

SEQ ID NO: 129727 - DNA, 601 bp, Human; identical to SEQ ID NO: 20451

SEQ ID NO: 129728 - DNA, 601 bp, Human; identical to SEQ ID NO: 20452

SEQ ID NO: 129729 - DNA, 601 bp, Human; identical to SEQ ID NO: 20453

SEQ ID NO: 129730 - DNA, 601 bp, Human; identical to SEQ ID NO: 20454

SEQ ID NO: 129731 - DNA, 601 bp, Human; identical to SEQ ID NO: 20455

SEQ ID NO: 129732 - DNA, 601 bp, Human; identical to SEQ ID NO: 20456

SEQ ID NO: 129733 - DNA, 601 bp, Human; identical to SEQ ID NO: 20457

SEQ ID NO: 129734 - DNA, 601 bp, Human; identical to SEQ ID NO: 20458

SEQ ID NO: 129735 - DNA, 601 bp, Human; identical to SEQ ID NO: 20459

SEQ ID NO: 129736 - DNA, 601 bp, Human; identical to SEQ ID NO: 20460

SEQ ID NO: 129737 - DNA, 601 bp, Human; identical to SEQ ID NO: 20461

SEQ ID NO: 129738 - DNA, 601 bp, Human; identical to SEQ ID NO: 20462

SEQ ID NO: 129739 - DNA, 601 bp, Human; identical to SEQ ID NO: 20463

SEQ ID NO: 129740 - DNA, 601 bp, Human; identical to SEQ ID NO: 20464

SEQ ID NO: 129741 - DNA, 601 bp, Human; identical to SEQ ID NO: 20465

SEQ ID NO: 129742 - DNA, 601 bp, Human; identical to SEQ ID NO: 20466

SEQ ID NO: 129743 - DNA, 601 bp, Human; identical to SEQ ID NO: 20433

SEQ ID NO: 129744 - DNA, 601 bp, Human; identical to SEQ ID NO: 20434

SEQ ID NO: 129745 - DNA, 601 bp, Human; identical to SEQ ID NO: 20435

SEQ ID NO: 129746 - DNA, 601 bp, Human; identical to SEQ ID NO: 20436

SEQ ID NO: 129747 - DNA, 601 bp, Human; identical to SEQ ID NO: 20437

SEQ ID NO: 129748 - DNA, 601 bp, Human; identical to SEQ ID NO: 129251

SEQ ID NO: 129749 - DNA, 601 bp, Human; identical to SEQ ID NO: 129252

SEQ ID NO: 129750 - DNA, 601 bp, Human; identical to SEQ ID NO: 129253

SEQ ID NO: 129751 - DNA, 601 bp, Human; identical to SEQ ID NO: 129254

SEQ ID NO: 129752 - DNA, 601 bp, Human; identical to SEQ ID NO: 129255

SEQ ID NO: 129753 - DNA, 601 bp, Human; identical to SEQ ID NO: 129256

SEQ ID NO: 129754 - DNA, 601 bp, Human; identical to SEQ ID NO: 129257

SEQ ID NO: 129755 - DNA, 601 bp, Human; identical to SEQ ID NO: 129258

SEQ ID NO: 129756 - DNA, 601 bp, Human; identical to SEQ ID NO: 129259

SEQ ID NO: 129757 - DNA, 601 bp, Human; identical to SEQ ID NO: 129260

SEQ ID NO: 129758 - DNA, 601 bp, Human; identical to SEQ ID NO: 129261

SEQ ID NO: 129759 - DNA, 601 bp, Human; identical to SEQ ID NO: 129262

SEQ ID NO: 129760 - DNA, 601 bp, Human; identical to SEQ ID NO: 129263

SEQ ID NO: 129761 - DNA, 601 bp, Human; identical to SEQ ID NO: 129264

SEQ ID NO: 129762 - DNA, 601 bp, Human; identical to SEQ ID NO: 129265

SEQ ID NO: 129763 - DNA, 601 bp, Human; identical to SEQ ID NO: 129266

SEQ ID NO: 129764 - DNA, 601 bp, Human; identical to SEQ ID NO: 129267

SEQ ID NO: 129765 - DNA, 601 bp, Human; identical to SEQ ID NO: 129268

SEQ ID NO: 129766 - DNA, 601 bp, Human; identical to SEQ ID NO: 129269

SEQ ID NO: 129767 - DNA, 601 bp, Human; identical to SEQ ID NO: 129270

SEQ ID NO: 129768 - DNA, 601 bp, Human; identical to SEQ ID NO: 129271

SEQ ID NO: 129769 - DNA, 601 bp, Human; identical to SEQ ID NO: 129272

SEQ ID NO: 129770 - DNA, 601 bp, Human; identical to SEQ ID NO: 129273

SEQ ID NO: 129771 - DNA, 601 bp, Human; identical to SEQ ID NO: 129274

SEQ ID NO: 129772 - DNA, 601 bp, Human; identical to SEQ ID NO: 129275

SEQ ID NO: 129773 - DNA, 601 bp, Human; identical to SEQ ID NO: 129276

SEQ ID NO: 129774 - DNA, 601 bp, Human; identical to SEQ ID NO: 20438

SEQ ID NO: 129775 - DNA, 601 bp, Human; identical to SEQ ID NO: 20439

SEQ ID NO: 129776 - DNA, 601 bp, Human; identical to SEQ ID NO: 129279

SEQ ID NO: 129777 - DNA, 601 bp, Human; identical to SEQ ID NO: 129280

SEQ ID NO: 129778 - DNA, 601 bp, Human; identical to SEQ ID NO: 129281

SEQ ID NO: 129779 - DNA, 601 bp, Human; identical to SEQ ID NO: 129282

SEQ ID NO: 129780 - DNA, 601 bp, Human; identical to SEQ ID NO: 129283

SEQ ID NO: 129781 - DNA, 601 bp, Human; identical to SEQ ID NO: 129284

SEQ ID NO: 129782 - DNA, 601 bp, Human; identical to SEQ ID NO: 129285

SEQ ID NO: 129783 - DNA, 601 bp, Human; identical to SEQ ID NO: 20440

SEQ ID NO: 129784 - DNA, 601 bp, Human; identical to SEQ ID NO: 20441

SEQ ID NO: 129785 - DNA, 601 bp, Human; identical to SEQ ID NO: 20442

SEQ ID NO: 129786 - DNA, 601 bp, Human; identical to SEQ ID NO: 20443

SEQ ID NO: 129787 - DNA, 601 bp, Human; identical to SEQ ID NO: 20444

SEQ ID NO: 129788 - DNA, 601 bp, Human; identical to SEQ ID NO: 20445

SEQ ID NO: 129789 - DNA, 601 bp, Human; identical to SEQ ID NO: 20446

SEQ ID NO: 129790 - DNA, 601 bp, Human; identical to SEQ ID NO: 20447

SEQ ID NO: 129791 - DNA, 601 bp, Human; identical to SEQ ID NO: 129294

SEQ ID NO: 129792 - DNA, 601 bp, Human; identical to SEQ ID NO: 129295

SEQ ID NO: 129793 - DNA, 601 bp, Human; identical to SEQ ID NO: 129296

SEQ ID NO: 129794 - DNA, 601 bp, Human; identical to SEQ ID NO: 129297

SEQ ID NO: 129795 - DNA, 601 bp, Human; identical to SEQ ID NO: 20448

SEQ ID NO: 129796 - DNA, 601 bp, Human; identical to SEQ ID NO: 20449

SEQ ID NO: 129797 - DNA, 601 bp, Human; identical to SEQ ID NO: 20450

SEQ ID NO: 129798 - DNA, 601 bp, Human; identical to SEQ ID NO: 20451

SEQ ID NO: 129799 - DNA, 601 bp, Human; identical to SEQ ID NO: 20452

SEQ ID NO: 129800 - DNA, 601 bp, Human; identical to SEQ ID NO: 20453

SEQ ID NO: 129801 - DNA, 601 bp, Human; identical to SEQ ID NO: 20454

SEQ ID NO: 129802 - DNA, 601 bp, Human; identical to SEQ ID NO: 20455

SEQ ID NO: 129803 - DNA, 601 bp, Human; identical to SEQ ID NO: 20456

SEQ ID NO: 129804 - DNA, 601 bp, Human; identical to SEQ ID NO: 20457

SEQ ID NO: 129805 - DNA, 601 bp, Human; identical to SEQ ID NO: 20458

SEQ ID NO: 129806 - DNA, 601 bp, Human; identical to SEQ ID NO: 20459

SEQ ID NO: 129807 - DNA, 601 bp, Human; identical to SEQ ID NO: 20460

SEQ ID NO: 129808 - DNA, 601 bp, Human; identical to SEQ ID NO: 20461

SEQ ID NO: 129809 - DNA, 601 bp, Human; identical to SEQ ID NO: 20462

SEQ ID NO: 129810 - DNA, 601 bp, Human; identical to SEQ ID NO: 20463

SEQ ID NO: 129811 - DNA, 601 bp, Human; identical to SEQ ID NO: 20464

SEQ ID NO: 129812 - DNA, 601 bp, Human; identical to SEQ ID NO: 20465

SEQ ID NO: 129813 - DNA, 601 bp, Human; identical to SEQ ID NO: 20466

SEQ ID NO: 129814 - DNA, 601 bp, Human; identical to SEQ ID NO: 20433

SEQ ID NO: 129815 - DNA, 601 bp, Human; identical to SEQ ID NO: 20434

SEQ ID NO: 129816 - DNA, 601 bp, Human; identical to SEQ ID NO: 20435

SEQ ID NO: 129817 - DNA, 601 bp, Human; identical to SEQ ID NO: 20436

SEQ ID NO: 129818 - DNA, 601 bp, Human; identical to SEQ ID NO: 20437

SEQ ID NO: 129819 - DNA, 601 bp, Human; identical to SEQ ID NO: 129251

SEQ ID NO: 129820 - DNA, 601 bp, Human; identical to SEQ ID NO: 129252

SEQ ID NO: 129821 - DNA, 601 bp, Human; identical to SEQ ID NO: 129253

SEQ ID NO: 129822 - DNA, 601 bp, Human; identical to SEQ ID NO: 129254

SEQ ID NO: 129823 - DNA, 601 bp, Human; identical to SEQ ID NO: 129255

SEQ ID NO: 129824 - DNA, 601 bp, Human; identical to SEQ ID NO: 129256

SEQ ID NO: 129825 - DNA, 601 bp, Human; identical to SEQ ID NO: 129257

SEQ ID NO: 129826 - DNA, 601 bp, Human; identical to SEQ ID NO: 129258

SEQ ID NO: 129827 - DNA, 601 bp, Human; identical to SEQ ID NO: 129259

SEQ ID NO: 129828 - DNA, 601 bp, Human; identical to SEQ ID NO: 129260

SEQ ID NO: 129829 - DNA, 601 bp, Human; identical to SEQ ID NO: 129261

SEQ ID NO: 129830 - DNA, 601 bp, Human; identical to SEQ ID NO: 129262

SEQ ID NO: 129831 - DNA, 601 bp, Human; identical to SEQ ID NO: 129263

SEQ ID NO: 129832 - DNA, 601 bp, Human; identical to SEQ ID NO: 129264

SEQ ID NO: 129833 - DNA, 601 bp, Human; identical to SEQ ID NO: 129265

SEQ ID NO: 129834 - DNA, 601 bp, Human; identical to SEQ ID NO: 129266

SEQ ID NO: 129835 - DNA, 601 bp, Human; identical to SEQ ID NO: 129267

SEQ ID NO: 129836 - DNA, 601 bp, Human; identical to SEQ ID NO: 129268

SEQ ID NO: 129837 - DNA, 601 bp, Human; identical to SEQ ID NO: 129269

SEQ ID NO: 129838 - DNA, 601 bp, Human; identical to SEQ ID NO: 129270

SEQ ID NO: 129839 - DNA, 601 bp, Human; identical to SEQ ID NO: 129271

SEQ ID NO: 129840 - DNA, 601 bp, Human; identical to SEQ ID NO: 129272

SEQ ID NO: 129841 - DNA, 601 bp, Human; identical to SEQ ID NO: 129273

SEQ ID NO: 129842 - DNA, 601 bp, Human; identical to SEQ ID NO: 129274

SEQ ID NO: 129843 - DNA, 601 bp, Human; identical to SEQ ID NO: 129275

SEQ ID NO: 129844 - DNA, 601 bp, Human; identical to SEQ ID NO: 129276

SEQ ID NO: 129845 - DNA, 601 bp, Human; identical to SEQ ID NO: 20438

SEQ ID NO: 129846 - DNA, 601 bp, Human; identical to SEQ ID NO: 20439

SEQ ID NO: 129847 - DNA, 601 bp, Human; identical to SEQ ID NO: 129279

SEQ ID NO: 129848 - DNA, 601 bp, Human; identical to SEQ ID NO: 129280

SEQ ID NO: 129849 - DNA, 601 bp, Human; identical to SEQ ID NO: 129281

SEQ ID NO: 129850 - DNA, 601 bp, Human; identical to SEQ ID NO: 129282

SEQ ID NO: 129851 - DNA, 601 bp, Human; identical to SEQ ID NO: 129283

SEQ ID NO: 129852 - DNA, 601 bp, Human; identical to SEQ ID NO: 129284

SEQ ID NO: 129853 - DNA, 601 bp, Human; identical to SEQ ID NO: 129285

SEQ ID NO: 129854 - DNA, 601 bp, Human; identical to SEQ ID NO: 20440

SEQ ID NO: 129855 - DNA, 601 bp, Human; identical to SEQ ID NO: 20441

SEQ ID NO: 129856 - DNA, 601 bp, Human; identical to SEQ ID NO: 20442

SEQ ID NO: 129857 - DNA, 601 bp, Human; identical to SEQ ID NO: 20443

SEQ ID NO: 129858 - DNA, 601 bp, Human; identical to SEQ ID NO: 20444

SEQ ID NO: 129859 - DNA, 601 bp, Human; identical to SEQ ID NO: 20445

SEQ ID NO: 129860 - DNA, 601 bp, Human; identical to SEQ ID NO: 20446

SEQ ID NO: 129861 - DNA, 601 bp, Human; identical to SEQ ID NO: 20447

SEQ ID NO: 129862 - DNA, 601 bp, Human; identical to SEQ ID NO: 129294

SEQ ID NO: 129863 - DNA, 601 bp, Human; identical to SEQ ID NO: 129295

SEQ ID NO: 129864 - DNA, 601 bp, Human; identical to SEQ ID NO: 129296

SEQ ID NO: 129865 - DNA, 601 bp, Human; identical to SEQ ID NO: 129297

SEQ ID NO: 129866 - DNA, 601 bp, Human; identical to SEQ ID NO: 20448

SEQ ID NO: 129867 - DNA, 601 bp, Human; identical to SEQ ID NO: 20449

SEQ ID NO: 129868 - DNA, 601 bp, Human; identical to SEQ ID NO: 20450

SEQ ID NO: 129869 - DNA, 601 bp, Human; identical to SEQ ID NO: 20451

SEQ ID NO: 129870 - DNA, 601 bp, Human; identical to SEQ ID NO: 20452

SEQ ID NO: 129871 - DNA, 601 bp, Human; identical to SEQ ID NO: 20453

SEQ ID NO: 129872 - DNA, 601 bp, Human; identical to SEQ ID NO: 20454

SEQ ID NO: 129873 - DNA, 601 bp, Human; identical to SEQ ID NO: 20455

SEQ ID NO: 129874 - DNA, 601 bp, Human; identical to SEQ ID NO: 20456

SEQ ID NO: 129875 - DNA, 601 bp, Human; identical to SEQ ID NO: 20457

SEQ ID NO: 129876 - DNA, 601 bp, Human; identical to SEQ ID NO: 20458

SEQ ID NO: 129877 - DNA, 601 bp, Human; identical to SEQ ID NO: 20459

SEQ ID NO: 129878 - DNA, 601 bp, Human; identical to SEQ ID NO: 20460

SEQ ID NO: 129879 - DNA, 601 bp, Human; identical to SEQ ID NO: 20461

SEQ ID NO: 129880 - DNA, 601 bp, Human; identical to SEQ ID NO: 20462

SEQ ID NO: 129881 - DNA, 601 bp, Human; identical to SEQ ID NO: 20463

SEQ ID NO: 129882 - DNA, 601 bp, Human; identical to SEQ ID NO: 20464

SEQ ID NO: 129883 - DNA, 601 bp, Human; identical to SEQ ID NO: 20465

SEQ ID NO: 129884 - DNA, 601 bp, Human; identical to SEQ ID NO: 20466

SEQ ID NO: 129885 - DNA, 601 bp, Human; identical to SEQ ID NO: 20433

SEQ ID NO: 129886 - DNA, 601 bp, Human; identical to SEQ ID NO: 20434

SEQ ID NO: 129887 - DNA, 601 bp, Human; identical to SEQ ID NO: 20435

SEQ ID NO: 129888 - DNA, 601 bp, Human; identical to SEQ ID NO: 20436

SEQ ID NO: 129889 - DNA, 601 bp, Human; identical to SEQ ID NO: 20437

SEQ ID NO: 129890 - DNA, 601 bp, Human; identical to SEQ ID NO: 129251

SEQ ID NO: 129891 - DNA, 601 bp, Human; identical to SEQ ID NO: 129252

SEQ ID NO: 129892 - DNA, 601 bp, Human; identical to SEQ ID NO: 129253

SEQ ID NO: 129893 - DNA, 601 bp, Human; identical to SEQ ID NO: 129254

SEQ ID NO: 129894 - DNA, 601 bp, Human; identical to SEQ ID NO: 129255

SEQ ID NO: 129895 - DNA, 601 bp, Human; identical to SEQ ID NO: 129256

SEQ ID NO: 129896 - DNA, 601 bp, Human; identical to SEQ ID NO: 129257

SEQ ID NO: 129897 - DNA, 601 bp, Human; identical to SEQ ID NO: 129258

SEQ ID NO: 129898 - DNA, 601 bp, Human; identical to SEQ ID NO: 129259

SEQ ID NO: 129899 - DNA, 601 bp, Human; identical to SEQ ID NO: 129260

SEQ ID NO: 129900 - DNA, 601 bp, Human; identical to SEQ ID NO: 129261

SEQ ID NO: 129901 - DNA, 601 bp, Human; identical to SEQ ID NO: 129262

SEQ ID NO: 129902 - DNA, 601 bp, Human; identical to SEQ ID NO: 129263

SEQ ID NO: 129903 - DNA, 601 bp, Human; identical to SEQ ID NO: 129264

SEQ ID NO: 129904 - DNA, 601 bp, Human; identical to SEQ ID NO: 129265

SEQ ID NO: 129905 - DNA, 601 bp, Human; identical to SEQ ID NO: 129266

SEQ ID NO: 129906 - DNA, 601 bp, Human; identical to SEQ ID NO: 129267

SEQ ID NO: 129907 - DNA, 601 bp, Human; identical to SEQ ID NO: 129268

SEQ ID NO: 129908 - DNA, 601 bp, Human; identical to SEQ ID NO: 129269

SEQ ID NO: 129909 - DNA, 601 bp, Human; identical to SEQ ID NO: 129270

SEQ ID NO: 129910 - DNA, 601 bp, Human; identical to SEQ ID NO: 129271

SEQ ID NO: 129911 - DNA, 601 bp, Human; identical to SEQ ID NO: 129272

SEQ ID NO: 129912 - DNA, 601 bp, Human; identical to SEQ ID NO: 129273

SEQ ID NO: 129913 - DNA, 601 bp, Human; identical to SEQ ID NO: 129274

SEQ ID NO: 129914 - DNA, 601 bp, Human; identical to SEQ ID NO: 129275

SEQ ID NO: 129915 - DNA, 601 bp, Human; identical to SEQ ID NO: 129276

SEQ ID NO: 129916 - DNA, 601 bp, Human; identical to SEQ ID NO: 20438

SEQ ID NO: 129917 - DNA, 601 bp, Human; identical to SEQ ID NO: 20439

SEQ ID NO: 129918 - DNA, 601 bp, Human; identical to SEQ ID NO: 129279

SEQ ID NO: 129919 - DNA, 601 bp, Human; identical to SEQ ID NO: 129280

SEQ ID NO: 129920 - DNA, 601 bp, Human; identical to SEQ ID NO: 129281

SEQ ID NO: 129921 - DNA, 601 bp, Human; identical to SEQ ID NO: 129282

SEQ ID NO: 129922 - DNA, 601 bp, Human; identical to SEQ ID NO: 129283

SEQ ID NO: 129923 - DNA, 601 bp, Human; identical to SEQ ID NO: 129284

SEQ ID NO: 129924 - DNA, 601 bp, Human; identical to SEQ ID NO: 129285

SEQ ID NO: 129925 - DNA, 601 bp, Human; identical to SEQ ID NO: 20440

SEQ ID NO: 129926 - DNA, 601 bp, Human; identical to SEQ ID NO: 20441

SEQ ID NO: 129927 - DNA, 601 bp, Human; identical to SEQ ID NO: 20442

SEQ ID NO: 129928 - DNA, 601 bp, Human; identical to SEQ ID NO: 20443

SEQ ID NO: 129929 - DNA, 601 bp, Human; identical to SEQ ID NO: 20444

SEQ ID NO: 129930 - DNA, 601 bp, Human; identical to SEQ ID NO: 20445

SEQ ID NO: 129931 - DNA, 601 bp, Human; identical to SEQ ID NO: 20446

SEQ ID NO: 129932 - DNA, 601 bp, Human; identical to SEQ ID NO: 20447

SEQ ID NO: 129933 - DNA, 601 bp, Human; identical to SEQ ID NO: 129294

SEQ ID NO: 129934 - DNA, 601 bp, Human; identical to SEQ ID NO: 129295

SEQ ID NO: 129935 - DNA, 601 bp, Human; identical to SEQ ID NO: 129296

SEQ ID NO: 129936 - DNA, 601 bp, Human; identical to SEQ ID NO: 129297

SEQ ID NO: 129937 - DNA, 601 bp, Human; identical to SEQ ID NO: 20448

SEQ ID NO: 129938 - DNA, 601 bp, Human; identical to SEQ ID NO: 20449

SEQ ID NO: 129939 - DNA, 601 bp, Human; identical to SEQ ID NO: 20450

SEQ ID NO: 129940 - DNA, 601 bp, Human; identical to SEQ ID NO: 20451

SEQ ID NO: 129941 - DNA, 601 bp, Human; identical to SEQ ID NO: 20452

SEQ ID NO: 129942 - DNA, 601 bp, Human; identical to SEQ ID NO: 20453

SEQ ID NO: 129943 - DNA, 601 bp, Human; identical to SEQ ID NO: 20454

SEQ ID NO: 129944 - DNA, 601 bp, Human; identical to SEQ ID NO: 20455

SEQ ID NO: 129945 - DNA, 601 bp, Human; identical to SEQ ID NO: 20456

SEQ ID NO: 129946 - DNA, 601 bp, Human; identical to SEQ ID NO: 20457

SEQ ID NO: 129947 - DNA, 601 bp, Human; identical to SEQ ID NO: 20458

SEQ ID NO: 129948 - DNA, 601 bp, Human; identical to SEQ ID NO: 20459

SEQ ID NO: 129949 - DNA, 601 bp, Human; identical to SEQ ID NO: 20460

SEQ ID NO: 129950 - DNA, 601 bp, Human; identical to SEQ ID NO: 20461

SEQ ID NO: 129951 - DNA, 601 bp, Human; identical to SEQ ID NO: 20462

SEQ ID NO: 129952 - DNA, 601 bp, Human; identical to SEQ ID NO: 20463

SEQ ID NO: 129953 - DNA, 601 bp, Human; identical to SEQ ID NO: 20464

SEQ ID NO: 129954 - DNA, 601 bp, Human; identical to SEQ ID NO: 20465

SEQ ID NO: 129955 - DNA, 601 bp, Human; identical to SEQ ID NO: 20466

SEQ ID NO: 129956 - DNA, 601 bp, Human; identical to SEQ ID NO: 20433

SEQ ID NO: 129957 - DNA, 601 bp, Human; identical to SEQ ID NO: 20434

SEQ ID NO: 129958 - DNA, 601 bp, Human; identical to SEQ ID NO: 20435

SEQ ID NO: 129959 - DNA, 601 bp, Human; identical to SEQ ID NO: 20436

SEQ ID NO: 129960 - DNA, 601 bp, Human; identical to SEQ ID NO: 20437

SEQ ID NO: 129961 - DNA, 601 bp, Human; identical to SEQ ID NO: 129251

SEQ ID NO: 129962 - DNA, 601 bp, Human; identical to SEQ ID NO: 129252

SEQ ID NO: 129963 - DNA, 601 bp, Human; identical to SEQ ID NO: 129253

SEQ ID NO: 129964 - DNA, 601 bp, Human; identical to SEQ ID NO: 129254

SEQ ID NO: 129965 - DNA, 601 bp, Human; identical to SEQ ID NO: 129255

SEQ ID NO: 129966 - DNA, 601 bp, Human; identical to SEQ ID NO: 129256

SEQ ID NO: 129967 - DNA, 601 bp, Human; identical to SEQ ID NO: 129257

SEQ ID NO: 129968 - DNA, 601 bp, Human; identical to SEQ ID NO: 129258

SEQ ID NO: 129969 - DNA, 601 bp, Human; identical to SEQ ID NO: 129259

SEQ ID NO: 129970 - DNA, 601 bp, Human; identical to SEQ ID NO: 129260

SEQ ID NO: 129971 - DNA, 601 bp, Human; identical to SEQ ID NO: 129261

SEQ ID NO: 129972 - DNA, 601 bp, Human; identical to SEQ ID NO: 129262

SEQ ID NO: 129973 - DNA, 601 bp, Human; identical to SEQ ID NO: 129263

SEQ ID NO: 129974 - DNA, 601 bp, Human; identical to SEQ ID NO: 129264

SEQ ID NO: 129975 - DNA, 601 bp, Human; identical to SEQ ID NO: 129265

SEQ ID NO: 129976 - DNA, 601 bp, Human; identical to SEQ ID NO: 129266

SEQ ID NO: 129977 - DNA, 601 bp, Human; identical to SEQ ID NO: 129267

SEQ ID NO: 129978 - DNA, 601 bp, Human; identical to SEQ ID NO: 129268

SEQ ID NO: 129979 - DNA, 601 bp, Human; identical to SEQ ID NO: 129269

SEQ ID NO: 129980 - DNA, 601 bp, Human; identical to SEQ ID NO: 129270

SEQ ID NO: 129981 - DNA, 601 bp, Human; identical to SEQ ID NO: 129271

SEQ ID NO: 129982 - DNA, 601 bp, Human; identical to SEQ ID NO: 129272

SEQ ID NO: 129983 - DNA, 601 bp, Human; identical to SEQ ID NO: 129273

SEQ ID NO: 129984 - DNA, 601 bp, Human; identical to SEQ ID NO: 129274

SEQ ID NO: 129985 - DNA, 601 bp, Human; identical to SEQ ID NO: 129275

SEQ ID NO: 129986 - DNA, 601 bp, Human; identical to SEQ ID NO: 129276

SEQ ID NO: 129987 - DNA, 601 bp, Human; identical to SEQ ID NO: 20438

SEQ ID NO: 129988 - DNA, 601 bp, Human; identical to SEQ ID NO: 20439

SEQ ID NO: 129989 - DNA, 601 bp, Human; identical to SEQ ID NO: 129279

SEQ ID NO: 129990 - DNA, 601 bp, Human; identical to SEQ ID NO: 129280

SEQ ID NO: 129991 - DNA, 601 bp, Human; identical to SEQ ID NO: 129281

SEQ ID NO: 129992 - DNA, 601 bp, Human; identical to SEQ ID NO: 129282

SEQ ID NO: 129993 - DNA, 601 bp, Human; identical to SEQ ID NO: 129283

SEQ ID NO: 129994 - DNA, 601 bp, Human; identical to SEQ ID NO: 129284

SEQ ID NO: 129995 - DNA, 601 bp, Human; identical to SEQ ID NO: 129285

SEQ ID NO: 129996 - DNA, 601 bp, Human; identical to SEQ ID NO: 20440

SEQ ID NO: 129997 - DNA, 601 bp, Human; identical to SEQ ID NO: 20441

SEQ ID NO: 129998 - DNA, 601 bp, Human; identical to SEQ ID NO: 20442

SEQ ID NO: 129999 - DNA, 601 bp, Human; identical to SEQ ID NO: 20443

SEQ ID NO: 130000 - DNA, 601 bp, Human; identical to SEQ ID NO: 20444

SEQ ID NO: 130001 - DNA, 601 bp, Human; identical to SEQ ID NO: 20445

SEQ ID NO: 130002 - DNA, 601 bp, Human; identical to SEQ ID NO: 20446

SEQ ID NO: 130003 - DNA, 601 bp, Human; identical to SEQ ID NO: 20447

SEQ ID NO: 130004 - DNA, 601 bp, Human; identical to SEQ ID NO: 129294

SEQ ID NO: 130005 - DNA, 601 bp, Human; identical to SEQ ID NO: 129295

SEQ ID NO: 130006 - DNA, 601 bp, Human; identical to SEQ ID NO: 129296

SEQ ID NO: 130007 - DNA, 601 bp, Human; identical to SEQ ID NO: 129297

SEQ ID NO: 130008 - DNA, 601 bp, Human; identical to SEQ ID NO: 20448

SEQ ID NO: 130009 - DNA, 601 bp, Human; identical to SEQ ID NO: 20449

SEQ ID NO: 130010 - DNA, 601 bp, Human; identical to SEQ ID NO: 20450

SEQ ID NO: 130011 - DNA, 601 bp, Human; identical to SEQ ID NO: 20451

SEQ ID NO: 130012 - DNA, 601 bp, Human; identical to SEQ ID NO: 20452

SEQ ID NO: 130013 - DNA, 601 bp, Human; identical to SEQ ID NO: 20453

SEQ ID NO: 130014 - DNA, 601 bp, Human; identical to SEQ ID NO: 20454

SEQ ID NO: 130015 - DNA, 601 bp, Human; identical to SEQ ID NO: 20455

SEQ ID NO: 130016 - DNA, 601 bp, Human; identical to SEQ ID NO: 20456

SEQ ID NO: 130017 - DNA, 601 bp, Human; identical to SEQ ID NO: 20457

SEQ ID NO: 130018 - DNA, 601 bp, Human; identical to SEQ ID NO: 20458

SEQ ID NO: 130019 - DNA, 601 bp, Human; identical to SEQ ID NO: 20459

SEQ ID NO: 130020 - DNA, 601 bp, Human; identical to SEQ ID NO: 20460

SEQ ID NO: 130021 - DNA, 601 bp, Human; identical to SEQ ID NO: 20461

SEQ ID NO: 130022 - DNA, 601 bp, Human; identical to SEQ ID NO: 20462

SEQ ID NO: 130023 - DNA, 601 bp, Human; identical to SEQ ID NO: 20463

SEQ ID NO: 130024 - DNA, 601 bp, Human; identical to SEQ ID NO: 20464

SEQ ID NO: 130025 - DNA, 601 bp, Human; identical to SEQ ID NO: 20465

SEQ ID NO: 130026 - DNA, 601 bp, Human; identical to SEQ ID NO: 20466

SEQ ID NO: 130027 - DNA, 601 bp, Human; identical to SEQ ID NO: 20433

SEQ ID NO: 130028 - DNA, 601 bp, Human; identical to SEQ ID NO: 20434

SEQ ID NO: 130029 - DNA, 601 bp, Human; identical to SEQ ID NO: 20435

SEQ ID NO: 130030 - DNA, 601 bp, Human; identical to SEQ ID NO: 20436

SEQ ID NO: 130031 - DNA, 601 bp, Human; identical to SEQ ID NO: 20437

SEQ ID NO: 130032 - DNA, 601 bp, Human; identical to SEQ ID NO: 129251

SEQ ID NO: 130033 - DNA, 601 bp, Human; identical to SEQ ID NO: 129252

SEQ ID NO: 130034 - DNA, 601 bp, Human; identical to SEQ ID NO: 129253

SEQ ID NO: 130035 - DNA, 601 bp, Human; identical to SEQ ID NO: 129254

SEQ ID NO: 130036 - DNA, 601 bp, Human; identical to SEQ ID NO: 129255

SEQ ID NO: 130037 - DNA, 601 bp, Human; identical to SEQ ID NO: 129256

SEQ ID NO: 130038 - DNA, 601 bp, Human; identical to SEQ ID NO: 129257

SEQ ID NO: 130039 - DNA, 601 bp, Human; identical to SEQ ID NO: 129258

SEQ ID NO: 130040 - DNA, 601 bp, Human; identical to SEQ ID NO: 129259

SEQ ID NO: 130041 - DNA, 601 bp, Human; identical to SEQ ID NO: 129260

SEQ ID NO: 130042 - DNA, 601 bp, Human; identical to SEQ ID NO: 129261

SEQ ID NO: 130043 - DNA, 601 bp, Human; identical to SEQ ID NO: 129262

SEQ ID NO: 130044 - DNA, 601 bp, Human; identical to SEQ ID NO: 129263

SEQ ID NO: 130045 - DNA, 601 bp, Human; identical to SEQ ID NO: 129264

SEQ ID NO: 130046 - DNA, 601 bp, Human; identical to SEQ ID NO: 129265

SEQ ID NO: 130047 - DNA, 601 bp, Human; identical to SEQ ID NO: 129266

SEQ ID NO: 130048 - DNA, 601 bp, Human; identical to SEQ ID NO: 129267

SEQ ID NO: 130049 - DNA, 601 bp, Human; identical to SEQ ID NO: 129268

SEQ ID NO: 130050 - DNA, 601 bp, Human; identical to SEQ ID NO: 129269

SEQ ID NO: 130051 - DNA, 601 bp, Human; identical to SEQ ID NO: 129270

SEQ ID NO: 130052 - DNA, 601 bp, Human; identical to SEQ ID NO: 129271

SEQ ID NO: 130053 - DNA, 601 bp, Human; identical to SEQ ID NO: 129272

SEQ ID NO: 130054 - DNA, 601 bp, Human; identical to SEQ ID NO: 129273

SEQ ID NO: 130055 - DNA, 601 bp, Human; identical to SEQ ID NO: 129274

SEQ ID NO: 130056 - DNA, 601 bp, Human; identical to SEQ ID NO: 129275

SEQ ID NO: 130057 - DNA, 601 bp, Human; identical to SEQ ID NO: 129276

SEQ ID NO: 130058 - DNA, 601 bp, Human; identical to SEQ ID NO: 20438

SEQ ID NO: 130059 - DNA, 601 bp, Human; identical to SEQ ID NO: 20439

SEQ ID NO: 130060 - DNA, 601 bp, Human; identical to SEQ ID NO: 129279

SEQ ID NO: 130061 - DNA, 601 bp, Human; identical to SEQ ID NO: 129280

SEQ ID NO: 130062 - DNA, 601 bp, Human; identical to SEQ ID NO: 129281

SEQ ID NO: 130063 - DNA, 601 bp, Human; identical to SEQ ID NO: 129282

SEQ ID NO: 130064 - DNA, 601 bp, Human; identical to SEQ ID NO: 129283

SEQ ID NO: 130065 - DNA, 601 bp, Human; identical to SEQ ID NO: 129284

SEQ ID NO: 130066 - DNA, 601 bp, Human; identical to SEQ ID NO: 129285

SEQ ID NO: 130067 - DNA, 601 bp, Human; identical to SEQ ID NO: 20440

SEQ ID NO: 130068 - DNA, 601 bp, Human; identical to SEQ ID NO: 20441

SEQ ID NO: 130069 - DNA, 601 bp, Human; identical to SEQ ID NO: 20442

SEQ ID NO: 130070 - DNA, 601 bp, Human; identical to SEQ ID NO: 20443

SEQ ID NO: 130071 - DNA, 601 bp, Human; identical to SEQ ID NO: 20444

SEQ ID NO: 130072 - DNA, 601 bp, Human; identical to SEQ ID NO: 20445

SEQ ID NO: 130073 - DNA, 601 bp, Human; identical to SEQ ID NO: 20446

SEQ ID NO: 130074 - DNA, 601 bp, Human; identical to SEQ ID NO: 20447

SEQ ID NO: 130075 - DNA, 601 bp, Human; identical to SEQ ID NO: 129294

SEQ ID NO: 130076 - DNA, 601 bp, Human; identical to SEQ ID NO: 129295

SEQ ID NO: 130077 - DNA, 601 bp, Human; identical to SEQ ID NO: 129296

SEQ ID NO: 130078 - DNA, 601 bp, Human; identical to SEQ ID NO: 129297

SEQ ID NO: 130079 - DNA, 601 bp, Human; identical to SEQ ID NO: 20448

SEQ ID NO: 130080 - DNA, 601 bp, Human; identical to SEQ ID NO: 20449

SEQ ID NO: 130081 - DNA, 601 bp, Human; identical to SEQ ID NO: 20450

SEQ ID NO: 130082 - DNA, 601 bp, Human; identical to SEQ ID NO: 20451

SEQ ID NO: 130083 - DNA, 601 bp, Human; identical to SEQ ID NO: 20452

SEQ ID NO: 130084 - DNA, 601 bp, Human; identical to SEQ ID NO: 20453

SEQ ID NO: 130085 - DNA, 601 bp, Human; identical to SEQ ID NO: 20454

SEQ ID NO: 130086 - DNA, 601 bp, Human; identical to SEQ ID NO: 20455

SEQ ID NO: 130087 - DNA, 601 bp, Human; identical to SEQ ID NO: 20456

SEQ ID NO: 130088 - DNA, 601 bp, Human; identical to SEQ ID NO: 20457

SEQ ID NO: 130089 - DNA, 601 bp, Human; identical to SEQ ID NO: 20458

SEQ ID NO: 130090 - DNA, 601 bp, Human; identical to SEQ ID NO: 20459

SEQ ID NO: 130091 - DNA, 601 bp, Human; identical to SEQ ID NO: 20460

SEQ ID NO: 130092 - DNA, 601 bp, Human; identical to SEQ ID NO: 20461

SEQ ID NO: 130093 - DNA, 601 bp, Human; identical to SEQ ID NO: 20462

SEQ ID NO: 130094 - DNA, 601 bp, Human; identical to SEQ ID NO: 20463

SEQ ID NO: 130095 - DNA, 601 bp, Human; identical to SEQ ID NO: 20464

SEQ ID NO: 130096 - DNA, 601 bp, Human; identical to SEQ ID NO: 20465

SEQ ID NO: 130097 - DNA, 601 bp, Human; identical to SEQ ID NO: 20466

SEQ ID NO: 130098 - DNA, 601 bp, Human
atatggatgatgaagaaggagaaggagaagaagatgatgatgatgatgaagaggaggaaggattagaagatattgatgaataaggggatgaggatgaaggtgaagaagatgaagataatgatgaaggggaggaaggagaggaggatgaaggagaagatgactaaatagaacactgatggattccaaccttcctttttttaaattttctccagttcctgggagcaagttgcagtcttttttttttttttttttttttccctcttgtgctctgtcaccctgttcttgaggtctcttttctctrctccatggttctcaacttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttcttcctcctttctctgtatattgggctcagagagtacactgtgtctctatgtgaatatggacagtt

SEQ ID NO: 130099 - DNA, 601 bp, Human
aggagaaggagaagaagatgatgatgatgatgaagaggaggaaggattagaagatattgatgaataaggggatgaggatgaaggtgaagaagatgaagataatgatgaaggggaggaaggagaggaggatgaaggagaagatgactaaatagaacactgatggattccaaccttcctttttttaaattttctccagttcctgggagcaagttgcagtcttttttttttttttttttttttccctcttgtgctctgtcaccctgttcttgaggtctcttttctctgctccatggttctcaayttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttcttcctcctttctctgtatattgggctcagagagtacactgtgtctctatgtgaatatggacagttagcatttaccaatatg

SEQ ID NO: 130100 - DNA, 601 bp, Human
ccaaccttcctttttttaaattttctccagttcctgggagcaagttgcagtcttttttttttttttttttttttccctcttgtgctctgtcaccctgttcttgaggtctcttttctctgctccatggttctcaacttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctrgaagctggagggtgctaggcccctgtgtagtagtgcatagaattctagctttcttcctcctttctctgtatattgggctcagagagtacactgtgtctctatgtgaatatggacagttagcatttaccaatatgtatctgtctactttctcttgtttaaaaaaagaaaaaaaaaacttaaaaaaatggggttatagaaggtcagcaaagggttggtttgagatgtttgggtgggttaagtgggcattttgacaacatggcttctcctttggcatgtttaattgtgatatttgacagacat

SEQ ID NO: 130101 - DNA, 601 bp, Human
tttttttttttttttttttttccctcttgtgctctgtcaccctgttcttgaggtctcttttctctgctccatggttctcaacttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttyttcctcctttctctgtatattgggctcagagagtacactgtgtctctatgtgaatatggacagttagcatttaccaatatgtatctgtctactttctcttgtttaaaaaaagaaaaaaaaaacttaaaaaaatggggttatagaaggtcagcaaagggttggtttgagatgtttgggtgggttaagtgggcattttgacaacatggcttctcctttggcatgtttaattgtgatatttgacagacatccttgcagtttaagatgacacttttaaaataaattgtctcctaatgatgactt

SEQ ID NO: 130102 - DNA, 601 bp, Human
caacttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttcttcctcctttctctgtatattgggctcagagagtacactgtgtctctatgtgaatatggacagttagcatttaccaayatgtatctgtctactttctcttgtttaaaaaaagaaaaaaaaaacttaaaaaaatggggttatagaaggtcagcaaagggttggtttgagatgtttgggtgggttaagtgggcattttgacaacatggcttctcctttggcatgtttaattgtgatatttgacagacatccttgcagtttaagatgacacttttaaaataaattgtctcctaatgatgacttgagccctgccactcaatgggagaatcagcagaacctgtaggatcttatttggaattgacattctctattgtaattttg

SEQ ID NO: 130103 - DNA, 601 bp, Human
caatgggaaaagagtctctacccctttctgttcgaagttcatttttatcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttcttcctcctttctctgtatattgggctcagagagtacactgtgtctctatgtgaatatggacagttagcatttaccaatatgtatctgtctactttctcttgtttaaaaaaagaaaaaaaaaacttaaaaaaatggggttatagaaggtcagcaaagggttggtttgagatgtttgggtgggttaagtgggcattttgacaacatggcttctcctttggcatgtttaattgtgatatttgacagacatccttgcagtttaagatgacacttttaaaataaattgtctcctaatgatgacttgagccctgccactcaatgggagaatcagcagaacctgtaggatcttatttggaattgacattctctattgtaattttgttcctgtttatttttaaattttctttttgtttcac

SEQ ID NO: 130104 - DNA, 601 bp, Human
tcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttcttcctcctttctctgtatattgggctcagagagtacactgtgtctctatgtgaatatggacagttagcatttaccaatatgtatctgtctactttctcttgtttaaaaaaagaaaaaaaaaacttaaaaaaatggggttatagaaggtcagcaaagggtkggtttgagatgtttgggtgggttaagtgggcattttgacaacatggcttctcctttggcatgtttaattgtgatatttgacagacatccttgcagtttaagatgacacttttaaaataaattgtctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacattaaaagtgtacaag

SEQ ID NO: 130105 - DNA, 601 bp, Human
catagaattctagctttcttcctcctttctctgtatattgggctcagagagtacactgtgtctctatgtgaatatggacagttagcatttaccaatatgtatctgtctactttctcttgtttaaaaaaagaaaaaaaaaacttaaaaaaatggggttatagaaggtcagcaaagggttggtttgagatgtttgggtgggttaagtgggcattttgacaacatggcttctcctttggcatgtttaattgtgatatttgacagacatccttgcagtttaagatgacacttttaaaataaattstctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacattaaaagtgtacaagttgctttgttacaataaaactaaatgtgtacacacacacaaaaaaaagaatacataaataccatgcctagaaattctatgcctggagaaatgtcaacatctggagaatcactcgcatagagtt

SEQ ID NO: 130106 - DNA, 601 bp, Human
gggttcaagtgattctcctgcctcagcctcctaagtagctgggactacaggggtgcaccatcatgcccagctaatttttgtacttttagtagagacgggggtttcaccatgttggccaggttggtccggatctcctgacctcatgatccgcccgcctcagcctcccgaacttctgggattacaggtgtgagccactatgcccagccaactgttttatgttttaataaacatgtttgcctacattgccaggctattattttaagaatagatgtctttaagagtagatgtattcagcttatcwtagactttaattcattgattatctcaatggctaatttcaagctcttgaatggaatgttcacatacctttgtttttgttttttttttttttttggaggcggagttttgttcttgtcactcaggctggagtacaatggagcgatcttggctcacggcaactttcacctgctgggttcaagcgattctcctgcctcagcctcccgagtagctgggattacaggcatgcaccaccatgcccagctaatttttttctttttttgagatggagtctcactctgccgcccaggctggagtgtagtgg

SEQ ID NO: 130107 - DNA, 601 bp, Human
cctcttccctctaatattcacagaattgcataaccatcaccacatctaattttagaacattttccttaccctaaaaaggaaccttatacccattagcagtcactcctcgttctacctgttgttgtcattgtcatcctgcccccaccccccagctcctcctttcctcctttcttgccagccctaggcaattaccaaccactaatttattttctgtctctatagatttgcttattttgggcattttatataaatggaatggtacaatatgtggtcttttatgactggcttcttttacttaccrtaatgttttcaaggttcatccatgttgctgcatgtatcagaactttattcctatttattgccagataatattccatcttatgggtataatgcattgtatttatcctttgatcagctgatgggcttttgggttatttccactttttggctgttataagtaatgccgccatgaatactggtcataagtttttgtggatatgtgtttttatttcttttggtatatgcctgggagtagaattgctaggtcttaaggtttaacattttgatgaattgccaaactattatttaaaatgatgataca

SEQ ID NO: 130108 - DNA, 601 bp, Human
ttccctctaatattcacagaattgcataaccatcaccacatctaattttagaacattttccttaccctaaaaaggaaccttatacccattagcagtcactcctcgttctacctgttgttgtcattgtcatcctgcccccaccccccagctcctcctttcctcctttcttgccagccctaggcaattaccaaccactaatttattttctgtctctatagatttgcttattttgggcattttatataaatggaatggtacaatatgtggtcttttatgactggcttcttttacttaccgtaaygttttcaaggttcatccatgttgctgcatgtatcagaactttattcctatttattgccagataatattccatcttatgggtataatgcattgtatttatcctttgatcagctgatgggcttttgggttatttccactttttggctgttataagtaatgccgccatgaatactggtcataagtttttgtggatatgtgtttttatttcttttggtatatgcctgggagtagaattgctaggtcttaaggtttaacattttgatgaattgccaaactattatttaaaatgatgatacaattt

SEQ ID NO: 130109 - DNA, 601 bp, Human
ttatttcatcacccaggtattaggcctagtacccattagctttgcttattttttaattgacttatttatttttttattattgagttgtaaatgttctttatatattctggttacaagtcttttatcagatatacgacttgcaaatgtcttctctagttctgtgagttgtcttcattttctcaatgataacatttggagaattataattttggaacactagtatattttctaattgctttgtattctaatgagaattagatcagagatgatggattggtttaccctgatttatttatatttwaaaagcttatgtttaaaatgtgcttcaaagagaaataatacccataagatattcgtctaattccttataggcacttaggaacaaatactttaaaagatgcatttttagtaataatctgttagtctaagaaaagtggtaacaggaaaagccaataatttattacgctttgttttccatgtcatcttggttactagtttatattggttggcttctttcctccctgtagggaaaagtaatagaacctctgaaagattttcataaagatgaagtgagaattttgggcagagaacttggacttcc

SEQ ID NO: 130110 - DNA, 601 bp, Human
agatgcatttttagtaataatctgttagtctaagaaaagtggtaacaggaaaagccaataatttattacgctttgttttccatgtcatcttggttactagtttatattggttggcttctttcctccctgtagggaaaagtaatagaacctctgaaagattttcataaagatgaagtgagaattttgggcagagaacttggacttccagaagagttagtttccaggcatccatttccaggtaaaaattagaactgaattttgtttgattcatctttagaccttcatgttgaagaaaaatcarttcagacaattctgaaataatctgtcatctcagggaatatgtaacatgagagaaaggaaaggatggttagggaataattgaaatcttttgagtatctactgtatttacttcattttattaaatactcattttccattgtatctgcatttaagtgttacattatccttgggagtctggcatctgatgttgccatcagatgagaaaaccaagacataaagatattttaataatattgccacacagtcctagtagtagagctaggatttgttatattatttgtaccataccgcagtgcgttcc

SEQ ID NO: 130111 - DNA, 601 bp, Human
aatgatatccccaataatttttatctcagagtttatactcttaatgatcatattggctccataaacagctttacacatgtataacctatgtggtgattagcacttgttctcaaatcaagtaatcagattgagatctttagtccctaacctgcatgccggcgaagaatggtctgtggaccggtgtggtggctcatgcctgtaaccctgagtctactaaaaatagaaaaattagccaggtgtggtggcatgtgcctgtaattctagctactcgggaggctgaggcaggagaatcgcttgaacycgggaggcagaggttgcagtgagacaagattacaccacagcactccaacctgggcaacagagcatgactccatcttaaaaaaaaaaaaaaaagaaaaaaaaaaaagaaaagaatgatctgtgaatgtaatggagggaagccaagtgttctatgtccttggtcattatttcatctagactcacttgatgttttaaaaatctattttgtatgttgagttttctattatgtaagacttcattggcaaaaatggttttactgctttaaaaactatcttaagtatgctgtttattctaaaggtaa

SEQ ID NO: 130112 - DNA, 601 bp, Human
tagtattaccctgttttatagatgaagaaacttagggacagagattaatatgccaaaaagttatgcagactaaaacgtatgcataatttaaatgttgcagcattctaaatgttacaacatttttagaatgttgaagcattctaaaaaatgctgagttgaatgggaaactaatagctacatttggatacttatgatgggcagatggattttaattttggaaaggttttatgttttgaaactagtggcatttttatattagatttttatattagaaatataacattaatgttaaatactattrttactcctacctttaggtcctggcctggcaatcagagtaatatgtgctgaagaaccttatatttgtaaggactttcctgaaaccaacaatattttgaaaatagtagctgatttttctgcaagtgttaaaaaggtaatatttgatacagctaatcattacaagaaattgaacggattcttattatataccagcatttataatgaattttttagggttttattatttgaaaatttggtgtaatataacctttgaaatgactgtggagaaaatattccacagatattcttatatgcatatttt

SEQ ID NO: 130113 - DNA, 601 bp, Human
gtaactaacctgcacattgtgcacatgtaccctaaaacttaaagtataataataaaaaaataaaaaataaaaaaaaagaaattctgtttcagagattattcttctaaaacctaataagcattttttctaaatatatgaatctgtcagtttaaattcccctttgctctgaattcatgcagttctgcctgtaaataaaacaagataaaaattgattgttgccaggcgcagtggttcatgcctgtaatcccagcactttgggaggctgaggcaggcggatcacctgaggttggaagttcaagascagcctgaccaacatgcagaaaccccatctctactaattagccgggtgtggtggtgcatgcctgtaatcccagctagtcgggaggctgaggcaggagaattgcttgaacccaggaggcggaggttgcggtgggccaagattgcgccattgcactccagcctgggcaacaagagtgaaactccttcttaaaaaaaaaaaaaaattgattgttatttttaaagtaaactaaaatattttatttcatgaaagtgatagagccagctattgggttaaggaactcttgccttctttttaaaggcc

SEQ ID NO: 130114 - DNA, 601 bp, Human
ctattgggttaaggaactcttgccttctttttaaaggccaaatgttgtaagctgcttatgttgttttaaaatcactattgaaataaccttacttggagttactgatactttctttcagtggtttatggattatctcattcatacataaatttattttgaaatttgcaatgatacttacaggcagtattaccctaatatataaaaatagaattgtggacaggttatttaattcttaaaagtttctgagttttaagtagatttgttatagagaacttcaacgtctgtgtgctaactgctgctrcaaagggagttgaaatagttccccactcttctttttagagaagtgttacaaaaaatagatacttgagataatctgatgaatgagtgatttctttcttgaaaatgaaacttattcaggctctactacttttcccaccaaaataaaattttcttttgttattggataactgactttagtctcttaccctttgaagcttagacccttgcaagcccagataaaaatgatggttcatagttagtataacaatgcattttattttctaaataccaaagtaaaccgtatttgtaaaaaatgaaaata

SEQ ID NO: 130115 - DNA, 601 bp, Human
aatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatggaagaaaattttcgcaacctacttatctgacaaagggctaatatccagaatctacagtgaactcaarcaaatttacaagaacaaaacaaacaaccccataaaattaacttttaagctgatacttaaacacgttgataagtaaatgtttatgaattgtttttgtctcccacttaagaattctttatccactcaaaaaacacgggcagatcttgtctgccaaattataatttttcataattttattttatttttttgagatggggtcttactctgttgcccaggctagagtacagtggcatgatcactgctcacgatagcctcgacctcgttgggctcaggtgatcctcctatctcagcttcctgagta

SEQ ID NO: 130116 - DNA, 601 bp, Human
caacaaaagccaaaattgacaaatgggatctaattaaactaaagagcttctgcacagcaaaagaaactaccatcagagtgaacaggcaacctacaaaatggaagaaaattttcgcaacctacttatctgacaaagggctaatatccagaatctacagtgaactcaagcaaatttacaagaacaaaacaaacaaccccataaaattaacttttaagctgatacttaaacacgttgataagtaaatgtttatgaattgtttttgtctcccacttaagaattctttatccactcaaaaaacacrggcagatcttgtctgccaaattataatttttcataattttattttatttttttgagatggggtcttactctgttgcccaggctagagtacagtggcatgatcactgctcacgatagcctcgacctcgttgggctcaggtgatcctcctatctcagcttcctgagtagcagggactacaggtgcatgccaccacactgcccagctaatttttgtatattttgtagagacagggtgttgccatgttgtccaggctggtctcaaacttctgggctcaactgacccacccacctcggcctccca

SEQ ID NO: 130117 - DNA, 601 bp, Human
tcatgttggccaggctggtcttgaactcatgacctcaggtgatctgcccacctcggcctcccaaagtgctgggattacaggcatgaaccactgtgcccagcctaaattcttgatattaccatgatactttatgtatgtcttagctgattcaggtaggatttaatatgggattttaatttggaatttatttataccattaaagaagcatttagtatatactttcattcaaaatttccaaaaatccattaataatgtcaccatgcataagatatttttcaatgcatcttttcttttttttttwaaaaaaaaaaaaagctttgtcaagttaaactggtgtatcttttgactattaaaaattattgattatctttttattttcagggtgactgtcgttcctacagttacgtgtgtggaatctccagtaaagatgaacctgactgggaatcacttatttttctggctaggcttatacctcgcatgtgtcacaacgttaacaggtgtgtttcacaggagctagggtgggggcttgtgtaatggaaggatgtatttcttaagggctttcaattaatggaagaccaaaaggctcaaatgtagatatagg

SEQ ID NO: 130118 - DNA, 601 bp, Human
aatttagtagtaaccccaagggaaaaaaatcaaagaaaagaaataggcatgtgccagatagcattaaaatagttacatttaaatatataatttacatttagattaatttccctttaatttgcatattaacttcttacattggatatatcaacagctgatttataatctatttctaatcctcaatttcatcgtaccatatatagttcaaaaattcacttattttgtactagattgctaattaaatgttcttacttcacagttattctctctgttcagttttcttcatgggtgttaggcagtyaacaaccaaaaagaattacttgaggtttcattttactcaaattgctgcagaaatcagaagcttaccttttaatgttaagctagcagagtctgtatagttcgagataaggagttacagggaagccatgtttttaccgatgggaacatgctcattcaaaggcttactcaaatgaactgaaaaccgtcaaatacagaagcatctttaaaatgctgaaaaatagaattattactatcttcaataatgggggccaggcatggtggctcacgcctgtaatcccaccactttgagaggccaaggcga

SEQ ID NO: 130119 - DNA, 601 bp, Human
agccatgtttttaccgatgggaacatgctcattcaaaggcttactcaaatgaactgaaaaccgtcaaatacagaagcatctttaaaatgctgaaaaatagaattattactatcttcaataatgggggccaggcatggtggctcacgcctgtaatcccaccactttgagaggccaaggcgagtggatcacttgagcccaggagtttgagaccagcctgggcaacatggtgaaactccatctctacaaaaaatacaaaaattagccaggcatggtggtgtgtgcctgtagtcccagctactcsggaggctgaggcagaagaatggtgtgaacccgggagacagagcttgcagtgagctgagattgcaccactgcactcaagcctgggcgacagagcgagacttcatctcaaaaaaaggaaaaagaaaaaaaaaagaatcttggtgaactttagatttatttgctggggtctttttgatgaattggagtttaaaaatattcttccctgtttgccggtttttttcctaatttggataagggaatctttgtacagggagggactgttccagttttactgtcatatatagtgtggataaatacctgt

SEQ ID NO: 130120 - DNA, 601 bp, Human
ggcttactcaaatgaactgaaaaccgtcaaatacagaagcatctttaaaatgctgaaaaatagaattattactatcttcaataatgggggccaggcatggtggctcacgcctgtaatcccaccactttgagaggccaaggcgagtggatcacttgagcccaggagtttgagaccagcctgggcaacatggtgaaactccatctctacaaaaaatacaaaaattagccaggcatggtggtgtgtgcctgtagtcccagctactcgggaggctgaggcagaagaatggtgtgaacccgggagrcagagcttgcagtgagctgagattgcaccactgcactcaagcctgggcgacagagcgagacttcatctcaaaaaaaggaaaaagaaaaaaaaaagaatcttggtgaactttagatttatttgctggggtctttttgatgaattggagtttaaaaatattcttccctgtttgccggtttttttcctaatttggataagggaatctttgtacagggagggactgttccagttttactgtcatatatagtgtggataaatacctgtcccagtacactctagtgattacttttgtttgtaagaa

SEQ ID NO: 130121 - DNA, 601 bp, Human
cccagctactcgggaggctgaggcagaagaatggtgtgaacccgggagacagagcttgcagtgagctgagattgcaccactgcactcaagcctgggcgacagagcgagacttcatctcaaaaaaaggaaaaagaaaaaaaaaagaatcttggtgaactttagatttatttgctggggtctttttgatgaattggagtttaaaaatattcttccctgtttgccggtttttttcctaatttggataagggaatctttgtacagggagggactgttccagttttactgtcatatatagtgtggrtaaatacctgtcccagtacactctagtgattacttttgtttgtaagaaatgagaaggtgaaaagagcaggttcatggcattctcttaactttctcctgtaaagatcttttatgaactttaggaactgtattgtttagaaaaattataacttactgtctatacgtgggacaaaaaccttgcttctgttgtagtatgtttggaaggagacaataaagtagttggtgataccggtggttttgtgctaatatggttttctattgtgtattttacctaagtacatattaagaaaagaagaaaaaa

SEQ ID NO: 130122 - DNA, 601 bp, Human
aatctttgtacagggagggactgttccagttttactgtcatatatagtgtggataaatacctgtcccagtacactctagtgattacttttgtttgtaagaaatgagaaggtgaaaagagcaggttcatggcattctcttaactttctcctgtaaagatcttttatgaactttaggaactgtattgtttagaaaaattataacttactgtctatacgtgggacaaaaaccttgcttctgttgtagtatgtttggaaggagacaataaagtagttggtgataccggtggttttgtgctaatayggttttctattgtgtattttacctaagtacatattaagaaaagaagaaaaaacattaaactttaccatgatagtttccggggagatttattttctttgctaaaaacaggactaacgaaaagtgaatagggagaactagctaagtggcactcatatctctaccctgattccctcttgttttctgggtgaagattgtgaaacagatcccttcaaaccagtggccagctacacttcaagttgttaaaattgtctgattctaatttcctcaagttatgttccaaactgtactctcattaactca

SEQ ID NO: 130123 - DNA, 601 bp, Human
cttgttttctgggtgaagattgtgaaacagatcccttcaaaccagtggccagctacacttcaagttgttaaaattgtctgattctaatttcctcaagttatgttccaaactgtactctcattaactcaagatatttgtggtgtatcttcatgtctttcaaacagacatttatataaaacactaatgaatcatttttttggaaggaagtagtaggatactaagtcctatttcaatggcctttttaatgaagtgcaaatgagaatctctctagaatgattgtttctcaagtagagaaaaaaaratgagtttactaattttgggaaattcactgtagtttcctcttggagatttccagtgcatgttagcatagtatattaatagtttctgaagtcttgtcataaagacacctatttttaaattttaattgtgtatttgtttcctaggactacccataacaaatcaccacaaactaggaggcttaaaacaacagacatttattctctcacagtttaggaggccagaagtctgaattcagtgttggcagggtcatattctctctgaagactctaggggaggatccttccttgcttcttcctactat

SEQ ID NO: 130124 - DNA, 601 bp, Human
tcatgtctttcaaacagacatttatataaaacactaatgaatcatttttttggaaggaagtagtaggatactaagtcctatttcaatggcctttttaatgaagtgcaaatgagaatctctctagaatgattgtttctcaagtagagaaaaaaagatgagtttactaattttgggaaattcactgtagtttcctcttggagatttccagtgcatgttagcatagtatattaatagtttctgaagtcttgtcataaagacacctatttttaaattttaattgtgtatttgtttcctaggactrcccataacaaatcaccacaaactaggaggcttaaaacaacagacatttattctctcacagtttaggaggccagaagtctgaattcagtgttggcagggtcatattctctctgaagactctaggggaggatccttccttgcttcttcctactatcgagtggtggcagcatagtccagtctgtctttgtgttcacatgaccctcattcccctgtgggtatctgtgtatccaaatttcccagcacttggaaggataccagtcattggattagagcccatcctaatccagtattacttcatttt

SEQ ID NO: 130125 - DNA, 601 bp, Human
acacctatttttaaattttaattgtgtatttgtttcctaggactacccataacaaatcaccacaaactaggaggcttaaaacaacagacatttattctctcacagtttaggaggccagaagtctgaattcagtgttggcagggtcatattctctctgaagactctaggggaggatccttccttgcttcttcctactatcgagtggtggcagcatagtccagtctgtctttgtgttcacatgaccctcattcccctgtgggtatctgtgtatccaaatttcccagcacttggaaggataccrgtcattggattagagcccatcctaatccagtattacttcattttaacttgattacatttgcaaagaccctttttctccccagagattctgggtgggcatgaagttttggggatactcttcgacccagtacattaagtgaaaagagagttgtaataatcacttatatctttgcacattctgagatacagaatattccagagaacacactttgaggaaaacacgtagaacacagaccttcctataatcttatatcttgtcctatccatctggggagttgaagtgggcaggagaagggcctga

SEQ ID NO: 130126 - DNA, 601 bp, Human
taatgtgaacaagtctttttcatggtctccttgatgctatatcttttgcatttttatgtcttttgttggtgattttgctgtttaaaatggatctcaactatagtgttgaagtgctgtctgggttcctaagcacaggaatgctgtgatgtaccttacagagaaaatctgtgtgttagataaacttcattcaggcatgagttaaagagctactgattgtcagttcagtgttaatgaatctataataaatattaaatacagtgtcttaaatcagaaacacataaaacaaggttatatattaatyagttgatgaaaatattacaaccagaggcttgcaggaacctaaccctccatttcccctgggagaaatggttcagtattcgctaattcgttgtttgcagtgtagaatataactatactgcaaattataatagagaataatgagactggactgtttctgtttacagcacatcagtgaaacatcactgatgtgatcaaattctgttttttgcatttgtgattaagtccatttaaaatgctctgcgagtagctgaaatcaatgcatgatgacagtcttaactacgctgtgtgtgtatatgtgatt

SEQ ID NO: 130127 - DNA, 601 bp, Human
aaaacaaggttatatattaatcagttgatgaaaatattacaaccagaggcttgcaggaacctaaccctccatttcccctgggagaaatggttcagtattcgctaattcgttgtttgcagtgtagaatataactatactgcaaattataatagagaataatgagactggactgtttctgtttacagcacatcagtgaaacatcactgatgtgatcaaattctgttttttgcatttgtgattaagtccatttaaaatgctctgcgagtagctgaaatcaatgcatgatgacagtcttaactaygctgtgtgtgtatatgtgatttcagatattgcctgggaggatttaattgaactgagttagagtgcttttctatggtgtggtgattggttctacatatacctttctctagggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtaatttatatatttttt

SEQ ID NO: 130128 - DNA, 601 bp, Human
attaatacactggggcagaaaaaggctttaaattatatatgctctccaattgtgtgattactgtataaaaagtaattgattataattttatctaatcctgccaatttctactttacaaacagtattccccaaataaaaaagaaaactctaggagtgaagaagagtttgttagaaataaggatgcaatttgatagctttatggccagacacccaagaattgcctaaatgttctccctactaccaattccaactcaatttttgatccttctttgtcttcaccagaacattccaaaggagctayttgcataatagcaagtgaaaatcaaagtgagactctattagttgggccactgcctccagtgcactaacacgaggctgtcgtgatagctaggtagatgggttggttcggaacgtggcttagagtcatttttctcttaggctcaaatttgtcaaatttgacaagtgagcaggctatcctctcctgtatacttgataatgattattacagtgtactctgtgccaccttggtggcccttagagttgtatgtttaagctgcagataatttgcagagcattggctgaaacacataaaatcacatgc

SEQ ID NO: 130129 - DNA, 601 bp, Human
ggcccttagagttgtatgtttaagctgcagataatttgcagagcattggctgaaacacataaaatcacatgcttggatgccacagcaatgtcaaatcgctatatgttcttaagcacttgtggctcagtcacaaacacaacttgcagactagcacctgtttgtggatcacactttgagtagtactgagtttaagtcactaatattttaaaccttaataacttacacctatccctgcagaggggaataggttcattatataagattaatcagaaaccatcccatatacatggaggacaatagygaaaatagtcaaattttaatttcaaattacaaatgtaagccctctaggactgctggacatgcagtggatgctgacttttctctataattttttttaataggtggtattaaagatggtcactgagattaagaagattcctggtatttctcgaattatgtatgacttaacatcaaagcccccaggaactactgagtgggagtaataaacttcttgttctattaaagtaccgtgtgcagtttaaattgattagaaatcattcccattattgacatgcagtactgtgaaaagagttactggagc

SEQ ID NO: 130130 - DNA, 601 bp, Human
gcaatcctcttttccatatctgcatcttcatgggggttgttgaagttgctttgaagtagaaaaaaaataggtatcttttatgagagacattttccctattattgtgttatacttacccagttcctttgattagaaggttctttactccaagacagaagagaagccagatgaggtgattcatgtttataatcccagccctttgggaggctgaggcgggagggtaatttgaggccaggcatttgagtccagcctgggcaacatggcaagatccttgtctctacaaataaataaataaattatwaaaaagattcgaagatataacagaagcaaacttaagcccagtgtgtgtagttatgaccacgtctattgagattttaagtttttacattaattgctcttacatgtttattcctggttcttaaagcattgtaaagtaaggcaaactgtgccttttcctcagagagtgaatgcagagcatccttcaccccatctagggggttcctttaactttctgaccaccccctacttttggcagtctattcctagccacaactagttttctttccaacccagttaactccccactgccccaacctatccc

SEQ ID NO: 130131 - DNA, 601 bp, Human
tctgcatcttcatgggggttgttgaagttgctttgaagtagaaaaaaaataggtatcttttatgagagacattttccctattattgtgttatacttacccagttcctttgattagaaggttctttactccaagacagaagagaagccagatgaggtgattcatgtttataatcccagccctttgggaggctgaggcgggagggtaatttgaggccaggcatttgagtccagcctgggcaacatggcaagatccttgtctctacaaataaataaataaattataaaaaagattcgaagatakaacagaagcaaacttaagcccagtgtgtgtagttatgaccacgtctattgagattttaagtttttacattaattgctcttacatgtttattcctggttcttaaagcattgtaaagtaaggcaaactgtgccttttcctcagagagtgaatgcagagcatccttcaccccatctagggggttcctttaactttctgaccaccccctacttttggcagtctattcctagccacaactagttttctttccaacccagttaactccccactgccccaacctatccccagctcatggctgccata

SEQ ID NO: 130132 - DNA, 601 bp, Human
ttaacacaaacagttctacctcattcttttaaacaattatatagactctcacacacagatgtacccttttaatttaatcaagactatattgataggctttcagattgtttccggtgggaggatatcagctttctttcgcctgtggccttcctagcagggtttaaaggatggtgcattttaaattataatggttattgccaggttgctctccaaaaaagtgacaccagtttacccacaaatggagcatgagagctggcatatgcattttgaaactagtgaattgagcctgactctgttttcrtaatactcagtggatactcacttgcagcattaatttcaatgcattttagttaaatatatacttacgtggatatagaaacacaatgacactagtgaggactggaaaatcaactaatgatttaaaattttaatttcccaaatggccaactggaacagatggttatctcttctctcctgaagactttcagggctgatggggaggggacaactcattctgatcttttatccctctgactttgaagacatttttccttctgttgaatcagaattgtttttcctttaattttaccccagcgatctt

SEQ ID NO: 130133 - DNA, 601 bp, Human
gacaaggtcttgctctctcacctaggctggagtgcaatggtgctatcatagctcacgataaccttgaattcctggttttaagcaatcctttcacctcagtctcctgagtagcttgtactacaggcatgtaccattgtttttatgttttgtagagatgggggtctcgctattttgcccagactggactccaactcctggcctcaagcaatcctcccaccttggcctcccacagtgctgggattataggcattaagtcactgtgcctggcctcccaatttcttttgtgctttttttttttttycccctcataggaattagcttctaacccttggcttgcttctcatccctctccagacttctgtattcttttagagaggggttactaccactggactcattgctctagtaagcaggtgaccacactactgcagattattgaggaaaggtctcttctggacccttgaacatcacctctaatacctgaagttcacactggctttttttttttttttctagttgtagtcctaaacttcagtgtttgatttttttatgtgcataccaggcttcccagcaggccaggtgattggttggagcattagca

SEQ ID NO: 130134 - DNA, 601 bp, Human
gaacctcacctacaccagagcgggatgtgtgggtgggaggggtggaggccagggagacatctgaattttttttttgtttcaagatggagtttcactctgtcacccaggctggagtgcagtggtgcgatcttggctgactgcaacctctgcctcccgagctcaagcgattctcgggccgcagcctcccaacattggaattttataacaacgaagcaatagaagagatcccagtcccagccctggaatgggtcgtggaggcaccaggctgcttctttggttgacagaagatgggatgaggackggttcgagggacggcctgggataatggacaaagcgaaatattgggatattttaacaaccacactcacctgctattcagcttgggtggaggctgattggccaccagccaccaccttcactggggattggaaggtatagctgggtcttctctccacagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagc

SEQ ID NO: 130135 - DNA, 601 bp, Human
gttttattccctttgggctcaccctctacctaatcacacctccagatggcaggcagagaggggccaggctgaggcagggactcctcctttggtccttgctcttgctgcttttaaacaaaaattgttgtaaaatacacataacatgaaatttaccatcttaaccatttttaagcatacaagtcagtagagtgaggtatattcacattgttgtgtaactgtattagtctcttttcatgctactgataaagacatacctgaaactgggaagaaaaagaggtttaatggatttacagttccacayggctggggaggcctcacaatcatggcggaaggcaaggaggagcaaaggcacatcttacatggatggcggcaggcaaagagagcttgtgcagggaaattccccttttaaaaaccatcagatcttgtgagacttattcactatcatgagaacagcatgggaaagttacctcctactgggtccctcccacaacacatgggaattcaagatgagatttgagtggggacacagccaaaccatatcagtaatgaatctccagaaccttttcatttccaccagcagaaacactgtactcaataaata

SEQ ID NO: 130136 - DNA, 601 bp, Human
cagtcatcccagaaagggagtccttacatccctgaggactccccaaggtgaaataaatccttcccatggcctttctgttgcctaactatcaatcatccagccacagaactctgtgaaacatctaagaattcagccaaggctgcctgcctgtcatgggaagctgagaaccatgagcccaagtttgcttttcttagaatttacagtctggctggggagacaaggccaaggtctatatacatgccctttgtttcccagattttctttgaggaagggtttcagctttgtgagtgactggttgaawcacaaaaccagggatctttatacggttgagcaggggttcattgaatccagtggttctcaaactttggtttagacccatagccttttgttcgaactaaattttatggggaagtcagtgcatgaaactgaagagaacagagtttctctggctgaggaggagagggctgggttcaggcttcttggagcctctaactaggctccttggagcagagccagttcaccgattagtcagacttcctaagagtcaaaatcaggaaaacagatccttaaatgggaagtgacttaatcaaggtcacagcta

SEQ ID NO: 130137 - DNA, 601 bp, Human
ggtgtgagccaccgcgcccagccgggaagcattttctacttcacaaacctccttgggaaccagtgcaacttatttgctgcctccatggtgttgggcttgtttatctgaagacagaagagactcttgtcctcctagtcatcccttccccaaccctgtactttgcccggcccataactaaggtttggcacttgcccctcctgggaagaggtatgcataaaaagtgactaaataaagttcacgattttcttcaactagactgacttccactatttcgaacccagatccagaccatgtacagttracccttgaacaacataggcttgaactgtgtggatccatttatatacagacacttttcaataaaatttacactgaatgtgcctgtccctcctgcctctcctttcacctccacctcctcttccacctctgccaccctaggaccgcaagaccaacccttcctcctcctcagcctactcaacctgaagacaaggaagatgaaggccttgaagattatccacttccacttactagtaaatatattttcttttccttatgattttcttaatttttttctccaacttactttattataagaatacag

SEQ ID NO: 130138 - DNA, 601 bp, Human
gggggaaagttccgctttcagacctccttcacggtggttcttttggcgccacaggctcgtgtgtccagggggcaccgagctgcgcgctttcggcgagcggctagccccggctcaccgcaaccagccaccgtgaatctgaggatccgatatcggccctggaccctcagatccgtggtttcggtgaattaccgagctggcattgccgaaattctcattgcagtatcagtgtgttttgaaaggaaaggttacagcactaaaggcgccgtgtctacactgaggaagcaagtcttggacagtaagkgcgccttcttcggagccctctgcatagcagagcccggtgggggcgcggtgccaaaggccggcttcatttgagcggggtaactgccttccctgccggccactcttcatttccggagcagttttaatagtgtatgtccagttgtagaggtcaaaaactcgagtttgtgaaactgcttccccgggtctttcggcttgtagtcgctacaaagtcattgatatattttaggcgtgccacgttacctgttttgaaaggaggagaaaaatatatgaaccacgaaaactgaattcagagatgaaggca

SEQ ID NO: 130139 - DNA, 601 bp, Human
aatcttctaattataatgtgatgcttgttttttgtttttgtttttgtttttgagacggtgtctcgctcttgttacccaggctggagtgcaatggtgcgatctctgctcactgcaacctctgcctcccgagttcaagcgattctcctgcctcagccttccaagtagctggaattacaggtgcccaccagctcgcccagctaattttgtgtatttttagtagagactgggtttcaccatgttggccaggctggtctggaactcctggcctcaggtgatctacatgccgcggcctcccaaagtkctgggattacaggcatgagccactgcaccgagcccaatgtgacttcttatatagccagtttacagtcagaggatgcactagctggaagagaagcattgtattcccttggcaataattgctcttatgtataccaataagctggtttatgagtttggttagtgagaattcatctttaaaagatgggaaaatgtttggtaagcagccaaaagaagcttctaagttttcagggttgaaacctacacattgaacccttccaaattcagcttgtttgtggtacaatcagctaaccattccccaggt

SEQ ID NO: 130140 - DNA, 601 bp, Human
aaaattctaagattcaaaactatattttgatttagaagaagaatatgcacgcgcacttgtatgtttgagtcagtgttgagcaataattttacctgaagtctaattaaggaaaaaaaattcaatgatgggcctcatttttaaatttgaaatggaaatgattttattacattctatagaaaattgtataatatcacacattagacctcctaatttattactaaaattatatcagtaaatgaaatcgtccaattctctggtatatttaagaattgtcaacacagaaacagatttaaaaatctcwtattgaaattagattatctgtcacgacggccatactgggaaaggagctttgtgataaaggcctgtgggttcttcatcacagttttaacaaatcacaatttaaaataccttttaaagtaagtgcccattttattgtgcttactttccattatagatcagagtttgagaatatggtgtctgtagccaaattgtttagttttgaaacctgtgtctcctttctccagtttcccagttgggtggcattggggaagttgcttaaaccctcttctgtcctaatctatgcaatgggaataatagcacc

SEQ ID NO: 130141 - DNA, 601 bp, Human
atattgaaattagattatctgtcacgacggccatactgggaaaggagctttgtgataaaggcctgtgggttcttcatcacagttttaacaaatcacaatttaaaataccttttaaagtaagtgcccattttattgtgcttactttccattatagatcagagtttgagaatatggtgtctgtagccaaattgtttagttttgaaacctgtgtctcctttctccagtttcccagttgggtggcattggggaagttgcttaaaccctcttctgtcctaatctatgcaatgggaataatagcacytatcttgtaggatagctgtgaaagttaaatgaattaatacacataaagttcattaaacagtgtggttgtcagtagtaagctcttaagaggtgttagtattattcaagtatttaaataaattaaatctcagttaatctttcccacttccccaaaatacgattatacacccaactgattcacatagatattatacataaagaagagaggccacaggttcagaattataaaattgccagctgtagctcctctccactctacctttctttccactcaaaaaagagaatctgaatgagagtgatg

SEQ ID NO: 130142 - DNA, 601 bp, Human
gcaggttagttacatatgcatacatgtgccatgctggtgtgctgcacccattaactcgtcatttagcattaggtatgtctcctaatgctatccctcccccctcccccaaccccacaacagtccccagagtgtgatcttccccttcctgtgtccatgtgttctcattgttcaattcccatctatgagtgagaacatgcagtgtttggttttttgtccttgccatagtttactgagaatgatgatttccaatttcatccatgtccctacaaaggacatgaattcatcattttttatggctgcrtagtattccatggtgtatatgtgccacattttcttaatccagtctatcattgttggacatttgggttctttccaagtctttgctcttgtgaatagtgccacaataaacatacatgtgcatgtgtctttatagcagcatgatttatagtcctttgggtatatacccagtaatgggatggctgggtcaaatggtatttctagttctagatacctgaggactccccacactgacttccacaatggttgaactagtttacagtcccaccaacagtgtaaaagtgttcctatttctccacatcct

SEQ ID NO: 130143 - DNA, 601 bp, Human
atgtcttggatgcttttgagagtaaaatattagagaaaatttggagaaaatctggttttatttttacaaaactattgactattgaaagagaactttaaaattcagtcactaacttaacaaaattatataaatttgaatgatgtttcatttttactgaaaaataaaccttgtgctcttgaaaccaacatatcattttgagaaataagtctttactgataaaaacagtgcagaattggatttatcacagatctcattattcaatggtacttaatagctgagaacttaatagttttaagtctgrtgtcacttctctggacaaaataatcttaaattcttataatctttcaacttaagtcctttttttataagctttgttttatttccttactttacttttgatccttcccagtccttcagaattttaacttctatatcatggttttactctgccaattcccatattaccttcccaatttaccttgttagtaaatttttacttctttggtctctgaggcaagctgtcttctgaattcttgcccagaaattctaagacttttctaatatattattaaaaatacttgtccagataaaccaatataaa

SEQ ID NO: 130144 - DNA, 601 bp, Human
ataaaaatatatggagttctcaattttccatggaaatagaatctagggttaatgtggtgaaataattttcattattaacaagccttattttagtatatgtaaataggattagattgaaaagccaagttttatagtaaaagatgtgatttctgtaaaagagagtattctgtaaaagctggaggacaagtgaagcttaaaggagcagcttgtactgatgagaaaggggagaggaatgagtggacctctcttcagagaggaaagaaagataagatgaaaagccagcatgaaaaggaacttgctrtttaaaattacaacaaactgtttatgtggaccagtagcatcatgatgtaaaataaattttctttactgctttgccatgacgcttaattgataatacattctagtaagcccaaatttgaatctcttctcgataactaacattcagttaatttcttatttcgaagtgggaagagcaatggctggaaagaaacttcctacagagaaattctgatgcaaatatgtcttgaaatccagagcattttggtccaaatttaacaatgtgtgtcaaattttacaacagcagatgtgaatttatggttct

SEQ ID NO: 130145 - DNA, 601 bp, Human
aaatatgtcttgaaatccagagcattttggtccaaatttaacaatgtgtgtcaaattttacaacagcagatgtgaatttatggttctttattaagttttaggaattctgaattgtatttgtctgcttaattctatagtgaaactaaagctcagttaaatagtctaaagaatgttacttaatagtaaaattacataaatatgccatgcacatgttggctttcaacagagtgcatttgaatatattcagatctgtggtgggtgctgaagacttgtctatataggttcagttccataactgaamcagtgagaatctagaaaaccagtgttttcaaaactactccctcatgggtgaatggagcacatactattgaatgatctgctctaaacttaggcattggtgggcctgaaataagacttgggcagtgagcatctgcttctcttcacccaaagagttgaccttccaagactatagaggaagttaaaattaagaaatgagtataagagagacacaagtaggtgacttctcaaattctgaaaagggaagtttgggtaaacaaatctgaaggaagaagaaattaatattagaaaagcagagttagga

SEQ ID NO: 130146 - DNA, 601 bp, Human
ttcagggatattggcctgaagttttcctcttttgtatttctgccaggttttggtatcacgataatgctggtctcacaaaatgagttaggaagaagtccctgtctttcagtttttggaatagtttcagaagaaatggtatcagctcctctttgtaccttcggtagaattcagctgtaaatccttctggtcctggtctttttttttgtttggtaggctatttattgctgcctcaatttcagaacttactattggtctattcagggattccacttcttcctggtttagtcttggggtggtgtaygtatccaagaatttttccttttcttctagattttctagtttatttgcataacggtgtttattgtattctctgatcgttgtttgtatttctgtgggttcagtggtgatatctcctttatcattttttattatgtctgtttgattgttctctctttttttctttattagtctagctagcaggctattttattattataattattatttaaaaaaaatagctcgtagattcattgatttttttgaagggtttttttatgcctctatctcctttaattctgctctgatcttgtttatttcttgc

SEQ ID NO: 130147 - DNA, 601 bp, Human
tgtatgactcagcagaggcagccataatcccccttggaatgtaactccattggagttataactgcacccccatcccccatggcagccacagcaagctctgcccaggagaggctgagttcagacacgtctatccctgcccctacctagtggtcatcctctgcctgcccaggtagccaaagacaaagatcataatctcctgggagccctatagccctgcccaccgtctgagaaacctgaatacttaaccaggtgtccctagggcaagtttgcatcttctctataggattgcagctgatgcgcttctttttttttttttttttttcttaaacagagttttgctcttgttgcccaggctggagtgcaattgtgcaatctcagctcattgcaacctcttcttcctgggttcaagtgatactcctgcctcagcctcccaagtagctgggattgcagatgcccgccaccacgcccagccaatttttgtattttcagtagagacggggtttccccatgttggccaggctggtctcgaattcctgaccttaggtgatccacccacctcagcctcccacagtgccgggattacaggtgtgaaccgccacac

SEQ ID NO: 130148 - DNA, 601 bp, Human
tatgactcagcagaggcagccataatcccccttggaatgtaactccattggagttataactgcacccccatcccccatggcagccacagcaagctctgcccaggagaggctgagttcagacacgtctatccctgcccctacctagtggtcatcctctgcctgcccaggtagccaaagacaaagatcataatctcctgggagccctatagccctgcccaccgtctgagaaacctgaatacttaaccaggtgtccctagggcaagtttgcatcttctctataggattgcagctgatgcgcttytttttttttttttttttttcttaaacagagttttgctcttgttgcccaggctggagtgcaattgtgcaatctcagctcattgcaacctcttcttcctgggttcaagtgatactcctgcctcagcctcccaagtagctgggattgcagatgcccgccaccacgcccagccaatttttgtattttcagtagagacggggtttccccatgttggccaggctggtctcgaattcctgaccttaggtgatccacccacctcagcctcccacagtgccgggattacaggtgtgaaccgccacaccc

SEQ ID NO: 130149 - DNA, 601 bp, Human
ccccttggaatgtaactccattggagttataactgcacccccatcccccatggcagccacagcaagctctgcccaggagaggctgagttcagacacgtctatccctgcccctacctagtggtcatcctctgcctgcccaggtagccaaagacaaagatcataatctcctgggagccctatagccctgcccaccgtctgagaaacctgaatacttaaccaggtgtccctagggcaagtttgcatcttctctataggattgcagctgatgcgcttctttttttttttttttttttcttaaacrgagttttgctcttgttgcccaggctggagtgcaattgtgcaatctcagctcattgcaacctcttcttcctgggttcaagtgatactcctgcctcagcctcccaagtagctgggattgcagatgcccgccaccacgcccagccaatttttgtattttcagtagagacggggtttccccatgttggccaggctggtctcgaattcctgaccttaggtgatccacccacctcagcctcccacagtgccgggattacaggtgtgaaccgccacacccagctctgatgtgctcttgaaagcatca

SEQ ID NO: 130150 - DNA, 601 bp, Human
ctctgcctgcccaggtagccaaagacaaagatcataatctcctgggagccctatagccctgcccaccgtctgagaaacctgaatacttaaccaggtgtccctagggcaagtttgcatcttctctataggattgcagctgatgcgcttctttttttttttttttttttcttaaacagagttttgctcttgttgcccaggctggagtgcaattgtgcaatctcagctcattgcaacctcttcttcctgggttcaagtgatactcctgcctcagcctcccaagtagctgggattgcagatgccygccaccacgcccagccaatttttgtattttcagtagagacggggtttccccatgttggccaggctggtctcgaattcctgaccttaggtgatccacccacctcagcctcccacagtgccgggattacaggtgtgaaccgccacacccagctctgatgtgctcttgaaagcatcaccttctggctggaggccaacaaacacaaaatcagtgcactaaataaaaacacaaccagggacccttatggtgtccacttcactcccctgataccttcaccggagcaggctgcgagacctgaaaacg

SEQ ID NO: 130151 - DNA, 601 bp, Human
ccctatagccctgcccaccgtctgagaaacctgaatacttaaccaggtgtccctagggcaagtttgcatcttctctataggattgcagctgatgcgcttctttttttttttttttttttcttaaacagagttttgctcttgttgcccaggctggagtgcaattgtgcaatctcagctcattgcaacctcttcttcctgggttcaagtgatactcctgcctcagcctcccaagtagctgggattgcagatgcccgccaccacgcccagccaatttttgtattttcagtagagacggggtttycccatgttggccaggctggtctcgaattcctgaccttaggtgatccacccacctcagcctcccacagtgccgggattacaggtgtgaaccgccacacccagctctgatgtgctcttgaaagcatcaccttctggctggaggccaacaaacacaaaatcagtgcactaaataaaaacacaaccagggacccttatggtgtccacttcactcccctgataccttcaccggagcaggctgcgagacctgaaaacggatcacatcacaagactcattgcagacactccccagtaccagcctaag

SEQ ID NO: 130152 - DNA, 601 bp, Human
ccaagtagctgggattgcagatgcccgccaccacgcccagccaatttttgtattttcagtagagacggggtttccccatgttggccaggctggtctcgaattcctgaccttaggtgatccacccacctcagcctcccacagtgccgggattacaggtgtgaaccgccacacccagctctgatgtgctcttgaaagcatcaccttctggctggaggccaacaaacacaaaatcagtgcactaaataaaaacacaaccagggacccttatggtgtccacttcactcccctgataccttcaccrgagcaggctgcgagacctgaaaacggatcacatcacaagactcattgcagacactccccagtaccagcctaagctggtagctccactgggttgccagacctagaagagcaaaaacaatcatgacggtttggctctcaggaagccccactcctaggagaagggggagaacaccacatcaagggagcaccctgtgggacaaaagaatctgaacaacagcccttgaatcccagatctgccgtctgacatagtctacaccaacgaaaaggaatcagaaaaacaattctggtaatacgacaaaag

SEQ ID NO: 130153 - DNA, 601 bp, Human
caaagatgagaagctcaaagaacacctgggaaattcgttgcaaaaagatcattgactaggcatgtagtcatcgttatctagtcaagacaaaagaaagaatcttaagagctgtgaggcaaaagcatcaggtaacctacaaaggaaaacctatcagattaacagcacatttctcagcagaaaccctacaaggtagaagggattggggtcctatttttagcctcctaaacaaaacaattatcagccaagaattttgtatccagtgaaactaagcttcataaatgaaggaaagatacagttgttyccagacaaacaaatgctaagagaatttgccactaccaagccagcactacaaaaactgctaaaaggagctctaaatcctgaaacaaatcctcaatatacacaaaatagaacctccctaaagcataaatctcacaggacctatataacaataacacaatgaaaaaaaaaaacaaggtatttaggaaaaaaaatagcacgatgaatagaatggtacctcatatctcaatactaacattgaatgtaaatgacctaaatgctccacttaaaagatgcagaatgacagaatggataagaagtcacc

SEQ ID NO: 130154 - DNA, 601 bp, Human
tagaagggattggggtcctatttttagcctcctaaacaaaacaattatcagccaagaattttgtatccagtgaaactaagcttcataaatgaaggaaagatacagttgtttccagacaaacaaatgctaagagaatttgccactaccaagccagcactacaaaaactgctaaaaggagctctaaatcctgaaacaaatcctcaatatacacaaaatagaacctccctaaagcataaatctcacaggacctatataacaataacacaatgaaaaaaaaaaacaaggtatttaggaaaaaaamtagcacgatgaatagaatggtacctcatatctcaatactaacattgaatgtaaatgacctaaatgctccacttaaaagatgcagaatgacagaatggataagaagtcaccaaccaagtttctgctatcttcaggagactcacctaacacataatgattcacataaacttatgataaaggtgtggaaaaagatattccgcaaatggacgctaaaagcaagcaggattagctgttcttatgtcagacgaaacaaactttaaagcaacagcagttaaaaaagacaaagagggggcccagtggg

SEQ ID NO: 130155 - DNA, 601 bp, Human
cagtaaatttaagaaaaccaaaattatatcatgtactctctcagaccacagtggagtaaaattggaaatcaattccaaagggaaccctcaaagccatgcaaatacatggaaattaaataacttgctcctccatgatcattgcatcaacaataaaatcaagatggaaatttaaaaattcatttaattgaatgataatagtgacactgttcccggaccaaactgagggttgggctgttatttctcacagccccataatgagatgcagataaactggggaggaagagagtttttatttctgtamccggttacagggagaagacctggaaattatcactagaccaattcaaaattataaagttttccagagcttatatactttctaggctatatgtctatgtgtaagtgtgcattcgcctaaagacacagtgatcaacttcttttaatctgtaactaaggtctgagtcctgaagaccttgctctggagcctcagtaaatgtcttacttaatctacatgggtccagatactggggtaattacccttatcttgtctcctgctaaatcatggaggtttgaggagttcttcagacccccaataaacttg

SEQ ID NO: 130156 - DNA, 601 bp, Human
caaactcagccgaagaaaagaaataactaagatcagaacacaactaaatgaaatttaaacgacaacaacaacaaaaaacaataaaaagataaatgaaaaaaaaaaactggttctttgaaaaggtaaataaaactgatagatcattagcaagattaaccaagaaaaggagacagaaaatccaaataagctcaattacaaatgaaacgggagatattgcaactgacaccacagaaatacaaaaggtcattcaagacgactatgaacacctttacgcacataaactagaaaatgtagaggagaygaataaattcctggaaacatacaaccctcctatattaaaccaggaagatacagaatctctgaacagaccaataacaagcaacaagactgaaatggtaataaaaagaaaatgccaacaaaaaaaagtccaggaccagatggattcacagctgaattctattagacattcaaagaattggcaccaatcctaatgacactattccaaaagatagagaaagagggaatcctccctaaatccttctgtgaagtcactatcaccctaataccaaaaccagagaaggacataacaacaacagcaaca

SEQ ID NO: 130157 - DNA, 601 bp, Human
aaaaaaaaacttaaaagtcatatgaaacaaaaaaagagcccacatagccaaagcaaaaagaacaaatctggaggcatcacattaccctacttcaaactgtactataaggccatagtcaccaaaacagcatgatacgggtataaaaataggcacatagaacaatggaacagaatagaaaacccagaaataaacccaaatatttacatccaactgatctttgacagagcaaacaaaaacataaggtggggaaaggacaccctattcaacaaatggtgctgggataattggcaagccacatgtrgaagaatgaaactggattctcatcttaccttatacaaaaatcaactcaagatggatcaaagacttaaatctaagacctgaatctatacagattctacaaggtaacataagaaaaacctctctagacattgagttaggcaaagacatcaagaccaagaatccaaaagcaaatgcaacaaaaacaaaggtaaatagttggtacttaattaaactaaaaagcttttgcacagcaaaaggaacagtcagcagagtaaacagacaacccactgagtaggagaaactcttcacaatctgtacatct

SEQ ID NO: 130158 - DNA, 601 bp, Human
caccaaaacagcatgatacgggtataaaaataggcacatagaacaatggaacagaatagaaaacccagaaataaacccaaatatttacatccaactgatctttgacagagcaaacaaaaacataaggtggggaaaggacaccctattcaacaaatggtgctgggataattggcaagccacatgtagaagaatgaaactggattctcatcttaccttatacaaaaatcaactcaagatggatcaaagacttaaatctaagacctgaatctatacagattctacaaggtaacataagaaaaayctctctagacattgagttaggcaaagacatcaagaccaagaatccaaaagcaaatgcaacaaaaacaaaggtaaatagttggtacttaattaaactaaaaagcttttgcacagcaaaaggaacagtcagcagagtaaacagacaacccactgagtaggagaaactcttcacaatctgtacatctgacaaaggactaatatccagaatctacaaagaattcaaataaatcagcaagaaaaaaaacaattccatcaaaaagcgggctaaggagatgaatagataattctcaaaagaagatgt

SEQ ID NO: 130159 - DNA, 601 bp, Human
acaaaaacataaggtggggaaaggacaccctattcaacaaatggtgctgggataattggcaagccacatgtagaagaatgaaactggattctcatcttaccttatacaaaaatcaactcaagatggatcaaagacttaaatctaagacctgaatctatacagattctacaaggtaacataagaaaaacctctctagacattgagttaggcaaagacatcaagaccaagaatccaaaagcaaatgcaacaaaaacaaaggtaaatagttggtacttaattaaactaaaaagcttttgcacarcaaaaggaacagtcagcagagtaaacagacaacccactgagtaggagaaactcttcacaatctgtacatctgacaaaggactaatatccagaatctacaaagaattcaaataaatcagcaagaaaaaaaacaattccatcaaaaagcgggctaaggagatgaatagataattctcaaaagaagatgtacaattgaccaatgagcataaggaaaaaagctcaacatcactaattatcagggaaatgcaaatcaaaaccacagtgcagtaccacctcactcctgaagaatgaccataatcaa

SEQ ID NO: 130160 - DNA, 601 bp, Human
tacttggaatatgtgtgaataaaaatacaaaatacataatgttcatccaaagggcttaacattttatattagatacaaaataagaactgatgggtgtgttaataggaatattaaatagaatttctctcaaggaaagattttaaaggaaatgatcataaacattgtgccgataaatcactcatcatataataaacaaaacatgattaaatatttatctaaatttaacagttttagatgcttaagttttgcttgggttctattaatttgtgcatgtagttaagaaatatatcttgccattcargtagacccagttctaaacaaaagttctaccaccaactagcatagtgacacgtgaccttgtacaggttagtaacatctctaagttctccatttcttcgactgcaaaatgtgaataatgatattatttatctcagtgcccttgtgaggattaaattaattagtgaattaagtgcttcatacagtgactgatgtttgataggtgtcagtggagataacattttgtaattattatatatgatttaaaatgcatgtgataacaccatatagtttaggttatatgtgtatatttgtacagtatttc

SEQ ID NO: 130161 - DNA, 601 bp, Human
taggaatattaaatagaatttctctcaaggaaagattttaaaggaaatgatcataaacattgtgccgataaatcactcatcatataataaacaaaacatgattaaatatttatctaaatttaacagttttagatgcttaagttttgcttgggttctattaatttgtgcatgtagttaagaaatatatcttgccattcaagtagacccagttctaaacaaaagttctaccaccaactagcatagtgacacgtgaccttgtacaggttagtaacatctctaagttctccatttcttcgactgyaaaatgtgaataatgatattatttatctcagtgcccttgtgaggattaaattaattagtgaattaagtgcttcatacagtgactgatgtttgataggtgtcagtggagataacattttgtaattattatatatgatttaaaatgcatgtgataacaccatatagtttaggttatatgtgtatatttgtacagtatttcttctgatgttaaatttctgtatacattttcttgtaaataagaatagaaaatagtgtctccatcttctctctacacatttgcacatctttccaatcttacaga

SEQ ID NO: 130162 - DNA, 601 bp, Human
ctaccaccaactagcatagtgacacgtgaccttgtacaggttagtaacatctctaagttctccatttcttcgactgcaaaatgtgaataatgatattatttatctcagtgcccttgtgaggattaaattaattagtgaattaagtgcttcatacagtgactgatgtttgataggtgtcagtggagataacattttgtaattattatatatgatttaaaatgcatgtgataacaccatatagtttaggttatatgtgtatatttgtacagtatttcttctgatgttaaatttctgtatacaktttcttgtaaataagaatagaaaatagtgtctccatcttctctctacacatttgcacatctttccaatcttacagacctgggtgattgtgctgtaggctagaatatgcgcagactctagtcaaacatacttgatatctacttcctcctctggtgcatagtagatggatgtgggataagtcacctagcccatttctgaacttcagttgtaatctgtaaaatgagatcattgatagctaactaataggttgcttggaagtacagatgtaacaatgtcaagaatctccatagttgacatagaa

SEQ ID NO: 130163 - DNA, 601 bp, Human
aaataattgttgaatgagatgaataaactatagtgagaagatgctaggctttgttaaccattcaaacctaagctcaaatcccagcgcggccacttgctacctctggtactttgaacaaattctttagccttgtttctttgattttgttttgtttcagtcaggaaattgtaagataattatagtctcctcattattcttgtaagagtaaaataaggaaacatgggtaaagcacttaacatagaatatattttctataaattttacttcctcttttttttcatttataaagttgttcttccaragtagtagtattaacattgaatagtgtaaagcattcatgccattttattgtatcttctcttaggacatacagaagataatttggtccctcttgtcaatattcttggagtgattgatgacaaaccattttagtgtccctagaaatggaggacttactgcccctttttttcaaaaatgaatattctttttttttggctataatctgaggaggagatgcagtgatctaaaggtaaaagtatcagaaaaaagaattgtccttttgctgattgatttgagggatgtgattatgtagtacattgat

SEQ ID NO: 130164 - DNA, 601 bp, Human
gtataagctctaatgaaaatcttgtgtatttttaaaatgtctcttacttgatatgtaaaggaaaacagaacaaaggcattgaagaggtaactcttttggttttaggaatattaaaatgcaatcttcaccagctgtccatttttaaattagatttcagtttttcacatggggtactgtgtgtgttggttagcattggagtaagaatttaaattcttaaaagctttgaagttaattctgtattaagaaacaactgagaggttgagtatggcactatttcttcctgaatctgagatcaagcagwtgtgcctctttcaatcagtttttactaccatgagatttaaagcaaagaaaaaaaaaacagttaatgacagttcaaattcacttagtagagtaacgtgttctaaaatggaggattgtaatggttgaagaattgggttatgtttttctcttggtgtgtgtcattttgtattgttttgtcttgccactaagttaatttgatgcatttccctcagaaattggggtagtggggtgtttacatcagaagactatgaccaaagtaaaatgaggggtgaaatatgcttttaaaaatatagagcaaaag

SEQ ID NO: 130165 - DNA, 601 bp, Human
gtattgttttgtcttgccactaagttaatttgatgcatttccctcagaaattggggtagtggggtgtttacatcagaagactatgaccaaagtaaaatgaggggtgaaatatgcttttaaaaatatagagcaaaagcagtgattgatactatagatcttcaattttatcttcaggttctagagttttccagatattcactgtagaaaaaaaaagacttctggtcacaaattctgttactttcacaccaaaccccaaaacatttcaccgaatttcttatcttcctactctttcatttctacyattttctttctttcttacaaataaaccttccttatcaaatcccattttctgtgctttatttgagcaattgatacatcctactttctttagatatcattttcctttgcctccagatacaactgcatctatggggtctctgatttttatagcttgttagaagaagatgctgtattatataggataaaaattattatataatacctatgtatacaaaataataaattcccccataatttaaaaataatgtagtattatagtttaaagttaggttctcttcatctacttcctgaaactctacag

SEQ ID NO: 130166 - DNA, 601 bp, Human
agagcaaaattttgttaagccttgaaacagaaaaatttcccatagggaattttttaaaaatatggcagactagaaagtattagttgtcccaaaggagtcttatttttccaattgaagtagctgctgcttatctgaaacttaacagtttgttgtggccaaaataagcaggtggttataagaaattaaatttccctggagaatgaataatagtgacatacaagtaattataatatcacatgattcacattctgaagaaggtcaaataataaacatataattcatttccatctgccaacatgartatttgttgagtgcctactgtgtgcctggcacagctagcttcacggttctatctggatatatagatggaagacgggtgagtcagagaaagagataaagactttttatatatacaagcacaaataaaaaaaccgttttggaatttttgcagaattgcaaatgttacttcatattttaaagtcaaaaaaatagcaaatataaaacacttaaaatttttttctaaaaggtagtatttcaattttaccatagagagatggttgccttatctaacatctcgaaaagagccaccctttgatgttcc

SEQ ID NO: 130167 - DNA, 601 bp, Human
agattcttttggcgcagaacaaacagggccaatgacttaacattaggcttaatcagttatcctagaaatttaatattgaataattctttaactttgggtaatagttaatcatagctactaggcatttttttttaacatctgttctttcagggaaaaaaaaaaaaaagaaaacatcatataatcaggtcttcctgaaattctgttcaatgtgtttctgcctaattctcctccaggactctgtttgtttctttaatgaccaagatttcttttagatgagtattaaattctttgagtttgtaaygcaacacttgcaaatatttcgctagaaatttatacacacatatctgtcattttattctacaaattgatgttttctcattctataacataaggaactcagtatttaaagttcaaagcaatcaccactttaacaaactcttgagcttgtagttgaaagttcacacacattttacagaagagaaacacagctagagaaaagagcctaatcatatagtcagtaacttagattcatgatgactattctgtcttgaattaaataagctacccttatttgaatagtttgggggacatctaactagta

SEQ ID NO: 130168 - DNA, 601 bp, Human
attaggcttaatcagttatcctagaaatttaatattgaataattctttaactttgggtaatagttaatcatagctactaggcatttttttttaacatctgttctttcagggaaaaaaaaaaaaaagaaaacatcatataatcaggtcttcctgaaattctgttcaatgtgtttctgcctaattctcctccaggactctgtttgtttctttaatgaccaagatttcttttagatgagtattaaattctttgagtttgtaacgcaacacttgcaaatatttcgctagaaatttatacacacayatctgtcattttattctacaaattgatgttttctcattctataacataaggaactcagtatttaaagttcaaagcaatcaccactttaacaaactcttgagcttgtagttgaaagttcacacacattttacagaagagaaacacagctagagaaaagagcctaatcatatagtcagtaacttagattcatgatgactattctgtcttgaattaaataagctacccttatttgaatagtttgggggacatctaactagtatgtttttaatgtatattttcattaacatttcagattactca

SEQ ID NO: 130169 - DNA, 601 bp, Human
ttttagagttgtgggtaggtaatgttgaatagttggatggccagtttaaagacaatctgaaaagacaggcattataataggaatttgctgaggttgacatttgaagacattgattatatttaggtatgtcttaagatggcaggaaaagataaatctgtttggaaggggacaagattagcaagacaagtgaggatgattttgtaggaatctaggtgtgaggtcacacagccagactaaaatggtgtcggttaataaaaccatgtccagaaaaccatagatatttataagaaacaaatgataygttgatagactataataggtgaataaggggaaagagtaccttactttctgacttgagagattggcctccttcacctagtaaataaatcaaaatggaatacatgctatgtgtctgcccttgtgtttagcaccatgcagtaagtggtagaactagaacttgaactctggggtgttttgcatgaaggtccttactctcaatttcactatactgcctccaacctatgagtgccatttagctattttgattctcattctacagatgaggagaatagggctcaaagatgcctcaggttgtcttaac

SEQ ID NO: 130170 - DNA, 601 bp, Human
atgcaaattagattgttaacttcctatgcaactaggaatacttaacagtacttaacaatatttatattgttcctttggacataagtatggctatgattgcccccacctcccaaaaaaacaacaaaaaggaatcataggaaacaatttttaaacttattttcaattttttttattattgattaaataaaagcacaacttaacaaaatataggcagtcttgtactttatatacaatgatccttctggggagacatggaaattcatctgtcttcctcaagccaagtgggactgttctgtcctargagaagggatttttaaggagtggggaaggaaggggaaaaaaaggaaatcttttccttattgtcaccactgcttacccttttcaaagaagtatcttcggttcttagaaatcccatgcccagggtgaaaatggagagaaagaaaacacaggaagaagagagtatatatagagagggaggccagggaactaggagaacagaatgagaggcaaggtaatctctctcacccttttaggaaaggactctcattgcctgtgctccttctttacctgacaagctgcagttgcccctacctctactgtt

SEQ ID NO: 130171 - DNA, 601 bp, Human
tatacttttttaaataaaataggaaataataagctggattgaggtaatatatatttggctcctactcacacaaaaattttgaaaaagaaaaaaaatgtttaatttattttttaattcttcatttgtaatcacgaaatatctgaactaaatatttgaatctctgcaaaggctgggagttgctatgtgttgttgggaccacactactctcatatcctgtgtaaataccccatgactgagtaaatattatcatgcaattttagaattagaagtttagatgttttgacctaaatgttttccaggkttaaaatatccttcttacagaacagtgatcctcataagtttaaacagactggaaacaataaagcctaaaaagaaaatcatgcacatcaacaattttctttctatctttcaactttaattttcacccttatagccctaaaccactaatttgaaaagatttttctaaaagttcatctttctaatatatcataatatttctttttttctggccctggaagagattgagtactccgtattttttaaatatataatggatatattataaatactagaaatgagtacaatactattatttaatttt

SEQ ID NO: 130172 - DNA, 601 bp, Human
acgaaatatctgaactaaatatttgaatctctgcaaaggctgggagttgctatgtgttgttgggaccacactactctcatatcctgtgtaaataccccatgactgagtaaatattatcatgcaattttagaattagaagtttagatgttttgacctaaatgttttccagggttaaaatatccttcttacagaacagtgatcctcataagtttaaacagactggaaacaataaagcctaaaaagaaaatcatgcacatcaacaattttctttctatctttcaactttaattttcacccttayagccctaaaccactaatttgaaaagatttttctaaaagttcatctttctaatatatcataatatttctttttttctggccctggaagagattgagtactccgtattttttaaatatataatggatatattataaatactagaaatgagtacaatactattatttaattttgtgccaatttcatgaatgaggaaactagatattgagcaaagtgcaaagatagacattacagtcctgacctctggtaagtatttcagaattgtcactttcaaaaggtaattcaagaacactgtatttatgt

SEQ ID NO: 130173 - DNA, 601 bp, Human
aaacgtaacaggagcatgtattaaccagcttcatataaccaattttccaaactaatatcaacactaaaaagattttcaggtatattaagctggagaactttgttcagaagactttaagaagtggccatataggaaagcaatcaggattgcaaacattaaactttagcataaataccacttgttcctcctttcagagacaatgaaaactcttgcttatggctataataatcaggctacaaggatttctaagaactgttcttagtttaatttttctgctattgccagatgcttttcaccattytaggtgcccaaatcctgaagccaaatttaataaaggagaaacaggcctaattgataaatggatgttcagtatgcgttttccagtcagaacttgccttggcttagtggaacattctggtagttcaggcaaaaagtgtttcactacaagatcctgaacactatattgcatagaatatttgaaaaccagtgatgtccaagtcactaaattcttcctttacttctttcggatgggactaaagagaaggagtagcttgaccttgcttctatcaccttaagaaatatatgcacactctcaaacaag

SEQ ID NO: 130174 - DNA, 601 bp, Human
ggttttcccttgtcttgacttcatttggacaacttgttgccagtgtattttaggatggcagggattaaaatccatccattcaacaacttcagtgtaaacagtttattttattttatttatttatttatttttgagacggagtctcactgtgtcgcccaggctggagtgcagtggtgcgatcttggctcaccacaagctctgccattctcctgcctcagcctcccgagtagctgggactataggtgcctgccaccacacccggctaattttttgtatttttagtagagatggggtttcaccrtattagccaggatggtcttgatctcctgacctcgtgatctacccgcctcagcctcccaaagtgctgggattacaggcatgagcctgtatttaatttttttaaattaatagttctagcaaaagttcttcaactgagtcttcttagtttagtgtagctcacatgtccatctaaatcaatcttatgattcaataagatggactctttcttctggccaaattaagcatgtgcacatctcttgagctggtcagggttggagtggggaatgaagtcaactttcctgaactgcataaactgagtact

SEQ ID NO: 130175 - DNA, 601 bp, Human
aatgagttagagagttaggattaatgatacaggatttgtatttctcactagtcaggatccaaagaactttagaatcattaattgagagtgggaagtgtaaccaggtctcagaagaaattctatttaattgtttaagttatagacctatactgagtgcaaagttccatagtagtgatgacacagagtggactagaatcccagagcagtcattatttgaatggtttgtgcaattgacatatgcctcagtttttgtttttgttttttaaccaataagcatggaaaaaaaaaacctcctatgttrgtttcttatttttcatatatagaaagtcatatggaatactcctgctatatggtaagtactccacaaattacagttactaggctacagataaagaaatggtctaattttgaaataagcttatgatcttttggaaagtaagtaccttatattatgggaattgggtatgtgaataatcggggctcaatatgaaattttgaagttctaccattctgaattggaaaattgaagcaagtgttgatctgaaatctaaaatgtcatgtgcactgagatcaggatacacgtattcagagagcagaatga

SEQ ID NO: 130176 - DNA, 601 bp, Human
gattcagtttttcatgtttgcacagtttatttaactatgttaactaaatggtctgaacagaatagttgctaccatggcttaagttactggttcagtgtctatggcaatgcattaaatcaagtttctgctcccagttttataaaaaggaaaattgactagatgagaacattgccaccttattcattatgtatagctcattagttcccttgtcaactttcctttgcttttaatcaattgaaagaaaaagtcttcatggatttttagtaggaaacatatggagctgtaaatcatcagtaatgtrtgaacttatatttacaggtgcaactgaccttgactgtgcatccttcccaacttacttcttataaatcctgtaatcaataagtgaaatagtattccatacccttcataattcaccttccaatgtctgtttttccacacatcatctaagcttctataaaacattcttttcctctgtaatggactccaatcctgtttataagttttataaataagagcttaacatttcttctcaatacttagaaatgacgataaaagaattagttgacaagattggtatcttaagaatttcaactccacttaa

SEQ ID NO: 130177 - DNA, 601 bp, Human
tgttagccaagtaaatttttatacatatttattttactttaagtgaatatttaaaatacattttcagtttgtttcttaggataagtgagaaaaatatcaaatatttgagagaaaaaaagatttttaaaaagagcgagagttactcataaaaaatgagtaaattcggccaggcgcggtggctcacgcctgtaatcccagcactgtgggaggctgaggcgggtggatcacgaggtcaggagatcgataccatcctggctaacatggtgaaaccccatctctactaaaaacacaaaaaattagscgggcgtggtggcgggcacctgtagtcccagctactcgggaggctgaggcaggagaatgatgtgaacccgggaggcggagcttgcagtgagccgagatcgcaccactgcactccagtttgggtgacagagcgagattccgtctcaaaaaaaaaaagaaagaaagaaattacatttaataaaactgattccttcaactttaaatacatatactttttaagataaggtctccttctgttgcgcatggtgaagtatagtgagtatagctcactgcagccttgaactcctgggctaaagggatc

SEQ ID NO: 130178 - DNA, 601 bp, Human
tactctgcaaggcgcagtgtgtctgactgaagtatattatgcacgcgagctttccaaaagctgaaaaaaatattgagaaccaatgaataaaaccataggtatctaaaagacattgaataataataagagatatacaatagaatttaagaattcattaataaaaagtataactggagtttttctaaaataatggactcttaaaccagtaaaatatatatctaatttaaaatggtttcttttaaattataataaaacatatacatgtaggcacatcttattaaacaatggacaaatgtagaastaaatttcatttccacttaaaaaggcacaggcaggtttcaaatggttctgcatataaacttgctgacatgaataattttaaatcaggccagttatagctttcattctttgaactgaattcaaaactctcttacttttacattattagagagatgaatcaaatgtttctataatgcctactttcattcaatccacacccaattttagaggactgctgtcacaatgccaaaaaaacatagactgaagttttaataatgtttcttatatgataaagaaattctagggtaattttatagcacag

SEQ ID NO: 130179 - DNA, 601 bp, Human
aatacccaagactgggtaatttatcaagggaagagatttaatggactcacagttccacatggctggggaggcctcaggaaacttacaaccatggtggaaagggaagacgcacatcttacatggtggcaggagagagataacaagcaagagcaaggaaaactgccttataaaaccaccagatgtcatgacaactctctcattatcacaagaacagcatgggagaaaccacccccatgatacaatcaccgcccacttggtccctccctctacacatggggattatggggattacaatttgcartgagatttggttggggacacagagccaaaccatatcaccaacataatataaaatcactttgaaaggacctcaaaatacatcctaaaatttgtttcaaagatgaaaaatataacttaaaataccatgacttctgaatcagggtagtttgcaaggtgattatcttcacaattagaaccaaaatgcttaataatactattttagtttgtgtaaaactttaaagagtattcatgctcttcatctccctatttctatcttttttaaagaaaagcagtcaattagttaaataatcactaatgcagt

SEQ ID NO: 130180 - DNA, 601 bp, Human
aagacaaaaaataacaaatgctggcagatgtggggaaagggaattcttatacactggtggaaatgtaattagtattagctattatggaaaacagtatgtaggttcctcaaaaaattaaaaatggaacaaccataaaatccagcagttgcactatggagtataaatccaaagaaaattaggttggtatgttgaagagatagctgcactctcatgtttattgaagctctattcataatagccatgatatggattcaacctaagtatctaccaatggatgaatggataaaggaaatttggtgtccacacacacacacacacacacacacacacacacataatggagtactactgagccctaaaaaagcatgaaatcatgtcatttgtggcaacatggatgacacttgaggacattatgataggtgaaataagcaagacaaagaaagacaaaggccttccttattatctcacttacctgtagaatctacaggagttgatctcatagaactaaagagcagaatagtggctcccagatctggaacgtgtacaagaggaaggatggggagaaactgagtcagcaggtacaaagtcacagttagatagg

SEQ ID NO: 130181 - DNA, 601 bp, Human
aatacaaattaaaaatttagccaggcctggtggcatgcatctggggtgctaccacccagctactccggagactgaggcaggaggattgcttaagccagggagatcgagctgcagtgagccataatcatgccactgcgctccagcctgggtgacagagcaagaaactgtctcaaattaaaaaggtgcgggaagataagtttgtgtttatacctttgtaaatataattctgaaactgtagcgtatttttgacaagtgctttgcttttgttatcaaataatgctggcagtggaatgaggctcaygacattattatcaataaacacataaagaaaataaaaggctatacctatttttctttctaatgttctcaagagtaggccaaaaatataaaaagcaagatactagaggtttagttaatctgattgtattgttttcatatagatctctagatttctgcaattggatgtgtttaacatgaaaccttgatatatgatttcactaccaacaacaacaaaaaatcagttgggattatgatttctaatggtgtggaaaccctgttttataaaaataagacacattagctacttaaagttcatctgaac

SEQ ID NO: 130182 - DNA, 601 bp, Human
aataagacacattagctacttaaagttcatctgaacctgaactgtaattatttcagagaagtcctgaaatcattttggtcctgatttagaggtcttctttgtcttttcaatttaaagcaattttcatgtatagatttttaccacatttccaccttttataaaaccctaaagaatatcagtcactaaacctactgtagtaactgatctgatattcatttaagctaaaactttaagctaaaagaaaataattaaatttgtttgacctaaaaagaatgtccttgcattttgtagtctccattaaaaaaaaaaaacactccagtaatctttcgaatcttttttcagccaacagctctgtaacatcttgcctctatacatgatactgcctttttagccaattccaacctagagcaatgagtaaccatggctccatccaattttccacatgacatctgtggcagtagaagtattaacaggacttctctcctggagagctttgccttaggaagagcttaaatttctgtaagaaagtcactgacacaggaattcagtcaggactctgcactaggactagaagctgccagggttcagatgctgacaaggc

SEQ ID NO: 130183 - DNA, 601 bp, Human
actgcttttaggctctttgaatttatcttccccagatgccctgagatttcagatccactctttattttactaaaacttcatagctgtgaagtgaccatcttctctgaaggctcacatggaaaaaaaacaaacatgtttctacatggtaaaaggcatgtttgcatatttacatatgaatatattgatggatccttggcattaatgattctacaactgtatgttcttattaaactctgggttcagcataaaatagtatcttactgatttatcttcagtgctattgtatggtctgcttggctgmaggttgtataagatgacaaagcattgatttagtgaattttttcacagttttgtgaacaaaaagcttgcatatttaataagtaagttattcaaatcttgaagaaatacaggcacgttctccaggcatttttagaaagaagagaaagagaatctatagcaggtggatatttccaactaggcaaaacgaaaagcacacaaagagttaactcaactgtataaatgaatatgctaatgaatgcataatttatctctgaagaaacatatttattgtttcactatttgattagatggcttcaatgtt

SEQ ID NO: 130184 - DNA, 601 bp, Human
atattgcatctcttactaacaaaggaagcacaatagatacacattcatatgtgtctttgaatcaaaaagtgtgctgtatgtttactactttctgggcactgtttcttccataatgttattaataatagttctaataatagttccatgaaaacttaccagtttgaaggtgctatgtacatagtatagagtagatttcaagaaatggttgagataccccaagacttaaatcatgggttgagttctttcctcatctgtttcatttaagcttgaaatatctctcttctacttctcttttcttccktttctcttactattgtctgatactccggataattcctcagcattactccctttgctctccagagcagggacgttttgatagaagttgcagcacaaatctcataccacctcctttaccttctcaatgtcctaggccaactttcattttcacccactacctcacatacacacactccttagcattctcagagggatttaatacactttgaatcaatcatctgttaccttaaataacttccaaagcaaaatacatatcaaaccataaggtgttgtttctttaattgtatgggtgccataagtc

SEQ ID NO: 130185 - DNA, 601 bp, Human
attttcatgatactgattcttcctatccatgaggatggaatgattttctgtttgtttgcatcctctcttatttccttgagcagtggtttgtagttctccttgaagagatccttcacatcccatgttagctgtattcctaggtattttgttctctttgtagagattgtgaatgggagttcattcatgatttggctctccgctcgtctcttgttggtgtaaatgaatccttatgatttttgcacagtgattttgtatcttgagagatacacaaactaaaattgtgtcctcaggatacagcttyaaattctatatgtttattattttattcaattttgtgttcaaatcatcctatgtgctatcatttttccaattacacagatgagaaaattgaggccctgggagattaaattacttgctcaagagagcacacctattctattaaaagggagataaaataatatttataatttttaaaaatataattctgaaaactctagcagctttttgacaagtgttttgcttttgttgtcaattaatactgttaccaaatgatactcttcttaatttattcatatccacagtgacgaattgcacaaaatta

SEQ ID NO: 130186 - DNA, 601 bp, Human
gagcttgcagtgagccgagaatgcgccactgcactccagcctgggcgacagagtgcgacaccgtctcaaaaaaaaaaaaaaaagagaaaagaaaacttttattagagataataagttcaaaatataaacaggtaaggtagaaatggtacacacgaataacaaacataaaagtacagatggaactgtgttaggaggcaggactcatctctggaggtggagctcagataccagacaaaattgaggactaagacaaggactgggcggaagtagctttcctgaagacatgctcactagtgtgccmtgtcagtttaccattgcaatggcagcacctgcgagcgaccaccgcctttccaggcaataacccgatgacccagaagttactacccttttccgggaaatttctacctaaatcaccccttgatctgtattaaagtaagtaggccaggcttcacacctgtaatcctagcactttggaaggccaaggcaggcagatcacttgaggccaggagttggagaacaggctggcaaacatggggaaacccatctctactaaaaacacaaaattagccagcccaggcctgtaatcccagctactcgggag

SEQ ID NO: 130187 - DNA, 601 bp, Human
tacgtttttatgtagcacatgcaaagtttaaactgtttcttagtgacttaggagtgatcatcatgactattaattacacacagatgctgtcctaggctcttttcaggcatttatgttgtaattcatggtactactactgtgagtcctccaccctccattagagttatttatttatgctctgccttatgctaaaggacttaatattccttaaaatacatcttaaaagatttttttctgtgtcagtttgccaagaataatggcctccagctccattcctgtccctgcaaaggatatgatcttkttcttttctgtggctgcatggtattccatggtgtatatgtactacattttctttatccagtctgtcattgatgagcatttaaccaaatactgcatgttctcacttataagtgggagctaaatgatgagaacacatggacttatagaggggaacactctgggcctattagaaggaggagggtgggaggagggagagcagggaaaataactaatgggtactaggcttaatccctgggggatgaaataatctgtataacacacctccaggacacaagtttacctgtgtaacaaacctgcactt

SEQ ID NO: 130188 - DNA, 601 bp, Human
catgttctaccacctcctatttgatcttggataaaacagggatacatagaaatattaattaattaagcaaatatttattgagcacctactgtgtgccaaacacttgtctagggtgtaaggtacagtatatgttaatgctgtatacatgctttcccacatagagaaacaggtcagctccagcttttttacataaacattcacactagatacactttaattattctagaaggcagggaaattatttgagaattttcataatcctggggaaatatagtaaaaaataaaattttgaatatggacrtactatatcaagagcaaatagttgtgccaatatttctagaagcaaatgagtattaaacaatatcttgtttatctaaagctaataaaaatttagaaatgggtagccaaactaaaatagcaatttgatcagctaatgaacacatttcattcaacagccattgaatgagtacttatcatagggacaagtattaaaatcaatgtaagtaatattattatactttgttccttggctcttatgccctttgataaggtggcatgtggatttggagagaatagaaaagagaaaaagaacaaatatttt

SEQ ID NO: 130189 - DNA, 601 bp, Human
aagcaaatgagtattaaacaatatcttgtttatctaaagctaataaaaatttagaaatgggtagccaaactaaaatagcaatttgatcagctaatgaacacatttcattcaacagccattgaatgagtacttatcatagggacaagtattaaaatcaatgtaagtaatattattatactttgttccttggctcttatgccctttgataaggtggcatgtggatttggagagaatagaaaagagaaaaagaacaaatattttgaggagggtgaaactgatgtgtgccaccccaaatctttgwttatatattttatgtagcatttcattgtataaagaaataatatacatgtataaataattttttaaaaattggatttctagtttcagcaaatgcctttatgctctttttaaaatatgacagtctggtttacaattgaagtacattatgtatcaaaggacccatatttgacagtgtacaaagttatgcgtttaaaaataattacactgttaaccaatgaatatgagttaatactgggaagaaaaactttattcaagtgttcattgcccatagcaaagtaaattatagaacagaaagttaata

SEQ ID NO: 130190 - DNA, 601 bp, Human
gcaaaatagcactgtggctcatgtaatactatacatttttaccactactgccttcaagcacttataaaacttctttcctcatttttcatttctcatgttcagtatttcagttttgttgacaactgaaaatgggaatcagatttgaggaatcccttcaatgtggttgatttttgccccatgaaaaagaagtggtaatttatatcaactctcaagaagtttaggcaaggtgtgggatgaaggcaataaaatcataattataatatcatgtgctaatgtggaagaacaaattttgagtgtagcmataggggagcgtctgattcagactaaacatgtacctgcaaattagtcaagaaataatgagacaatctgttaccaaactcttggctttgccgttctctttctctggcactactacgaaccaagataaataattatacaatatgtaataaagccaccttgttaattgccacttaataaaaataaattagtaaaaagtttggttaatcaatcattggttcattggttgcttcaatagtaaggctgagatctgatggcatggctttgatggtccacattcttcccaagtgataaatagtaaact

SEQ ID NO: 130191 - DNA, 601 bp, Human
tttttcatttctcatgttcagtatttcagttttgttgacaactgaaaatgggaatcagatttgaggaatcccttcaatgtggttgatttttgccccatgaaaaagaagtggtaatttatatcaactctcaagaagtttaggcaaggtgtgggatgaaggcaataaaatcataattataatatcatgtgctaatgtggaagaacaaattttgagtgtagcaataggggagcgtctgattcagactaaacatgtacctgcaaattagtcaagaaataatgagacaatctgttaccaaactctyggctttgccgttctctttctctggcactactacgaaccaagataaataattatacaatatgtaataaagccaccttgttaattgccacttaataaaaataaattagtaaaaagtttggttaatcaatcattggttcattggttgcttcaatagtaaggctgagatctgatggcatggctttgatggtccacattcttcccaagtgataaatagtaaactcttcttttaatcatcagactgtatttatagtcttgactagcatccattcaataatattaatttgtcataaaagaatataga

SEQ ID NO: 130192 - DNA, 601 bp, Human
tgttaccaaactcttggctttgccgttctctttctctggcactactacgaaccaagataaataattatacaatatgtaataaagccaccttgttaattgccacttaataaaaataaattagtaaaaagtttggttaatcaatcattggttcattggttgcttcaatagtaaggctgagatctgatggcatggctttgatggtccacattcttcccaagtgataaatagtaaactcttcttttaatcatcagactgtatttatagtcttgactagcatccattcaataatattaatttgtcrtaaaagaatatagaatatgcatcattttgttagcctgtcagcactgcaggaaaatcagctcacacatatgtcatgaagaagatggtggtttcatgtccctggttggcagtacatgtaaggttgctggtataatgtactttgccatttctgttccctttctgaaaaagaattccttactaccaaggctgcgcaggtccatatgcaatgaccaagagtacataaagataatgtccagttcagttcagttttgtggtgtgtttgtatttaaaatgtgaagtagcgtgtctatatgcattcatg

SEQ ID NO: 130193 - DNA, 601 bp, Human
ataaatagtaaactcttcttttaatcatcagactgtatttatagtcttgactagcatccattcaataatattaatttgtcataaaagaatatagaatatgcatcattttgttagcctgtcagcactgcaggaaaatcagctcacacatatgtcatgaagaagatggtggtttcatgtccctggttggcagtacatgtaaggttgctggtataatgtactttgccatttctgttccctttctgaaaaagaattccttactaccaaggctgcgcaggtccatatgcaatgaccaagagtacayaaagataatgtccagttcagttcagttttgtggtgtgtttgtatttaaaatgtgaagtagcgtgtctatatgcattcatgtttatttgaacaaatgctgtaagtcccctgcaaccttttagttaagtattgtatttttctgcactagaactttatttgatttttatttttctgatttcatgtgctatttatttattaatcttgagcatgaatgcttatgtttgagcatagttagatgctttaaaatccatgcataataattcaagcatttgggtttcaaaagaaccagttcttttgaact

SEQ ID NO: 130194 - DNA, 601 bp, Human
atgcattgtgaaatggttaaatctagctaattaacaaatgtgttacctcacatagttatcatttttatggcccaaacccttatacatccactctcttagcatttttcaagaatacagtatgtcattattaacgctagtccccatgctgtacaacagatctcttgaagtcattcctcctaactataagtatgtattctttgaccagcatcttcccaaccttctctcccaatgactaccccagcctctggtaaccaccattctaccgtctatttctgtaagatcaacttttctagattctacrtatcagtgacattgtgcagtatttgtttttctgtgcctggcttatttcactgaacgcagtgtcttccaggttcatccatgtggctgcaaatgacaggatttccttctttcttgtggctgaatagattatcaccctcatgtaggcctagtttttttgtttgtttctttgtttgtttgtttttttaggcagtgctactgatgctcattcctttatgaattaatttctttatttgaacttttctggttgggaaaggcaatatacatagaaatcactaatacctgagaagaattcatttcccta

SEQ ID NO: 130195 - DNA, 570 bp, Human
tttctcaaaactaatgaaatgaaatatagcagaatgctaacccatataaaaataaagtgtacccaaatattgtaatgtaaaaaatatatatatattcatatagtagagccagaagtggagttcaagcatgtttaaccaaataagagttttaatttgcagttcaatcatgggttcaaacagcccatttttggaccacaacaacatatatgtctagcttactttaattaccttacttcaaaaagtcttgatgttacaagaaaatacctgctttttaacatccaactcccttctaccagcatgwtcttacttcctccttctccagcctgtatcccatggtcttttattatagttagatccttacaaactataactctcttgtcctttttatcttccacttttcttacttagcaaacccaaacctctataaatccagctatctgcataccctaggcttaaatacaaactggtaaacatagctggataagaattactcaagtattatgacaggtttcatacaatgtgcatgaccataaacctcagattaacacacaccacagctcagaaaccctg

SEQ ID NO: 130196 - DNA, 601 bp, Human
gatgtaatcaggcactgaatagaactgttgatatgcactgtgcatgtcaatcctctctgtgttatgcatgaagcaactttgtgtgtttgtgtatatggtctgacttcttccataaagtaattcttagactagattgaggttttatatgaaaaattttatgagaatatattttttctggttgcatgagaggatgttcagtctgattaaattgtcccagaacatgaggttactacttaagagatttaccgtaaccttatgtaacttcattcattattggtctaatttgctaaaaaagctctgyctttactgacaaatggaaatattcaggcttaagccttttcttgcgaaaaaaaaagagagagagagagagcgagaaagaaaagaagctttattatcattttacattcaagggcaatctcttttttttacgtatgaaagtaagtgagatccatctactactttgaaaatgaagaaagttgagatcattgacaatgaacatactataattttaaatttaaatgtttaatagtttacttattataatttatttataagaattactgtctttaaactactattggcttactagttgttgtttttt

SEQ ID NO: 130197 - DNA, 601 bp, Human
aaaaattttatgagaatatattttttctggttgcatgagaggatgttcagtctgattaaattgtcccagaacatgaggttactacttaagagatttaccgtaaccttatgtaacttcattcattattggtctaatttgctaaaaaagctctgcctttactgacaaatggaaatattcaggcttaagccttttcttgcgaaaaaaaaagagagagagagagagcgagaaagaaaagaagctttattatcattttacattcaagggcaatctcttttttttacgtatgaaagtaagtgagatmcatctactactttgaaaatgaagaaagttgagatcattgacaatgaacatactataattttaaatttaaatgtttaatagtttacttattataatttatttataagaattactgtctttaaactactattggcttactagttgttgtttttttgtcacatataaaatgctttactggttccagttagtatatttattcaactgccaattaaagattatccctgtgtaaaaaaaaaatgaataaaacaaacaacaaaaaaaatcatcctgtagcagctcaatttgagcaaaaaaaaattta

SEQ ID NO: 130198 - DNA, 601 bp, Human
ggaggaaatagtctattgattgatttctacacacctaattgaaaaatatttaccaaaactcaagctttctgagccaaagtcaatgtggatgacttttggaatgtccttggtaccatgaagatctaaggatattaatacatagtaatacgagggtcaggccaatcaaaggagacgacagaagaggaatcattaacatccaaaggcatttttacactgtgataattatccccatttgctcaggttaatatgctttcaatggaaacatgtggaataaacagctgtcatggacatgtgccaccaraataaaagctcttctcagccagaaaaacaattgggaagttagtgaaccagtacatgctcataccttaggaaagcaaatacttttcactgagcccatagacaaaattaaagtctggaagaattctttttttttggtgggggataggaaataatacaaatcttgaaaacattctaaaatattcagataggttccataaatatttgttcaaaaattaaaatagaataaccttttattcattgttcaatttttatctatcaaatctcgaattatgaaaacaaactacactatgctttacataag

SEQ ID NO: 130199 - DNA, 601 bp, Human
ggaaatagtctattgattgatttctacacacctaattgaaaaatatttaccaaaactcaagctttctgagccaaagtcaatgtggatgacttttggaatgtccttggtaccatgaagatctaaggatattaatacatagtaatacgagggtcaggccaatcaaaggagacgacagaagaggaatcattaacatccaaaggcatttttacactgtgataattatccccatttgctcaggttaatatgctttcaatggaaacatgtggaataaacagctgtcatggacatgtgccaccaaaakaaaagctcttctcagccagaaaaacaattgggaagttagtgaaccagtacatgctcataccttaggaaagcaaatacttttcactgagcccatagacaaaattaaagtctggaagaattctttttttttggtgggggataggaaataatacaaatcttgaaaacattctaaaatattcagataggttccataaatatttgttcaaaaattaaaatagaataaccttttattcattgttcaatttttatctatcaaatctcgaattatgaaaacaaactacactatgctttacataaggga

SEQ ID NO: 130200 - DNA, 601 bp, Human
cacctaattgaaaaatatttaccaaaactcaagctttctgagccaaagtcaatgtggatgacttttggaatgtccttggtaccatgaagatctaaggatattaatacatagtaatacgagggtcaggccaatcaaaggagacgacagaagaggaatcattaacatccaaaggcatttttacactgtgataattatccccatttgctcaggttaatatgctttcaatggaaacatgtggaataaacagctgtcatggacatgtgccaccaaaataaaagctcttctcagccagaaaaacaaytgggaagttagtgaaccagtacatgctcataccttaggaaagcaaatacttttcactgagcccatagacaaaattaaagtctggaagaattctttttttttggtgggggataggaaataatacaaatcttgaaaacattctaaaatattcagataggttccataaatatttgttcaaaaattaaaatagaataaccttttattcattgttcaatttttatctatcaaatctcgaattatgaaaacaaactacactatgctttacataagggaatagaaataaaagtaggcatagtctggt

SEQ ID NO: 130201 - DNA, 601 bp, Human
taaggcttgatatattttctaccttccaaatgggcattcaacgaacttaaattttatctttatattgtacttaactgtaactcagtaatttttcttaaaggaggagaacaaattgtacaatacagtccatattagaaggaattagcttttgtttttaaaaagaagagaatgtgttttatatcatttgacattttcaacttataaattttagcaagcatgcatccattataattacactggttttttactatgtaatttaccacagaacagaatacatatacagacagttaaattaattcaytagataggggacatataggaaagtcagcttcttatagttaaccaatccaaatatattcataaaaatatagatggaaaacttgattcaagaaatagtttccatttatctttcaacagtagttttcaaattggttagcataaggtccaactttaaatggatgaattatgttttgaaaataaatacttgcatttaaatgattattttcagcagtgaattattcttcggctatctctctgcacagagcataagacatttatttatttatttatttatttatttatttatttatttatttattta

SEQ ID NO: 130202 - DNA, 601 bp, Human
ctgttacaaacttgtttaaagcatgagagtttatcacaaagataaaattttggttaagagtatgttatacaacaaaggcgtccatgaaggtggactgaagagtattaaagggaaaagttgagatccaagaacataaaaccctgatttcacagatggtagtaatggaagttcatccctgaagagttttctgttggagagtgttctgctcaaaatcaatgcatctcaaatttaatgtggatacaaatcatgtgcaaatattatcaaaattcggattcagtaggtcttagagggtgcggtgccragatttttatttctaacaagctccaattttatatcaataagtaccactttgctttcatatccaagtatatattatattccaatggcttacagtgaaaaaagcaaatttatgtataccataattgttcagtcaaaagtcagacttttggccatgttgacaatgatagttatccagaactagttttgtatgagctgattcattctcttaaatacaggacaatagttatgatcacatatcatcaaaaataggatagattatattcaacatattatcaagtttgatggataaatcagtggagca

SEQ ID NO: 130203 - DNA, 601 bp, Human
tcaaaaataggatagattatattcaacatattatcaagtttgatggataaatcagtggagcattcaatgccttttagaaaaattgtcatctaaaatgtcaaagcatgttttgttaatataattatataattaaatgggtatattttaggtattttgaaatctttttcatccaggacattatatcatccagggaaaaatacatagcagaggtaccagtgtaaatacacatttttatgctgcctttaggcataattcaatatattttattgtactaaatggaagctacattctctgaacactrtcctgacatagagaaaaaaatatattcctgttaaaaatataaaattgatctggatattctttgttacatattacttgaacctgttcatctctatcaccatttactgattttcacctgtgttatttttcacattccagtcatgccactaacactttagaaagtagaattagtgctgctgctgttagttcctaccattcagatctgattccaatgtacattttaagatattttgtttacctagcaaagtaactaagaagtttggagaagtgaggctaaaaaaatgtattatgtcttaggctg

SEQ ID NO: 130204 - DNA, 601 bp, Human
gtattgtgtaaaccactgtgtttgtggtaatttgttacaacagcaatgaaaatttctgatgtaccaggctctctgctaagtactttatattagcttatttttggcctcacaacaactctaagaaataagggccattattatccccattattattaaggtttaggatattttaagtagcttttcaagctcatcacttgtaaatagtaaagccagcatacgaccccaggactgctttggttggataaagatgatgtccttaaaattattagaaaacgtatatctcaaaacaatttaagagtttcttgttttcatttcctctaccgtagaatgaaactaatttttctttactaactgcatgctgaaaagaagggtcaatgaggaaatctctgtgagacatatgggcccaatgggggggaaaaagctattatatactttgtgtaaaattagtcctccttttctttctaaagtcatcaattttctatttttctttaatccaatatgttcagtataaagtcatcagttttcaaccttcttttaatcagaggtatttcctggtattttataagggaaaaataaaatgtgacatcactaacctgttata

SEQ ID NO: 130205 - DNA, 601 bp, Human
gggggcctgggtgaggtcgctcacgcctgtaatcctagcactttgggaggccgaggcgggcggatcacgaggtcgggagatcgagaccatcctggctaacacggtgaaaccatgtctctactaaaaatacaaaaaattagccgggcgtggtggcaggcacctgtagtcccagctactcgggaggctgaggcaggataatggtgtgaacctgggaggcggagcttgcagtgagccaagatcacaccactgcactcaagcctgggcgacagagcgagactctgcctcaaaaaaaaaaaaaaargggggaaattggactatcctttgtgaagcacccaccatgttccaggttactgatatcgtacattcattatcgacttaatgctgaaagataagtgtgattgtccctgctttacagtttgtgaagtagggaggtgtagtggttaaatatattcaaagtcatatggctaggaagtctggtgtcagggttcaaaaccaggacgtttgagtttcaaattgctgggttttttcctccactctttatagtattctgcttctgtattctgtagtttctggtcacacaaaacacaatgtaaaatgtcag

SEQ ID NO: 130206 - DNA, 601 bp, Human
tgtgtgtgtgtgtgtgttttaatcatctttctctttattagtataatataattttacctgccttgatatcatgtaggcataaggtattagtcttgttccatttgtaaagattccaggagtgttctgctttttataacacttcaaagttttgtgcttggagctccactatccaagagaggcaaatggctgttaaggaatctagtaaaacattccaatataaaaaccttcaggggcacatggtgatccattaataaaacagaaattcaaatgaaaactttagtttaacaattaagatgatccygactccttgctaaattcccattgtcttatgggatacaagaatgcaatatgagatattgtacaatgcctttagtattttttctaatagatttagttccatcacgaactgctaaaacagtgtgagaaaattcttgaagaagttatataaatattaatgtatttcagagttttgcttattgtattgatatatgttcaaaatgatgtattttttcagcaatacaaaggatataacttatctcacctttctttaggcaaatgaatgacaacaaattacaatagtacaatatcactagatatcttc

SEQ ID NO: 130207 - DNA, 601 bp, Human
tacctactaaagagaaataatactttaatcactgtaaaaacccaagcaaagtagaatttttcaaagccctgtggagtggcaaccctatatctttaatatctaagaactagaaaataattttaaatatacatatgttttatattccttaagagcaagtgactttaggtgagaggagaccaaaacttaagtgaattaccatttaaagcaaaagatcaaactagaatgttaaattgtagcaaaaaaggaagaaattatgtgactctttcatactataatattaccagtttggaaaataggcctrgtaataaagtttgttttactaattctttctaaattccaggccaaaaatatcatgtaactttaacatggctttcatttccagtcatgtacagaagagtcctttaatcttatcttgctaaagaaaagaaatattttttgccttaaaactgtattctataaatcagttcatgtctgtctttctacatacaaattaatttctgtttgttgattaaaatctgctggggcggagaggtagctgtttgatgtaattggtctatcaagtttaaatgcaaatgattaagtagggtaaacattagcaggg

SEQ ID NO: 130208 - DNA, 601 bp, Human
ttaaattgtagcaaaaaaggaagaaattatgtgactctttcatactataatattaccagtttggaaaataggcctggtaataaagtttgttttactaattctttctaaattccaggccaaaaatatcatgtaactttaacatggctttcatttccagtcatgtacagaagagtcctttaatcttatcttgctaaagaaaagaaatattttttgccttaaaactgtattctataaatcagttcatgtctgtctttctacatacaaattaatttctgtttgttgattaaaatctgctggggcrgagaggtagctgtttgatgtaattggtctatcaagtttaaatgcaaatgattaagtagggtaaacattagcagggatggcaaacagaaccaaaagcattttctcatggtactctgctggaaagctgatgtgatttctagacagaacagacagcttacccaaaactatctaagtacaaatatggctacctctttcttctacattctctctcacctgttccaattagctgtaggaatcctcagggagaactgcatttcacaattagattttagaattgccgtacccttaataaatacgggag

SEQ ID NO: 130209 - DNA, 601 bp, Human
tttacactagtgttctttcaagtatgagttataaaacagatattttatgtagaattttttttaaaaaattcttatcatctactacctaacattagtggcagacagcattgtaagaatgaagacctgggtggttatcagagtccatgttcttcagggcttgaggccatgcttttggaaatcatttcccagagccggggcatttgaggagagtacagaaaagcaaatgaatggtgaataggagaaaggccatcagccaggcagctgcaggttagacggatggattgacttcccagcagagcarggcacagtttgctcaattacccttttgtacagctgggaaagaaagacaggaacatcagagactgctatctctcagttaccaataacttttgaaagaggtatttgaaagacatataaatgatattttccactgcctccctgtgcagggaaagcattgtatgtcaagtcaaaactgaaattcactagtaaccaaaattaacagccatagtctttggcaactatctttggtcacactatcacctagaattggctttgtactttgtatcagagctttacatgaggtccttgatctactcatcag

SEQ ID NO: 130210 - DNA, 601 bp, Human
gagaaggcactatcttgagaacaacaagggggaaatccacgcccataatccagtcacctcctaccaggcccctcttccagcattggggattataattagacatgagatttgtgcaggaacacaaatccaaatcatatcatatgcccagcaggagtatagtatctggacattttagccaatcaatagctttatgtccaatttatctgaattaatacgaatcagagccttttagattaaggaaattttatttttaaaaataaaaatattttcacagaaaaacattcttagaaaaaatattgargactgtttggcacagatcagtaataaataacttattaaattctaatcagatgtttagcatatatcttttacagtctttggattatatcaacaatattagataaagatataacctacactattcttcagatatatttaatttttttcattttcaaaagattttattggctttcccacagaaatcattataaatattctcatagctacaaaggctttagaacaaatagaaaatttccataactttatctttctgaagtataattgtgttgaagtatgatcagcgatttttattgatcttatg

SEQ ID NO: 130211 - DNA, 601 bp, Human
attgactatagtccctagcttacattagattttcctgttgtgttgtacattttatgggtttcgacaaacacttaataatgtttattcattatcatatcagaataatttcactgccctaaaaatgtcctgttctccgtctattcattctttcctccctcccttgagaccctggcaaccactggtctctttactatctccatagttttgccttttccagaatggcatatagttggaatcatacagtatttagccttttcagactggcttcttttacttcgcagtatgcatttcaggtcccttygtgtttttttcatggcttgctggctcatttctttttattgctaaataatatttcattgtctggattaccacaattttttcattcatctattgaaggacatcttgtccaagttttagaagttataagtaaagcttgtataaacattcttgttcaggtttttgtgtggacataaacttgcaactcatttgaaaagtcgttaattgtgaaaagtgtttttgacagagaggaaagacacaggtctttaagttagaaagactttaatctcaaccttgccattttagtcattcagtacgtttttat

SEQ ID NO: 130212 - DNA, 601 bp, Human
tcatatcagaataatttcactgccctaaaaatgtcctgttctccgtctattcattctttcctccctcccttgagaccctggcaaccactggtctctttactatctccatagttttgccttttccagaatggcatatagttggaatcatacagtatttagccttttcagactggcttcttttacttcgcagtatgcatttcaggtcccttcgtgtttttttcatggcttgctggctcatttctttttattgctaaataatatttcattgtctggattaccacaattttttcattcatctatygaaggacatcttgtccaagttttagaagttataagtaaagcttgtataaacattcttgttcaggtttttgtgtggacataaacttgcaactcatttgaaaagtcgttaattgtgaaaagtgtttttgacagagaggaaagacacaggtctttaagttagaaagactttaatctcaaccttgccattttagtcattcagtacgtttttattggaggtctactgtgctacccctgccgtttttggtgttagaaatgcatatagggctcctctgcctgtaacctgagtgccccacctacatta

SEQ ID NO: 130213 - DNA, 601 bp, Human
aaacttgcaactcatttgaaaagtcgttaattgtgaaaagtgtttttgacagagaggaaagacacaggtctttaagttagaaagactttaatctcaaccttgccattttagtcattcagtacgtttttattggaggtctactgtgctacccctgccgtttttggtgttagaaatgcatatagggctcctctgcctgtaacctgagtgccccacctacattaaaaagcctcattagacttctggttcctgatctgaaagatgcctatcttcttgaatattcatgattttctattttattttsaaaattagaacagctgccacggacaggacttgtatttcctgggagcaagtgccaaattgctacatagcatcccattgagaaagaagtgataaaatgtgttagttcattttctttctagtccttctaacctatatgttttttaaaatatttgtctaaatatgaaaagcattttaatactttccaaaacaatattcttgaattatccacaatataaaatgaaataaggacatggaatcattttttgtatatctaatagtgatgagaattggacttgagctgagaattcattttgagctctat

SEQ ID NO: 130214 - DNA, 601 bp, Human
atcatacaggacttttgtgaagcccaaatgcaaaaatgtacaatgtatataaaagaatgttgcaaactataaaacaccataaaaacattcagtattattaccaattgctttaatgtatttctaggtctatttaatcttttattgtatatatttaatctatacaacatgaggttttgatatacatatgccttgtgaaatgatgactacagttaagcaaatcaacatatcactctcctcacatagttatcattttttgtgtgtgatgagagtacctgaaatccactctcttagaaaatttctrctatacagtacactattattaaccacagtcatcatgctgtactttacatttctagttgtgtgtcctatacagttgtaactttgtagcctttgaccaacatctccccacttctgacatcttcccacccctggtaatcaccatccactctctgtttctgtgtatttgccttttctagattccacatataagtatgattatgtagcatttgtctttctttggcttatttcaattagcataatgttctccaggttcctctgtgttgtcacaaatggcagggtctcctttgttgaggctgagtaa

SEQ ID NO: 130215 - DNA, 601 bp, Human
ctttggcttatttcaattagcataatgttctccaggttcctctgtgttgtcacaaatggcagggtctcctttgttgaggctgagtaatattttattgtgtttgtatctatatagacaatttatttatcctttcatccataaatagacactttggttgtgtccatatcttggctattgtgaataatgctgcagtgaacaggggagtacaggcatctcagtattgattcctttcttttaggcatatacccagaagtgggattgctggattatctggtagttctattttaactttttgaggaaycttcacaccgtttttcataattgctgtaccaatttacattgccaccaagagcgtacaaggatttccttttctctacatcctcatcaatacttggtatctcttgttttttcaataagaaccatcttaacaggcatgagatgatatgtcattgtgattttgatttaatttccctaatgatgagtgatgttgagtaccttttcatatatctattggctaattatatgtcttctttggaaaaatgcctattcaggtcatgtgcctgttttttttatctgcttctctgtgggttttgttttgttt

SEQ ID NO: 130216 - DNA, 601 bp, Human
taatattttattgtgtttgtatctatatagacaatttatttatcctttcatccataaatagacactttggttgtgtccatatcttggctattgtgaataatgctgcagtgaacaggggagtacaggcatctcagtattgattcctttcttttaggcatatacccagaagtgggattgctggattatctggtagttctattttaactttttgaggaaccttcacaccgtttttcataattgctgtaccaatttacattgccaccaagagcgtacaaggatttccttttctctacatcctcaycaatacttggtatctcttgttttttcaataagaaccatcttaacaggcatgagatgatatgtcattgtgattttgatttaatttccctaatgatgagtgatgttgagtaccttttcatatatctattggctaattatatgtcttctttggaaaaatgcctattcaggtcatgtgcctgttttttttatctgcttctctgtgggttttgttttgtttactactaagttttatgaattccttacatattttggatatcaaccctttatcaggtatatggtttgcaaatattttctccctatt

SEQ ID NO: 130217 - DNA, 601 bp, Human
ctcacactgatttcatcttgtttcttaaggaaaaggcctctgtattttacttatacattttcttcacaaagcacacctaaaacttgccctgtagcaggtgtccaataaatatttgatgcatgattgaatgattcgatgatttttgagataggccttaaaggaaacataggaatctgaacagagtagatggggccaaggaaccataaaattaggtagagatggggtaaagcctaaactaattgggagaaactgtgacgtatccagccccatagatcatttcatgcttgtagaataacaaacwatcaggctaaggtaaattaagaaggtaattttctgcacagcaatgtaaatatcgatagtgtatttttaaaactttattgtttgtgtaattcttttctatgacataatatggattattatattggcttattgtttaataaaaagataaatatttagagcattaaattatatcaaacttggaagtaaaataaagagtacctatcttaaaacataatcctgggtactactagtagtttataatttagtaacatgggcattttccctctgaagattattccacagtggcaagtggtggggggag

SEQ ID NO: 130218 - DNA, 601 bp, Human
ttttatacaaaattaaattagtattttaatttatactactacaaaataagccactttccccttataaataaaattcagttgtggtcttatgtgtattaattctcagtttttaatagttttttgaattttacagaagaaaaatttgataatattttcaaatgaaaaacacaaatatagttaaagctagttttgagaattttaatcatgttagtctttgtgtagtcccacatttctataaaatatggtggaaattatttctatgaaatacagtaaagaagataattcatctgcagattccackatgttcctttggaatacaccacttacctgttctctagtaaaattggagatctgcaaattttgattgtgtgatagtcaaggattcaaacattcagtagctaaatagaaaggtggtaatttttaaatggaaaatatattctagtctcataccttttgtataccatttaaaataaaactatagcagatgacaaccttcatcgacatgcatcttgaagttatttgtcatttcaagaaagcatttaaaattttgttctctctctctttctctcttcttcctttttttttccccccaaaggccttg

SEQ ID NO: 130219 - DNA, 601 bp, Human
catctgcagattccactatgttcctttggaatacaccacttacctgttctctagtaaaattggagatctgcaaattttgattgtgtgatagtcaaggattcaaacattcagtagctaaatagaaaggtggtaatttttaaatggaaaatatattctagtctcataccttttgtataccatttaaaataaaactatagcagatgacaaccttcatcgacatgcatcttgaagttatttgtcatttcaagaaagcatttaaaattttgttctctctctctttctctcttcttcctttttttttccccccaaaggccttggatggtatactgtaaattcagcatatggagataccattatcataccttgccgacttgacgtacctcagaatctcatgtttggcaaatggaaatatgtaagtgtgacctacctgggacttggttaattgcccttgttcttttaaataaaattctttctgtgagtaactgtgaatttcaaattaacctaaatgcaatattaaactgtgagtacaaatgtaggaaggtaaaattgtgtggaatatggcaaaaaaataattcctatcttacataacaaatgatatttt

SEQ ID NO: 130220 - DNA, 601 bp, Human
atctgcagattccactatgttcctttggaatacaccacttacctgttctctagtaaaattggagatctgcaaattttgattgtgtgatagtcaaggattcaaacattcagtagctaaatagaaaggtggtaatttttaaatggaaaatatattctagtctcataccttttgtataccatttaaaataaaactatagcagatgacaaccttcatcgacatgcatcttgaagttatttgtcatttcaagaaagcatttaaaattttgttctctctctctttctctcttcttcctttttttttycccccaaaggccttggatggtatactgtaaattcagcatatggagataccattatcataccttgccgacttgacgtacctcagaatctcatgtttggcaaatggaaatatgtaagtgtgacctacctgggacttggttaattgcccttgttcttttaaataaaattctttctgtgagtaactgtgaatttcaaattaacctaaatgcaatattaaactgtgagtacaaatgtaggaaggtaaaattgtgtggaatatggcaaaaaaataattcctatcttacataacaaatgatatttta

SEQ ID NO: 130221 - DNA, 601 bp, Human
gttcttagaatgtattagtctgaaagattccaccttaagtgttagaggcaaagaaaaaagcagagttccagaataaatcagtggattataggacagacctcagtggaggatggcaacctttcttcatttgttcatgttctacttgatgtggttattgcaaagacaagatatatcagtagatagagccttagacagtctttcggaattaatcatcagtattacaagcttgattctggcatttagccttaaaaatgtgttgatgctataggtcttttttatatttaacggtgttgatttttttcccatatttcttgcagatagtaaaatcaaattttctcaggtatgaaggtacaagtgggtctgaaaatggagggtagagatcctggtagggagatgtggaatggctatgtaactttgagtaataaaatgtctcaatttaattaatcaatattaatgcaaagtgtttgtgtggtacaatttcccaatgctggaccacaggagactcatgacagtctgcaagcttcaagtagatatgtttccctggacacaatatcaaaatttccctagctccttgaaatgttaaaaggtatttgcaaaggaa

SEQ ID NO: 130222 - DNA, 601 bp, Human
ccttaagtgttagaggcaaagaaaaaagcagagttccagaataaatcagtggattataggacagacctcagtggaggatggcaacctttcttcatttgttcatgttctacttgatgtggttattgcaaagacaagatatatcagtagatagagccttagacagtctttcggaattaatcatcagtattacaagcttgattctggcatttagccttaaaaatgtgttgatgctataggtcttttttatatttaacggtgttgatttttttcccatatttcttgcagatagtaaaatcaaatyttctcaggtatgaaggtacaagtgggtctgaaaatggagggtagagatcctggtagggagatgtggaatggctatgtaactttgagtaataaaatgtctcaatttaattaatcaatattaatgcaaagtgtttgtgtggtacaatttcccaatgctggaccacaggagactcatgacagtctgcaagcttcaagtagatatgtttccctggacacaatatcaaaatttccctagctccttgaaatgttaaaaggtatttgcaaaggaaaagaatttgatggtcaaatactttacaaaaag

SEQ ID NO: 130223 - DNA, 601 bp, Human
ggcacatactacatgttgccatgaatatcagctgcccctgtctccaacacacacatgcgtgcacacgcacacacacacacaccttgtaaaatactatcagatttagaataaacactgtaagatatttttaatctccctattctataattttaagctaccatagtgtggccctattataatatagcttctaactacttaagatagccaggtcagcaaaaaaagaaaataaacaaaggcatgatttttccatttgataaatattcagttgaatgatttagagaaacttagccaagaagactcrgaagcaaaatttggcttaaatcattgcccttgactaaattactttaatgatgcaagtaaatttgtagcattgcttttcccttcaattctatacttggttatgaatctttgaatcatgttaagatataattcacatagactattttttaacactttggaatcaatatgcaattttgctaaaatagtgcatgtcctcttttatggtcctccaactaatactcatcaattgtcacaacctaatataaaagaaaattacattcaagatacatagttaatatagaggactcaaaacaaaccttta

SEQ ID NO: 130224 - DNA, 601 bp, Human
cattgataaaacattacagggtttacaaagcaaagtaaagttatacattttctattagagaaagagtatgtgcacaacagtctggatattttactttggtgaactggaaagtagtgaaacttggcaaagcgacccaccaaatctgtctatttagaacctaaatttatggggagaattgtcaaatatcatcacatattccaggcatagtactcttgaaggagaaactaagaatgttttgaccttttttttctgttcattttgactcttcattggccacgtaaattaactgcatgtattacawctattgagctctcagagagggtgtcactaaataactgatttcagtttccagaaaactttgacttacttacaccccaagaattttctttttgtttaaatatttcagatgcattcttctctcaaatgtattagatatttgcctttttaaaacgtggattccaaataagattcagtgtttcatcaataaatcagagttccaattatgaacattaataacattctattaaaatagtgataatgtcaaggtttactcttatgtgaaaggctttaacccccacacaatatgtttcccagaaactgg

SEQ ID NO: 130225 - DNA, 601 bp, Human
ttttgactcttcattggccacgtaaattaactgcatgtattacatctattgagctctcagagagggtgtcactaaataactgatttcagtttccagaaaactttgacttacttacaccccaagaattttctttttgtttaaatatttcagatgcattcttctctcaaatgtattagatatttgcctttttaaaacgtggattccaaataagattcagtgtttcatcaataaatcagagttccaattatgaacattaataacattctattaaaatagtgataatgtcaaggtttactcttaygtgaaaggctttaacccccacacaatatgtttcccagaaactggtgtctattttgagaagcttttttttcttggtcaactttttatcattttatggtcactatcctaccaatcaggtagtcaagtgtcacttctagtttgtgttaatgttaattttctctgttgtgtcttcctatttttctatatttattttttctattgttctatcttgcttatgttttgttcccaatcagtgtctttggaaactagaaatcatcattgtgaaaattgtatttgtggaattatatttctagaattaata

SEQ ID NO: 130226 - DNA, 601 bp, Human
cgtatgaagatctatgattcatggtaatagtcagtgttaatagagtaatgttatttggttaatgttaaaaatgaatagtgtcaaaatgaatttggcaatgctttcaaatgaatgtgattttataatagtgacaccatctattgcacatttaaaaatcgtcaaaagtatattttcaaataaattgttaaaaaggtcttaaaaagacattgtttttataccagagagcatgtattcagtctttggtcagtgttggaaaataaacgggtcaagaaacccttggaataactctgcattgcctgastttctggagtttccaaattgacagcccctgattgaaccaaggtaataacattgcctttttattttgcagttgggtgactgcatttcagaagacagttatccagatggcaatatcacatggtacaggaatggaaaagtgctacatccccttgaaggaggtgggtgtgagggcaggaggacagggagtacattcagaggacctgttctgactttctttgttctaggtattctttaaaccagtggtctccaacctttttggcaccaggaactggtttcatggaagacaatttttctttggatc

SEQ ID NO: 130227 - DNA, 601 bp, Human
tactttaagtatgtactaaattaatacatgattttttaaacatcattttcagcccttgtacagaagaatcaagagcagaggaaataatttctgtatatggcatgatctagaagttaattaagtgagtgggaaaagggattccaggattctatttctgtgtctctgattcacggttttgaaacgacatctaacctcactacatgtcaattttctctcctgctgaatacagttagaaggaaaaaaaacacttctcaaaggtgtggtgctgtttcgttaaggattgtgattgtcagatgaaagmccctatcatcagtgttctttattttcttcagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactgtaagtaattcaatatataattatgctatttaatgtattagaaataatattcaaatgctattaatctttgaggtcccaatccaatt

SEQ ID NO: 130228 - DNA, 601 bp, Human
gaaaaatataatacctaactgatagtgttgttatagagagtaagtgaaatcacaaatcaaaaatagcatgctacatcacacattaaattgtcattattaagtactttattattattattatatggtcattatcacaatataaacatagagctgaagatatttggggggaaaatgcaataaaggattttcttcttattattaatttatctaaaatttttgtgatactggcatgtgttctacagtaacctagcacttctacatctattttagagaaaagccaggaatgcctgctgagcctttygaaagaatcacctcacctacatttctttttttggttccctagggcacaatatcttatatgagaacaaaagtgaaattcttccaaagttgccctaatattaaaaggtagttttgccttaaacttgggaaataagtttcaacttgatttaaacccaagaaattaatatttcattatgtatagcttatctaaaatcaaacttttttaggtgaaggcagaattctttctttcttttttttttttttgtgtgagacatagtctcactctgttgcccaggccagagtgcagtggcgtaatctcagc

SEQ ID NO: 130229 - DNA, 601 bp, Human
taacctagcacttctacatctattttagagaaaagccaggaatgcctgctgagcctttcgaaagaatcacctcacctacatttctttttttggttccctagggcacaatatcttatatgagaacaaaagtgaaattcttccaaagttgccctaatattaaaaggtagttttgccttaaacttgggaaataagtttcaacttgatttaaacccaagaaattaatatttcattatgtatagcttatctaaaatcaaacttttttaggtgaaggcagaattctttctttcttttttttttttttgtgtgagacatagtctcactctgttgcccaggccagagtgcagtggcgtaatctcagcttactgcaacctccacctcttgaattcaagtgcttctcctgcctcagcctcccaagtagctgggattagaagcgcatgccaccacaccctgctgatttttgtatttttagtagaggtggggttccaccatgttggtcaggttggtctggaactcctgacctcaggtgatctgcccacctcagcctcccaaagtactgggattacaggtgtgagccaccaagcccggcccagaattctttctg

SEQ ID NO: 130230 - DNA, 601 bp, Human
aaacccaagaaattaatatttcattatgtatagcttatctaaaatcaaacttttttaggtgaaggcagaattctttctttcttttttttttttttgtgtgagacatagtctcactctgttgcccaggccagagtgcagtggcgtaatctcagcttactgcaacctccacctcttgaattcaagtgcttctcctgcctcagcctcccaagtagctgggattagaagcgcatgccaccacaccctgctgatttttgtatttttagtagaggtggggttccaccatgttggtcaggttggtctsgaactcctgacctcaggtgatctgcccacctcagcctcccaaagtactgggattacaggtgtgagccaccaagcccggcccagaattctttctgttagaaatattcaattggaaataaaccatattagtgtaagtgtaggtgtacaacacaggagagaacatcaagataagtaataagaattgggaaattggcttcagaaagaatagaaatatctgtgagtatgaggcatgcagagttgggtagacggagaagttcttgaatggatacgaagaaaatgattttatcatgctggctgtgta

SEQ ID NO: 130231 - DNA, 601 bp, Human
tggttctcaaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcacatattcaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatcc

SEQ ID NO: 130232 - DNA, 601 bp, Human
ggttctcaaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcacccattcaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatcct

SEQ ID NO: 130233 - DNA, 601 bp, Human
gttctcaaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcacctcttcaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatcctt

SEQ ID NO: 130234 - DNA, 601 bp, Human
ctcaaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcacctatttaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatccttccc

SEQ ID NO: 130235 - DNA, 601 bp, Human
tcaaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcacctattccatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatccttcccc

SEQ ID NO: 130236 - DNA, 601 bp, Human
aaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcacctattcaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatccttccccct

SEQ ID NO: 130237 - DNA, 601 bp, Human
actgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcacctattcaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatccttccccctcc

SEQ ID NO: 130238 - DNA, 601 bp, Human
tgaagcataccctttagccctattttctccataaattgaccaaaatggaatgaaagttgcatcttggctccaatgaacaggacaaaattacaatacacttacagtcctgttgattgtgtcaaggttctccctcagttcataggattcatctttttttaagcagatcttctctcctgcatgccaaaatcctcgctggtgttgtttagctcatgtctcctctttttatttcatatgaagtattatcatgcaatatgagtacagtggcatctaatagctttagctatttgctagctgatttttrtccttccaaactataagattcatataatatataattaaatttccctatcataaagccatgcagtttgattgttcctatggtcttttatacataaaataattaccaccattcctacctcagttaaagacattttgctaagaagaaattgatttttatgtaacagggtttctttgtagttggccctaagattagtacttgtatagcaagtagctattagcttcaatccttctataaaaaggtatatttaagcaattaccattactagcttcttgagaaaattatgtataatttagtcattta

SEQ ID NO: 130239 - DNA, 601 bp, Human
acagtactcaatagtatttaagaatgtcattcactacattattcagaagactagtataagtaatttctttatgctgacagaaaactttgtttctcccaatgaattaattgctgtttttgtttcctttgcgaaggaaaatttaaaactaattaggtttctgctttggctatcggggatgacagagccaaatttgtgtctcagttttagcaataatacctgctgaatatctttctttgttaacttatattattcctacatcatctatatttttcctagtcttaatttcttaatttctttttttcttttgtcattttctttttttcttctcctctctctcttcctttcccctttctttctttctcattcttctcatttcatcctttcttcctttttactttccttccttccttctttccttccttttatgttttttcttttaatctggatatatagtgtatttccttttaagctgcctcaaatatttttgtcaaattacataaggcataaatataaaaataaaacattggactttttaaaaatgcccttgaaacttgagcaaaagccatgctgtcaataaaataaaagtcatcaatagaaaata

SEQ ID NO: 130240 - DNA, 601 bp, Human
tgagcaaaagccatgctgtcaataaaataaaagtcatcaatagaaaataaatcagctctcaaattccttaggtccaaaatattaattatttgcccaggaatcagatattggtaacacaaactgtactctttttgtgtgatcaatgaaacacattcccttttttatcttacttgataaaatgctatcttcatcaagaaatacaactgttctcattgtagcgaccaagtataatcatctgacattttgcctctatcaaaagggacagcccgaaggaataagaagctcaaatacttacacactracggatgtgaggcgcaatgcaacaggagactacaagtgttccctgatagacaaaaaaagcatgattgcttcaacagccatcacagttcactgtaagtcacctacttcttcatcagcagcttcacctcaaaggcttctaatagcttaatgtagctatcttttcaaataaactgcacgtatatctttcttaaataacttggttgcaatagatgcagtagagagagaaagcatcgggataagctcaactttgtccagatttgtactgcaatattgaaacctttcatggctctgataaccgcaa

SEQ ID NO: 130241 - DNA, 601 bp, Human
gacatcatccactacaatcccactgagtataaagagactttagaaattgtcttgagtacatagttctaactctttcatttgactcataatactttaaaaacatgtgggatatgagctaaatttttgagagagatacagggaggtacattggggaataaagcaaccagatggttgcttctgattgtctgatgttgggagtgctcccttgagagccctgtaaaaatagtggactgttatgttcacagctgggccatttctccatttactccttgcttatgttgcttgggtttgaatgtgtctmccatcaggggctagttacagagaaagcagtagcttccagtataacaatattatccagtcctgttccatgaaaataaaataatgaagaaagagaatatagccagcagatagaaccatatgtggaatagctagctgtctattatcattgctcatgatgtctttgggccaataatcaataatctagtgccttagagatggtgtgatgtgcttatttttaagagatgcaaggtacacaggtctctaaaagaaaagggctcttatttactttacttgtagataaggcaggggaggatagatggca

SEQ ID NO: 130242 - DNA, 601 bp, Human
acagggaggtacattggggaataaagcaaccagatggttgcttctgattgtctgatgttgggagtgctcccttgagagccctgtaaaaatagtggactgttatgttcacagctgggccatttctccatttactccttgcttatgttgcttgggtttgaatgtgtctaccatcaggggctagttacagagaaagcagtagcttccagtataacaatattatccagtcctgttccatgaaaataaaataatgaagaaagagaatatagccagcagatagaaccatatgtggaatagctagctstctattatcattgctcatgatgtctttgggccaataatcaataatctagtgccttagagatggtgtgatgtgcttatttttaagagatgcaaggtacacaggtctctaaaagaaaagggctcttatttactttacttgtagataaggcaggggaggatagatggcagactgacaaagcaaaagacttggttgcagccatatagtgcctacgtgtttggctgtgatgggggaaaattaaacaaaagtgtgtaaaagtttaattggattttagtgcatttaattagatttaaatgcatcttg

SEQ ID NO: 130243 - DNA, 601 bp, Human
tatagccagcagatagaaccatatgtggaatagctagctgtctattatcattgctcatgatgtctttgggccaataatcaataatctagtgccttagagatggtgtgatgtgcttatttttaagagatgcaaggtacacaggtctctaaaagaaaagggctcttatttactttacttgtagataaggcaggggaggatagatggcagactgacaaagcaaaagacttggttgcagccatatagtgcctacgtgtttggctgtgatgggggaaaattaaacaaaagtgtgtaaaagtttaaytggattttagtgcatttaattagatttaaatgcatcttggttttgacaggtagactctaacactgggttttaactctgttgctgactctgttcctcctcaaaagctgaaaaaaagtatttcaagtaaatcaacatctgattctaaattatatggaaacataaaaatcctatttttacccacttatctttgattgcttgcttattttccaaaaacaagatttgtttccttttcaaacatgtctaaaggaagtgtgggtagagaagcgccaacccattcttgcacatgtttgcagaatagac

SEQ ID NO: 130244 - DNA, 601 bp, Human
cccttttatccctgagctatagtagaatacctggaacatagtaggagttaattcagtattccctgaacaagtgcttatactcttgtaattgtctgaaatgtaggccattggctatccttttagagtaaggaagtgtgactgataattggtgatttgagacaaggttatcaccaaaggaaaaggttgtgattgcgatccctccacttaaacccttggctagtatatccaaactcccagtgcatttgttaccagagcatgacatgtgacaagaacccttaacccatgatgggttcagaaaacacacataccatttgaaataggagttgacaagaattacctttataagaaactgtggagaaatatttttctagagtttctttttgatggaaatatattgatgaaattattttgtattgctttactgcctgccttttgatcctttttaacactcgatcctctgctacttgttgtcttactctgtgagctcagtttcttattgtactctctttcagccacagcctcatcacaacttgttcactaaaataaagtgccacttcctatgctgcaatctagcatgatatgtttgtagtaatcagtgatc

SEQ ID NO: 130245 - DNA, 601 bp, Human
aaacctcaaataaaaatgacaaagaaaactgatcccagtggactatctaaaacaataatctgccatgtggaaggttttccaaagccagccattcaatggacaattactggcagtggaagcgtcataaaccaagcaagtatttgtcttcttgttatatgctgcacttcgtccaatgcgttttttttccttcacgaacctaccctataggttggtttgttaccacataaaatttgcagtgtgtaggttggtttgttaccacatagaatttgcagtacatgctcagaggaagcttttgctaacytcttaattttcctagaggaagaacatggctcaaagagaaattttatcccagggccatggagaagggaagaaccattgtgtcatggtcagtatctgtttttaaaagaatataaattaggtattacttcatgatcattcattcctaaaatgtgagtgattaaaacattaagatatacactttcctgcaaaataagctcatgcatctcagtataagtgaactctaatactgtgctcaacttatgcacattaaggggtgttacttcttaaaactatgtcctcgtgtaggaatggtggagaagaa

SEQ ID NO: 130246 - DNA, 601 bp, Human
tgacactggaggatgacaatgaattctcctatatcgggcaggaaagttgagaaaagttgataaacatcacactgtagacttcctaggtgccgacttgcttccctaaaaaaagaatgactattaaaaggtggtggatagtgggaaaatcaatatggatttcagattaattctataggtcatcagttatgaaattttctatggtagattaatatctttgcagttgtagctcctctccttaaaacaagattaatttctttgtaggcaaggtcatactttattaagtgtgattttttttttttttactgttagctatagaatagacattttatctttgagtattattacatcatactataatggtaaaggtgactttcatatatcaacaaattttgtttttaatttcatattaacatttttcatttcagtaagtattccagaacacgatgaggcagacgagataagtggtaggtactatgctgccgactcttcttccttgactatcagctcaagatttatgaagtgtcatggtataagtaattttcttagctgtccacaattttgacttgaattaaaataccaaagacaagatagtaagaatgct

SEQ ID NO: 130247 - DNA, 601 bp, Human
agaactaatgtttcagtcccagactggaagcaagaaaaaatgtcccagttcaagtggtcaagtaagaagttccctcttactaagccttttttgttccattcatatcttcactgattaaatgaggcccacccacatagaggagggcaatctgctttacttagcctactgattcggttcaaatattaatctcacccagagataccctcacagacacagccagaataatgtttgaccaaatgtctgtgtaccacatgacccagtcaagttgacacataaaattaaccaccacaacttggtaacmaatatgttctttttctcaatgaacattttacctataaacacttcacatgggtttgtgtccatggcatctatagaaaattcggaagacctgtgctatgtaagtgaaaggaaaagcaaacagttgcccagaggcaacatccattttatagaagttctccttctgtgtgtacaggtttcctgatattcaaatcttatcctccctttataatccatgataatttactcacaaatccaacagcttgcgttctagggtattttcattttattatgacttctgaatactccacagtaattttacttc

SEQ ID NO: 130248 - DNA, 601 bp, Human
agatttgctgagtgctttgcattcctggttagttattccttgcttgtgccttctgaaataagcaggcatttttggaatatgaattagtcttcttaacccttcaagctgctcatgcagagtaagttcagattcataataagatctttcaagttaagaatgtctaacgccatttttgtgatacagctagcaaagcagtgaaattttagcaacatttagctaagttctttgcattgataattttaaaagtcattggagaaagataagagaaacaatcttttatttctagtaaaatttaagagtrcatttgctaatatacctagtggctatttagccagcattcactccttattccactaatagaagctaaatatttttattataattttcaaaaatggaaaactggagcaagaaagacttggcaattgtgttcttttcccattgtgaaatgacatattcatttaggagtaaggactcatgacttttttgctgctttaatccatataacttcccaatggaagttttttgttaaaaaaaactgaaggtgctttgatgacgagaatagatgactctgatttttttccatgtatgtagggtattaact

SEQ ID NO: 130249 - DNA, 601 bp, Human
cacaaggaagaaagggcttgcatcaaaatataatgtgttcatatttcaaaatcccctctctatatattcgtttcatttttttaaaaaagatcacacttgttttaaatatattttccaaaggctaaggaacaaaaaagtcccattctctggcatgagccaggctgtatgtgtcccatcatctaccctaaagaaacattttgagctgtgatgctgagtgcatgcaggtggcttcctgttttcatgcacattcagtacagttgtgttttttctgatccctcagccttttacctaatggttgtcrtattcactattgacctagatggaaaagccattttctgttttcactgaggacacacgcattccctatttctttgtagagtcttagaaattctaaagacataaaattttcatgaggaatttctttgtagagtcttagaaattctaaggttataaaattgtaagttgtagtaataagaccaactatttattcttctctatttccttcttcaatcaagaaattgctcataactctcagtggggattagtgtcctgctgtcctcctctagtttttcattaaacttggcccaaggggagactcctt

SEQ ID NO: 130250 - DNA, 601 bp, Human
tgctttggttttctaaatataaaattctattatagtattttattggacttttccaaatgataccagccagattgtgatttactggctgcacctaccactgtcatccccttcacttgtcctgcctcctccatcctctcactatgctattgttcagttaaaggcatacttacgggatacccccaaagcagtcccctaccccttttgagatttcaaaacaagtgtagaatattgggaaaatctcaccaaaaaaggtcttaaatcttctgaaaagttatttgaaagtaactttagccctttaaaygcactgcgcttaagggaaattacacagaatgaggagttgagacttagatttaaactctcttctgctgctcttggccatcaagctccctgactcaccttcaatttggtgagtccctgcatgtaacctgccagctgctttcacatacactatcacatttatcctcacaccagctctacgaggaaatcctgttgtttcccctatttatagatgaacaagcatgcttaagaggaggggttgtctaagatcttggagctcagaattaatacatgaggataaaaacccaggcttgcagaccccaag

SEQ ID NO: 130251 - DNA, 601 bp, Human
tggagctcagaattaatacatgaggataaaaacccaggcttgcagaccccaaggccaagacccctctctgccttgcagcttagactagagggtcacctttagcacttcttcccacggtaacttactatgatcctgtaatttaaattttctctcatttaaggttattaaaaagaggcaccgatgaggaaaatttaaaataaataaccatcataatttatattttataaattgtaaaataaatgtatatatattatatatacatgtatacttatataatatatacatatattacatatatacwtgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttctggagactgggaatttcaagatcaaggcaccagcagatctagtgtctggtaaggacccactttctagttcatagaggtgccttcttgctgtaacttcacatgatggcaggaggcaagagagctc

SEQ ID NO: 130252 - DNA, 601 bp, Human
tttttttctgagtaatatttcaaattttaaatgtagacatttgatatgtccttaaaagtttattcctgtatgtttatacattttgcagctattataaatacaattaattttgtaatgtttccaattgttcctagtagtatgtgaaagtgtgattaatttttcatgttgaaatgtatactgacatcttactaaattaccttgttagtagttatattcgttgttttgtggattcctatgtaaacaatgattgcatctgcaaatggagataattttactccttcccttctactctatatgccayatatttcttttgcttgcttttttggcactcataggcacctccaatacacggctgaatagaaatgttcagaatggacacctttgcatgtttccagtcttagaggggaaattgctcaatagttaccattatgtacgatgttagctgtatgtccctacccagagttagtcaaactgcagagttaagggtataatcctccagattacctagtctgcccaagaattctgactccacctgcaaggagttagggtccgaccacaaagtaagagggaagagtacactcaagatcacccttacttctga

SEQ ID NO: 130253 - DNA, 601 bp, Human
cagctattataaatacaattaattttgtaatgtttccaattgttcctagtagtatgtgaaagtgtgattaatttttcatgttgaaatgtatactgacatcttactaaattaccttgttagtagttatattcgttgttttgtggattcctatgtaaacaatgattgcatctgcaaatggagataattttactccttcccttctactctatatgccatatatttcttttgcttgcttttttggcactcataggcacctccaatacacggctgaatagaaatgttcagaatggacacctttgcrtgtttccagtcttagaggggaaattgctcaatagttaccattatgtacgatgttagctgtatgtccctacccagagttagtcaaactgcagagttaagggtataatcctccagattacctagtctgcccaagaattctgactccacctgcaaggagttagggtccgaccacaaagtaagagggaagagtacactcaagatcacccttacttctgacaccaaatgcaagttttggtgtttcccaaaagaatcctcaggtttgataattcactggaaagattcacagaacttactaaaattt

SEQ ID NO: 130254 - DNA, 601 bp, Human
gtagtatgtgaaagtgtgattaatttttcatgttgaaatgtatactgacatcttactaaattaccttgttagtagttatattcgttgttttgtggattcctatgtaaacaatgattgcatctgcaaatggagataattttactccttcccttctactctatatgccatatatttcttttgcttgcttttttggcactcataggcacctccaatacacggctgaatagaaatgttcagaatggacacctttgcatgtttccagtcttagaggggaaattgctcaatagttaccattatgtaygatgttagctgtatgtccctacccagagttagtcaaactgcagagttaagggtataatcctccagattacctagtctgcccaagaattctgactccacctgcaaggagttagggtccgaccacaaagtaagagggaagagtacactcaagatcacccttacttctgacaccaaatgcaagttttggtgtttcccaaaagaatcctcaggtttgataattcactggaaagattcacagaacttactaaaatttttatattcctgattatatttattacaagaaaatgttacattaaaaatc

SEQ ID NO: 130255 - DNA, 601 bp, Human
agttttggtactagaataatgtggatcttataaaatggatcaataaaagggccccatcctcttctttttccaagtttgttaattcgttaaatatttgatagaattcaataatgaaactaactggaccttgagttttctttatgagaacttgcttcaaaacaaaatgtaaatttttaaattaattaattcattttttttctgtttaagacagagtttcactcttgttgcccaggctggagcgcaatgtcacgatctcagctcactgcaacctccgcctcccaggttcaaatgattttcctgyctcagcctcctgagtagctgggattacaggcatgcgccaccacgcctggctaatttttgtatttttagtagagacggggtttctccatgttggtcaggcttgtctcaaacttccaacctcaggtgatccgccctccttggcctcctaaagtgctgggattacaggcatgagtcacagcacccagccaaatttcaatttatagatacagggttgattctttttgaataaattttggcaggttgctcaataatttatccatttcatttaaattattgacatttttgaaaaaaaaaaaaaagc

SEQ ID NO: 130256 - DNA, 601 bp, Human
tcaaatgattttcctgtctcagcctcctgagtagctgggattacaggcatgcgccaccacgcctggctaatttttgtatttttagtagagacggggtttctccatgttggtcaggcttgtctcaaacttccaacctcaggtgatccgccctccttggcctcctaaagtgctgggattacaggcatgagtcacagcacccagccaaatttcaatttatagatacagggttgattctttttgaataaattttggcaggttgctcaataatttatccatttcatttaaattattgacatttttcaaaaaaaaaaaaaagccggtagaattttttatcccttttatgcctatgggttctatagtgataacccttttttgttatctgatattgctaatttattttttcttttatctttcttagtctttatagggtgttatcaattttcaaaatgacctcaaataactttttgctttttttatctctattgcttattttttatgattttgctcttatcattactacttttttctttacatttccactttttctcctttctctgatttcttgaaataaaaattttgattcttagtattagactttctt

SEQ ID NO: 130257 - DNA, 601 bp, Human
aaatacttgttcttttattctttttcttaaaaatacatgtttatggcaagagagctagcccagtgaagcaactggaacatatgtggattttggtattcaagagaggtcctggaaccagtccactgctgataccaagggacaactgtactatttacttcatcaggatcatacatattaaatgttggtacaattgtcttaccaattattgagaaagtgatatcgaatcattcaataaagattgtacatttatttatttctcccttcagttctgtcagtttttactttatacttttattaggtrcatatacttacaattgttataacttccttatatatgaaacctttgtaattacaaaatatctctcattatctctgataattatcaattatatgtaagaccacctccctatctgttttctaggaatcttctgtccttccatcctgccttcttttgaattacttaattaagttttagtattacattttaatacctctactggccttttaactatacctctttgtgttcgtttactgtggttgctataaggattacaataagaactcaaaacaatctactcatgttaaaaatctaagatttttg

SEQ ID NO: 130258 - DNA, 601 bp, Human
atgtttaattatctctggtgtgcactttttttctgatgagacatcacctgttatttatgttattgttctcctgaacaaattttctgtggcactttcaaacatttctttttatatttgcttttggttagtatgtctatgattaacttgagtgtgtttttccttttgcatttcctccttccggacttctgagcattttggatcttcaagttaatgggcttcatcaaacctgggaaattttctcattgtttctttaaatatagttttgcctcattctctttctcttctgtttgacttcaaatayatgtatgtcagcatatgttagcctgctcactatcatctcacaggccactgaagatctgctcactttttttttttccactgccctggactccaccatctcctcacttttttactgttttctttctctctgttttccagaatctgtgacttacaattttgttcctaggttcactaatgctttcttgtgccacctctaatctgatgttaagagcatttagtgaattgttcaatatcaatattctagttttcagtcatagaattatttttgttcacattttttgctgctgatatttccatctgc

SEQ ID NO: 130259 - DNA, 601 bp, Human
gacttctgagcattttggatcttcaagttaatgggcttcatcaaacctgggaaattttctcattgtttctttaaatatagttttgcctcattctctttctcttctgtttgacttcaaatacatgtatgtcagcatatgttagcctgctcactatcatctcacaggccactgaagatctgctcactttttttttttccactgccctggactccaccatctcctcacttttttactgttttctttctctctgttttccagaatctgtgacttacaattttgttcctaggttcactaatgcttacttgtgccacctctaatctgatgttaagagcatttagtgaattgttcaatatcaatattctagttttcagtcatagaattatttttgttcacattttttgctgctgatatttccatctgctctctcattgttaccaaattttcctttaagccattaagtgagtattatataattgacttaaaattcttgcctgctgattccaaaatctgtaaatctgcatcacctaaggacattccctggactttgtgttacatttttctattcagtgtatgtattgtaacttttttactatataatgga

SEQ ID NO: 130260 - DNA, 601 bp, Human
agctgggtatgtatggacttcatattggtgaacactaatatattaaggaacagtggaaggaaatagacataaaggatcatgtcagttcaacttagtagaataatgatcttttggatgcctaccatgttctagtcactgtattatgtgctatggataaaatataaataaaacatggctattattctcaaagagtttgtggtcaagtcaaggaaactaaagagatgtctcacatctcagtgtttccttggggcagatggatggagaaatgagctaagagcttgaagggaaaagctggatttcwttgcattttttgagctaaagaaagggatactttctaggatgtcaattagaagcctgaaagaaccatgccttaggaataggagcaagccaaaggtagaccaaattttactaaaattgcagtggggctccaacaaaggtcaataacctgatagaattgtgtaatcagccccttagcctaacaaaggaaagggggagccatagctgatagaaaataacattctgtagggtctctacagttcttttgttcatagggtcagcaaaatttaaaaggacaagatattcaaagagtcaagaaaataca

SEQ ID NO: 130261 - DNA, 601 bp, Human
gctatatacgcagtaatgggattgctgggtcaaatggtatttccggttctatatccttcaggaatcaccacactgccttccacaatggttgaactaatttacactcccaccaacagtgtaaaagcgttcctatttttccacattctctcaaaacaggaagagagtttttcgaaaggaaactttcgtgactcagaaagtgttttcggaagaatggaaacttaccagtttcccccactccctcctcaaaataatcattatcttctgaataataaaaaccaactatgagatgttaacattcaaytatcattttatattttaatgcaaaaactttaagtgcaaagaagctttattttttgaattggtgtttgggttcagtaagaacagattctaataccttagatttgttttaaataaatgattatgaaaataattttaaaatatgaaaattttaggccaggtataggcaatggctcacgcctgtaatcccagcactttgggaggctgaggcgggtggatcactggagactagaagctccagaccagcctggccaatgtggtgaaaccctgcgtctctactaaaaatacaaaaattagccagtcc

SEQ ID NO: 130262 - DNA, 601 bp, Human
gtactcacgttaaatgtgtgctttgtgagttctaaccgactctaaacaagcactgatgtgcttcctgtccgtatagatagactggggggtcgtttttaagtatagaaagactttaaaaaatccgtttagtacaattttgttgtgagaatgtgctccttatttagattgctggatatccaatctttcactatacctgttttttctgagagtggtgctagaaagcagatagcaaaacgagacttcttgaccagcaaggcatgagaacagaacttttttctgtattacaaactgatctactggkgggaactgagcccatcagcacattagcttcagttgtaaccaagaagcatatttaaaagtaacatctgatgacattttaatgtaattacattgtatcttttctatttcatagtatagggccttcagggcatttctggggagtcctccaaagatatgaacattttcacatgttctgttttgtgaccaagaccatacatctccaagacacgggctacaaaccacacagcattggaacataatatagtcaattacactcaaacgtatactcatggacatgtcacttttgtactctaaccgcatg

SEQ ID NO: 130263 - DNA, 601 bp, Human
tgtaagacctgacctgttccctaacgggtcactgcaatctaaactatgtaggaccactgtgacattactaactggatcatctgtagcctgagagcccacaccactccaagcactttcttctaaagcaaaacattaattattgtaaggtcttgactttttccttaacatttaaaaaatcaactttattcaggtataatgtacatacaataaaatgtactcacgttaaatgtgtgctttgtgagttctaaccgactctaaacaagcactgatgtgcttcctgtccgtatagatagactggggrgtcgtttttaagtatagaaagactttaaaaaatccgtttagtacaattttgttgtgagaatgtgctccttatttagattgctggatatccaatctttcactatacctgttttttctgagagtggtgctagaaagcagatagcaaaacgagacttcttgaccagcaaggcatgagaacagaacttttttctgtattacaaactgatctactggtgggaactgagcccatcagcacattagcttcagttgtaaccaagaagcatatttaaaagtaacatctgatgacattttaatgtaatta

SEQ ID NO: 130264 - DNA, 601 bp, Human
tgctgggattacaggcatgagccaccaaaccaggtcagtaatatacattttgaagattaggaaatggaatatggccaggagtggtggctcacacctgtgatcccagcactttgggaggccaaggcaggcagatcacttgaggtcaggagttcgagaccagtctgaccaacacggtgaaatgccctgtctctactaaaaatacaaaaattagctgggcatggtggcatgtgcctgtgattccagctacttgggaggctgagttgagaggatggcttgaacccaggaggcagaggttacagtragccgagactgtgccacagccctctagcccgggtggcagggtgagactgtctcaaaaaaataaataaacaaataaacaatcaaataaaattatttactgtttttcagacaagttcttgagagggaaattaggtcctagaaaagaacaaataacctaaaaagatgttaaaaagggagatatattgaattgaatattgaatataaaatttaaaattttaaatagacaagcaagcagtaagatgagtcagtaaacttatttcattgcaaaaaaatggccacctaccaaccaaaaacagttctg

SEQ ID NO: 130265 - DNA, 601 bp, Human
ggtatttaatatttatgaaatgataaaagaatgattatacagaccactaaactaggaattagaaaatccaagtccaagtcctacactaaaaggcaaagtaagttttaagctcagttttttcagtgtaaaataagtaattttcaattcaattaaacattcgttgccatgactaaagcttcctaatcattactttaacagatgggaatattctgagagttccttagaggggtcacaaaaaaatccaaattttgttattacctcctccatcatgacgtcctgtgtggccgagatttctcctttsgttgctccactgtgtaccaggttccgcagtcgtatacagaattctctcatctatgacagaaacttattcagcactccaacagttacccgaattcaattgtaaatgactctcatagaccaacgcaagttctattttgaggtataactcaggccagacccatgacagagttcataaaggcaaatgtgtttttcttcaacttgtccacttaaacacatagctaaaaatgctttccataaggagaaaaggcataagttactcctccaaaatactagacggaactgctccttctctgcaaacatc

SEQ ID NO: 130266 - DNA, 601 bp, Human
cagaatttaaacccatgtatgtctgactccaaagcctattttttcctactatactaagatgcctctcttctgtaagaatttaagagataaaaatgagattatttaaatgcatttggtaaatgaaatttctgcattcgtccactcaacaaatacttaagaaacagctattgtgccaagcactaggctagacatgttaaatatgaactgagcctttagagcttaaggaacttgtcccaggatataaagtaatgagaagactagagctcagatagcctgacttcagagattacacactccactrctccactatgctgcatctctaagatttaaaggaaaacacaagtgaagcattagtgttttccatcgcagtgaaaaaaagtaggccattttaactccatacagtcttgaaaggaagcctaataaagggcctactggctgacaaacggaaacatttattctttcctcaaaccaattgcagttttatgcatattcattctggacatggatagtattaataataaagtttcttaactgtcttgatcataaataatattaccacctcatattttagtgctttttacattttctaaaatgtttttac

SEQ ID NO: 130267 - DNA, 601 bp, Human
tgcaaaaccctacaatcatttaccccaacttctttttatttttttaagagacagggtgtccctctgtcacccaggctggagtgcaggggtgtaatcacagctcactgcagccttgaactcctgggctcaagtgatcttcttgcctcagcctaccatgtagctagaattacaggcacgcatcaccatatccagctaattttttcattttcttgtagagatggggtctctctgtgttggccaggctggtctcaagttcctgtgctcaagtgatcctcctgccttggcctcccaaggcactggrattatagacattagccaccatgcacagcctaccccaactttttttagttttactgatggagaaagtagtctcaaaggtaaaacgacctattgatcaaagaatagaatggtcataagaacactaaagcagtcacagaaaacagctcaactttgaaaaaagttcagtgctgtgggtaaatgagctagttataggagagaaggagtaaggaacctaccttagtgactgtttattcactgtttattcacagaggaagaagagaagggaagacagctgtctactactttctggtagggaatgaaa

SEQ ID NO: 130268 - DNA, 601 bp, Human
ggagagaaaggtaaaagaatgagatatgaaataaggggaaagaatgtgtagatcccaatttaaagacaaatgatatgggccttagttaattcccacgcccatgacagacatcaagtgagaggaagaaggaaagatgcagcagttgagagtcagttataaatcttagaagcgtgagaaccttcaacagtttttaaggcagctacaggcagacacagaatgaaggagaggttagaacagtaaggtagttcgaagataacaaccaaactgcttgaaagagagcaaaacttcatataattcttcygcttaaaaatcttcctgacttctcattgcctattgaattggggcaaactctcatgctagtattctaagttcttattatctgtgtctaattttacctttccactgttaaggctagaagatttcagtgcttgaaaccactgcagaagagacagaatcttagtcttcatttgtatttgcaatactgggtttttgagaaagtagtacagtaaagtctaaagcactgtaaaaatattagttacttctactgtataaaaatgcaaaaccctacaatcatttaccccaacttctttttattttttta

SEQ ID NO: 130269 - DNA, 601 bp, Human
gagtataaagggcagcctgcccaaaattgagctaaattttttgattgatggagaccctttgcttgtcccctgggggcagttgtatgtcaagggaagctacactgagtgcatctgtacttgcctcttggggccatttgtcttctgattaagattttatatctttagctaattaaatagagaatttaaactaacctaaaacaatgtggattatatatagtccctttctagcaacctataactagaaaaactgcagctggtgccagaaaggtccaagccctatttccagtttaaatatatttcmtaagaaggtgaattataaagaagggtcctacctctcaagtctcattttataaaggagctccattgtaactgatctctaaaaatattttcaggccagatgcagtggctcatgcctgtaatcccagcatgttgggaggctgaggtgggaggataacttgagcctgggaggttgaggctgcagtgagctgtgatcgtaacactgcactccagcctgggcaacaaagcaagatactatctcaaaaaaataaaaaaacaaatctccctagtggagagatctgtttattttaaatgacttgctgaa

SEQ ID NO: 130270 - DNA, 601 bp, Human
tcagaatataattacacattaaattaatattaaaaccaacaattagcccatttagggaaatgtatttgtgactttaattgaaattgctcacttcccatcccagtacttcacatcttttttcctttacttttctccattgcacttatcttctggcatattatacttcttatacactttgtctttccctactagaacatcaactacacaaagataggtattcttttctgtgttgttcactgtttaatctccaatgcctagaatagtgtcagatacatatgttaagaaatatttaacgaacacrtgactttttttgtgggggggagcgggggacagagcctcactctgtcacccaggctggaatgcggtggcacgatctcggctcgctgcaacctctgcctcccaggttcaagcatttctcatgcctcagcctcccaagtagcagtgattacaggcatgcaccaccatgcctggctaattttttgtattttcggtagagacagggttttgccatgttggccaggctggtcttgaactccgggcctcaagtgatctgcctgcctcccagagtgctgggattataggcgtaagccgccacacccag

SEQ ID NO: 130271 - DNA, 601 bp, Human
gtctggcttcctttggctgacataatgtctgtgagattcacacacattgctgtgtatatgagcaatttgttcactgctgtgattctatcttaacagaagcaagttaacttagagaagaagttatgcttgcctgtcattttgttttgttctgttttccaagagagaaccttcctttattaagatttactgtgtgtgttacgagcctgaacatctagtcattaaaccatctctcttttaacgttatatccttcccaagttggtttctaccacagaaaggaggcagagtatcacataagcaacygtaattgagttactctagccaaggattaatgagctctgtttgggattcacattcattttgtatttactcagtgccaaggctacaaatgacaactttaggcatctgtcattatgaagaagacattgccactggtaactatggtcaagtcaatgacaatgaaggtgtacagtcagaacatacttagattagaaaggttttaaagacctaaatgatgtgtattttcaactagtaactactgttacatgtgtatctacatgtagtagtggaaccatttcaatcaattctcagttatccaacggt

SEQ ID NO: 130272 - DNA, 601 bp, Human
cttagggctgactttaatatgttgtttccaaaactccatctatttaccatttactgtaactttctagatttcatataacttgtctcccataaaagattatacacttcttaaagataagaaccagatcatggatattttgtgtcctttatagcatctagcagtgctggcgacatgacacagatacaccagttgatctgaacattgttccattctccatatcaccacaggagaatttgaaaagcactacttttctcaactcacgtccctgttgaagatccaatgtttccctattacctcccayaacaaatccaaactccgtgacctaattcctttttcttactttttaacttaggcaaaacatatgtttagtgtgtaaaacacactaacaattcgttttttaaaaacatacatatatacccatgtaaccatcattcatatcaatatacataacatttccaggctctggaggttctctggctcctttgctgttaagtaacccacaacttccaccagataaccactgtttttactttataaccattgattagttttgcctgtcctttaacttcgtataaaagtattcatagaacacattatcttt

SEQ ID NO: 130273 - DNA, 601 bp, Human
cattcactaaacaaatctatcaagatcaagaacacattaattagggcacaaaaccaggaatgtcaagcaacacacagctctcctctaggttcatgtttccatcaagctcatcatctctgcctacaagctaagtactacagccacattgttaagtaacaaagaaacacaaggtggcaaaatacatgtgagagaggtccttgcttattctaattcgcgtaagagacacaattaggaggtgcatctacctgtttttcctactagcaagaactgctccaaaagcaatttttttttttttttttttgagacagaatctcactctgtcgcccaggctggagtgcaatggcgccatctcggctcactgcaacctccgcctcccaggttcaagtgattctcctgcttcagcctcccaagtagctgggattacagatgtgcgccaccatgcctggctaatttttgtatttttagtagagacggagtttcaccatgttggccaggctggtctcgaactcccgaactcaggtgatccactcaccacagcctcccagtgtgctgggattacaggcatgagccaccgcacccggccctcaaaactcattctgaa

SEQ ID NO: 130274 - DNA, 601 bp, Human
aatgatagtacaaaataaagggagtacgatcatggggaaaactggcttttggttgtaaaaggaattcagaagaaactgaaggggctcaacagctccaaataaataaggctctagctgtagctcttcagaaagaatatggaacatgcagaacttagtctctcagtgggagtccattctctatgtgtcacaagagtatgcaggaaaaaaaggagatgattaaacataaattctccacatcagaagctgacaagtttacattgtcatttaggcaagaaaactttaaaaaataatgaaaaaagcktttgaagtaacttcttagaaaactgatctcttttgagctggtggaaccaaccagtttctgaattcatttaaatcactgctgattaaaatttaaataaataatgtccaaaatattggggaatatttttgcataagcactacactcacattgttaaatacaaagaaacaaaaggcaaaatacatgtgagagaggtccttgcatgttctagttagtgtgagagacacacttgggagttgcatgtacctgttttcaaaaattttttaaacctcattaattcttttttttagcagatttctctat

SEQ ID NO: 130275 - DNA, 541 bp, Human
acagagatagaaatgataaaaagctgaatttttcttggaaattacaagtttttgtttgtttgtttttttaaaaacaaacaaacaaacaaaacaaattctcggctgggcacagtggctcatgcctgtaatcccagcactttgggaggccgaagcaggtggattgcttgaggtcaggagttcaagaccagcctggccaacatggcgaaaccctatctctactaaaaatacaaaaaaaaaaaaaaaaaaattagccaggccgatggtgcacgcctgcactcaggaggctgaggcaggagaatakcttgaacccaggaggtggaggttgcagtgagctgagattgtgccactgcactccagcctgggcgacagagcaagactcagtctcaaaaaaaacaaaaaaacaacaacaaaaaaacacaaaacagaactctatatagtttaaaaatttatttaaagaactttagtttagttataaagcacccttatttgaaaaaccttttcatgtattttatttatttatttattgttttttttttttttt

SEQ ID NO: 130276 - DNA, 601 bp, Human
agaatggaagttcccaagaaaatgacagtggtattcattatttttattcctgaaaaataggagtattctataacagagatagaaatgataaaaagctgaatttttcttggaaattacaagtttttgtttgtttgtttttttaaaaacaaacaaacaaacaaaacaaattctcggctgggcacagtggctcatgcctgtaatcccagcactttgggaggccgaagcaggtggattgcttgaggtcaggagttcaagaccagcctggccaacatggcgaaaccctatctctactaaaaatacmaaaaaaaaaaaaaaaaaattagccaggccgatggtgcacgcctgcactcaggaggctgaggcaggagaatagcttgaacccaggaggtggaggttgcagtgagctgagattgtgccactgcactccagcctgggcgacagagcaagactcagtctcaaaaaaaacaaaaaaacaacaacaaaaaaacacaaaacagaactctatatagtttaaaaatttatttaaagaactttagtttagttataaagcacccttatttgaaaaaccttttcatgtattttatttatttatttattgttt

SEQ ID NO: 130277 - DNA, 601 bp, Human
taaagggatactccagtagaaatggaatttgaatctcttggggtaaaaacataataaactaacaaagcaataaatactatttcatcctttctattctattgtatacataaaataggcatgtaaaaatgctacttgactaagaaaaactatattaacctactaaaagcagtaaacatttgaagctggggattcttgcttttaatcaatcaatattgattaaagcaaatgcatcctactttattttaggaataattctaaaacctggtcagagtcttttttaaacaaaacaaaacaaactcatcatactgcctgattttctacttggggaaaccaaataatgatactctcccaaatgcattcttttactgatccagttacacaaatattgaatttcaaagaagagactgaatggcaaagcaaaagtaaaaagaccattttcataaacaaaagccaggcacttctactgttctccttcttccatcttcattattaaaataagctcaattttggtcttcttaaagggacagtgatactcatcacaacaaccttcatttacagcctttactatagtgacacagagagggacaagaggaaggctcca

SEQ ID NO: 130278 - DNA, 601 bp, Human
ttataggaaccaaattagaccagaaatgaaacagaagctgcagggggttcattggaagcaacaggaaaactttaactcagtatcttatgtttgctagaaataatcaaatctttcaaattttaagacaagtatccatctcttaactatcaccaacttacagatataactaaactgtgagttatttttactctgctaactttgctgaggtttaaacccttctctacttgaccctaatgtgtatttgtcttaaaataaaattcaccttacaagaaaccaccaattttaaaaagtattctaattygtagtagttaacttaataggcacccctaaaatcacagaacaattatagaaatcacagaaggtagacatgtaactatctgatgatgaagagaaatgcagtaacagcacttgtatttgtttacatataaacactgggctgctgagtatcacagcatattccagggacagtcagccaaaatccaccagtgattattctcatagagagatgaaaagccctcgaatgacaaataaatggtcttcagattttggctatcacatacaagcctgtgctgcccaatcagcatactaaaatgctgtcaag

SEQ ID NO: 130279 - DNA, 601 bp, Human
aataatgaaatgagtaagttagcaaaagcaaaacttttattgagtaaaagtaaagaggtaaagctaaatggaaaaattatatacagtaaagtgacctaaaattatctttaagtatttaggttcaaaataataaagacattaactcacactacataaaacacattttcctgattttacaagtgtttatcctctcttaaccagataacactactatcttcaaactcactgactattacagatggaaaaatatcgcagcaagctgacggatccaggctcatctaaacaaatataactttagttmttttcctaggtgctaacctatatgataacaaatccaattataggaaccaaattagaccagaaatgaaacagaagctgcagggggttcattggaagcaacaggaaaactttaactcagtatcttatgtttgctagaaataatcaaatctttcaaattttaagacaagtatccatctcttaactatcaccaacttacagatataactaaactgtgagttatttttactctgctaactttgctgaggtttaaacccttctctacttgaccctaatgtgtatttgtcttaaaataaaattcacc

SEQ ID NO: 130280 - DNA, 601 bp, Human
ttacagttctctaagcataataatgaaatgagtaagttagcaaaagcaaaacttttattgagtaaaagtaaagaggtaaagctaaatggaaaaattatatacagtaaagtgacctaaaattatctttaagtatttaggttcaaaataataaagacattaactcacactacataaaacacattttcctgattttacaagtgtttatcctctcttaaccagataacactactatcttcaaactcactgactattacagatggaaaaatatcgcagcaagctgacggatccaggctcatctaawcaaatataactttagttcttttcctaggtgctaacctatatgataacaaatccaattataggaaccaaattagaccagaaatgaaacagaagctgcagggggttcattggaagcaacaggaaaactttaactcagtatcttatgtttgctagaaataatcaaatctttcaaattttaagacaagtatccatctcttaactatcaccaacttacagatataactaaactgtgagttatttttactctgctaactttgctgaggtttaaacccttctctacttgaccctaatgtgtatttgt

SEQ ID NO: 130281 - DNA, 601 bp, Human
actaaataaccttggccgggcacggtggctcacgcctgtaacccagcactttgggaggccgaggtgggaggatcacaaggtcaggagatcgagaccatcctggctaacacagtgaaactctgtctctactaaaaaatacaaaaaattagccaggcgtggtggggagcacctgtagtcccagctacttgggaggctgaggcaggagaatggcgtgaacctgggaggcgaagcttgcagtgagctgagatcgcgccaccgcactccagcctgggcaacagagcaagactccgtctcaaaaaarcaaaaacaaaacaaaacaaaaaaacaactaaataaccttattataaagcagcatggacaaaattcagggaaattttgggtggctgcatagtttctgacttgcctaagtcacaatgtgctaacatgtgacaaaccctcacagaatgccccaatctccactctttactcagattcccagccacaaatgatgctctaggggccttttctcccaatgtcagacatttacataacatctccaggtccttcatacagttttatatcccttcatccactctttctggtcaccaatgaccatgaactg

SEQ ID NO: 130282 - DNA, 601 bp, Human
taaaagttgttacttatcatattgagaaactggaccaaataagcattaagaactatattatgataattccacatttagagttctgctgtgtcaggctctagaaatggaatacaatctcataactaagtgaaccaatcacaaagaagtaaagtttcatagtaagactggttcattagaaagaccatctaggaatttaatttattgactatcaaatacactattatttgcatgacagaatattgataactactgaaggtgggtgacaggcatatgcagggttctttaatacaatcctgtttamtttatatatgtttaaaattgtccaagataaaaagttaagaactaaataaccttggccgggcacggtggctcacgcctgtaacccagcactttgggaggccgaggtgggaggatcacaaggtcaggagatcgagaccatcctggctaacacagtgaaactctgtctctactaaaaaatacaaaaaattagccaggcgtggtggggagcacctgtagtcccagctacttgggaggctgaggcaggagaatggcgtgaacctgggaggcgaagcttgcagtgagctgagatcgcgccaccgca

SEQ ID NO: 130283 - DNA, 601 bp, Human
tggcccaacattgcctagtttccattattgtactagagatccagaactgaacctcaaacagacctgcaaataactgattgtcttttgtaagtaatacatagggaattttagggaagctgtctgtgtcaaattaagagatttgaattccaattctatctctgattctgtgcaacccaaacaagacacaactgtcagtaagttttagtttcttcacataaaacctgggtataatcacccatgttcacatcctgagttactctactctgatgtcatgaggagaaataaatacaaatacattagygaactttgaattctcacgaagcaagatgccctgtagctttatgtcctgagtacctccaacagaaatatgggctgttcataactccttagatttatataacaatatacagtttgaaaaatgcctgcatacattatttcatttgatggctacatacaaactgtaggagctcataaagaaacaaattgtccatgttattgacatagaaatgtgacactacaatgagttaaattactgcccagcatctaaaatcaagaattaattattagtaactgtctctccacaactcacctggttctacaa

SEQ ID NO: 130284 - DNA, 601 bp, Human
tcggtctatttatcctatatcttacagtctgaggagcacaccatgaatgccacttctgtcacatcacagccctcttcaaatccccttcctgtgtcacaggtgaataagtataaattcctctgagggtcagagacattcattccaccatggcctatgcacggttccttgcatcccatcaataaataaatgtgagttgatgctactgctaatggttttttctcagcactaagtttattcacctccactgctttctctcacgacactaagcccacactatgggtcatctgcccactacactggkgatgtagcataatgatcacattagggcactgaatttttagagatctgaaactggaaccatggggcaagttagatgccctcctctagaagggaaaggttagggagcttcatgttcttgttctcttgccgtcagtctatagataacattaacaacagtagcaatgggagctaatatttctaagcacttcttatgcgcctcacatggttctcacaacaaccctacgagataggtccaattattatccctattttacagatgagaaagctgaggctcagacaggttaaatgccaatgaccactg

SEQ ID NO: 130285 - DNA, 601 bp, Human
accaaaaccaccccttataattatgactgccatttgaaacagtgatctgagaagaggcttctttttcctccagagaaaacatagaagtctggctatgtggtgaggacacatttacattaataaaccatttgctgataaaagaagagatactcttatagccggatattacttgcggcctctttcagaaacaaaggttagaaggtaccgtttccctagtaaatatactaggaaaaatgcagggtggaaaatgtggtagagaaaaggggttgttttggcttgtggtttgtattttttaaaccaytaaaccaccacaaagttcagtcagcagaagtgtccacagcctgagaagtgcccctctactaaggagcccagaagaagcctgttcacctcccggctgacttctttctctagaccaatgagcatgagctaggcagccctgagggcacacacagctctccaggatctctgagggtgaacccggagaggaaagcacaaatttagatgccatccaagggtcttgttttcccactgaaactcaatgacttttctctcaccccaaactatcgctactcctatttgtttcagacaaagtctgcttgtc

SEQ ID NO: 130286 - DNA, 601 bp, Human
cttaccctcttcattaagcagtgtcatttctgggacttcatcctatagatacacagtacttacatgcatacaatatgaatttatgtgcaacaaagctaatatttattcggcacttaccgtgtgccaggcactattctaagcactgtacatatatatagtaacccactgcaatactgtttgtaatagcaaagactgaaacaacccaagtcccattagtaaaggaaatggttaaataaactgtggtagatccagacaatggaagataatgaagctgtactgatgtactgataaggaaatgtcyccaagatacgctgtaagtgaagtgaggacaagatgcagagcagacgacctagtgtgctaccactagtataagaaaagaagacaataatatatatgtgtatgtttgtactaaaaaaaataaggaaaggcataccagaaatagaaataataacctaagagagaggcaggggaatgaagagtgacagagatggaaacaaaattctttttcatatacctttttatattttgattttggaacaatgtaatttcattatctattaaaagaattacactttagaaaacaaaacaaaaaaatacacac

SEQ ID NO: 130287 - DNA, 601 bp, Human
tttattgctgtttggaggcagagtcttgctctgtagctcaggctggagtgcagtggcgtgatctcagttcactgcaacctctgcctcccgggttcaggtgattctcttgcctcagcttcctgagtagctgggaatacaggtgcccaccaccatgcccagctaatttttcgtatttttagtggagacggggtttcgccactttggccaggctggtctcgaactcctgacctcaggtgatctacccacctcggcctcccaaagtgctgggattacaggcgtaagccatcgtgcccggcccatkttttgtttttattaagtcaaatttatcaatctttttcttttggtttttaactggtgttatgcttataaacatttttctgctattataatgaaaaaaaaaaacaaaaaaaaaagaaggataagtgagaagaaaacatcagaaacaagactctcaatgaaaaactccattactcactaaggccttggcatagtccccaactatgaaacagataatttcaacagataattgagtagtgacaatttgtcaaccgcttctgttaggtatccactgggtgaagcatgacctaatacctccttgaat

SEQ ID NO: 130288 - DNA, 601 bp, Human
atctctttccttactgataatgaaatacatctatctacatcataatttttaagtaccgaatctacatgattaaatcaaaacacgtttaatcagtcccctattgttggaatccggattttttcatgcttagaaacaatactgttataaacatttctgtaagtaaatcttcgtgcacagccttaatcatctgcattaatgcactgtgtaatgacattctggtcaacaatgaaccacatatatgatagtggttctgtaaggttataatgtatttttgctgtaccttttctatgtttagatacacaaataacactgtgtaacaactgcctagagtattcagtacagtaacatgctgtacaggtttgtagcttaggggcgatgggctataccatcaaggtttgtgtaagtacactccatgatgtccacacaatcacaaaatcacctaatgacgcatttcagaaaagatccctgtcttaagcaatgcttattaattttattaataaataaatgtattaaatttccttatatcctaatcaatatctggtatacataattactaactttcttcttggatccaatttgagccttttctccttttatgtgt

SEQ ID NO: 130289 - DNA, 601 bp, Human
acactgagtgaaacacagacaaatagataaagtcagctttaggaactaaggtgaaattaaattttgtttaaactttaatgtcttgtttacatgcgatgagaaagaaagaaaagtgaacagtcctcaaaacaaaacacctcaaaccaaccaaccaaccaaaaaacactggcaacgtttctgtattttgtaacagaaagggtagggtcagtctgtaaagggaaaaacagtgtctgtgaatatagctgtagacaggttaggtgaaattcattcagaaacagaagagtttcaaatgggctagttkaagggaaaaaagacgctttacctaagaaaacttttttttctgaaatcccaccagaaatgtaagatttaagcctttcagactaaagaatacaaagaatataaaatatattttaacatattagaaacattttatattctttgttgtctttgttctatgaggaatttcacctcactaacaaactgtatgtggctattattttttgccatttttaaaaaagttatgacaaaatgaaggtatctgttctgctctgacggtctgtctggcagcatggaactaagaagctggactaccaaggcctca

SEQ ID NO: 130290 - DNA, 601 bp, Human
tacattttaatgtctagatttgcagaagacagctgaattcctgtatctgcatctgtgtttaatctgttgcagtatgttgttctgcttgaagcagatgaaggaaatccagcctcacacagatatgttgctcaagggcagaccctgcacactccctgaaagggccctagggaaccaaagatcacactttgagaactgctgctcttgaggcaagactggattaaatttaaaggcaacaatactggtaagtctaattttgtatgctaaaaggtgtgacaaagggcattatttaacctgaaaacayaattgatttggtgaagtcatctatgcccaatcctgtttttcacccgacagaagtcaaagacagatcatcctgacgtggcatagcatacgtttaccctcaaaaacactgtggaggccaggtgcagtggctcacacctataatttcagcactttaggaggccgaggcaggtggattgcttgagcccagttgttcaagaccagcctgggcaacatggcgaaaccccatcctcacaaaaaaaaaaaaaaaaaaaaaaaaaattagctggtgtggtggcctgagcctgtggtttcagtgagccaa

SEQ ID NO: 130291 - DNA, 601 bp, Human; identical to SEQ ID NO: 21560

SEQ ID NO: 130292 - DNA, 601 bp, Human; identical to SEQ ID NO: 21561

SEQ ID NO: 130293 - DNA, 601 bp, Human; identical to SEQ ID NO: 21562

SEQ ID NO: 130294 - DNA, 601 bp, Human
atgtggaaggtatgcaaagcattgagtttgctacattttcccccttgttcgttgaattttgttatgtgtattctgagcaaaaaagaagaaactctgtagaaatctaactttaaaagatatttatttttattttgaaaatttcaaatctacagcaaaattgaaggactacatgaagacctatctgtccttcatttaaattcaccactgttatcttatcccagatggcttgcctctccctctctctttttcactctctacatgcacgtgtatgtgcatgcacacacacacacacacacacaccaatcacacaatttttttgccaaaccatccaaaagtaggttgcagatttcacaacactttacctataagttcctcagcatgtatttcccaagtacagggacattttcctgtttaactatatactattaccataactgagaaatcaatgataatttaatattatcataccacatgccatccgtaactcagatttcccccattatgtccaaagtagccttggtagcccctttttatccagatctagtatccaatcaaagttcaagcattgcagttggctcttgtaaagagaccgtgctaatag

SEQ ID NO: 130295 - DNA, 601 bp, Human
ttatttttattgtggtaaaacatacatatatatatacataacatgaaatttgacagtttaactgtttaaacatttttaagtgtagagctcagtggtactaattttcacaatgttgtgcaaccatcaccactatttctaaaacttgttcatcatcccaaacagaaactcggtaggcattaaataataattcccacttccatctctatcccttacccccagccattggtaacctctaatctactttctatctctgtgaatttgcccattttagatattttatataactggagttatacaataktcttccttttgcatcaggcttatttttcttaacataatattcttaagggtgatccattttgttgcaggtatcagaactttattcatttttatagctgaataatattccttgaatgtatatgttagtaatacattttgtttatccatctattgatgagcactgggttgtttccaccttggctactaggaataatgcgtaatgaacgttggcgttcaggtatctgtatgagtccttattttcaattcgtctggatatatacccaggagtagaattgctgggtcaaatggtaattctatgttt

SEQ ID NO: 130296 - DNA, 601 bp, Human
gtttaaacatttttaagtgtagagctcagtggtactaattttcacaatgttgtgcaaccatcaccactatttctaaaacttgttcatcatcccaaacagaaactcggtaggcattaaataataattcccacttccatctctatcccttacccccagccattggtaacctctaatctactttctatctctgtgaatttgcccattttagatattttatataactggagttatacaatattcttccttttgcatcaggcttatttttcttaacataatattcttaagggtgatccattttgtwgcaggtatcagaactttattcatttttatagctgaataatattccttgaatgtatatgttagtaatacattttgtttatccatctattgatgagcactgggttgtttccaccttggctactaggaataatgcgtaatgaacgttggcgttcaggtatctgtatgagtccttattttcaattcgtctggatatatacccaggagtagaattgctgggtcaaatggtaattctatgtttagctttgacagactattttccacagtagatataccatttacattcccaccagcaatatataag

SEQ ID NO: 130297 - DNA, 601 bp, Human
atataagaattccaatttcttatgaaatgttattttttaaagaattgtttgttgttgttgttgttgttttcagatggaatttcactcttgttgcccaggctggagtatagtggcatgatcttggctcactgtaacctccgcctcctggcttcaagtgattctccagcctcagcctcccaagtagctgggattacaggtgcctgccaccaggcccagctaattttttgtatttttagtagagatagggttccatcatgttggccaggctggtctcgaactcctgacctcgagtgatctaccygtctcagcctcccaaagtgctggaattatgtatgagccaccgtgcctggcaagaattgttaatacaagcttgaactgtttaccttttctctttaaatgctatgaaaacagctattactctttttaaactttaggtatgctttgaataataacgtttttgtttttatgcacagatgtagatgtagagggaacttagaaggaataagtcaaccaatggaaatgtcatcagtgtaaattttttcttttctaggagtctgcccatgatgaaatgccttaggtcttccttacctttttattggca

SEQ ID NO: 130298 - DNA, 601 bp, Human
ctctttttaaactttaggtatgctttgaataataacgtttttgtttttatgcacagatgtagatgtagagggaacttagaaggaataagtcaaccaatggaaatgtcatcagtgtaaattttttcttttctaggagtctgcccatgatgaaatgccttaggtcttccttacctttttattggcagtcacattataaagtgtcttatgacatgtctcttaatgtatatttaaacctttgaattactcttttactttttatatcaagccatatgtacccaaaatgggtcataagtttgagaayttaatactttcgttactggatctttggggtattgcttttctggttggaaacctctgtgcctggtggtgcctttgcccaagttcttgtcctgcatccaggaagaatgaggtatgcagacaagtggagggtgagcaagacaaagaggagctttattgagctcagaggagaccggcagtgggcatctcctctctgtaggcaggtcacccagtcaagtgttcagccctcagcacaaaggaaccctggagtgggtggcccctctctacaggcaggtcatcctgatgagtgttcagcttcagcttt

SEQ ID NO: 130299 - DNA, 601 bp, Human
gaaaccttctccccataacaattagaggtgatttgaaaatcattaaaaatttttttgtagataatggacttactttaatgtgtaatttttacatttcagtccttgggaaatatatttaataaaacctaactttgaactggtggttttgtaatctagtcaagttgcttcattaatttgagatgatgttacttaaaataatggggtaaatacttaactttgcctttttggaaaaagttgtaaaaggttagaaagtaatttctaactgacaattaattgaggaaggtaaatgtatctcatactrcttaaaaaataaatatccggcctctacaaaacgtaggtgtactttggtattaaggccagagattatttggtgaagctagttatcatcagatttttctgattattcagacatctgaagaagctacattatgctgctgtcatttttattttcatgagcatcaacttttctcttgtttcagctgaatgtcggatatgtcctatgttatttctacaataactggcttatttctcttcgtacctcagcaaatattgagcagtttccccttgaagaggaggctgtgatggttttagtttcaacagg

SEQ ID NO: 130300 - DNA, 601 bp, Human
attgatttagtccaacccttttgttttagagaaaatcaaggcctgagagaggaactaacttgtgcaatataatgtattaatatagcaaatatttactgagttcctgccgtgccacatatactgtattaggtgatgtaccggtatacagtgagagcaaaacagaaacaactcctgctctgaggaatcagatagtatattagtagtgtggaatctggggtgatttgggccctagtgcctttgccttcattgccagggctggcccagcatatctagctgcctatgtgggtgagccttgcttcaytcaacatgtctcacaaacctcaggatccatttaggaaatggctatcctaataaggctgatgaatagccacatccccttccaaagcctcgttattgtgagacctactctggacttgttcatggagtaagatgcctttttttttttttgagatggagtttcgctcttgttgcccagggtggagtgcaatggcacaatctcagctcactgcaacctctgcctcttgggttcaagcgattctagtgcctcagtctcctgagtagctgaggttacgggcatgtaccaccatgcccggctaatttt

SEQ ID NO: 130301 - DNA, 601 bp, Human
taaataatagtctttttggaataaatgaatttttgccatccgaaacataaatacatagttatttgatctttggataatcttttttttttttttttttggagacaaagtctcactctgtcacccaggccggagtgaagtggcgcaatctcggctcactgcagcctctgcctcccaggttccagcgattctcctgcctcagcctcccagttagctggtgttacaagcatgcaccactacgcctggctaatttttgtatttttagtagagacggggtttcaccatgttgaccaggctggtctckaactcctgacctcaggtgatctgctcgcctcggcctcccaaagtgctaggattacaggcatgagccactgcgcccggcctaaaatcttagatctttagttaatcttataacaatttataaaaatattcttcctagttttgctcctactctgagtaaataagcttgccttactggtagatcctagatcagtattatttgaacttttttttcttacttttaacctataatatgaaataccttttagttgtgtatgtacatttcatatatatgtgtgtacattaaaaaatttcatggaacaat

SEQ ID NO: 130302 - DNA, 601 bp, Human
tgaattaacccagtaacaccagaaaattgtaatctaaaacaaaaaggaataagatgaacagtatgtaactataaaaatacaatatctgatattaagaaacagacaaatccataaatatagtaggaagtttaaaataggcctctttcagaactagtaggtcatagagatcataactgttagatcacaaaaatgtgagtaaggatacagtggatttgaataacataaataaaccaatctgacctaatgaacgcgtacagaatactgtccttatatctaattttcctgcagagtctgtttactmatttgaggtgtggatgactaagaaaccagctgtcacgcttagggaagatgcatctggttctgttagcgcttgtgttactttgtttttaagattatatattaaaaactaaacaacaaagatacacaggtaaaataggcccaggagcagtggagcacacttgtaatcccagcactttgggaggctgaagtaggaggattgcttgaggccaggagtttaagacctgggcaactggtgagacctcatctcttaaaaaatacaaaaattagtggggcatggtgatgcacccctgtagtcccagct

SEQ ID NO: 130303 - DNA, 601 bp, Human
atctgagtgctgcctaatttaaaaggaaagcaaaaaggtaaaacaatactccaaaacagaatatttgcttggagtcacgagttggctttagtaaattgaagcataacctagtataaagactgacctttaggagcagtgcagttgtgtactttgtaacgtgataataggcctaaatgaagagaacctaacactcctttaggatttggcccccagtctttagatctaatgtgtataaattggatgtacttttttcttttccttttttcctgtttaactcaggtggtagagaatgggagagtayatttaaaaaaaaaaaaaaggaaaatacagttcaaagagctatgtgggagacagtgttaaccaagttagacaaaaatgaaaacagatgtaggactgtgtaatttagtttaactctgtagaatcatatcattagcaaatatatattcagtgggagtggtgaaggaaatagattttcacaagataggttgctcagaatacaaagaccaggttcagttagttaagatttgatcaatgtgaacttgaatttaaaaattaggaatttggggaatttttttaagagcaacctctgatttttccattg

SEQ ID NO: 130304 - DNA, 601 bp, Human
ctataaaaaattgttcaggaaattcaaagtcgtgagagaatttctcactatccttcaaagtagttttaataaagtaatatcattaagctccaagttgaaatatagggtagaaattgtctgtctatattcctagactttaaaatgcttttcctatttaaaaaaacacattgtagtttccttgtaaaagattaatagggttcttgtgtaatgcagtttgacactttatagttggcctgcagaggcaagtaaaaaaaaaaacaaaaaaaacttgctatgtttcttaacactgaagcattggctrtattttttcttttggctttctgtttgagacagaagagtgaatctttagtatctttgaatgaaggattgaatttattaatctcccctccccttaaaagctagatctttctgtggtgaaaagagtgataagagacttgtttcctaatcaagacggattgagtatcttaaaacatatgaagattagttgtgctacaaatcgattgaaagagtttaatgggtacgagtagatcacttgatcagaagatttagctatccgtaacaattagcattggtattgatcacaatttgcagtattactaga

SEQ ID NO: 130305 - DNA, 601 bp, Human
actatgcctttttgataaattgtgtgctagtgactattgtaataattcaatttagaggacacagaattaatacttagagcattacagtcattggaaattaagaaaaatttaaatacactaacatactatagattgaaaaattatagaatgattggtgaaagactttcaagcatgcaggtatatcacattcaaatagcattctgtggaggaagtagaatggaaaaaaagttcaaagagaaaaagagaagatgtggctgggtatggtggctcaggcctatgatcctggcactttgggaggccratgcagaaggattagttgagctgaggacttcaagaccagcctgagcaacatagtgagatatgtctctacaaaaagtaaaaataaaaaaattagccaggcatggtggtgcacatctgcagtccagtctactcaggaggctaaggtgggaggatcacttgagcctggagggcaaggctgcagtgagctgtgactacgccactgcactgcagcttgggtgacagagcaagactcctgtctcaaaaaaaaaaaaaaaaaaaaaaaaagaagatataaaattccttaaagaggcatgttcaggca

SEQ ID NO: 130306 - DNA, 601 bp, Human
aataatagaaactcgcttatttatgattgttaataagtaggataaattgcagatcatttatactattaaagtgctttattgctttgaggtgtgcctgtaactgaatgttttacttccaaaattaaaattttctttggctgaataaagatattctgaaacctgacatttctcctttaatctttgttgagccaaatgacatatcaacttaaaaagataagcaaatatattaactgaatctggcagtagctgcagctgttattaatgtcaggcctatctacagatcagtggctgctccctgttwgggtgaactctagctttgggtaagtaggttttgtgttgagaaaaaaaaaattaagacaacaaacctgaaccagctacttagttaggattacttattatacagtctttgacatttggtttcagaaaaataaatgttaagtttaacatagatggcaaataatgcctatctgtgacatctcacaaaaaattcttgaattattcataacttaatgtccccatttggttccatgttttaaaataattaaaaaaataaatttaaaaataattttaaaaataaaaaaaatttttttaaataattaaa

SEQ ID NO: 130307 - DNA, 601 bp, Human
attaaacccattcagtttatttttttaatttagttactgtatttttctgaaattctgaaatttctacttttttctattttgcatgtttggtatctttcttttactttaagactgtttaatcttacttccttggaaggctgggcgtggtggttcacacctgtaatctcagcaattcgggaggccaaggtgggtggattacttgaggtccagagtttgagaccagcctggccaacatggtgaaaccctgtctctactaaaaatacaaaaattagctggacatggtggcacatgcctgtaatcycagctactcagaaggctgagggacgagaattgcttgaacctgagaggcagaggttgcagtgaactgagatcgtgccactgcactcaagcctgggtgacagagcgagactctgtctcaaaaaaaccaaaccaaaacaaaacgaaaaccttaattccttgtaacatggttataataactgctttaaggttagtctggtaattccagcatctgtgtcacattggagttggtgtctgttgactttttttctttataatatattgagcttttactggttatttgaatgtcaaataattttggatt

SEQ ID NO: 130308 - DNA, 601 bp, Human
ttggctgggtgtggtggctcacacctataatcccagcactttgagaggccgaggcgggcagatcacctgaggtcaagaattcaagaccagcctaaccaacatggagaaaccctgtctctactaaaaatacaaaattagctgggcatggtggcacatgcttgtaatcacagctactcaggaggctgaggcaggagaatcgctttaacctgggaggtggaggttgcggtgagcagagatagtgccattgcactccagactgggcaacaagaatgaaactccatctcaaaaaaataaaataaartaaaaataataatacttgtctgtttgtgccatcagggaatgacccagttaggttcagctgcaagttttgactcgccttatgtaagctgtaattccaatgtcagttcagttttcaaagcctttatagtgctattcagatctgtactgtatgtgcaccactcaggggccagtctgggtgctgggcagtaacctgttttgtagttcagttctcagtgcttttggtgtgctgtttaaggtcagacctgtacatgtgcagtttagagatgatcccaggtggtcacaggcaattttatgagatccc

SEQ ID NO: 130309 - DNA, 601 bp, Human
atatcatttgttatcagtgaaatacaaattaaaaccacaattagataccactcgtcttccactagaatgcttaaaatttaagagactttccagtggcatgagcaacttgttaggtgatgatgcagaataactaaaacatggatacattgctggtggtaatatgaatatggtacaaccactttagaaaacaatttcttacaaagttaaacttactataagatccctccatgccacctctagatatttacccaaaagataggaaaacatatgcccacattaagatctatgcacagctttaatyaccaaaaaacaagaaacaactgaaataaccatcacatgatgaacagataagcaaattgaactacttttattcaatagaatacttagtaatgtaatggaccatttatatatgaagaatatagatgagtctcaaaagcattatgctaagtgaaagaagcctaatacaaaaggctatatactatatgattttatttatatgacattctagagaaggcagaaatatagggaaagaaattagattaatggtaacccagggtctgggaaccttctgggatatagaaatgttctgtatttttattgt

SEQ ID NO: 130310 - DNA, 601 bp, Human
gtctgggaaccttctgggatatagaaatgttctgtatttttattgtggtggtagttatgtgactgtatacattgcactgtacatgtaaatgggatgaattttatagcatataagttattatacctccataaacttgacttttaaaaaagctttaaagcaccgtgttaactagattgtcaaaattcttttgaatcatttacttaatacttaagtgaaaggaaattatttaagaacctctgtatgcttcaaagaagaataaaattcaaagtatcatgcaaaaatatttgccttgtatatgccrttttataaccttttttgatgcatggtaaatatcgtgacaataaatatatgcctgcagtaatttaaatggctgcatagtagcccattttatatcataatttactaaactggtctttcatttttgaacatttagattgcttccagttttatgctctttcaatttgaatactatagccctcatccttatagctattatcttggaataaatttctagaaaaggaatttctggttgaggtcatacctattttaaagattttatattcatattactaaattttcacccagaaatgttctataatcc

SEQ ID NO: 130311 - DNA, 601 bp, Human
ctgaatttgaatattggcctgccttgctaggttggagaagttctcctggataatatcctgaagagtgttttctaacttggttccattctccccgtcactttcaggtacaccaatcaaatgtagatttggtttttttacatagtcccatatttcttggaggcttttttcgtttctttttactcttttttctctaatcttgtcttctcgttttatttcattaatttgatcttcaaccacgatagcctttcttccacttaatcgaattggctattgaagcttgtgcatgcgtcatgaagttctsgtactgtggttttcagctccatcaggtcatttaaggtcttctctacactgtttattctagttagccattcgtctaaccttttttcaaggtttttagcttccttgcgatgggttagaacatgtttctttagctcggagaagtttgttattaccaaccttcggaagcctacttctgtcagcttgtgaaagtcattctccatccagttttgttccgttgctggcaaggagctgcgatccttttcaggagaagaggcgctctggtttttggaattttcagcttttcagccctggtttctcccta

SEQ ID NO: 130312 - DNA, 601 bp, Human
ctactatgtggcaggtactgttttagtcttggaatgtccatcaatgggcataacaaagatctctgcccttgtgttgtttataatctggcagggagaaacaggcagtagatagtaaacacagtaggtgaattgttaagtgttgtagaaaaagcaacaaggtagaaaaagggtaagaggaactgggagtgctggtgggatgggcttggggatagtgatggagagatgtaagtagcaacttcaattggggaggtcaggatgacctgactccattgtcaggttgaaattggagcagagagctggrgttgagggagttagtcaagtagtaaggttatccgggggaagagcattccagcaaagggaacaagtagagcaaagtcaggaggtacttagagtatcccgtgaacagcaaggaggccatgtgtctgctgcagagccagtgatggagagagtataaaaggaggtttaggaaggaaagctgggtgatggggatcaaatcatacagggccttaggccactgaaaagactttggcttttagtctgagtgaaatacggggagtctctgaactgttttgaacagagaaataacatctgacttgcattt

SEQ ID NO: 130313 - DNA, 601 bp, Human
aacatggctgaaccttagggatattatgctaagtgaaataagccaaaaagacaaaatactgcatgatttcacttatatgaagtatctgaagtagtcaaactcttagaaacagaaagtagaaaggtggttgccaagagccggggagagtggcaaaaggggagttgtttataatggatatggagcttcattttttgcgagatgaaaatgttctagggctgggtgcggtgggtcacgcctgtaatcccagcactttgggaggccaaggcgggcggatcacctgaggtcaggagttcgagaccarcctcaacatggggaaaccctgtctctactaaaaaaaatacaaaattagccgggcgtagtgctgcatgcctgtaatctcagctactcaggaggctgaggcaggagaattgcttgaacctgggaggcggaggttgcggtgagccgagattgagccattgcactccagcctgggcaacaagagcgaaagtccgtctcaaaaaaaagaaaatgttctagagctctattgcacagcaatgtggatatagttaacactattgtactgtacatgtaaaaatggttaatatggtgaaatttgtattat

SEQ ID NO: 130314 - DNA, 601 bp, Human
tctaaatattctacaaatacctcaaattcaacatgcccctttctgctcaattactcttacagaccttattttttctgttaatggcatcatcattagcccaattgatcaggccagaggtcctctttgattcctttctttctctcaactcccactatctatcagatcctgtcagtatcttgtctcacatctttcccttctcttccacagagttgctaccacatcattttaggcctaattactttttacttgtatcattgtaagaaactgcctaaccgggctttttgcttccaatcccccacgsctttccagaccatactgtcttctattcatcatactacttttctgttcaaaactaacaaatgaaatgccatttttttttatgctttggaaagccacggaaaactttatcctcagcctcctttagaccctacttacctttccagcctcaccattcatgacatccctgcagctctgtgctgctgccctcattctgtggccttatcagcctcatagctggtggtcacatacaccagcagcctccacctttacaaagccattttccctgactgcagtgctcctgaacccccgctccttttggctg

SEQ ID NO: 130315 - DNA, 601 bp, Human; identical to SEQ ID NO: 21563

SEQ ID NO: 130316 - DNA, 601 bp, Human; identical to SEQ ID NO: 21564

SEQ ID NO: 130317 - DNA, 601 bp, Human; identical to SEQ ID NO: 21565

SEQ ID NO: 130318 - DNA, 601 bp, Human; identical to SEQ ID NO: 21566

SEQ ID NO: 130319 - DNA, 601 bp, Human; identical to SEQ ID NO: 21567

SEQ ID NO: 130320 - DNA, 601 bp, Human; identical to SEQ ID NO: 21568

SEQ ID NO: 130321 - DNA, 601 bp, Human; identical to SEQ ID NO: 21569

SEQ ID NO: 130322 - DNA, 601 bp, Human; identical to SEQ ID NO: 21570

SEQ ID NO: 130323 - DNA, 601 bp, Human; identical to SEQ ID NO: 21571

SEQ ID NO: 130324 - DNA, 601 bp, Human; identical to SEQ ID NO: 21572

SEQ ID NO: 130325 - DNA, 601 bp, Human; identical to SEQ ID NO: 21573

SEQ ID NO: 130326 - DNA, 601 bp, Human; identical to SEQ ID NO: 21574

SEQ ID NO: 130327 - DNA, 601 bp, Human; identical to SEQ ID NO: 21575

SEQ ID NO: 130328 - DNA, 601 bp, Human; identical to SEQ ID NO: 21576

SEQ ID NO: 130329 - DNA, 601 bp, Human; identical to SEQ ID NO: 21577

SEQ ID NO: 130330 - DNA, 601 bp, Human; identical to SEQ ID NO: 21578

SEQ ID NO: 130331 - DNA, 601 bp, Human; identical to SEQ ID NO: 21579

SEQ ID NO: 130332 - DNA, 601 bp, Human; identical to SEQ ID NO: 21580

SEQ ID NO: 130333 - DNA, 601 bp, Human; identical to SEQ ID NO: 21581

SEQ ID NO: 130334 - DNA, 601 bp, Human; identical to SEQ ID NO: 21582

SEQ ID NO: 130335 - DNA, 601 bp, Human
aatacgagttgttgcccaggcgcggtggtaatcccagcaccttgggaggctgaggcgggaggatcacctgaagtcaggagtttgagaccagcctggccaacatggcgaaaccccgtctctactaaaaatacaaaaattagctggtgtggtggcggacgcctgtaatcccagctacttgggaggttgaggccggagaattgcttgaactcgggaggcggaggttgcagggacccaagatccagccactgcactccagcctgggcgactgagcgagactccgtctcaaaaaaaaaaaaaaaaagaaaagaaaaagaaaaaagaaataggagttatctccatttaacacatggggaaactgaggctgggaacttaacgtgactcaccctagatcatacaagcatagtaagggagtggaggctgaattcaaagccaggttcccaggacttgacagccctacaccgcgtgccaaggtgcacaggatgggtggtgggtggcacctgatcccacggggtggccatgctcccaggccgactcatcccgggtggggtggagtccaggaactgcccaaggaggaaggagggtggacagacgaagtggctgt

SEQ ID NO: 130336 - DNA, 601 bp, Human
cgtgcctcagtctccccatccccattctcctgccctcacgcccaggcacggccaactccctcccagaagggtagggacaccgggcagttcccctggttctgtcccagggtccagcgcagggaaaggagagactctcaagggtgtgctccagcctcctcacaacggtcatcgtctctgcatgtgcttcattcacatggaaagttttactcattttatagatgtggacattgacgattagggaggccaaggcctgcaagacctgcagcccaaccatctctctcctcatggcaggacccgggakccggaggtgactcgccacctgacacaggctgtgaaacgccgggccggcctagtcggcaaaattggtcataaatgtgaccaaatttatttagaagccaggcgcccgcctcccctcctgggctgttggccgagtgctgcaagaaggaagcccgggacccctcttggctcccgcggccgctctccgcggcccccacgccctcctgagccacctacagaggggcccgtcccacttccaacgacgggagggcgaagagtgcagagctggtcccgcccgcgccccgcgcctgcgctgccagggccg

SEQ ID NO: 130337 - DNA, 601 bp, Human
ttcatggggtgaaggtggcttcaggcctggcccatctgcaccctgggcctccatactgagcacatgcctgagtgggtagagtcagtgagcccagagccctgatgggcacacggcgcacacagcactgcccctgccctgttagaagcaggttagagtgatcatataatccctgtggtttattatgggcctatcatgtgctggacacagttctgagtgcttgtgtctgttaccttatgtaatcctcacggcaggtctgtaataaaaacttcattatcatcgccattgtcccatttccaagatraggaaactgaggccagggagctaagtaccctgccctgtctgccaggctgcaaaggtccccgttgagcctccctctgggctcaggctgcccctcccgtgctcttaagcagcatctccagcccagccctgctgtgccagctgcccccacagccctgcaatcactggaggggaaactgagggagagttcagtgcagacaactcggccttgcaccatcctagatgggcagctcaggaacaagacccagggaagaagcctgggctgtccccgctccttcctctggtgtttgggacccagagccct

SEQ ID NO: 130338 - DNA, 601 bp, Human
atactgagcacatgcctgagtgggtagagtcagtgagcccagagccctgatgggcacacggcgcacacagcactgcccctgccctgttagaagcaggttagagtgatcatataatccctgtggtttattatgggcctatcatgtgctggacacagttctgagtgcttgtgtctgttaccttatgtaatcctcacggcaggtctgtaataaaaacttcattatcatcgccattgtcccatttccaagataaggaaactgaggccagggagctaagtaccctgccctgtctgccaggctgcaraggtccccgttgagcctccctctgggctcaggctgcccctcccgtgctcttaagcagcatctccagcccagccctgctgtgccagctgcccccacagccctgcaatcactggaggggaaactgagggagagttcagtgcagacaactcggccttgcaccatcctagatgggcagctcaggaacaagacccagggaagaagcctgggctgtccccgctccttcctctggtgtttgggacccagagccctatatgggaccactggagcggagagctgaggcgggagtgagaggcactcggag

SEQ ID NO: 130339 - DNA, 601 bp, Human
aaaagaaaaagcagaggccgtgaaagaggaccaacttgtgcgaggtcacacagccatatccacagagaaagccaggccggctggcttgggggactgaggagtcggggggcccatgctggcaaggcggctcctcacccagctctccaaggggctccctgcttcctggtttcaccagttacctccctcagggtcccaggtgggtcttcgcagcccagcagagcacctgagctctggcacactgcctgcatggcttgattggcctcaaaggtcggagtgcttcccagacatctccaggaagaargtgccactgagcccttcctgctgtgcagacgcagtctctcctctgccccacagggatttccttctgtccccacagttacccggatactggcaatactaatgacaactatttatgtagcacttgctctgtgccagtcacttcaaatacataatctcactgaatcctcacaacaactctgggaggtgggcattgttatccccattttgcagatgaggaaactgaggcatggagtagttgggcgacttatgcaaggaagtggctgagccagaattcaagccctgagtttgtctgactcccagt

SEQ ID NO: 130340 - DNA, 601 bp, Human
taggtcaccaccattctaaagccttctgtgagctccagacagaagtcacctctcctccgcctgaatctttcctgtacctaattcaaaccttcttatcccaaagtgctgaactgatttgtttccaattccatctggctatgccagtctcagtctccaagaagagaggtagtggtagtgttttctccagttattccccggtccctaccccatcacacacacacacacacacacacacacacacacacacacaacacacacaccccagcccactcggtcttccaaagggccgggcacatgctargtattcatgattctggaggaaaggaatgaagaactcttccaaaggacgagcctgatgcccctcactcgccagacctcccggcatccggagcttccgcctacacacaggacaagactccttggttccgctcaggaagttcctacgtttaggatctgagatgatggccaggctcccaagggggatagagacctgcctggcactgacagctggtgagggggagggcggaggaccctgccaggccttcgcagctgggccaggggctatttatacccagctcctggcccggcccttcccttccct

SEQ ID NO: 130341 - DNA, 601 bp, Human
tgagccagttgcgccactgcactccagcttgggcgacagagcaagactctgtccccccaaccaaaaaaaaaaaaggaatgaaattctgatgcttctgatgcaagctacaacgtagaggaaacttgaaaacaagctaagcgacagaagccagacacggaagaacaaatactgtatgatttcacttacatgaagttctaggtaaagacacgccagcttaggcaacagagtaagactctgtctcaaaaaaaaaaaaaggaatgaaattctgatgcaagctacaacatagaagaaacttgaaaasaagctaagcgacagcagccagacacataaggacaaacactgtatgattccacttacatgaggtgtctaggtaaattcacagggacagaaagtagaacagaggttgccaggggttctggaagggagggagtgggaagttactgcttaataagtacagagtttgggatgatgaaaacagacggtggtgatggtcgcacagcattggaatgtacttaatgccactgaatagtacactttaaaatggttaaatagcaaaattaaaaaaatcaaaggagggatggtgcttgcatccccagccttc

SEQ ID NO: 130342 - DNA, 601 bp, Human
tttgtattttttagtagagacggggtttcactgtgttagccaggatggtctcgatctcctgacctcgtgatctgcccgccttggcctcccaaagtgctgggattacaggcgtgagccaccgtgcccggcctcccctttttgcttttcttatgatgcatcctaagccttcagtgcacagctgccttcccttggggacccctctctgaccacacagtgggacctcccagccctaaccatgctcctgttacaagctacaaagccagctcttccctgttgtcctgggatccaggttctgggtctrtccctcacgttgcctcggcttaactctgagcctttgggctttggccagcccttcctggacctgtcaccctgcattgtgtcactaatgtcaccgtgagtgcagcaggaacagaaaggtgaggtctgggggtgactgagtggaaggggatatcccaggcagtgatccacgccataggagaaaaacccatgcacacggagaaaagataaccaaggaaaaagctattccttcccctccgacaggagcccccgaggacaggccccaggagccccggaaactcactagccctgctggccaaatgac

SEQ ID NO: 130343 - DNA, 601 bp, Human
cagtcagagggaagaggctgcgggccctgtgctccatcccagggagccctgtgggatgtttctttggggagaaaagggaagggagggaaggggtgtggagggcggggcagtgcctgggctggaatgttgcagcttctgttctccaaagcagctcctggagcgcctgcctgcggctctggctgatctgataagatgtgacaagaccgcctgaaaaatgttgaaacctgtaaaatgtttaaacctgttttttgttgtgttgtgagcatgaagtgctttttccttctttcttacccaccccccyaccccttcatttcacaggaaagtgaagttgataagcctggaaaaagggaggagggtgcgagagagggattgttgccttcagccaaattgtggtccggggcatggagcagtctggtgggacctggggaggaggaaagagagtggaaacaggagggaagaggggacaagaggtgagaggagtcaagggtggaagaaggaggaggacaggagaagcgggggatggaggggtcctgcacccctggcctgctcagcagccccagcccatcctccccaggaccaaacacagtcccccacttggcac

SEQ ID NO: 130344 - DNA, 601 bp, Human
gcgaaacgcctgtctctactaaaaacagaaaaaattaaccaggcgtggtggtgggcacctgtaatcacagctaccctggaggctgagacaggagaatcgcttgaacctgggaggcagaggtttcagtgagccgagattgtgccactgcactccagcctgggcaacagagtgagactctgcctcagaaaaaaaaaaaaaaaaaagatgtagcctccaccctcctcagtgaccccacctcagtgcaggtgaccagtcagttgcagagtgtgagaagtcccacttgggacttcaaggaataggkgtgctgaggggaaggaagtgggagaaggcaaagaagtccccttcaaagaggtgacattcgagctgggccttgaagttgagctcagcttggccagcttttcctcctggagcttggccatctgtttctttgcctcccactccactaagtggaattctaattcaaatttttcctaagccatgtttgcatctttagttcattttaaccttgtaacatttctccccttcctgacccctccaaaccctaagtcagtctcccattttacagattgggaaatgagaaccttacagagttaggctgccg

SEQ ID NO: 130345 - DNA, 601 bp, Human
ccatgtttaaatccccttttaatgtctccaattcaaattgttccctctggccatttccccagctcttatacatccgtcacaggtaaccttcaatgcactcaagtgaattgtccaccgactccattgatggtgagttttttgagaggagggattctttcactcgtttccatgtagaatctagcacctgcttcagcaggtgcagtggccctgcgaggacctccctgcgaggacctccctgcctcctttcactgccctcagcagccccactgagtgcccagtcctttccttcgtctctcccagrtcccacaggctgtctccacggcgagctgagggcaggtgatggccatggccctgctggctctctgggccttttaacacagctgctagctccacagtttgggagtcctttgtttgaatcttagaagcagcccagtggggaacacacaaagctgtgctgcttggctgggagctcactcttagagcagctccccagggctcctcagagagccaccagcctggtgtgtgtctttattcaataaacattcacgctgggccaggccttatgctggacgccgggagcacagtgcgtggggcactcctg

SEQ ID NO: 130346 - DNA, 601 bp, Human
acacagctgctagctccacagtttgggagtcctttgtttgaatcttagaagcagcccagtggggaacacacaaagctgtgctgcttggctgggagctcactcttagagcagctccccagggctcctcagagagccaccagcctggtgtgtgtctttattcaataaacattcacgctgggccaggccttatgctggacgccgggagcacagtgcgtggggcactcctggtcttgcaaggactcttacctgaacctggagctgccctgaggaagcccattctcctctttatgggggcccagasgccaccctccctgcctcacacctgatagcactggccaccagggctggcacctacctggactgtcccatccactctcttattctatgctcttcagaaaaccaaggacagtccctgaccagctggctactggggtcagggatgcaggctatacactacggcagatcacttggggtggttttgaaaaatacagacacccaggctccaacaccagcgtggcaggatcagagcctctggagaggagtccaggaaactggatcattaaaagcctccaccagaagtgtgacagtagaatggtatgag

SEQ ID NO: 130347 - DNA, 601 bp, Human
ttcaataaacattcacgctgggccaggccttatgctggacgccgggagcacagtgcgtggggcactcctggtcttgcaaggactcttacctgaacctggagctgccctgaggaagcccattctcctctttatgggggcccagaggccaccctccctgcctcacacctgatagcactggccaccagggctggcacctacctggactgtcccatccactctcttattctatgctcttcagaaaaccaaggacagtccctgaccagctggctactggggtcagggatgcaggctatacactacrgcagatcacttggggtggttttgaaaaatacagacacccaggctccaacaccagcgtggcaggatcagagcctctggagaggagtccaggaaactggatcattaaaagcctccaccagaagtgtgacagtagaatggtatgagatgatgcagcaggaaggccccaaccttccctatgatgttctttggccaaagacgtttaatctgatctaaccaagctttgagaggtaacctcttgttatcagggaacacaagggacagaggaacaaaccaaatgacaccatggggaagcaactggaca

SEQ ID NO: 130348 - DNA, 601 bp, Human
ttaatctgatctaaccaagctttgagaggtaacctcttgttatcagggaacacaagggacagaggaacaaaccaaatgacaccatggggaagcaactggacaaattcagagcagggtttgaacccagggccttgccagctggagtactaaaccatggctgggcactttgaggccacagtgcactggacactgcccagggctccagcttggacctccagctgggcctggccctggccctaaagccagcagtggcagatgcgcacgcaggaggcagctgcaggttgggaggcctcacgggggrtgctgcgaccacacccaggtgctcagggcaacgattccactctctacctttcaaggtgggtatttccaccacattcccaggagggcttctttgcgcctcatccccccacggcgctgaggatgggcaggtgaagacagccctgcccagcacctggacttcccccactctatttagggaggccccacccaagttcaaagcgctggctgcccctcccttgcagccccattctccatccccaggcgaggcagtccagagcgagcctcaacattttcctctgcacctccttcccccaacttcatc

SEQ ID NO: 130349 - DNA, 601 bp, Human
ctccctcccctctgtggtatcctccctccctccctcaaggttgagaagcactgccctaggtcacagacagggctggggacctgcccacagccccaccctgggtccacagctggggctcctgggtcctctgccctccccctgggccccacctcctattcccagtaccagtccctccaagttgttaggatcaacccgtcccctgttttccaacctctggtcttgtccacttcctctcccgaagtagccctcccccatcatctctctccttggcctctcagcaaatctccatgttcacggccasagaagcaaaacttccctgatccagcagccatgaagaagaagcatttgggcacgcccctccgtttccgtccaccttggcagaaatcagaggccggctactgcgctcgcgttttatgtgcgttccaaaacacacgctcacgtacatcggaaaaggacaggataaaagatgtgtttcaaaagaaaccttttcctcctgcagcctcatgcgtcatctggaaccccctgcccaggcctgactcctcgtttcctctggggttttcctcttttcttttcccttcttcctggtttccccttagctttc

SEQ ID NO: 130350 - DNA, 601 bp, Human
aagaagcatttgggcacgcccctccgtttccgtccaccttggcagaaatcagaggccggctactgcgctcgcgttttatgtgcgttccaaaacacacgctcacgtacatcggaaaaggacaggataaaagatgtgtttcaaaagaaaccttttcctcctgcagcctcatgcgtcatctggaaccccctgcccaggcctgactcctcgtttcctctggggttttcctcttttcttttcccttcttcctggtttccccttagctttcttagctgtgcagtggggtgtatctgtttgtgagtargtggaagttctgtctgcaaaggtacaggatgctcacactctttgggttcaaggcagcaagccttttccctactgggttgggggctccacaccttccttggttcttgcctgcagctacatttccccccaacccaggacttcgctttccttactcttttttttttttctgagacagagtctcgccctgtcacccaggctgtagtgcagtggcgtgatctcagctcactgcaacctccgtcttccaggttcaagcgattctcctcctgagtaactgggattacagacgaggaccaccatacct

SEQ ID NO: 130351 - DNA, 601 bp, Human
aatcagaggccggctactgcgctcgcgttttatgtgcgttccaaaacacacgctcacgtacatcggaaaaggacaggataaaagatgtgtttcaaaagaaaccttttcctcctgcagcctcatgcgtcatctggaaccccctgcccaggcctgactcctcgtttcctctggggttttcctcttttcttttcccttcttcctggtttccccttagctttcttagctgtgcagtggggtgtatctgtttgtgagtaggtggaagttctgtctgcaaaggtacaggatgctcacactctttggsttcaaggcagcaagccttttccctactgggttgggggctccacaccttccttggttcttgcctgcagctacatttccccccaacccaggacttcgctttccttactcttttttttttttctgagacagagtctcgccctgtcacccaggctgtagtgcagtggcgtgatctcagctcactgcaacctccgtcttccaggttcaagcgattctcctcctgagtaactgggattacagacgaggaccaccatacctggctaaatttttttgtatttttagtagagacggggtttcaacatgt

SEQ ID NO: 130352 - DNA, 601 bp, Human
agtaggtggaagttctgtctgcaaaggtacaggatgctcacactctttgggttcaaggcagcaagccttttccctactgggttgggggctccacaccttccttggttcttgcctgcagctacatttccccccaacccaggacttcgctttccttactcttttttttttttctgagacagagtctcgccctgtcacccaggctgtagtgcagtggcgtgatctcagctcactgcaacctccgtcttccaggttcaagcgattctcctcctgagtaactgggattacagacgaggaccaccayacctggctaaatttttttgtatttttagtagagacggggtttcaacatgttggccaggctggtctcaaactcctgacctcaagtgatccgcccgcctcagcctcccaaagtgctgggattacagacgtgagccaccacgcccggcctcctcactgttttctgaccagaaatggtccactctgctctgcagagcctcacctcctctcccactcccttccttcccctcactgtgtacaacaccctgtcactccaccaggccaggcatgccctggtaagggtgctggggcacagggagtttct

SEQ ID NO: 130353 - DNA, 601 bp, Human
gggtttcaacatgttggccaggctggtctcaaactcctgacctcaagtgatccgcccgcctcagcctcccaaagtgctgggattacagacgtgagccaccacgcccggcctcctcactgttttctgaccagaaatggtccactctgctctgcagagcctcacctcctctcccactcccttccttcccctcactgtgtacaacaccctgtcactccaccaggccaggcatgccctggtaagggtgctggggcacagggagtttctgtaatttctgtctgcattctacttacattcatcacaraagtaggaaggcatttcttctgggggaaacacacgttgtgtagaaaagataaaatctctctctctggcatggtggcgcatgcctataatcacagcacttcagaatttcgaggcagggggatcacctgaggccaggaatttgagatcagcctgggcaacacagcgagacgctgtctctacaaaacacagaaaaattagctgggtgtggtggtgcacacttgtagtcccagctactggggagactgaggcaggaggatcgcttgagcccaggagtttgaggctgtagtaagctgtgattgca

SEQ ID NO: 130354 - DNA, 601 bp, Human
gtggtggtgcacacttgtagtcccagctactggggagactgaggcaggaggatcgcttgagcccaggagtttgaggctgtagtaagctgtgattgcaccactgcactccagcctgggcaacagagtgagatcctgtctcttaacaaaacaaaagaaaacaactctctcttacacatacatagaaatagcgaacatttaaagtcaaaaaattctaaatctctgcaaatgggatgtgtgttcgacacaaaaggcaaaatgtcagtgcacattagccccagttaaggttcccccaggaatcacyctggcctaagagaaggctcaaatcaccatgggtgggaggaggtgtcctccagaggggggatgacgtcatggagcacctttttggggacactcaggctgtgaatgaaataaagaacgcttttacaggtgattacccataatgaataagataaggtggggtacatttatttgggtagagagtggctaataaggtagtgaagaacttcaccaatttcctcaactctgctctaagtaaggtagtaaggagcctattcactgaggcactcagagtggccattttattatttttttgagacagagt

SEQ ID NO: 130355 - DNA, 601 bp, Human
tcagcctcccgagtagctgggactataggtgcatgccaccacacctggctaatttttgtatttttagtagagacagagtttcactatgttgaccaggctagcctcgaactactgaccacgtgatctgcccacctctgcctcccaaagcgctgggactacaggtgtgagccatcacgcctggccagtggccattattaataataatagttaacatttattgaggcctgactatgtgccagttgccatgtaaagcactttacatagaatacatcctttaatttgccaaagaacccaatttaamggatgatgacatgggctcagagaggccaagtgactcgtctaaagtcacatagctaggaaatggtggcactgagatggcaaaaaaagcagtgagggctgagggaggtggctcacacctgtaaacccggcactttgaaaggccgaggcgggaggagcacttgagctcaggtgttcaagactagcctagccgagaaagcaagaccttgtttctactaaaattaaaaaaaaaaaaaaattagctgggcatggtggtgaccacctgtagtcccagctacttgagaggctgagttgggaggattgc

SEQ ID NO: 130356 - DNA, 601 bp, Human
agagtttcactatgttgaccaggctagcctcgaactactgaccacgtgatctgcccacctctgcctcccaaagcgctgggactacaggtgtgagccatcacgcctggccagtggccattattaataataatagttaacatttattgaggcctgactatgtgccagttgccatgtaaagcactttacatagaatacatcctttaatttgccaaagaacccaatttaacggatgatgacatgggctcagagaggccaagtgactcgtctaaagtcacatagctaggaaatggtggcactgagrtggcaaaaaaagcagtgagggctgagggaggtggctcacacctgtaaacccggcactttgaaaggccgaggcgggaggagcacttgagctcaggtgttcaagactagcctagccgagaaagcaagaccttgtttctactaaaattaaaaaaaaaaaaaaattagctgggcatggtggtgaccacctgtagtcccagctacttgagaggctgagttgggaggattgcttgagcccaggaggtcaaggctgcagtgagccaagatcgagccattttactctagcctgggcaacagagtgaga

SEQ ID NO: 130357 - DNA, 601 bp, Human
gttcatagggaacagcaggaggttagcaaggggacagccagcttataaactctctggtgggaggggcgtgggggagagcaagtgaaggaggacatagaacaggggtgggggtggataaaccacaagacctcaggggactgtgccctgagagaaaaggaagaggatgggcatttctgggacattgatgtcacataaaactccaaaacccaagggaccaagaagaaaggaggccagggcctgaggtcctgctgatgagcttcaatcttactagcggtgaagaggggtcaccatctatggggcygaaagaagcccaggccctatatgcaggctggatcccccgacaggacctgtcagagctagaaggagccttgggggtcatctggtccagtttgcatattgcacagggctcagagctaaggccatctcactgggctgaggagccaaagaacatagtcagctctgagaagggctcttcaaggctggctctcctttgtttgcagaacacactgtaccaccgtggagaggataaaaatctaaaattcagcaccttaacccattctcacaccagtcaaactttcgacagtcctattggtctatagat

SEQ ID NO: 130358 - DNA, 601 bp, Human
tcttactagcggtgaagaggggtcaccatctatggggctgaaagaagcccaggccctatatgcaggctggatcccccgacaggacctgtcagagctagaaggagccttgggggtcatctggtccagtttgcatattgcacagggctcagagctaaggccatctcactgggctgaggagccaaagaacatagtcagctctgagaagggctcttcaaggctggctctcctttgtttgcagaacacactgtaccaccgtggagaggataaaaatctaaaattcagcaccttaacccattctcayaccagtcaaactttcgacagtcctattggtctatagatgcctgggaattccctcctttcccaggtcaggaagatctcgacctccttccaccagcttcccaggactttcttttctttctttctttctttttcttttttttttttttttttaacagattcttgctctgtcactcaggctggagtgcagaggtacgattccagctcactgcaacctgcacctcccaggttcaagtgattctcgtgcctcagccttccgagtagctggaattataggcacccaccaccatgcttggctaatttt

SEQ ID NO: 130359 - DNA, 601 bp, Human
agctaaggccatctcactgggctgaggagccaaagaacatagtcagctctgagaagggctcttcaaggctggctctcctttgtttgcagaacacactgtaccaccgtggagaggataaaaatctaaaattcagcaccttaacccattctcacaccagtcaaactttcgacagtcctattggtctatagatgcctgggaattccctcctttcccaggtcaggaagatctcgacctccttccaccagcttcccaggactttcttttctttctttctttctttttcttttttttttttttttttaacagattcttgctctgtcactcaggctggagtgcagaggtacgattccagctcactgcaacctgcacctcccaggttcaagtgattctcgtgcctcagccttccgagtagctggaattataggcacccaccaccatgcttggctaatttttgtatttttagtagagacggggtttcaccatgttggccaggctggtcttgaactcctgaccacaggtgatctgcccgcctcggcctcccaaaatactgggattacaggtgtgagccaccatgccaggcccttcccaggacatttctgag

SEQ ID NO: 130360 - DNA, 601 bp, Human
gcgccccatgtctcactcccctggtgtggccagaactggggatggtgcaagaataaagccctaggcagtgtggaaagcagacagctgaccctgtgacttctggggctcccctccgaggtggggaagaacagaggagctggcctctggggtctgagaagaccagccggcccgtgggcaaagggacgacagcaaattctcctccagtgaccctcagcccctgacgccctgtctaaccctctcagatccaaagctgcgagccctcaggaacatgtggctacctctaacccagctcacttgcctrgttaaaagcaaccacaggtgtccagcctgcaaacatttcccggcacacagggccctgtgcaaggggcagtgggtgacgacaccaagcccagttccggagcaccctgctgttctgcggcactgctgactcacaagcgattctgccgctgtgcagtctcaaagccagccccacccggggatctctgtcttccttggtctgtcatgaaggtgctagtaacccccaggcttctcagataactccttctccttcacttgtgcactcttgctctctgtctctctctgtctctgtctctccctctct

SEQ ID NO: 130361 - DNA, 601 bp, Human
tgtccagcctgcaaacatttcccggcacacagggccctgtgcaaggggcagtgggtgacgacaccaagcccagttccggagcaccctgctgttctgcggcactgctgactcacaagcgattctgccgctgtgcagtctcaaagccagccccacccggggatctctgtcttccttggtctgtcatgaaggtgctagtaacccccaggcttctcagataactccttctccttcacttgtgcactcttgctctctgtctctctctgtctctgtctctccctctctctctcacacacacacacaygcatgcacgcacacacacgtgtgcacacatgttaaattctaacccttgcagtaccatggatttccattttgttgagatgaatagaggattaaaaaaaaaagaactgatcaggttgtcggcagggtaattatcagtaaaaagaaacagaggagctgtcccatccgcaggtggtaggtggcaccctccacgcctgcaggccagggctttgtgatctggctgaccccaatcctgatcttattgctaccacccattaccacgtctccttgggaggactcaacttcctaatgagaaaaacatccc

SEQ ID NO: 130362 - DNA, 601 bp, Human
ctgtctctgtctctccctctctctctcacacacacacacatgcatgcacgcacacacacgtgtgcacacatgttaaattctaacccttgcagtaccatggatttccattttgttgagatgaatagaggattaaaaaaaaaagaactgatcaggttgtcggcagggtaattatcagtaaaaagaaacagaggagctgtcccatccgcaggtggtaggtggcaccctccacgcctgcaggccagggctttgtgatctggctgaccccaatcctgatcttattgctaccacccattaccacgtytccttgggaggactcaacttcctaatgagaaaaacatcccccacttcaaagaggctgcggggaggaagaattgaaatgatgtagataaagcttttatcacagtccctggcacatagtaggtgcacaataaatgttggttgccattgtcatagtgctaataaagaccagtgacatcctctatgccaggcactgtttgtgtgcttgccgcatattaaccccataataattctgtaaggaaggtatgttatcatcacccctatctcagtggggaaactgaggcagagattggcccacattacc

SEQ ID NO: 130363 - DNA, 601 bp, Human
atggatttccattttgttgagatgaatagaggattaaaaaaaaaagaactgatcaggttgtcggcagggtaattatcagtaaaaagaaacagaggagctgtcccatccgcaggtggtaggtggcaccctccacgcctgcaggccagggctttgtgatctggctgaccccaatcctgatcttattgctaccacccattaccacgtctccttgggaggactcaacttcctaatgagaaaaacatcccccacttcaaagaggctgcggggaggaagaattgaaatgatgtagataaagcttttrtcacagtccctggcacatagtaggtgcacaataaatgttggttgccattgtcatagtgctaataaagaccagtgacatcctctatgccaggcactgtttgtgtgcttgccgcatattaaccccataataattctgtaaggaaggtatgttatcatcacccctatctcagtggggaaactgaggcagagattggcccacattacccaggtaattagggacacatctggtctggctccagaggctgaagacttaaccacaatgttctcctgcccctctcagaaggagttggatgagagatcc

SEQ ID NO: 130364 - DNA, 601 bp, Human
tcctctatgccaggcactgtttgtgtgcttgccgcatattaaccccataataattctgtaaggaaggtatgttatcatcacccctatctcagtggggaaactgaggcagagattggcccacattacccaggtaattagggacacatctggtctggctccagaggctgaagacttaaccacaatgttctcctgcccctctcagaaggagttggatgagagatcccatctgtatgtcccactcggggcacacagagaggcaagcgcaacttggttcctgccccgcaggggctcccagcctcaytgggtgacagatcctaaaaatgcaactacaggggacctaagacgggagaatgattcaccagccagacagcccgggtgtcccctggtgcaagatgagcggtgcctgatcagtccctggttcctggctgctgcataggagagggggctcagctggatggctgactgattggctgactgcttcattcattaattcctgagtgcattcattcattccttccactcaagccctccagaaagggtggtctggactgaactagtttacacgggatgattacaacagaagtcagaggactctcagctt

SEQ ID NO: 130365 - DNA, 601 bp, Human
tgttggttttttgtttttttgagacagggtctccaggctggagtgcagtggcgtgatcccggctctctgcaacgtctgcctcctggattcaagcgattctcctgcctcagcctcccgagtagctaggaccacaggcgtgtgctaacacacccagctaatttttgtatttttagtagagatggggcttcaccatgttggccaggctggtctcgaacccctgacctcaggtgatcctcccgcctcggcctcccgaagtgctgggatcacaggcatgagccactgtgcccagccaaaaaccaggatttttaagtaatggaataaataggtaaaattcaggatgtggtcacatctagagggagatggggaatgggctgaggaggacccacagatggacacgacggcctagtcacggtctggtccttcagggacatagtgaggctcaggttttcattctgtcatcatgtctaatatatatgattgttctcttgtatatgtcaagtattatgtaataaaaatatttttgatcagcttgcaggagaatagctggtatctgcttaggcttgtgccagccataccattggcacatcagctcttcttcacc

SEQ ID NO: 130366 - DNA, 601 bp, Human
aggctgggcgcagtggctcacacctgtaatcccagcactttgggaggccaaggcgggtggatcacgaggtcaggagatcgagaccatcctggctaacatggggaaaccccatctctactaaaaatacaaaaattggccaggcatggtggtgcgtgcctgtagtcccagctacttaggaggctgaggcaggagaatcacttgagcctgtgaggcggaggttacagtgagccaagatcacaccactgtactccagcctggtgacagagcaagactccgtctcaaaaaaaaaaaaaaaaaaaaatccctgatagctaaccacatttaattcacccttcccttcctgagaactggaggcctttgtgagtactctggctgaacaggataccagaacgcaaggtcatgccagagtctgcattgccttttgtccaccaagtcacagacttctgccacatgcctccccacccgcttctttcttcagataggcttattggttgggacaaaccaacataaagtgtgtgggattccctgaagccagccttttctgttttggaaggaattcagatctttctgctctaaagaagcctggcctgggagagaatat

SEQ ID NO: 130367 - DNA, 601 bp, Human
tgacctcaaatgatctgtccgccttggcctcccaaaatgtagggattacaggcatgagccactgcgcctagccagtttctgtctgttatttcatttcaacctcacaactaccttgagatcatattttttattcccattatacagaggaagagactgagactcagatttttaagcaaccacccaaagcaaagttctagaagctatgaagtggacatctgggatttgcaccacaggtggttctgtcacagagcctaccctctttctggagtgctatgttgcctccccacaccaaggttagatkcccagagccggacttcctgggagatcacagagtgaggggagtgctgtcccagagagtggggaccagctgagcctgaactgcagcctgcttgggaaggagtctgattcctgggccaagtgctaacagaattcctatttatttatttatttattggagatggagtctcactgtgtcacccaggctggagtgcagtggcgcgatctcggctcactgcagcctccacctcccaggttcaagtgattctcctgccttagcctcccgagtagctggcattacagctgcccaccaccacacccagct

SEQ ID NO: 130368 - DNA, 601 bp, Human
cctggcagagcatcacagaggcaatgagaatccagctggagcagggagacaagagtctgggaccagcaggtgactctcaacagtgtcctttcatcccacaacctgtctttgaggatccactgtgtgccctgtgctatgtttggtggtatgggttgaaagatgatggagaactggtcctgcccacaggtgacttacagtctagtccatgaaatagatgtgctcagaagggcctttgctggggccgcggtgctgagggaaggctgcgcagaggaagtgatggctgaactatgatttcaagacygaacaggagtttgtagtcatcccaagagaaggcagggggtagcacagaggcacggagaagtgaggtgtgcacgagaacaacgcagactgtaacatgaaattaatgtcagcaaaatgtgtgtctaactcactgagtacacacctgaccctgtgctagtctcacatgcgttatatcctttcatcctcacaatagccctcgttatccccattttgcagagagaaaaccaaggcttggagaggtgaagtccacccagataaaaaggcagaaccatctagagtccaggactgctgtacccaggcc

SEQ ID NO: 130369 - DNA, 601 bp, Human
atgaagcccccatacaagcccaaaaggacagggttcaagtgcttccggatagcggaacacgtggaggttcctggaaggtggtgtgcctgggaagggcgtggaagctcagtgcagcttctcccatacctcgccctatgcacctcttcatctgtatccttgtaatatcctttataataaaccagtaaacgtgtgttcctgtgttctgcgagccactctagcaaattaatggaacccaaggaggaagtcacaggaaccctgatttatagcaggtcagtcaggagcacatgtaaagcagcctggrgcttgggattgctactggaagtgggaggctgtcctgggaactaagacctcaacctatgggatcagatgctatgtccaggtggagatcatcagaattgaattggattagaggacgctggctgatgtctgccgcagaattgacagcttgcttggtgtatgcacgcatttggtcacagaagtcttctgtaccaattattgcagggtgaaagcagaggaaagacagtttacgtcttttcctgtactttcattaaaaagttaatcacttggccaggcgtagcggctcacacctgtaatcccagca

SEQ ID NO: 130370 - DNA, 601 bp, Human
actgctgtcagcaactgtgcaatcccagcttgaggacagcctgatggcttgtggaaaggtggccagtgaagaggacacatccccaaataagagacttcccagacgttcacaaatagtatctataagcccaaagcatcagcctttgagtggaaggtcaagtgtaaacttgtctcaaaaccatcctttggggaacaaagtagaatatgaacaagcaaatttttaccccaataacaagtccacaactgagcctgaatggtggtagaaggaaaaaggctttaggtccaacagggtgtgggctcarggcttcccatgccatgcccaggctgcactgtgggactccctatctataaactggcaagaattagattcagataaatcatgatgtctgcatggggatcagcacatagcacatggtcaacaaacgtattaacctgttcctagatagagaaacaacttctgccaattgcaatcttaaaattaatgacttagacacttaagcatcgtgtgaactggtgaacatggagggggaaatagtacacaaataggaaacgtttacaagtggaactgggattaaaaaaaaagaaaaagaaacccaggggaa

SEQ ID NO: 130371 - DNA, 601 bp, Human
aatttttaccccaataacaagtccacaactgagcctgaatggtggtagaaggaaaaaggctttaggtccaacagggtgtgggctcagggcttcccatgccatgcccaggctgcactgtgggactccctatctataaactggcaagaattagattcagataaatcatgatgtctgcatggggatcagcacatagcacatggtcaacaaacgtattaacctgttcctagatagagaaacaacttctgccaattgcaatcttaaaattaatgacttagacacttaagcatcgtgtgaactggtraacatggagggggaaatagtacacaaataggaaacgtttacaagtggaactgggattaaaaaaaaagaaaaagaaacccaggggaattgacactgtggagaaaaggctcatctccactcctgggacagcagcctgctcaggtcgaggggcccatccaccttgagagaccctctaaggaccctccatagttcagggctgttagctacatgacctgagccaagtggggtccgagctgagcagcgcagagcagactgaccccaggtcaacaggccccaggttgggctgccttttaaagtcaga

SEQ ID NO: 130372 - DNA, 601 bp, Human
gggatcctgctcactcacagcacaagccctatttgcattcctaatgggccctgcgagattggttttccttgccggcccagctggctctggcagataagtgggactctgtgcccaggggcaggtttcccagaaaggtcttccagacagacctgggtgcttggtcctgttgctcccatccccctccccaacacacacgtacacacactcagtcctcgcagtttttccagccgagctggagggaatggcttgtgcctgtctcctagtttgctaggccttacccaggccattaggattccctgaygactacaggcctcagcagagccccttccagctggcagccctttgccctcgcccccctcacctccacctacatcttcccatgtgtccctggttggaaatctcactctgggtctggccagtggtttttgcattaggccaggaggataaccaagccccatgccctgagctgtgaacctgggtatgccccgtgaccagttggcttcagacctgaggcctctgtgccctctcccaggggctctccagtgagcatcaggacccctacaggaaggagctgaggactcccctgtccagccccacttct

SEQ ID NO: 130373 - DNA, 601 bp, Human
ggcaggtggtcgtgttattatcatcatccaatttgcagatgagaaaactgagggagggaggagactcatccactgtctcacagctctttgtgtgtagagtttagagctctgcaccccccacccttccctgagaccagctttcagtgaccaccccctccaccaggcacagatggtccaaatagctgggtgacctgaacgcggaatacagcctccatgactgcaatctcggagctggaagtctttggccagcagcttatccaactctcctagttactgagactcagaacagttcaggaagttrcctaatatcaagatggtggcagagccaggtctcaggtgccctaactccctgcccggaagccgcccacctcctcacactggcccctctcgccccagagcccgctctggcatctccttcattccctagatgtatgggtgtgcctgacatttctggaattcactccacacacataatgaggccattttgagaaggcccgcctcagggggaaccagagagctgtctagtgtccccatcctgacccctgccaactcctcccggctgtacaggccaggctgcaaacagataaatcgacactactgg

SEQ ID NO: 130374 - DNA, 601 bp, Human
gagatttccacccagagccctcgctgtctgcctcagtttctccacctttgtcagtgactgagcatgtatccagatgccagagtgtgggccctggtagggcctggctgggtttgccactggtgaagctgcagcaagcacctcctaaaggacttggcaccaaagtccagctcctgcctcttttgacctcatcgccaaaggtcttcccaccaggccaggattaattgcagggcagacatcacagacccaagccctcaggatccctggggtggaggtgggggtgatactcagactccacccatckctcacctcttggccccggagctgttgacaaaatgctctgagagtctagaactttccctgagagcgtccccttcccccatgccatccacatacatattacagcaggttcttctaaggacataactcagctcaggctcttggtattattataacgtttgacctgttttcttctttttaagcaaaatgtgatcctatcggaagaataccaacagatcggccaccaattttgctccctctggactccgaagccccacccataatgggggcggggtgagcgggagggctgttaacttccaagaga

SEQ ID NO: 130375 - DNA, 601 bp, Human
ggccatccgatctggtatctgcccatctgtctgtctgtctgtctgtctgtgggatcaacagcctccagctagctcagctcctcaccagccccagccagcccagccccagcgagctgtaattcctgcctgttacaagtgttaacacctggcctggggccttcctcccccgcagtctccaggtgcctccctgggcccagcccactgacccccacggggtttgactgaacatgttcacaagcctctgaaaggtgggtggaggtgggagtgggtgggagaggcagcaggacatctgacagatggrgaaactgaggtaggtcttaggcaggtgctcgagtgggaggatgggtcctgggatggcgagaactcaggtgtgctatttcccagctcactgcccttgtcctctgcaaaacattttcacccaagctgtgaggcagggcaggctggggactcctgggtgaagtgtaaggaagcagacccagatgggtggccactggtcctcagtcacacagcggcagggtgagctcctgatctccagcaggccccctccatctgcacgtccatcgctggaatgtagcaggtgctgggctaggccctaataaca

SEQ ID NO: 130376 - DNA, 601 bp, Human
gggttggggagtgggggcagaaatgggatcaggaatcagaggcccatctaccctacagccccagccctaaccctgagaaggtgactcaccctccaccccagctccaagaccaaagaaaaacaacctcagagagaagggccagtgactctagtgcctggacagacaggacaagctggtgtcaaggaagcctgtgcccctgcctctctagcttgccatccctggccagctgtgccccctgcagccaccttgtgagacttttgcttcctgttggaccttccctccaggcccatggctgcccacsaaacacccaagctcaggtgtcattcatacccacaggtagatgtctgcaaagatattcacagccacacagccctgggcccagcacctggggacaggatcacaggcggactcagacacagccctcacacagctatggacttgaggctcactctcctccttacaagcacaatcaggtcatggccatgagcactgatattcatgcacaaagacatctgtggggctttccccacactgtcatgaaggcatgcgcgcgcacgtacacacacacacacacacacgcacgcacacacacactcacaca

SEQ ID NO: 130377 - DNA, 601 bp, Human
aacacagtcaagcccagcgtcacaggcagacacaggctctgacctttacatgggcaaagatacttctagacttctctctgtctcttacacatgtacatacacacatcacagcaccagccacttgctcacactcgtgtgcagacacacacagcacaacctgtcgtgggcatggatcccccaacacgcccacacgatttcacatccatagtagcccagttgcaggcacaaacacttttgcacacagagacacactggtgtatagaaaacacctcttagggtcatagacccagaacacacgcacacacacacacacacacacacacacacacacacacacacacacctctctccttggcttagacaaagcagcattcctgtcccccaccaaattcccaaacaagccatgtgtctagcattatgttagggccaatgtcttgaccttccaggtttccccagcgtttcttcctattgggcaatccctatctagatggtccccaagataccatttcacaccagaatctacaccaactggaagagtgccctcttctagttcatagggccggagagactggtctctcttcctcagtccctgccacctatg

SEQ ID NO: 130378 - DNA, 601 bp, Human
gaaaacacctcttagggtcatagacccagaacacacgcacacacacacacacacacacacacacacacacacacacacacacctctctccttggcttagacaaagcagcattcctgtcccccaccaaattcccaaacaagccatgtgtctagcattatgttagggccaatgtcttgaccttccaggtttccccagcgtttcttcctattgggcaatccctatctagatggtccccaagataccatttcacaccagaatctacaccaactggaagagtgccctcttctagttcatagggcckgagagactggtctctcttcctcagtccctgccacctatgggccgccaaacctttccttcctaccctcccccaacccaccagagtctctgcgaaagcaaggcgaaaaacggcatggccttggcccgggaatgggaagagggtcaggaatggccgggtgaggctggactggtgttggcagcagcctttccccagactggccgaacctccttcctgaagtccctggctgccctggccaccccatggacttctttatgtgctggaagcctcaggttagcccagccccccggaaaagtgtgggtt

SEQ ID NO: 130379 - DNA, 601 bp, Human
gcgaaaaacggcatggccttggcccgggaatgggaagagggtcaggaatggccgggtgaggctggactggtgttggcagcagcctttccccagactggccgaacctccttcctgaagtccctggctgccctggccaccccatggacttctttatgtgctggaagcctcaggttagcccagccccccggaaaagtgtgggttgggcagaagaaagacttccccttggctggctgtcctgggagcaactcctagcaccctctaaacagagacccttggccatgtccccaccctctctcccagragccccaaacacccagacacaaatgctgccatccccaaacaactggaagactcggggtgtggcccccaagtctcgctgtctctgctcctcctaccctggactctgggttggcgaaaggcagggagtctggggacctgcaggcggtaccgcaccgtggtggcacttctttctgactttcaccccgggggccacagcccacttctcactcacagatcccaaattcttcctcctcacctccccccgcccaggccaaggctctcctatgtccaggaggggaagattctttaattaaagttttcc

SEQ ID NO: 130380 - DNA, 601 bp, Human
ggaggggaagattctttaattaaagttttccggaatgtagggggctggagactggggagaggcggagtgtaatttagagaactggtttcagtgtcttcccctctggcccctgggacctgcggagggtgggagagcggcgatggggccgctcggaaaacaaggggactcctggagctggggctcccaaagcgatgtttattcctcacccaggccccccagacacgcacagccccccccaagcactgctcccggcttcccagtcttatttactaaaatgtcttttgtatccacatttctcagrgacggaattctcccttccctctccctttctcctcggtcctcggttttccaaaaggaagaaatgtgacatggagaattggatttttggtcaaagaacaacaagcctacccctcccagacaacacattttcaaggaaccccccttttgccagggtggacaagcaagaaatgaataaaatccgaattcaatggcatcccggatcagcaaataccatattcacttcagaggctcaagatgaatctagagcggtggggagaatctgatgaaatccccccacccactcccctgccccgggaggagc

SEQ ID NO: 130381 - DNA, 601 bp, Human; identical to SEQ ID NO: 34133

SEQ ID NO: 130382 - DNA, 601 bp, Human; identical to SEQ ID NO: 34134

SEQ ID NO: 130383 - DNA, 601 bp, Human; identical to SEQ ID NO: 34135

SEQ ID NO: 130384 - DNA, 601 bp, Human; identical to SEQ ID NO: 34136

SEQ ID NO: 130385 - DNA, 601 bp, Human; identical to SEQ ID NO: 34137

SEQ ID NO: 130386 - DNA, 601 bp, Human; identical to SEQ ID NO: 34138

SEQ ID NO: 130387 - DNA, 601 bp, Human; identical to SEQ ID NO: 34139

SEQ ID NO: 130388 - DNA, 601 bp, Human; identical to SEQ ID NO: 34140

SEQ ID NO: 130389 - DNA, 601 bp, Human
catgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaartgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctaga

SEQ ID NO: 130390 - DNA, 601 bp, Human
cttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatstgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttct

SEQ ID NO: 130391 - DNA, 601 bp, Human
agtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatcygtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattcttt

SEQ ID NO: 130392 - DNA, 601 bp, Human
cttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaasaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatc

SEQ ID NO: 130393 - DNA, 601 bp, Human
tcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgagktggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagtt

SEQ ID NO: 130394 - DNA, 601 bp, Human
aggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgrccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccag

SEQ ID NO: 130395 - DNA, 601 bp, Human
tggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattatactattgcctctttttcacamatggatggtgctaaaatacgtgaaagtagtttattctcaattaatttaaaattcaccttgtacttctcttaatttgcttattagtgaatcctttctccatggataaactcctcaaaactgctgaagtatgtatgaggtattgtcctcacgttctggggggtataccatatgttccattaagatgtttgaagtattcacagaccttccccttctcccctattttacgtttgcttcccaaacttcattctatttttaaattttaattcctttatccatttttgcatcaatacttgtttaaaa

SEQ ID NO: 130396 - DNA, 601 bp, Human
tttttggttaacatcctaatatataatgtagctgatttgttgaagtttttgcatatattagctgagagaagtgggcactccggaagtgactacaggtccctgtatggctggggaggtgggcatttgttgttgttttgttcaatacactgtgtcttttggcatttgtatctctttggcgtagaaaggaggctggtgcagaactttcagaccttgtgactttttatattattaagaatacccttctctgtggctcacgatatgagaaaatgtaagattttttcctgaaaagcagggagaacarataaaggattttaaggtcattccaggaagctttagagctttgccaaaagtttaggtccacttcctgaggcagtttcattagcagacagctaatgtttgcttggtctactcccaagttatttttagaaacgagattattactgatagcacccatttgaatttgctcatttacgtttttatatgctaccaaatatgattagagtatgcttttaactaatcgctgacagatttactgcattagggattttctaagctatgagattcctacagtcatcagatttctactaactaggtacttcac

SEQ ID NO: 130397 - DNA, 601 bp, Human
ttacttttctcgcatctttctttccagtacctctcctcctgctgggatttatctacctaaagttgtggtgcagcttcccggcttagtatgtaaatatctcacttggattttcctgtggcagctaacctcacgtacttgccagccaactctgagtatcttcttagtgagaattctgctggggcctgggccagaaagggtgaaagggactaagggactgaggagactaggcagaaatcgtggatcctgggaagagttatgagcacaggttacactagtgactagataaggaagaaaatgtacrtgtgagaagagaaagggatgtgtgtgtatgtatgtatttaaattagagcagagtagctacccggaggagtttcagttgactggttacctgaaactagtcaagttacaactggaattgcacagccttcgtcatggtcggtgtgttaatagagcttgctgtgagtgcacctctccctctgatagtaattagcacagagaccgactgcaaaaaacaagaacgtcactacttgatattaagtgactgctgcaggtatttttcctctcaaatgttatgtgtaggccatgcagtcaactgtgaagt

SEQ ID NO: 130398 - DNA, 601 bp, Human
tatatgctggcatcagagcttttagtagaattctgaaaaatgttttgaaaagcaaagcattattttcagtgattccttaaaattacctgagtttataagataccacattggctgcggttccatcttcaaaaaaagtagcaaagaaccgctgtagaactgcttctgagcttttcagttgtctcgaatgtaccaactcaaagccaaaaggaaccatcattgtgtatcaagagactgaaataaatatcctattctcattttctctttttctgtgtttggggaggagaagataaaaggcccttcycttcttgctctttaaatgtactcatgatccattttcaaaccagcttcacctctgtgttttatttcagttgccaaatcaggacagatccttgactccagttttctctttcatcaccacacccattcattcaccaagttctttcagttcctcctcctaaacatctctagattctgtccacttaccagcacacccactccctggccaccatcatttctcacctagaactccacaatctcaattaactattattcccctctaatgcttttctatacaatcaggaaaatgtttctaaaacataag

SEQ ID NO: 130399 - DNA, 601 bp, Human
tccagttttctctttcatcaccacacccattcattcaccaagttctttcagttcctcctcctaaacatctctagattctgtccacttaccagcacacccactccctggccaccatcatttctcacctagaactccacaatctcaattaactattattcccctctaatgcttttctatacaatcaggaaaatgtttctaaaacataagcctgacatgtcagtccattgcttataaccctttagtggcttgttattgcctttacagtaaaattttaactcatgaaatttgtaagactctttaygtccaagttccttcatcacctcttctaattcatctcacctaccactccactgcattgacaccaacaccactttattttaattcttattgaccgttcctgcagtgttcctgaatgttcacatctctgtgtctcctaattttcagtatattctgcttagaacactttcttccaccctttccactggttaactgttgttcatgcttcaagtctcaggttaagtgtcacttcctaaatttaggaaactgtcctgactccctaagtccatttaagagtcaagataggctgagttatgctgcatga

SEQ ID NO: 130400 - DNA, 601 bp, Human
agtgtcttttcattttagtgggctcaagtgttttcatattgctggagtttatatttagacaggatatgataagagtgaaaacattcaaaaataagtaaagttcaaatggccaacaagtataagaagaggtactcaacatcattagtcatcagagaaatgcaagtcagaaccaatagtgagataccactcattgcatacctgctagaatggctatcatcaaaaagtcaggtaatgacaagcgctggtgcagatgtggagaaattggaacctgtatgcactgctggtaagaatgttcctcaaagaggttaagcatagagttaccatataacccagctattccaccaagtatacacctacaagcaatgaaaaacatatgtccacatgaaagcttgtatgtgagtattcatagcagcattattcataactaaacatttatctgataaaatctagtatatccatataatggaatattactcagcaataaaaaaaagtagtaccattacatactacaacatgaatgaactttgaaaacatgctaagcaaaaggagccagtcaaaaagaccacatattggatgattccagttacatgaaatgtccagg

SEQ ID NO: 130401 - DNA, 601 bp, Human
agtgggctcaagtgttttcatattgctggagtttatatttagacaggatatgataagagtgaaaacattcaaaaataagtaaagttcaaatggccaacaagtataagaagaggtactcaacatcattagtcatcagagaaatgcaagtcagaaccaatagtgagataccactcattgcatacctgctagaatggctatcatcaaaaagtcaggtaatgacaagcgctggtgcagatgtggagaaattggaacctgtatgcactgctggtaagaatgttcctcaaagaggttaagcatagarttaccatataacccagctattccaccaagtatacacctacaagcaatgaaaaacatatgtccacatgaaagcttgtatgtgagtattcatagcagcattattcataactaaacatttatctgataaaatctagtatatccatataatggaatattactcagcaataaaaaaaagtagtaccattacatactacaacatgaatgaactttgaaaacatgctaagcaaaaggagccagtcaaaaagaccacatattggatgattccagttacatgaaatgtccaggactggcagatctataa

SEQ ID NO: 130402 - DNA, 601 bp, Human
acaatggccagaagccctggccctccctctactccttaccctgttaatcttggatggtaggattataggtgatttcttttttattttgctttattgtttcctgtactttatagattttctacaataagcatatgttactttgataatcaggaaaaaataaaaaatgtgtatacaattatttttaacttagcagtataactgtcaaaaattccttaattccattgctttggtactaatttgctgctaaccactagggttaaatgagactacctttgtatctaagcttgtctatgtataatawatttttaaccttgttctttttatgacttaagatttaattgaatatctgaaatatgctgtgggttttggagtaaaagtgtgcaagtgcctcctaactctcacagttgtcctgggaaacccacctggcacttggctcagtgccatgctccccatctaaacttaccatggttgaatgccagtgtgactaaagttgaccaaggtagatggtaacgattgtcttaagcttcattgaaaggagatcggaagtttctttttcaccaaaaatatttcttttgacatagaagtttaaaacatttcttta

SEQ ID NO: 130403 - DNA, 601 bp, Human
tagggttaaatgagactacctttgtatctaagcttgtctatgtataatatatttttaaccttgttctttttatgacttaagatttaattgaatatctgaaatatgctgtgggttttggagtaaaagtgtgcaagtgcctcctaactctcacagttgtcctgggaaacccacctggcacttggctcagtgccatgctccccatctaaacttaccatggttgaatgccagtgtgactaaagttgaccaaggtagatggtaacgattgtcttaagcttcattgaaaggagatcggaagtttctwtttcaccaaaaatatttcttttgacatagaagtttaaaacatttctttaaggaacatctgcttttattagatgtacatttaagaaatccttctcagtatagagataaaaagatgaataagacattgtacctgccctcagatggctcatagtccaagaacactgttcaattgtgaagtttgtgcacaaggtgggcacaggtcaagtagcaaatgaaggttaacatccagcccacatgctgcccaccaaggagtccaccctggtttgggactgaatctgccctgagtaaggttaccagattt

SEQ ID NO: 130404 - DNA, 601 bp, Human
caagtagcaaatgaaggttaacatccagcccacatgctgcccaccaaggagtccaccctggtttgggactgaatctgccctgagtaaggttaccagatttagcagataggaatataggatacttagttaaatttaaatttcagaaaaacatcacataattttttagcatcagcatatcccatattttggtcagacttatactcaggtatttctctagcaaccctaacgctgaacaagaggaagagggtgccttttagctcatacgaggtgctggggcttggggaaggaagcaagggtggcygcactcacccagatgattgcttttttctaatttgttcacctagggtgtgtgtgcgtgtgtgtgtgtgtgtgtgtgtgtgtgtgttttctgatccatgcagaagctaactggtgtccctgtcacaatccagggtgggagaaagatgtgaaaacatgatgcatagagttaggttttatatgttacgtggttccagtggaacataaaggaaagtgtggtccattttacctgagaagatgtgcaaatcattcacaaatagtagtttcggatcctggtcttgaaagatgagtaaaagggagattt

SEQ ID NO: 130405 - DNA, 601 bp, Human
gtgcacaccaccacacctgactaatctttatattttttgtatagacagggttttgccatgttacccaggctggtctcaaactcctgggctcaagcagtccacccacctcagcttcccagagtgctgggattacaggtgtgagccattacacccagcctaaatttttttaattaacgtacaatatgatacttgagaatttgaggatatgttctgtgtacttatcttaggcttcatatggcatagtttcactggagggaagaatagaaattcataagaaattataggcttcattttttctaartgactgaagcttaacctctttaaatatcaattattatactttagccttttttaagaggaaaaaaattgctacatacattcttagtgtctgaagcaaagtataataaactctatgttaatgaataaggaccatcataacaaaccataattgatgggtcagtattttcatgggtgggactcagcaggaactgttggaatatacaggattccgtcctggtgcctgttaggtagatacggtgtgccctgtttgttgagttttttgtaccttttctttttttagtggttttgctatcagctgtta

SEQ ID NO: 130406 - DNA, 601 bp, Human
agcattttaataaacaaatgctatggataaaaatcacagaggtaaaaattaaattagaaaggagaatattgacctgattagaacacaggggtcaatttagggtatatcaagctaaaagctgagataggtagggaaaatctactgtggatataagagtggggagtttggatttgctgattaatgtgtggtcatcttagttaagtttctaatgagagagcatgcacagaacccttcctttaaggtattaagaatactatggcatggtcagtacaactttatctttttctttttttttttttttggacaccaagttttgctcttgttgcctgggctggagtacaatggcacgatttcggctcactgcaacctccgcctcctgggttcaagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgtctcaatatcttcttaatttatttaaccttttctcctaagagcacagaggtcattatttctaggtaat

SEQ ID NO: 130407 - DNA, 601 bp, Human
cctttaaggtattaagaatactatggcatggtcagtacaactttatctttttctttttttttttttttggacaccaagttttgctcttgttgcctgggctggagtacaatggcacgatttcggctcactgcaacctccgcctcctgggttcaagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgyctcaatatcttcttaatttatttaaccttttctcctaagagcacagaggtcattatttctaggtaataaatctccctaactcaaattaagagatcagccattgctgatatggggcttgtgggggcaggggcaagagtggaccccaaatctagtttaaaattacacaaataaaaacagtagacagcaaagcatagtgaaaatagcaatgaggcctgaactgtagtttcagctccctcactggacatgagagcctcagacagatcactttacctctcaccccaggtttctcatctgcaaaat

SEQ ID NO: 130408 - DNA, 601 bp, Human
caaaccgacttaagtcctgtcctgatgaaggagaactagcaagaaatacagtaaatatagtaagtatatagtatgtaaaaggcgatccaaactggaggagggaaagggcaggataagggttggggagttgcagttttaaatggaggtatgtggggattgagttggcctgtggaaaagctgacattcaggcaggtccttgacttggagggaaaggcctgtgtggctatggaagggaagagcattccaggcagaggaatcctctctgtgtgccaggcatgccatgctgagtactgcaagggcrcagatggatgatacgtggtttctaccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgac

SEQ ID NO: 130409 - DNA, 601 bp, Human
gatggatgatacgtggtttctaccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgactcyctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagat

SEQ ID NO: 130410 - DNA, 601 bp, Human
agtatttccattcatagtttagctcttaaatgtgaattagctatccagcaatcaccagacacttgaggaaagcctccagaaaacaaattggaaaaaggggcaagtcataggaaacagacaaaacaaggaacagaagaaaacatcatttttgcaatctataatattcacaagtttgttttttgagacagagtctcactttgtcacccaggcaggagtgcagtggtgccatctcggctcactccagcctcaaactccttggctcaagcgatctgctcacctcaggctcccaggtacctgggaygacaggcatttgccaccacacccggctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaag

SEQ ID NO: 130411 - DNA, 601 bp, Human
tggtaggaagttagtaaatcatatttaaagctgaaaacaaaaatctaaaaccagtaatgtaacattattatttgaagataaggaagtaaatataagaagaaaagccaagagaattgaaaatggttgcctttgaagaaagggaactgagaatggtagcataagcctggcatagtttttaaactttttttaaaaaaatattttggggttaaaagtaaaaatgaaaaatattaaatgtgacaattatggaaagcactttagcccatgccttttacagttcagtgttgcataaatataaactcttattaccctgctccttctaaaaagtgtactaaagccttgtaaagccagcgccacatactttctattcatttcatcttttttccccaattcccaccatacatgtgccatgttggctctgaggaaggaattacatacatacacgtcagtatctttccatttgtttgtgtatcttcttgatttactaatccattgttttattgatgtgaatgagaaggagctgttcacatgttgccactttctgaatcatgtggttggtaccttttttcaggattttcaggaaaatcctgaattgttttcttct

SEQ ID NO: 130412 - DNA, 601 bp, Human
ccatacatgtgccatgttggctctgaggaaggaattacatacatacacgtcagtatctttccatttgtttgtgtatcttcttgatttactaatccattgttttattgatgtgaatgagaaggagctgttcacatgttgccactttctgaatcatgtggttggtaccttttttcaggattttcaggaaaatcctgaattgttttcttctgttttgcctaatcatttgcatcggcaagattaaataaaagtcttttgcaaattgtgttcaagcttactgtagtttcctaattagtcttattaygtacattttaacacattttctccctatgatcagggccgcaagcttcttatcattgggaccactagccgcaaagatgtccttcaggagatggaaatgcttaacgctttcagcaccaccatccacgtgcccaacattgccacaggagagcagctgttggaagctttggaggtaaaaatgagtcaatggattgcacactgtttataagaaaggaattgaggctgaaataagtagtaccacattatacctggtgtttggtttttatgctaatctggaacatgggacccggggatattacaggtt

SEQ ID NO: 130413 - DNA, 601 bp, Human; identical to SEQ ID NO: 34141

SEQ ID NO: 130414 - DNA, 601 bp, Human; identical to SEQ ID NO: 34142

SEQ ID NO: 130415 - DNA, 601 bp, Human; identical to SEQ ID NO: 34143

SEQ ID NO: 130416 - DNA, 601 bp, Human; identical to SEQ ID NO: 34144

SEQ ID NO: 130417 - DNA, 601 bp, Human; identical to SEQ ID NO: 19148

SEQ ID NO: 130418 - DNA, 601 bp, Human; identical to SEQ ID NO: 19149

SEQ ID NO: 130419 - DNA, 601 bp, Human; identical to SEQ ID NO: 19150

SEQ ID NO: 130420 - DNA, 601 bp, Human; identical to SEQ ID NO: 19151

SEQ ID NO: 130421 - DNA, 601 bp, Human; identical to SEQ ID NO: 19152

SEQ ID NO: 130422 - DNA, 601 bp, Human; identical to SEQ ID NO: 19153

SEQ ID NO: 130423 - DNA, 601 bp, Human; identical to SEQ ID NO: 19154

SEQ ID NO: 130424 - DNA, 601 bp, Human; identical to SEQ ID NO: 19155

SEQ ID NO: 130425 - DNA, 601 bp, Human; identical to SEQ ID NO: 19156

SEQ ID NO: 130426 - DNA, 601 bp, Human; identical to SEQ ID NO: 19157

SEQ ID NO: 130427 - DNA, 601 bp, Human; identical to SEQ ID NO: 19158

SEQ ID NO: 130428 - DNA, 601 bp, Human; identical to SEQ ID NO: 19159

SEQ ID NO: 130429 - DNA, 601 bp, Human; identical to SEQ ID NO: 19160

SEQ ID NO: 130430 - DNA, 601 bp, Human; identical to SEQ ID NO: 19161

SEQ ID NO: 130431 - DNA, 601 bp, Human; identical to SEQ ID NO: 19162

SEQ ID NO: 130432 - DNA, 601 bp, Human; identical to SEQ ID NO: 19163

SEQ ID NO: 130433 - DNA, 601 bp, Human; identical to SEQ ID NO: 19164

SEQ ID NO: 130434 - DNA, 601 bp, Human; identical to SEQ ID NO: 19165

SEQ ID NO: 130435 - DNA, 601 bp, Human; identical to SEQ ID NO: 19166

SEQ ID NO: 130436 - DNA, 601 bp, Human; identical to SEQ ID NO: 19167

SEQ ID NO: 130437 - DNA, 601 bp, Human; identical to SEQ ID NO: 19168

SEQ ID NO: 130438 - DNA, 601 bp, Human; identical to SEQ ID NO: 19169

SEQ ID NO: 130439 - DNA, 601 bp, Human; identical to SEQ ID NO: 19170

SEQ ID NO: 130440 - DNA, 601 bp, Human; identical to SEQ ID NO: 19171

SEQ ID NO: 130441 - DNA, 601 bp, Human; identical to SEQ ID NO: 19172

SEQ ID NO: 130442 - DNA, 601 bp, Human; identical to SEQ ID NO: 19173

SEQ ID NO: 130443 - DNA, 601 bp, Human; identical to SEQ ID NO: 19174

SEQ ID NO: 130444 - DNA, 601 bp, Human; identical to SEQ ID NO: 19175

SEQ ID NO: 130445 - DNA, 601 bp, Human; identical to SEQ ID NO: 19176

SEQ ID NO: 130446 - DNA, 601 bp, Human; identical to SEQ ID NO: 19177

SEQ ID NO: 130447 - DNA, 601 bp, Human; identical to SEQ ID NO: 19178

SEQ ID NO: 130448 - DNA, 601 bp, Human; identical to SEQ ID NO: 19179

SEQ ID NO: 130449 - DNA, 601 bp, Human; identical to SEQ ID NO: 19180

SEQ ID NO: 130450 - DNA, 601 bp, Human; identical to SEQ ID NO: 19181

SEQ ID NO: 130451 - DNA, 601 bp, Human; identical to SEQ ID NO: 19182

SEQ ID NO: 130452 - DNA, 601 bp, Human; identical to SEQ ID NO: 19183

SEQ ID NO: 130453 - DNA, 601 bp, Human; identical to SEQ ID NO: 19184

SEQ ID NO: 130454 - DNA, 601 bp, Human; identical to SEQ ID NO: 19185

SEQ ID NO: 130455 - DNA, 601 bp, Human; identical to SEQ ID NO: 19186

SEQ ID NO: 130456 - DNA, 601 bp, Human; identical to SEQ ID NO: 19187

SEQ ID NO: 130457 - DNA, 601 bp, Human; identical to SEQ ID NO: 19188

SEQ ID NO: 130458 - DNA, 601 bp, Human; identical to SEQ ID NO: 19189

SEQ ID NO: 130459 - DNA, 601 bp, Human
taacgtaaatagattcttcaatgtttcctaccaaccccactcggttatgaaaagccagcaatgcccatttcccccacagaacacaccacatgctcgcaaaacaaccagccttagcaactggatgcagagacaggcagagagagagacaaaagcgcctggctcctgaataggatgccttctcagaccctggcatttcaaaggcagtgaaagaaggtcatcctaggtactagtttctcaaagaaatacctgtagtaaggtaactattctagtcacctttatatagtaacggcttgtatctcargcaattcgccagtttttcaattaaaactgacacatattagggatttttacttctgccccccgctccccgcaattcggattctttctttagactccctgagcctctgtccccatcccaggatttgactgaagggctgcagagcccagggctgcgcgctaagcagccttctgctgaacctcagcggactgggccatagttcacacaccctccactccttctacagcagctcccgctgggggcaccgccaggatatccacatttgtccaaggtctgggaacccgggaggtttctaggagaccc

SEQ ID NO: 130460 - DNA, 601 bp, Human
tagtaagagcaagtaatctccaatttcttaaatgtgacaacaagaaattgtccttttaaaatattcagcattagcctttaaaaaaaaagcatcaaaacttttggtcatcaatttgcaaatgtaaggacacgcactcactctttgagaaacacatgtatagcttatgcttctatcccccgtctttggaacaacagggcatttaaaacaaatacagctgggagccgacaatgtaatgtgctgggcaaacatatactcccattaacgtaaatagattcttcaatgtttcctaccaaccccactyggttatgaaaagccagcaatgcccatttcccccacagaacacaccacatgctcgcaaaacaaccagccttagcaactggatgcagagacaggcagagagagagacaaaagcgcctggctcctgaataggatgccttctcagaccctggcatttcaaaggcagtgaaagaaggtcatcctaggtactagtttctcaaagaaatacctgtagtaaggtaactattctagtcacctttatatagtaacggcttgtatctcaggcaattcgccagtttttcaattaaaactgacacatattagg

SEQ ID NO: 130461 - DNA, 601 bp, Human
atgctagacacacagtaaagcacaaacaaaaggataaggatttgaaagcatatgactaatttgcggggtgtgtggcattgtattgtgtttgaaatctgtggaggtcggtggagggtagatggagctgaatctggaaaggtgggttgcagtcatgctgcctaccacaccattaatagccatcttgcaaatttctgtccttcacaagagtaagtcaactggtataaacatcactcttctataggggtaggggtgatggagataggaaagagtgtgggtgtagggctccaactcaataatcttyacattaaataaattactacttaataaaggatttttttaaaaccctacatttcaaaaatgtgtattacccttccccaaaacacaaaatgtggagctattctttattctgttttcaagcatatcacactatattctacttgacaatgtgcttaaaatttctatgcctcttttttttctcccaatgggacaatattttttccacctcaaggtctctgcacacacattgctttttctacctgctcttaaaatctctgcatccttcttacctgtcatctctcaacctgtggatcccagtgttgcc

SEQ ID NO: 130462 - DNA, 601 bp, Human
taaatgaaggcttctcagaggagatggcattttctctcagcttttcaaaatgagaataatttcataatttcaacaggtgaatgtagaagtgaggagaagatgctagacacacagtaaagcacaaacaaaaggataaggatttgaaagcatatgactaatttgcggggtgtgtggcattgtattgtgtttgaaatctgtggaggtcggtggagggtagatggagctgaatctggaaaggtgggttgcagtcatgctgcctaccacaccattaatagccatcttgcaaatttctgtccttcayaagagtaagtcaactggtataaacatcactcttctataggggtaggggtgatggagataggaaagagtgtgggtgtagggctccaactcaataatctttacattaaataaattactacttaataaaggatttttttaaaaccctacatttcaaaaatgtgtattacccttccccaaaacacaaaatgtggagctattctttattctgttttcaagcatatcacactatattctacttgacaatgtgcttaaaatttctatgcctcttttttttctcccaatgggacaatattttttccac

SEQ ID NO: 130463 - DNA, 601 bp, Human
caaaactcaacattttaatttagaagaccataatttgatctaaccttaatacaactaacaaataataaaattataattatcaaaaagttagcaacaggtattaatatgtagtaagactccaatgggtatggccttagaaaaccaacaccaaagagaaaatatcttccaaaaaataaaaagtgctttgaagaaaaatgttcccttgttttagtttagccaaaacagccaaaacaaacaagcatgtggtctttgtatgagcacatggtaatgacactaaaacagtagcgcacaaaaacagtgtttttttttttttttgatgactatttgctgtggattattttctgagacggtagacacttgtttccttacatagcaccttgtaagaaggaaggacacttttcttagaataactgatggatttcactatcacactggagcaaagcagtttatttctataggtgtacatgcatttctgctttttatattatgcattaacttgaaaacacattttaagtacctcactttccattccttatacatactgtaatttattttagttaaaatgttagtaagaagcccaggcacctgctgattaagcata

SEQ ID NO: 130464 - DNA, 601 bp, Human
gatctttgacaaacctgacaaaaacaagaaatggggaaaggattccctgtttaataaagggtgctgggaaaactggctagccataagtagaaagctgaaactggatcccttccttacaccttacacaaaaattaattcaagatggattaaagacttaaactttagacctaaaaccataaaaaccctagaagtaaacctaggcaataccattcaggacataggcatgtgcgaggacttcatgtctgaaacaccaaaagcaatggcaacaaaagccaaaattgacaaatgggatctaattaarctaaagagcttctgcacagcaaaagaaaccaccatcagagtgaacaggcaacctacagaatgggagaaaatttttgcaatctactcatctgacaaagggctaatatccagaatctacaatgaactcagacaaatttgcaagaaaaaaacaaacaaccccatcataaagtgggtgaaggatatgaacagacacttctcaaaagaagacatttatgcagccaaaagacacgtgaaaaaatgctcatcatcactggccatcagagaaatgcaaatcaaaaccacaatgagataccatctcaca

SEQ ID NO: 130465 - DNA, 601 bp, Human
gatgaatggaacagaacagagccctcagaaataatgccacatatccacaactatctgatctttgacaaacctgacaaaaacaagaaatggggaaaggattccctgtttaataaagggtgctgggaaaactggctagccataagtagaaagctgaaactggatcccttccttacaccttacacaaaaattaattcaagatggattaaagacttaaactttagacctaaaaccataaaaaccctagaagtaaacctaggcaataccattcaggacataggcatgtgcgaggacttcatgtctraaacaccaaaagcaatggcaacaaaagccaaaattgacaaatgggatctaattaaactaaagagcttctgcacagcaaaagaaaccaccatcagagtgaacaggcaacctacagaatgggagaaaatttttgcaatctactcatctgacaaagggctaatatccagaatctacaatgaactcagacaaatttgcaagaaaaaaacaaacaaccccatcataaagtgggtgaaggatatgaacagacacttctcaaaagaagacatttatgcagccaaaagacacgtgaaaaaatgctcat

SEQ ID NO: 130466 - DNA, 601 bp, Human
gatctgcagatagacttataaaagcagttgtggagtatgtgaacatttatttcttattatttctactttctcagacaaatagaagtaaggatatagctgagagtagaaatgggagaggagacataagaggtttgaagggaagtaaggtaagaaatatgatccagttaagtgaaaatggattttaaaaaagaaatgtaccaaggggccccctgaggttattgactgtgaatttaaagtaggaccaatgtgtctgcgtatttttcttcagccaaattcagccttgtaagtgcaggcaaatagyaggcaggcagatgggctaaacagttagcagatcttctcctaatcccagccccactcttcaaagctatgcaagctttttatttttgtttccgattcctcatctgtaaaatgaatgaatggataatattagtgtattatcgattactggataatttagtgtattaatgaatggataatgtagtgtacctaccacatgggtttgttgtgaagattaaatagtactcaatagacacagagtgtcatgcaggtagttgttaaatacattaataattatccaattattggacctcttcaaagagaa

SEQ ID NO: 130467 - DNA, 601 bp, Human
ttcttctgttttatagagacaagccactctgtccaaacacaaatacatgtgatgaaaggaatattcttcccaagtaaggaaacaccaagcattgccttctaatggtacccgaataccaactgagtactattagtgtttggctgaacatcaaatcacatggaatagttaacgtattaatactctcaattagaaacccaaatatatcgtcactataaaaagatgatcgcataaagggtactggttgggtaaatggtaggtttaaagtatttcgatgctaactttaccactttgtagtaaaaamtacaaatttattatgaaaatttgaatgccaaatactatacgggtaggataaggactgaaaacagaatcttgagtttgatcacttgcaggtcatgggtgaccgtgacaagaacagtttgttactggggacaaacacctgtttagaaagggtccaagagagaatgggagaaggatagttgcaatttctctttcaaagagttttgccagtaacagacaattaattcaatagctagagagaaatgcataaccaagaggggattcttttttaacatggggtaattatttaagatgttctaaatat

SEQ ID NO: 130468 - DNA, 601 bp, Human
tcattgaagagtttcctgagaaaagacactgcattcatgtctcgttgttgagccaagtagttacatgttaccccggaaaatctcaatggaagagataatattatcatgtctataaatttgttcatctactctaattgccagctctttgccatttgcttataccttaaaagctgtttgtcattttgacaaaaaattaacatagaaaaactaaaaacacaaatgtagaaacattaccttaatcatgtctgtgtaataggtaggtaaagaagaggtagaacatattatcaatacttgaaacccktaggtgtaaaaataaggaacaaatctatccatgaaaacgttccacatagagaaaatgaactatgataaacggcccttccaaagtttatgactatttctttctacataatgcttaaacttgagtgatatttatcattaagcaaactaatattttagtttgccaatgattatttgctatgatagtaattaaggagtctgaaaagcagccgttgcttaatcacaaatctattatatttaaatacaaagactaattctcagaaagaccattcatcttcttctgttttatagagacaagccactc

SEQ ID NO: 130469 - DNA, 601 bp, Human
cagaaatgattaaggtgctggtggcatttacttatgcagaaagattaatagggttaaacaattgtaagttggccaaatggtaagaggaataaaaaagccatgaacaaatatttaaagggcatgttgtatccaaggataagcaggaattatttacagaaattcaaagagataaaatgaggcatgtggtgtaataaaaagacattaagcaatgagaatcgcactattttaaaggctttttcaaaagaaagagaattgttggattctgaagaaaacaaacaagtaaatacccatccatcattgragagtttcctgagaaaagacactgcattcatgtctcgttgttgagccaagtagttacatgttaccccggaaaatctcaatggaagagataatattatcatgtctataaatttgttcatctactctaattgccagctctttgccatttgcttataccttaaaagctgtttgtcattttgacaaaaaattaacatagaaaaactaaaaacacaaatgtagaaacattaccttaatcatgtctgtgtaataggtaggtaaagaagaggtagaacatattatcaatacttgaaacccttaggtg

SEQ ID NO: 130470 - DNA, 601 bp, Human
tactgtctcaatgttctaagatctaattcatgagggactctacacagcgtgcaaaagaagaactgaaagctgagaggcatctatcaaattgtcttgttcaatgggttcattgcatagaggtctctgcgtgttaacagacctgcccaagttttccagccagtttgtgggagcacaaggcccagtgtgtctacctccagggctttaccagcaccgaccacaccatgaagagtggcagttttttgtggacctttgggctctagtaaggatagtggtaaataatactgatggaaatgtgtgagayaaaatgcaggtgaaatttggggtattttcttatattcaggttttaagaaaaaaaaaatcaacaggcctatctctggagatgccaatgagaatgttgcagaaaatttaaaaaagagaaggaatagcagtgtgaggctagtcaattatgatgacaccagttattgctaaaaaatggatattgcaaagtgctgtttccttttttaaaaagtgaacaaatagaaagacttagcttgtaaacgaatgttcctggggagattctgctggagaattcattataactactaccatagggcaaaagcaa

SEQ ID NO: 130471 - DNA, 601 bp, Human
tgtgtttgtttgcttgtttgtatgagtgtacggagtacaggtgcaattttgttacaggcatagattgcatagtgttgaagtcatggataccttaagtatccatcctacaaattaaaaccacaatgtaggtggccttctaatgtaacatataattcctctggcaaaggaatacactactgtctcaatgttctaagatctaattcatgagggactctacacagcgtgcaaaagaagaactgaaagctgagaggcatctatcaaattgtcttgttcaatgggttcattgcatagaggtctctgygtgttaacagacctgcccaagttttccagccagtttgtgggagcacaaggcccagtgtgtctacctccagggctttaccagcaccgaccacaccatgaagagtggcagttttttgtggacctttgggctctagtaaggatagtggtaaataatactgatggaaatgtgtgagacaaaatgcaggtgaaatttggggtattttcttatattcaggttttaagaaaaaaaaaatcaacaggcctatctctggagatgccaatgagaatgttgcagaaaatttaaaaaagagaaggaatagca

SEQ ID NO: 130472 - DNA, 601 bp, Human
ttcaggctgcatttaatgagcagctaacaggaagcatggagtctaagccaaccctaaagaaagggggtaaggcagagacagggagacaggcactgaacatagactgtcagcatctagaggacagtcctgttctccagagggccttttgtgtttgtttgcttgtttgtatgagtgtacggagtacaggtgcaattttgttacaggcatagattgcatagtgttgaagtcatggataccttaagtatccatcctacaaattaaaaccacaatgtaggtggccttctaatgtaacatataattsctctggcaaaggaatacactactgtctcaatgttctaagatctaattcatgagggactctacacagcgtgcaaaagaagaactgaaagctgagaggcatctatcaaattgtcttgttcaatgggttcattgcatagaggtctctgcgtgttaacagacctgcccaagttttccagccagtttgtgggagcacaaggcccagtgtgtctacctccagggctttaccagcaccgaccacaccatgaagagtggcagttttttgtggacctttgggctctagtaaggatagtggtaaataata

SEQ ID NO: 130473 - DNA, 601 bp, Human
tctagccttctttcaaaggaggcacttttaataaaaatctaatagctttagttctatgtttgaataatgcaacttattaaaattgagaacctcacttatttagtgcttctctctctcttccaaagaaagccagctgatactgttatctcaaactggttagtatccagtggtctcagttttctagttcatccaatgttgccatctagatcagcttgccagttttctggggttttttgtttgtttgtatattgctcttttccaatgaattctagtggctatttagaagcatgcatgctgttgytgaggaatatgttcaatattatctaccagaacttcagactgaagatctgaaattcctgtgaggcaatttgacattcatttaagttacagatcagagttgtggagactctaattgtggtgtgtgtgtgtgtgtgtgtgtggtcattcatgttagttagacctcttttcctaggcttgtcattatttccatatttcctcattgaagctttattctctttaaatgggttttaactttgcacctagtgtgactgctgttatgtacacaagctgtaatttttaaaaataattctgtacagattcg

SEQ ID NO: 130474 - DNA, 601 bp, Human
aaacccaactaatcaaacaaacagatacgcgaggagtttgtgcagaagaaatagaaaagtactactactaccatagattatatgacccaggaaaaattacttaacatctgtcagtttccattctttcgtttgaaaaataaagagaatattatctactttaaagggttttttaagctttactgagacataattaacatacaaaaatgcaattcattttgatgagtttggacatattcatatacttgtgataccatcaccacatcaaagtttttgtgaagttcaatgcagataatgatgaagyttgatgagctaagatattggttgctttatttttacttgaaaccataggaatatctcagttttatcaatttagcaacattcttagattattcaaaacaaaaagtgcttaaagaggaccatatacttagagccactctgagatgagaatatatacaagagtaggcaaggtcccccatcccaagaattctggcacctacattttagaggtttatcgctcccttttttttattatattattattttctgtccttatgctctttctctttctttttttaagcttcttggcttttcttgtgtctat

SEQ ID NO: 130475 - DNA, 601 bp, Human
tttcattgattggaaaagcacatgaggagcgtttcttgggggccgggtagtgctctattcttgatccgcatggtcttcacacaagtgtatttattcactctgtaaaaattaattaagttgtgtatgatttgtggacttcttttaatgtgcatgttatatctcaataatatttattttgaaagtgaaagagcattttgaatgtaaaaactgctatatttatgaaatagaattaaatgacctccatatcatcttcaatatataggttatttaataaatctgcccaagtgctctactctaggamttttgtgtatcttcaactttagtcttgcttgagaaatactgaaaggattttctcatcaaaataaaagaaatgccttttagaggagaaataaaagctaggaatggacagaaagaggattataatttttcccacaggttgggaagaacatttattctgttaggttgtctcctggattttatggtgtttcaaattttatgaaacaagaaaatataaagaaagtctttctgaaaaaaaaaatatggtggaattcctattattgaaatagcaacatttgcgagaaagggatgggagaagatgaac

SEQ ID NO: 130476 - DNA, 601 bp, Human
attgatatatagttttttcaagtaggcaagactaatatattgtgttagaagtcaagagagtggctgcttttagttttcattgattggaaaagcacatgaggagcgtttcttgggggccgggtagtgctctattcttgatccgcatggtcttcacacaagtgtatttattcactctgtaaaaattaattaagttgtgtatgatttgtggacttcttttaatgtgcatgttatatctcaataatatttattttgaaagtgaaagagcattttgaatgtaaaaactgctatatttatgaaatakaattaaatgacctccatatcatcttcaatatataggttatttaataaatctgcccaagtgctctactctaggaattttgtgtatcttcaactttagtcttgcttgagaaatactgaaaggattttctcatcaaaataaaagaaatgccttttagaggagaaataaaagctaggaatggacagaaagaggattataatttttcccacaggttgggaagaacatttattctgttaggttgtctcctggattttatggtgtttcaaattttatgaaacaagaaaatataaagaaagtctttct

SEQ ID NO: 130477 - DNA, 601 bp, Human
caattaaaactactgaaattgccaaagataccaaagggaacaattaaaaaaataaatacatataggagttaacagacacagattttaaaataactataattaatatatttaagaaaatcaagtaaatgatggagatataaccaaagaactgaattaatcaaatggaagttttaaaactggaaaaaaatataatactggaaaggtaaattcaatggatgagttcaatagcaagagaagaataaataattttaaaatgttttaattgaaaatagccaccctaaagcaaagaacataaaaaatrtataaaatctaaaaaagggagtaaaaacatgtgggacattatgataaagaccaaagaaagctggtgttattatactatagcaaataaaaagtaaacatgaaagtgaaaagcaatatattctgatataaggatatatctaccagtaagatataataatgttatattagcctataaagaatgaaggcaaaaactgacaggtctggaggaaatatagaaaaattcacaatcataatgggagatatttaatgcagtttgcttcagtaactgataaaaatggagaaaagaaagtaaattaaaaaa

SEQ ID NO: 130478 - DNA, 601 bp, Human
aaaaagaaaaaaaatcctcctcaaagacgataaaatcatagcttctatagttttctttctaaaatgtccaacactcaattaaaactactgaaattgccaaagataccaaagggaacaattaaaaaaataaatacatataggagttaacagacacagattttaaaataactataattaatatatttaagaaaatcaagtaaatgatggagatataaccaaagaactgaattaatcaaatggaagttttaaaactggaaaaaaatataatactggaaaggtaaattcaatggatgagttcaayagcaagagaagaataaataattttaaaatgttttaattgaaaatagccaccctaaagcaaagaacataaaaaatgtataaaatctaaaaaagggagtaaaaacatgtgggacattatgataaagaccaaagaaagctggtgttattatactatagcaaataaaaagtaaacatgaaagtgaaaagcaatatattctgatataaggatatatctaccagtaagatataataatgttatattagcctataaagaatgaaggcaaaaactgacaggtctggaggaaatatagaaaaattcaca

SEQ ID NO: 130479 - DNA, 601 bp, Human
ctgcttcaaaagtggaggaaggcaaaaagctgagaatcagagcaaagcttttggcaatccacaatgctaaggagacaaaaattagagttcaaggcttgccaataaagagtagccttggtaaacatccaggttttcagttggagcccctataaactatacgttagccaaaaatcaaactagaaatagacaagctagcacacacatacatgtgaaagccaatttcaaatatatttcatactacagtaaactggaatcttctgccccaactgtaataaaaagaaaaaaaatcctcctcaaagamgataaaatcatagcttctatagttttctttctaaaatgtccaacactcaattaaaactactgaaattgccaaagataccaaagggaacaattaaaaaaataaatacatataggagttaacagacacagattttaaaataactataattaatatatttaagaaaatcaagtaaatgatggagatataaccaaagaactgaattaatcaaatggaagttttaaaactggaaaaaaatataatactggaaaggtaaattcaatggatgagttcaatagcaagagaagaataaataattttaaa

SEQ ID NO: 130480 - DNA, 601 bp, Human
gaaatgagtattgacagaaatacccatctctgtcacagattttattaaaacttagagtggaatatggatttactcagtgggtaatgttctgaaagatcaaatcaaataaaaagctagtcaatatttttcttccaaaaaattcaaagaatttacatacaaatttggtgctgaagacttggtcatgagctttatataagaaaaacatcctctctatttttgtcaagatatttgatagtctttctatatttaagaagtagggacccaaaatggaaataatatttcctaatagccagtttctctragaattatgacttaaaattttcacttctagttataaccaactatcaagcataagaccaacactcctaccatatgtgaaagctagatatttttaaaaacaagaagagaaaagaaagaaaattggttgatggcactggagagcttccaaggcaaccaggagttaaggggccaacattttggaagaaaggaaaacatatggagatgagcactgtgttgtacattactctttctctcaagaatttgctgcttcaaaagtggaggaaggcaaaaagctgagaatcagagcaaagcttttggcaat

SEQ ID NO: 130481 - DNA, 601 bp, Human
ctgacctcaagtgatccacctgcctcagcctcccaaaatattgggattacaggcatgagccatggcaccttgagttttctatttttagatgagggatcttcaaacagtaagaatagtgcaaatattcaaaaatattttaaaaatctgaaatctgaaacacttttggtcctaagcatttcacacaagagatactcaacctgtataaaggcatgaaacatacaacacacacacacacacacacacacacacacacacacacacatatccccagaaatgagtattgacagaaatacccatctcygtcacagattttattaaaacttagagtggaatatggatttactcagtgggtaatgttctgaaagatcaaatcaaataaaaagctagtcaatatttttcttccaaaaaattcaaagaatttacatacaaatttggtgctgaagacttggtcatgagctttatataagaaaaacatcctctctatttttgtcaagatatttgatagtctttctatatttaagaagtagggacccaaaatggaaataatatttcctaatagccagtttctctaagaattatgacttaaaattttcacttctag

SEQ ID NO: 130482 - DNA, 601 bp, Human
tgccaccacgtccagctaatgtttgtatttttagtagagacaagttttcatcatgttggccaggctggtattgaactcctgacctcaagtgatccacctgcctcagcctcccaaaatattgggattacaggcatgagccatggcaccttgagttttctatttttagatgagggatcttcaaacagtaagaatagtgcaaatattcaaaaatattttaaaaatctgaaatctgaaacacttttggtcctaagcatttcacacaagagatactcaacctgtataaaggcatgaaacatacaacacacacacacacacacacacacacacacacacacacacatatccccagaaatgagtattgacagaaatacccatctctgtcacagattttattaaaacttagagtggaatatggatttactcagtgggtaatgttctgaaagatcaaatcaaataaaaagctagtcaatatttttcttccaaaaaattcaaagaatttacatacaaatttggtgctgaagacttggtcatgagctttatataagaaaaacatcctctctatttttgtcaagatatttgatagtctttctatatttaagaa

SEQ ID NO: 130483 - DNA, 601 bp, Human
tgtgccaccacgtccagctaatgtttgtatttttagtagagacaagttttcatcatgttggccaggctggtattgaactcctgacctcaagtgatccacctgcctcagcctcccaaaatattgggattacaggcatgagccatggcaccttgagttttctatttttagatgagggatcttcaaacagtaagaatagtgcaaatattcaaaaatattttaaaaatctgaaatctgaaacacttttggtcctaagcatttcacacaagagatactcaacctgtataaaggcatgaaacatacaacacacacacacacacacacacacacacacacacacacacatatccccagaaatgagtattgacagaaatacccatctctgtcacagattttattaaaacttagagtggaatatggatttactcagtgggtaatgttctgaaagatcaaatcaaataaaaagctagtcaatatttttcttccaaaaaattcaaagaatttacatacaaatttggtgctgaagacttggtcatgagctttatataagaaaaacatcctctctatttttgtcaagatatttgatagtctttctatatttaag

SEQ ID NO: 130484 - DNA, 601 bp, Human
taggttgagcattcctaatttaaaaatctgaaataaaaaatgctccaaaatctgaaacttcttgaacactgacatgatgttcaatggttatgctcaaagtaaatgttcattgaagcctttaggatttttaatttattttattttttattttttggagacagagtcttactctgttgcccaggctggagtgcagtggtgcagtctcggcttactgcaaactctgcctcccgggttcaagtgatcctcccatctcagcctccttagtagcttgggaccacaggtgtgtgccaccacgtccagmtaatgtttgtatttttagtagagacaagttttcatcatgttggccaggctggtattgaactcctgacctcaagtgatccacctgcctcagcctcccaaaatattgggattacaggcatgagccatggcaccttgagttttctatttttagatgagggatcttcaaacagtaagaatagtgcaaatattcaaaaatattttaaaaatctgaaatctgaaacacttttggtcctaagcatttcacacaagagatactcaacctgtataaaggcatgaaacatacaacacacacacacacaca

SEQ ID NO: 130485 - DNA, 601 bp, Human
ttacaacaaaaatactagtagtattagtagcataggttgagcattcctaatttaaaaatctgaaataaaaaatgctccaaaatctgaaacttcttgaacactgacatgatgttcaatggttatgctcaaagtaaatgttcattgaagcctttaggatttttaatttattttattttttattttttggagacagagtcttactctgttgcccaggctggagtgcagtggtgcagtctcggcttactgcaaactctgcctcccgggttcaagtgatcctcccatctcagcctccttagtagcttgggaccacaggtgtgtgccaccacgtccagctaatgtttgtatttttagtagagacaagttttcatcatgttggccaggctggtattgaactcctgacctcaagtgatccacctgcctcagcctcccaaaatattgggattacaggcatgagccatggcaccttgagttttctatttttagatgagggatcttcaaacagtaagaatagtgcaaatattcaaaaatattttaaaaatctgaaatctgaaacacttttggtcctaagcatttcacacaagagatactcaacctgtataaa

SEQ ID NO: 130486 - DNA, 601 bp, Human
agaagaaaagggttctgatccatagacatgtggaaagatttacctaggtcctgggtttgccccgctcaccatatgtgcctagagtgtgacaactcacaaatgctctcacatgcattatctcattcaagttttacttgtgagttaagcagaatagatagaattataaacttagttgagaaataaggatattaagattagagcagccgagtcacttattcaaaagcacacaggtctaatgtggaagagctctgcaaatagaggtctatttggggtgtggccaaagctggcagcagcatcacartgaaccacaggcttcagagaagaatactcagatttcttgtcagggctactccagtctttgcagggtgcttatgagtaagaatacacctgttgcccagagttatagcagcctggagtaagagatatgctgtttccaacctctcttgtgaactttaagagctaagtcataattagatcccacacaaatctttattagagactttttcaggtaagctcataggtttttaacattctggaaggtggtttgataatctacaactttgttgctgccaggaaataaacttggaaagtgaaagaataa

SEQ ID NO: 130487 - DNA, 601 bp, Human
actccctggctattagatcactcctcagcaagcctatgggtcatatccgcagactttgtgttctaatattcagattttctcatagtgtgactccaactccgcaatggagaaaaacataatgagaggcagcaaaaggctccaaaaagaaaacattaatgcttttaacagcggggaatctgagtggaaaggaaatcccttctttcctgtcacttagggatgaaggaagagttgaaaaatataatagatcctttcctacagcctcagataagcaattttttggagggcatatgtgtacctacaygcacgcaggcagacatgtatatctgtgtgtgtgctttatctacaatgatgcaatgctgcatcaacagtaatcaataaaaccaattaggagagttatttctcatcaggctctgacaatgactcaccatgagaccataataggggatttcacagttttgggccttatctatgttttggggtaactttatctataaaataagatgactgaactgataatcattgaaactgcttctaggcaagacataagaaaatatactagagacaaataaggataagaaagatggaagtaagtaacaaataa

SEQ ID NO: 130488 - DNA, 601 bp, Human
gatactgcacaaagatatacctatgggttctcatacccatgtactgcttggttctccaagggtattcatacccatttgcaaagtttgctagctagcagaaacctcccttccctttctttttactattaaggtggggcaatagcagtgcctgaatatttttctcattttgtgttcatatcatcaagtcagtatcaaataaatatcttgcctttttcttgccccaaatcaacgcttcccataccaccaaggacagtttcagatgatggcactcacactaaggtgctgtggcttttgcattgcrtttgcctgaactccatagctccctcttctatgccccccactctgtacatttcacctctcacctaccatcactccctggctattagatcactcctcagcaagcctatgggtcatatccgcagactttgtgttctaatattcagattttctcatagtgtgactccaactccgcaatggagaaaaacataatgagaggcagcaaaaggctccaaaaagaaaacattaatgcttttaacagcggggaatctgagtggaaaggaaatcccttctttcctgtcacttagggatgaaggaagagttg

SEQ ID NO: 130489 - DNA, 601 bp, Human
agtcaccttcaactttgcctttccagcacaatttgcatttgcatcgagaagcatagcatggaaaaagaaaaaaaatattaattctactgtaaccttagacaacaaaataaaatagatgaaaacattttttgccctcatttaagaatcacataaagaatattagttcatccaatatggagacatgtttcaaatcattaaatctggaactcttaaattatttgctgaatatatcctcagtaattcaacttttgaaattctgttaatattaatatccatctctggacttccttaaataaaggtytaagtgtacatccttttcttgtcatgttaatgtgggtatatgcttcagagatcttacctaagtcattaaattcctaatgactgtttgggaaagatcattttacaaggtatattaagtaacatttttaaagaaatcattggattttcaacagtttctgaagtttgataatgtaattttcttacaaatgcctttagtcctttataagtataaagtaaggatgtcaatttcagtatataaatccaggcaaagcataaagaaatactttatgtatttcatctccattcctccagttacttccta

SEQ ID NO: 130490 - DNA, 601 bp, Human
cctctgtgttagtgaaagtgctttcactaaacacaacagctcaacccaacctttcctggcttttttttttttcacactttttatcttgcagagatatggaaagatatttaagaaagagtgacaataatatcaggcttcttttgcatttggaatagccctttagagttttaaaggtgatttcatataccttaactcatttgagatttaacaactcctgctaagattggattgtatctacattatgattaaaataacttacaaatatacaaatatggaagagaagatagaaaaatgaaaatgkttaggtgagagaaaaggtaaagctttaaattcacctttgtgtgattattgtcatgatactttatttagcttgctggtgcttctaattgaagaaacaccacctgtataggccatagacataaaatattagcagtagatagcatctcaggaattatctattagtccaatgaactcccccagtcagggcaactgactgagacttatccttgtcctaagtacaaagaagcagtctcagaaacacaaagtcctgccccacacccagcgctacagctgcgaagttgacaaagaaatttccgctccc

SEQ ID NO: 130491 - DNA, 601 bp, Human
tctacagcttccaaaaaggatcagagccctactgacaagtcaattttagcctggcgagatccacgtcagaattttagcccacagaactataagataatcagtttatgttctttcaagccattaagtttgtaatgacttattgttacagcagtgagaaaccaatacacctgacaagattcttagcatctcatggggagggtctgtgttttctttgactcccagaggcatcataaggcaggtcctctgtgttagtgaaagtgctttcactaaacacaacagctcaacccaacctttcctggcttttttttttttcacactttttatcttgcagagatatggaaagatatttaagaaagagtgacaataatatcaggcttcttttgcatttggaatagccctttagagttttaaaggtgatttcatataccttaactcatttgagatttaacaactcctgctaagattggattgtatctacattatgattaaaataacttacaaatatacaaatatggaagagaagatagaaaaatgaaaatggttaggtgagagaaaaggtaaagctttaaattcacctttgtgtgattattgtcatgatact

SEQ ID NO: 130492 - DNA, 601 bp, Human
aaagatggccaagtgtccaaatcttgggaggtctgttaattatacaaaaaatgaattgcatcctaagaatatttgaggtcagtagattaaagcaggcagtggcaagatcatacgtagacaggtgaactatcactctggtcactggatgttgggtatgatgcatgcagttaagatgccatacccatgaccctgcagtagatgccagatcctttctcagaggctggacagtgacaaggacttaattgtgagagtaatgtgggaggcaggatggtaggattttaatagaggcttgttctctgcrtgggctgcctgctattgaaagccagtctctgcatcttttcaaatggctagttcctattcaccctgtcatcacctctctgtccatgattgcctctggcaggtttttcctgctcctgcaccttgagctgcatgaagtcagcctgggttgtaccatcacaatattctgcagccaagtgctgctatggcattaaccatgatgtattgtgattatgtgtccatgtgattgctttgctgtggtggagagaacaatggctccctgaaagcacctacattcttatacctgaagtgtgtgactgtgtta

SEQ ID NO: 130493 - DNA, 601 bp, Human
tatccaattacttggcagacttacaggagaactgataagattaccaatagctaattttcaagatgtctagagtttgcatagcaaggaaaataaaataatagggaattgaacacaacacaatccaaagatgcaaaagaagcatcttttcaattttttttgattatttaaaaatgtgtcccttatctaaactcttaattttcccctaaggaaaagtgccttatattacctaaaaaatttttgttatgaagatttccatgtaggttcccactgtacattctttgaaaagtgttttagaaacaarcaaaaaaataggcctcatccttattgtttaccatttagccacatatattatttgggcatcagaaaggcctagtaaaagctaattaagatcaaaacattcttaacttgataattcttttaacagcagagaggaaatccctgggccttgtaattacatgggccattgaacatgtgaagtaaaaggaattaagcttgttatgactcactaccacgtccccaaaataccccaaacccagtgttatatggctaaagggaaaatgaatttgcagaaaacaaggaggtagtttgtcccatattcatc

SEQ ID NO: 130494 - DNA, 601 bp, Human
agagaacttctgatacatgcttcagatggagaatatcagaaatagagaaagaagttgagaggtgagagctctataaataaatacagagaatgagagtgtgcatgttagaggtacgaagatgtgacatagcaaaaaacaagaaaagctatccaattacttggcagacttacaggagaactgataagattaccaatagctaattttcaagatgtctagagtttgcatagcaaggaaaataaaataatagggaattgaacacaacacaatccaaagatgcaaaagaagcatcttttcaattttwtttgattatttaaaaatgtgtcccttatctaaactcttaattttcccctaaggaaaagtgccttatattacctaaaaaatttttgttatgaagatttccatgtaggttcccactgtacattctttgaaaagtgttttagaaacaagcaaaaaaataggcctcatccttattgtttaccatttagccacatatattatttgggcatcagaaaggcctagtaaaagctaattaagatcaaaacattcttaacttgataattcttttaacagcagagaggaaatccctgggccttgtaattac

SEQ ID NO: 130495 - DNA, 601 bp, Human
tacaaatatacatatgtatacacacacatatataaatatacatataaaattagaaacttaacccaatcagaaatttaacaatgttcacacagttagaaagttgtaaatctaggtttttgatccaagctgctgaatgtagtagtaaataatcacacagttttaatttattccaccaatcacagagagaacttctgatacatgcttcagatggagaatatcagaaatagagaaagaagttgagaggtgagagctctataaataaatacagagaatgagagtgtgcatgttagaggtacgaagwtgtgacatagcaaaaaacaagaaaagctatccaattacttggcagacttacaggagaactgataagattaccaatagctaattttcaagatgtctagagtttgcatagcaaggaaaataaaataatagggaattgaacacaacacaatccaaagatgcaaaagaagcatcttttcaattttttttgattatttaaaaatgtgtcccttatctaaactcttaattttcccctaaggaaaagtgccttatattacctaaaaaatttttgttatgaagatttccatgtaggttcccactgtac

SEQ ID NO: 130496 - DNA, 601 bp, Human
agcaagatgtccaggcccagagccacatgtacttctgcctgccttgctcagacatctgcagcactgactccggataagacgggattgggggtggaggaggaaagaacttgaagtaggggcaaaggtggagccagttaccctctcaccagctccctgagttggataaggtgccttacctttcaagagccttttttttttcttattgataagaagacaaggggaataatgtctaccccatcaaggtaggatcaccaagatccagtggatggtggtttcagaactgttatctggcccttagtayaggctaagccgaggttaaaactttttcttcttttgctatttattttcactgtaccttttacaggaaattaagtttgaattcataattcacatcttttgtgaaactggcaaccataatacagagaggtgagtattttgtgtgaggagacccactaccctttgctttgtacctcttcttctataatagcccctgtagtctagttaccttgctccaaatgcctgggccctcacatcacattggccttccctgtctccagttgtgaggaatataacccaattccagatgtgccctctggagatg

SEQ ID NO: 130497 - DNA, 601 bp, Human
ctctaagtccctccaggaaaatgaaatctatagctcctaaggtcatcccagaaaggcagaactttaaataaaaatcctcagatctcggcaagaacagcagaaaataggttacaacaatatggggtgtatccacaatgctctactctcacacaacctccatgtgggaacaaaatgtttcccagtcaaggagcagaatttacgcttctgtacgttcatggaagcagacaggtcaaggggtcctgtagctgcgcattaccttggtgatgccacacacagcaagatgtccaggcccagagccacrtgtacttctgcctgccttgctcagacatctgcagcactgactccggataagacgggattgggggtggaggaggaaagaacttgaagtaggggcaaaggtggagccagttaccctctcaccagctccctgagttggataaggtgccttacctttcaagagccttttttttttcttattgataagaagacaaggggaataatgtctaccccatcaaggtaggatcaccaagatccagtggatggtggtttcagaactgttatctggcccttagtacaggctaagccgaggttaaaacttttt

SEQ ID NO: 130498 - DNA, 601 bp, Human
cacattgttcttggaaaacggactaacgctgactgcccaggacttgtaaaaacctttctgtctgctttgctctgcagtgtgccagggagaaccatttggggacctctgttcctctaagtccctccaggaaaatgaaatctatagctcctaaggtcatcccagaaaggcagaactttaaataaaaatcctcagatctcggcaagaacagcagaaaataggttacaacaatatggggtgtatccacaatgctctactctcacacaacctccatgtgggaacaaaatgtttcccagtcaaggarcagaatttacgcttctgtacgttcatggaagcagacaggtcaaggggtcctgtagctgcgcattaccttggtgatgccacacacagcaagatgtccaggcccagagccacatgtacttctgcctgccttgctcagacatctgcagcactgactccggataagacgggattgggggtggaggaggaaagaacttgaagtaggggcaaaggtggagccagttaccctctcaccagctccctgagttggataaggtgccttacctttcaagagccttttttttttcttattgataagaagaca

SEQ ID NO: 130499 - DNA, 601 bp, Human
aaaagtgtaatagttcagttctgatataatttttaacttatgcgagggcttcagtactagataggaacaactgcttttctgcatatttcagagccttgctgaggaggtttgggtgcttttgtctcatgactttctttctttcttaagcagtccacacctgtagcacacctctaagtttaataagtgaaaagcatttcctgtcttacctgaaaaaaaaaacacattgttcttggaaaacggactaacgctgactgcccaggacttgtaaaaacctttctgtctgctttgctctgcagtgtgscagggagaaccatttggggacctctgttcctctaagtccctccaggaaaatgaaatctatagctcctaaggtcatcccagaaaggcagaactttaaataaaaatcctcagatctcggcaagaacagcagaaaataggttacaacaatatggggtgtatccacaatgctctactctcacacaacctccatgtgggaacaaaatgtttcccagtcaaggagcagaatttacgcttctgtacgttcatggaagcagacaggtcaaggggtcctgtagctgcgcattaccttggtgatgccaca

SEQ ID NO: 130500 - DNA, 601 bp, Human
aggtagacccagggcgaagacagcatctacaagccaaggagagaggcctcaggagaaatcaagcatgccagtgccttgatcttgaccttgcagctttcagaactgtgagaaacacatttctgttattgaagccaccaagtctgtgatactttgttaaggtagccccagcagactaatagaggaattgccatttaaaaaaaataaagttcaactgccacgttcaccgatttagagacaaaaccgccttcacttcagaggactatgtagctaactatgagaaaaatctgagttgtagcacccrgctcccaggatagtttttgccttttctcattcactaaagtatttgaagaaaggaatttgatattcactttctgtctcaacatttaagtactatgatatgttttctagatttttaagtttaatggaattgtagagctattttatggccctgattttactcatgtgaaatataaataaatgaaaaaaaataaccagacatatttataaacccacgtctgaagaaatccatccatctccacattgggaaatagactgcaaaccactcatcaagcaaaacgtcaagctgatgttttgtcagata

SEQ ID NO: 130501 - DNA, 601 bp, Human
tggtatccttatggaagaggagattaggacctcagacaactacaggtaaaagaccacaggtagacccagggcgaagacagcatctacaagccaaggagagaggcctcaggagaaatcaagcatgccagtgccttgatcttgaccttgcagctttcagaactgtgagaaacacatttctgttattgaagccaccaagtctgtgatactttgttaaggtagccccagcagactaatagaggaattgccatttaaaaaaaataaagttcaactgccacgttcaccgatttagagacaaaaccgscttcacttcagaggactatgtagctaactatgagaaaaatctgagttgtagcacccggctcccaggatagtttttgccttttctcattcactaaagtatttgaagaaaggaatttgatattcactttctgtctcaacatttaagtactatgatatgttttctagatttttaagtttaatggaattgtagagctattttatggccctgattttactcatgtgaaatataaataaatgaaaaaaaataaccagacatatttataaacccacgtctgaagaaatccatccatctccacattgg

SEQ ID NO: 130502 - DNA, 601 bp, Human
ttgaagtcttaaccagaatgaactacatttgcagacagagcccttaaagacataattaagttaaaatgaggtcattaggttgggccttagtccaataggtctggtatccttatggaagaggagattaggacctcagacaactacaggtaaaagaccacaggtagacccagggcgaagacagcatctacaagccaaggagagaggcctcaggagaaatcaagcatgccagtgccttgatcttgaccttgcagctttcagaactgtgagaaacacatttctgttattgaagccaccaagtctrtgatactttgttaaggtagccccagcagactaatagaggaattgccatttaaaaaaaataaagttcaactgccacgttcaccgatttagagacaaaaccgccttcacttcagaggactatgtagctaactatgagaaaaatctgagttgtagcacccggctcccaggatagtttttgccttttctcattcactaaagtatttgaagaaaggaatttgatattcactttctgtctcaacatttaagtactatgatatgttttctagatttttaagtttaatggaattgtagagctatttta

SEQ ID NO: 130503 - DNA, 601 bp, Human
ttacacattgtagttatgtatctaaatatcacatgccccagaaatatgcacaatctttatgtatcaaaaaattaacaataaaaatgcttgctatagatacaaattgttaacatctggtcattttaatccaggtggttagtggaaagctttggagagaaagtgagatgaaattgagtcagagatggccaagatgtggatgatggaatgaagtacctttttcaggtaaggagatgtcctcctgggaggaagtccaaagtattttttgaagacagatgggtttggaggctttggggataacagyaggtgaggctgatggcagtctgcaggcagctctgggcacgcatgaaactcaagctaaaagtctgcacactgaacatcagagaaatagtaaacatattttctcagctttttctcaagaagtgacccatcggagtcacattttagagaacactgggaactgctggtagcggtaacctattcttcactcaatagatgattggtaaaataaatgttaaaattttaacctgaaaaagtactggactgtatttctaaatttctaattctgaaatgttaagcttttctgtggagaatggtagcattt

SEQ ID NO: 130504 - DNA, 601 bp, Human
cacggagatagcagaatggtggtttgcaggggctgggaaggagtaggggtaaataatgaagaaaggttgtttaatgggcacaaaaatacagttaaatagaaggaataaggtccagtatttgatagcacattagggtgactatagttagcaataatttattgtacatttcaaaatagtaggaagaaagatttggaatgttccccacacaaagaaatgataaatgtttgaggcaatggatatcctagttaccctgatttgatcattacacattgtagttatgtatctaaatatcacatgcccyagaaatatgcacaatctttatgtatcaaaaaattaacaataaaaatgcttgctatagatacaaattgttaacatctggtcattttaatccaggtggttagtggaaagctttggagagaaagtgagatgaaattgagtcagagatggccaagatgtggatgatggaatgaagtacctttttcaggtaaggagatgtcctcctgggaggaagtccaaagtattttttgaagacagatgggtttggaggctttggggataacagtaggtgaggctgatggcagtctgcaggcagctctgggca

SEQ ID NO: 130505 - DNA, 601 bp, Human
agaaaatgtgatgtaaatatatttcatatatatgtgtgtatatatatatatatatacacacacacacacatacacacatgcacatatataatggaatttatataatatacaatgaaatattattcagccatacaaatgagtgaaatcccttcatttgcagcaacatggatggaactggaggaccttatgttaagtgaaataaggcacagaaagacagatatctcatattcttgtgggagctaaaatagttgatctcacggagatagcagaatggtggtttgcaggggctgggaaggagtakgggtaaataatgaagaaaggttgtttaatgggcacaaaaatacagttaaatagaaggaataaggtccagtatttgatagcacattagggtgactatagttagcaataatttattgtacatttcaaaatagtaggaagaaagatttggaatgttccccacacaaagaaatgataaatgtttgaggcaatggatatcctagttaccctgatttgatcattacacattgtagttatgtatctaaatatcacatgccccagaaatatgcacaatctttatgtatcaaaaaattaacaataaaaa

SEQ ID NO: 130506 - DNA, 601 bp, Human
ttaagatccaaatctactaggaagtttaaggtattttcttccttaaaacatttacagctttatgtggccatcaggttggattatatggaaaacagctcagcatcaaaaaacactttatagtaatttatatgatgtcactggccaaggaagatgatcatcctttagaagtaactataaaaatgcttgctatgaagaacaagctagaggcatcacactgcctgacttcaaaatatactacaaagccatagtaactaacactgcatgatactggcataaaaacagacacatagaccaatggaayagaatagagagcccagaaatgaatccacacatttttgttcacaaactcatttttgacaaaggcaccaagaaaacacttggggaaaaggacactttctttaataagcagtgctaggaagactggatatccatatgcaaaaccatagatccccatctctcactatattaaaaaatcaactgaaaatgtattaaagatttaaatgtaatacgtaagacctgaaactttaaaactaccagaagaaatcattaaagaatttctcaggacattggtctgagcaagaattttggggttaagacctca

SEQ ID NO: 130507 - DNA, 601 bp, Human
tacccaaaagcctttttttgtgtgtgtaactgatgtggcacaggcctctgaaaaaaaaaaaaaaaactgcagggtcctggagaaccataggccagagaaacctggagctgcaaagaaggacaagatctggaaggtttgcagctagccctcaatgaaccaggtttcaagtgaatgccatgaggaaactgaaagtcaaaactttaaaataccacactcaggaacaccacctaactatcatattcccatgcctgtttttggtttcctttaattttatagtacagctttgcaggggatagaaaayctaatatttcaaaccagttttaaaatttcaggttaatgcttcaggacatgtttgtgaaaaccaaacaaaaactcctcctttaatttcagctctatgaaaagacagtgttaagatccaaatctactaggaagtttaaggtattttcttccttaaaacatttacagctttatgtggccatcaggttggattatatggaaaacagctcagcatcaaaaaacactttatagtaatttatatgatgtcactggccaaggaagatgatcatcctttagaagtaactataaaaatgcttgctatgaa

SEQ ID NO: 130508 - DNA, 601 bp, Human
ttttggcacactcctttcgaatggcataggtagccactgaattccttatccctaggggttctatatttttacattcatgcttcttgctcagtacatgaagtttccctttacccaaaagcctttttttgtgtgtgtaactgatgtggcacaggcctctgaaaaaaaaaaaaaaaactgcagggtcctggagaaccataggccagagaaacctggagctgcaaagaaggacaagatctggaaggtttgcagctagccctcaatgaaccaggtttcaagtgaatgccatgaggaaactgaaagkcaaaactttaaaataccacactcaggaacaccacctaactatcatattcccatgcctgtttttggtttcctttaattttatagtacagctttgcaggggatagaaaacctaatatttcaaaccagttttaaaatttcaggttaatgcttcaggacatgtttgtgaaaaccaaacaaaaactcctcctttaatttcagctctatgaaaagacagtgttaagatccaaatctactaggaagtttaaggtattttcttccttaaaacatttacagctttatgtggccatcaggttggattata

SEQ ID NO: 130509 - DNA, 601 bp, Human
tgggaaaggcactactcagcgcacattttggcacactcctttcgaatggcataggtagccactgaattccttatccctaggggttctatatttttacattcatgcttcttgctcagtacatgaagtttccctttacccaaaagcctttttttgtgtgtgtaactgatgtggcacaggcctctgaaaaaaaaaaaaaaaactgcagggtcctggagaaccataggccagagaaacctggagctgcaaagaaggacaagatctggaaggtttgcagctagccctcaatgaaccaggtttcaartgaatgccatgaggaaactgaaagtcaaaactttaaaataccacactcaggaacaccacctaactatcatattcccatgcctgtttttggtttcctttaattttatagtacagctttgcaggggatagaaaacctaatatttcaaaccagttttaaaatttcaggttaatgcttcaggacatgtttgtgaaaaccaaacaaaaactcctcctttaatttcagctctatgaaaagacagtgttaagatccaaatctactaggaagtttaaggtattttcttccttaaaacatttacagctt

SEQ ID NO: 130510 - DNA, 601 bp, Human
agaaagaggcgaggtgattcagaaacagatcctctttccactttcccccgactctcccaaatgtacatttaagtccttcactttaattggatttatggtttgtagctttggcatcagagccatacttttaatttctaaaaaaagaaaatgctgggaaaggcactactcagcgcacattttggcacactcctttcgaatggcataggtagccactgaattccttatccctaggggttctatatttttacattcatgcttcttgctcagtacatgaagtttccctttacccaaaagccttttyttgtgtgtgtaactgatgtggcacaggcctctgaaaaaaaaaaaaaaaactgcagggtcctggagaaccataggccagagaaacctggagctgcaaagaaggacaagatctggaaggtttgcagctagccctcaatgaaccaggtttcaagtgaatgccatgaggaaactgaaagtcaaaactttaaaataccacactcaggaacaccacctaactatcatattcccatgcctgtttttggtttcctttaattttatagtacagctttgcaggggatagaaaacctaatatttcaaacca

SEQ ID NO: 130511 - DNA, 601 bp, Human
ttaatatatgaataaatacatccaaaaggacaatgaaatgtccaatactcctagctatcctgtgtaagaatcaactctcccacaaagtaatgcattccctgtcgctgaaagtgttcaagcagttggatggtcatttgctacaggaactgggaagggaattgctgctttgaaaaaaatcttgagaaaaaaagcataccttatttaaacggtggaaatgtattatcatttaaaaagcactagtttaggatccctgtctccctgcctaatcttgaccaaacacacacacagacacatacatacccacacacacacacacacacacagagtaaagtatggcaaacgctgcccctttcttcttaggggcttgactatgaataattagtaagtgaggaagggtggacatgagtgaaggaatggagaggagaaaaggaaacagtttcttataaaattgttaaaagaaaacagacagaccttgcttattagagcaaaagtttaaaaacatggaaacctattgcagtcaaaagtttgagaatgttttgatacttcataaagcaaactgtgagatgtggagttgcacgcagtccagggctattttagaggt

SEQ ID NO: 130512 - DNA, 601 bp, Human
tcattaatatatgaataaatacatccaaaaggacaatgaaatgtccaatactcctagctatcctgtgtaagaatcaactctcccacaaagtaatgcattccctgtcgctgaaagtgttcaagcagttggatggtcatttgctacaggaactgggaagggaattgctgctttgaaaaaaatcttgagaaaaaaagcataccttatttaaacggtggaaatgtattatcatttaaaaagcactagtttaggatccctgtctccctgcctaatcttgaccaaacacacacacagacacatacayacacacacacacacacacacacacagagtaaagtatggcaaacgctgcccctttcttcttaggggcttgactatgaataattagtaagtgaggaagggtggacatgagtgaaggaatggagaggagaaaaggaaacagtttcttataaaattgttaaaagaaaacagacagaccttgcttattagagcaaaagtttaaaaacatggaaacctattgcagtcaaaagtttgagaatgttttgatacttcataaagcaaactgtgagatgtggagttgcacgcagtccagggctattttaga

SEQ ID NO: 130513 - DNA, 601 bp, Human
taagggcagtggttgctgtccctttggtcactgctagattccaggtgcctagaacagagcctgtcatatagtaggtgctcaataaatacatcattaatatatgaataaatacatccaaaaggacaatgaaatgtccaatactcctagctatcctgtgtaagaatcaactctcccacaaagtaatgcattccctgtcgctgaaagtgttcaagcagttggatggtcatttgctacaggaactgggaagggaattgctgctttgaaaaaaatcttgagaaaaaaagcataccttatttaaacrgtggaaatgtattatcatttaaaaagcactagtttaggatccctgtctccctgcctaatcttgaccaaacacacacacagacacatacatacacacacacacacacacacacacagagtaaagtatggcaaacgctgcccctttcttcttaggggcttgactatgaataattagtaagtgaggaagggtggacatgagtgaaggaatggagaggagaaaaggaaacagtttcttataaaattgttaaaagaaaacagacagaccttgcttattagagcaaaagtttaaaaacatggaaac

SEQ ID NO: 130514 - DNA, 601 bp, Human
ggaaatggaggcagagagtcactatatgatgtgtgcaagagcaacacaaaaaggaaatgatggcgtgaatgtgaaagcctctgtgatctggcctctcacgctgcccaggtaccactcagctgtgctctaggtggacatcccagtgttctcagaccacccctgatacaaacacacagtgaaggggcactgacagatgagaggagagtgacagacagggtgggcctggggaaaaccgtgtaagaaaatgtttaatctgaagatgatgacatgtcattttcaacaatttgtggggctgtcacaraaacagggaatggaatgatttagttttgcctcagaagacagaattaggacaaataagtagagtgacaccaagatggaacataaataagggcagtggttgctgtccctttggtcactgctagattccaggtgcctagaacagagcctgtcatatagtaggtgctcaataaatacatcattaatatatgaataaatacatccaaaaggacaatgaaatgtccaatactcctagctatcctgtgtaagaatcaactctcccacaaagtaatgcattccctgtcgctgaaagtgttcaagcagt

SEQ ID NO: 130515 - DNA, 601 bp, Human
gttgcagtgagcccagatcgcaccactgcactccagcctgggcaacagagtaagactccatctcaaaaaaaaaaaaaaaaaaaaaaaaaaaaaaaaaaaaagacaaggaaatggaggcagagagtcactatatgatgtgtgcaagagcaacacaaaaaggaaatgatggcgtgaatgtgaaagcctctgtgatctggcctctcacgctgcccaggtaccactcagctgtgctctaggtggacatcccagtgttctcagaccacccctgatacaaacacacagtgaaggggcactgacagaygagaggagagtgacagacagggtgggcctggggaaaaccgtgtaagaaaatgtttaatctgaagatgatgacatgtcattttcaacaatttgtggggctgtcacaaaaacagggaatggaatgatttagttttgcctcagaagacagaattaggacaaataagtagagtgacaccaagatggaacataaataagggcagtggttgctgtccctttggtcactgctagattccaggtgcctagaacagagcctgtcatatagtaggtgctcaataaatacatcattaatatatgaataaat

SEQ ID NO: 130516 - DNA, 601 bp, Human
tatcaccaggaagtgatgcctcttgaccatttttatttattaaggcttaaaattttagaaaggcaattcataacatcacccttaatcaatcttacagacacatctatctctagaattctgcaacacagccacagaaatacaacattttacattggaaaacaggaggagaaatcctttctatgttttgtttaagcatgttttcaaatgccaagatatttaacttgctcctttaggaggcatttattgtgaatctactttgttccaagcgttttgttaggagctgagaggaatttacaaccamagcagattgctgtcaattgtccacatcatcattaaaccaatagcatgatgtgagtcctaaaacaatgaggctgtataaacagaaaggtaatatccagcgctaatgataacaatagtaagaataatagctatcatttcctgagcatacactttgggccagaaacgactctaagtgctctttttaaaaatactaactcatttaatatgcatagcgactttttgagctaggtagcattattatcctcactttaaagataagaaaatgaggccaggtatggtggctcacacctgtaatcccagc

SEQ ID NO: 130517 - DNA, 601 bp, Human
tgaattcagttgcaaccagttatatgcatctctaaaacccaaagtttctccttattttatcaccaggaagtgatgcctcttgaccatttttatttattaaggcttaaaattttagaaaggcaattcataacatcacccttaatcaatcttacagacacatctatctctagaattctgcaacacagccacagaaatacaacattttacattggaaaacaggaggagaaatcctttctatgttttgtttaagcatgttttcaaatgccaagatatttaacttgctcctttaggaggcatttaytgtgaatctactttgttccaagcgttttgttaggagctgagaggaatttacaaccacagcagattgctgtcaattgtccacatcatcattaaaccaatagcatgatgtgagtcctaaaacaatgaggctgtataaacagaaaggtaatatccagcgctaatgataacaatagtaagaataatagctatcatttcctgagcatacactttgggccagaaacgactctaagtgctctttttaaaaatactaactcatttaatatgcatagcgactttttgagctaggtagcattattatcct

SEQ ID NO: 130518 - DNA, 601 bp, Human
aaggagaagaaaagaggcggcattcagagatacgatacctatgaatccaagtagacatctacacttttaaccagacaggaaaaacatttaaaccagatgttatgtacagaaagaaagaaaagaatactcctggaaatcagtgtgaaaatttcatgaaggatactgtagcatttgctcttgaattcagttgcaaccagttatatgcatctctaaaacccaaagtttctccttattttatcaccaggaagtgatgcctcttgaccatttttatttattaaggcttaaaattttagaaaggcarttcataacatcacccttaatcaatcttacagacacatctatctctagaattctgcaacacagccacagaaatacaacattttacattggaaaacaggaggagaaatcctttctatgttttgtttaagcatgttttcaaatgccaagatatttaacttgctcctttaggaggcatttattgtgaatctactttgttccaagcgttttgttaggagctgagaggaatttacaaccacagcagattgctgtcaattgtccacatcatcattaaaccaatagcatgatgtgagtcctaaaacaa

SEQ ID NO: 130519 - DNA, 601 bp, Human
gtaacattttggagcaagaatatcactcatcttgtctgttcatatctagaactatttagagacctccatctaatgggtagatagttggaaatgatagtgataaacactttaaagctacttccatttaaagaaaggtgcaaacatctgagctctgttcccttctgagtttcttttccagacatttgtcttctagctgcttctgggaggagatgggagtgataaaattttttttttattaataatcctctctacagaatctcccaaacagcaagggaaggagaagaaaagaggcggcattcasagatacgatacctatgaatccaagtagacatctacacttttaaccagacaggaaaaacatttaaaccagatgttatgtacagaaagaaagaaaagaatactcctggaaatcagtgtgaaaatttcatgaaggatactgtagcatttgctcttgaattcagttgcaaccagttatatgcatctctaaaacccaaagtttctccttattttatcaccaggaagtgatgcctcttgaccatttttatttattaaggcttaaaattttagaaaggcaattcataacatcacccttaatcaatct

SEQ ID NO: 130520 - DNA, 601 bp, Human
tattttctgttttttttttttatacatttgctttagagccaggaagcaattctttaaatgttttatgttaaaaaaataagcagtgggtgaatttaagaaaataactgcacatggcaaggactgatctattcatcctccagagttgaggctcatatatttaagaagtaacattttggagcaagaatatcactcatcttgtctgttcatatctagaactatttagagacctccatctaatgggtagatagttggaaatgatagtgataaacactttaaagctacttccatttaaagaaaggtrcaaacatctgagctctgttcccttctgagtttcttttccagacatttgtcttctagctgcttctgggaggagatgggagtgataaaattttttttttattaataatcctctctacagaatctcccaaacagcaagggaaggagaagaaaagaggcggcattcagagatacgatacctatgaatccaagtagacatctacacttttaaccagacaggaaaaacatttaaaccagatgttatgtacagaaagaaagaaaagaatactcctggaaatcagtgtgaaaatttcatgaaggatac

SEQ ID NO: 130521 - DNA, 601 bp, Human
tgcagttttatctatttcttcagataaatagtagagcagtaaactgggaactttgtctgaaaaaaatatattttctgttttttttttttatacatttgctttagagccaggaagcaattctttaaatgttttatgttaaaaaaataagcagtgggtgaatttaagaaaataactgcacatggcaaggactgatctattcatcctccagagttgaggctcatatatttaagaagtaacattttggagcaagaatatcactcatcttgtctgttcatatctagaactatttagagacctccayctaatgggtagatagttggaaatgatagtgataaacactttaaagctacttccatttaaagaaaggtgcaaacatctgagctctgttcccttctgagtttcttttccagacatttgtcttctagctgcttctgggaggagatgggagtgataaaattttttttttattaataatcctctctacagaatctcccaaacagcaagggaaggagaagaaaagaggcggcattcagagatacgatacctatgaatccaagtagacatctacacttttaaccagacaggaaaaacatttaaacca

SEQ ID NO: 130522 - DNA, 601 bp, Human
tgccattacattgtctgaaatacagaattagcatgacaaaaagtagatgttaaagaaccaaagacatctgtcgaaaaaaaaatgcatttttatgtaacaaaattcagaatcaaaagcctttcagggaaagttatattgcatcaggatattgcattaaccatgaaaacaagaattacaccagatgtgcagttttatctatttcttcagataaatagtagagcagtaaactgggaactttgtctgaaaaaaatatattttctgttttttttttttatacatttgctttagagccaggaagcawttctttaaatgttttatgttaaaaaaataagcagtgggtgaatttaagaaaataactgcacatggcaaggactgatctattcatcctccagagttgaggctcatatatttaagaagtaacattttggagcaagaatatcactcatcttgtctgttcatatctagaactatttagagacctccatctaatgggtagatagttggaaatgatagtgataaacactttaaagctacttccatttaaagaaaggtgcaaacatctgagctctgttcccttctgagtttcttttccagacatttg

SEQ ID NO: 130523 - DNA, 601 bp, Human
ctcatggcccacacaatccagaaatggacaataaaatggccaaaatatcaaatctattgtcccaccttatttattcatcacatacaaagatgaataattgtatgataaaacatcgtgtgctttggcctactaatttattatttttaagttgtaattacatattttccaaattaaatcctaaatatcaattatgtaattgcaaaatacaatcagcaaaattcttgtgcatatttaagtaagaaaagaaagaaaagcatgtatcttttggtgataacatttgggatccaagtcaatccatcactacaatcacatctagaaaaagctttcctgattctatattgtgccaggaattcctgatttgtgaatgatttcatttgctccttcccagaacacaagcgcaccagcaaagaagctgtatgctctgtctgaggtgctggtgtgtcgctcaagtgccggctgtggcactgacagatgtgggtgtgttactcatcttcagactccttgttaatatgtcaatgacaccaaacactaaaagacacttatggtactttcaggaacttttatgtatccttctattaacataaacattagtaaggactac

SEQ ID NO: 130524 - DNA, 601 bp, Human
tttctcattgcaaagttctaacatattagaaacacattggagctctcatggcccacacaatccagaaatggacaataaaatggccaaaatatcaaatctattgtcccaccttatttattcatcacatacaaagatgaataattgtatgataaaacatcgtgtgctttggcctactaatttattatttttaagttgtaattacatattttccaaattaaatcctaaatatcaattatgtaattgcaaaatacaatcagcaaaattcttgtgcatatttaagtaagaaaagaaagaaaagcaygtatcttttggtgataacatttgggatccaagtcaatccatcattacaatcacatctagaaaaagctttcctgattctatattgtgccaggaattcctgatttgtgaatgatttcatttgctccttcccagaacacaagcgcaccagcaaagaagctgtatgctctgtctgaggtgctggtgtgtcgctcaagtgccggctgtggcactgacagatgtgggtgtgttactcatcttcagactccttgttaatatgtcaatgacaccaaacactaaaagacacttatggtactttcaggaa

SEQ ID NO: 130525 - DNA, 601 bp, Human
ctatgtctgcaggcactagagatagcatctggcattaacaacaaacaggccaggcacagtggctcacgcctgtaatcccagcactttgggaggctgaggtgggcagatcacctgagttcaggagttcgagaccagcctgaccaacatggagaaaccccatctctactaaaaatacaaaattagccgggcatggtggcacacgcttgtaatcccagctattctggaggctgaggcatgagaatcgcttgaacccgggaggcagagattgtggtgagctgagcgcaccattgcactctagccygggcaacaagagcaaaactccatctcaaaaacaaactaacaacaacaaaaataaacaaatgaaaaacccaaacagctcttgccctcaaagagtttgctgtttattgaggagaggaaagaaactataatatggctttatatcaatcagccatgtgttaaattagcgggtttgcatgtctttctgctctgcaaataaatgataaatcccttgataatttgcatattactcaaaataacctaccacggtgcttgccacagaacagatgctcaaatagtatttattgaaccgaattcactttct

SEQ ID NO: 130526 - DNA, 601 bp, Human
atattatcatataatccaaccacaaaaataaactgtgtccaggaacttttccaaaggactgagaaaataaaggtgggatagggacactaaggaaaatgatagataaaattaaaggcatgggaaaatttgctatctttgtttatcccttaagattacattgaatttcctttatggattgacccaatgctacctcgagaaccccttccctctaggaacctggttccagttacttcagagtgattacccaactcacggtcccattccaatgtactattatgtgtgttaaattttaacacttctyccacaggctagaatagctctccaccacttctctgcctatcagaatcctatgtctgcaggcactagagatagcatctggcattaacaacaaacaggccaggcacagtggctcacgcctgtaatcccagcactttgggaggctgaggtgggcagatcacctgagttcaggagttcgagaccagcctgaccaacatggagaaaccccatctctactaaaaatacaaaattagccgggcatggtggcacacgcttgtaatcccagctattctggaggctgaggcatgagaatcgcttgaacccg

SEQ ID NO: 130527 - DNA, 601 bp, Human
agtatagaaactagtaacaaaaacaaatgatgatctattgaaatctaacatgaaattagccaaaagagtttgaaaatgtaaagacaatctgaaatatagttactaggataaaaaatgaaacttcatcctaaatgcacataccttcagatataaaagtgtggaaatattacatgtgtaagacaaacatgtattaatgtaatatgtaaaaatacatgtaatatgtaaaaaaatgctcatttttttcaataaactgatagaataagaaggcttgcatgatatttttctagtaaacgttaaatayaaggcctacaagaacaagtatttttgttttaaatactgatgtatcccaaagtcttacaatacagattcccaatgaataattgaaaaataaatatctaaagtcctacacctatattttagctagccatgcaaaaatgcaaaatactttttaactcataaaattattagttctttattctcttctgaaacattcgtgttcagaatacctactctgcttaagaaaatataaaaacttagaatctcttctttgcctgtcttaattccccttttcctccagttttgtcttttattttctatttag

SEQ ID NO: 130528 - DNA, 601 bp, Human
cattgattctattcttctcaggtgccaggcattattagaagcacattctattattaactcttggatcctcaccattaccttacttaatagaagcccacttggaggatgaagaaatcgagacacagagcaattaagtagtaataatatgacaaagggtacataaccagtaagttaacagctggaatctgatcactcagctctggaccctgcccacttaactgctacctaatgcagcctgtacaagcggaataattgaactaaaatgtcttcaacactaaaaataaaatgcaaatcaaatctstttaaaaaaccaaaaccaacttgtattttgaagattaactgccactgtgtctaaacccaaatcctgctagccagagctgaatttgtgattacaaagcagtaacgcaaaggttagaaaggatcaaagatcttgaaaaacctcttctcagatccatctcacttttccattggccacatttccaatacatctctgccccattaaaaccttaccaaaattgctagttcagtactataagtttaaaacaaatgggttgctcaattccttttgatgcatcttccgcatctctcgctctttttcttt

SEQ ID NO: 130529 - DNA, 601 bp, Human
gataaccagacctgtatgtgtgcacataataaatctgcacttccatatttagaaagtgcttattcaattctgaagcagtatgcttttaaaaggcaatgtctaatagacacttctcaaaataatattgattcctatcattaaaggtaaccaattttgttggctctgcaaaaattacacaaagaaaaaatgctagagaaaaaacacataaaacctttgtttgagtgaaattatttttcacgtagtccaataaagcaatatatttatgaagctatggtgtatgtcctgtcttgaaaacttttgycataaaatggatggcatcagtctttagcctgatgaatctttcagagtgtcatagctcacctagtgatcagagttatgggaaactagttattacgttctaatcctcccaggccaaacaaaatgagagaacactgaagacatcagaaattatgaatcgctaaactttgtgacctacacaacagtaacacgtaagagaaaggaaatggtttttgtcaacaaatgggtaaagagtttaaggggaaaagaaactgagcagagatacatgtattagcctgaaccataagaaactgacatcttttgt

SEQ ID NO: 130530 - DNA, 601 bp, Human
aaaaaaaaaaaacatatatttacagaacagaaggtggagtgttttttagtatctcagctttccagtttagtctttaaaattattcagataaccagacctgtatgtgtgcacataataaatctgcacttccatatttagaaagtgcttattcaattctgaagcagtatgcttttaaaaggcaatgtctaatagacacttctcaaaataatattgattcctatcattaaaggtaaccaattttgttggctctgcaaaaattacacaaagaaaaaatgctagagaaaaaacacataaaaccttkgtttgagtgaaattatttttcacgtagtccaataaagcaatatatttatgaagctatggtgtatgtcctgtcttgaaaacttttgtcataaaatggatggcatcagtctttagcctgatgaatctttcagagtgtcatagctcacctagtgatcagagttatgggaaactagttattacgttctaatcctcccaggccaaacaaaatgagagaacactgaagacatcagaaattatgaatcgctaaactttgtgacctacacaacagtaacacgtaagagaaaggaaatggtttttgtca

SEQ ID NO: 130531 - DNA, 601 bp, Human
aaggtattggccgggcgtggtgttatcccagcacttcgggaagccgaggcgggtggatcacctgaggtcaggagttcgagaccagcctgaccaacatggtgaaacctcgtctctactaaaaatacaaaattagccaggcgtggtggggcatgcctgtaatcccagctactcaggaggctgaggcaggagaattgcttgaacctgggaggtgaaggttgcagtgagcctagatcacgccactgcactttagcctgggcaatgagcgaaactccatctcaaaaataaataaataaataaatamatacatacatacatacatacatacatacataaaacaaggtattataatttacagaatgatagtggaaagtgaatgcttatgtacactaaaatgtggagaaccattcagagctggccatgatggaaccggtactagttaaaaacacagatacccacattaattgagatataattttatttctccactctctttgcttcttacataattataaggcaatgtcacaaagcctaggggagtaagaataatggagatgtttttgtgactttgttcattcatggaacattctagttcttcatataa

SEQ ID NO: 130532 - DNA, 601 bp, Human
ttctagcttgatcctgctggcaacatgctgcatattcgtcttgtgcgagagaacacaatttgcataatgtgggacccagttctctgtgtgggaacacccttcagggaactcagaataagaagagccagcacttttgagctcagcatgaagggaatccacagcgcagacttcatttccctgtgacaggatttcccaaattgactgaagaaaatagattacattttctgggaggccccctggagaatgtttctgtttaagacacacacacacacacacacacacacacacacacacacacacrcacacgcgcacacacacaatatgtgtatatttatctatagttttgttggtggtgatatttaacaatgacagagtttcaacgaatttacatgaggatgacatgtaagagcatattttaatgcatttaagactttatcaatttttgctcaagggataatagaaaaaagcacctttaagtctttactgcttaaacctgtggcagaaataaattctaactacattatatgcatgaatacagcatatctgagtgcaaatcggttgtaaatagaaaatatttcagaagaggtcatatggctagaaa

SEQ ID NO: 130533 - DNA, 601 bp, Human
aattctagcttgatcctgctggcaacatgctgcatattcgtcttgtgcgagagaacacaatttgcataatgtgggacccagttctctgtgtgggaacacccttcagggaactcagaataagaagagccagcacttttgagctcagcatgaagggaatccacagcgcagacttcatttccctgtgacaggatttcccaaattgactgaagaaaatagattacattttctgggaggccccctggagaatgtttctgtttaagacacacacacacacacacacacacacacacacacacacacrcacacacgcgcacacacacaatatgtgtatatttatctatagttttgttggtggtgatatttaacaatgacagagtttcaacgaatttacatgaggatgacatgtaagagcatattttaatgcatttaagactttatcaatttttgctcaagggataatagaaaaaagcacctttaagtctttactgcttaaacctgtggcagaaataaattctaactacattatatgcatgaatacagcatatctgagtgcaaatcggttgtaaatagaaaatatttcagaagaggtcatatggctaga

SEQ ID NO: 130534 - DNA, 601 bp, Human
gaagattagaaagactctgaaggatgataggtaccatactgataaaacagagcagttgtatttctataccctaaacttgagcaacgaagagaggaataaatttcaagaggaaaataacattgttccaccttgttttgctagaattatagatcctgcaagaagatgaacagttcatggaagcatgaggtgggttgctcggatgcttttatgcctgggtgctcttggaaagctaaggacagacggaaacacaactcaggacacatcaataagagaagcctgctggcacagaggagggcaggtraaaccacctttgtagaagaggctcatttgaaaatgctcctgaaagatatgatatcagaacactatcttatgtagagtggataagactttgatgatcttgaaaatgcttactgaggaatacatagcatttatctttctttccttgattaaagaactttcatatatacatatttatcctgtatggataggtaggagaggtgatgccagcccacagagatgaccagtccctattccagaagttctgagttgttgcttaagtgaagaagtatgctggtctgctttcaaacttctgtaaacttca

SEQ ID NO: 130535 - DNA, 601 bp, Human
cttcccacagactaagaggagtgaccacaaccagaagttttctctatgcactccccaaaggccaactcatctggttaatggaaaaggtgagctctatgtatggtcatgtcattctgcttactcctagttcaagccctgaactaggaatttataaattataataatagtaatgacaataatcaatggtagatataaaagcaggcagttgaaaagtctgatttgtgggaaagtagtttagaccttggtcaccagcactagacatgcctgggatatatattcaaaattatgattccttttttgwtttttagaaatggagtctcactctgttgcccaggctggagtgcagtggtgtgatcgcaactcactgcagcctggaactcctgggctcaagttatctccccatctcagcctcccaaagcactgggattataggcatgagccactgtgcctagccctcaaaattatgattcttgaggcatgttgaaaccacttaattggagtcttggattctgttttgttaatatctgagatcaggtcattttcaaaatcatttcaataagtcttataaatattgatgtttgtgaaccactatgagaggatc

SEQ ID NO: 130536 - DNA, 601 bp, Human
ttggttgacattgacaacctgctccaataggatgctcttgtcatgcccttcaactcagcaggcgcctgccagccctgttgtcgatggtctcaggctgatttctcctttgagctttacgtggtgcagactacatctctttttcaagattgcaaaccagccattattggttgaaaatttaatgtcttgctttgtttctatcatttcttatttcattttctgaagtctcagcagaagtcttgtctttctctataccatcttggtgctcgaggagacatttcttgtccttttcttcccacagacwaagaggagtgaccacaaccagaagttttctctatgcactccccaaaggccaactcatctggttaatggaaaaggtgagctctatgtatggtcatgtcattctgcttactcctagttcaagccctgaactaggaatttataaattataataatagtaatgacaataatcaatggtagatataaaagcaggcagttgaaaagtctgatttgtgggaaagtagtttagaccttggtcaccagcactagacatgcctgggatatatattcaaaattatgattccttttttgttttttagaaatg

SEQ ID NO: 130537 - DNA, 601 bp, Human
tttactaaaaattagggttttattttttctcccctgagattctctcttaagttaaagacgacattaccactcacttcattaatgcaaatatggccatattagaatgcagccgttgaacatctgcctctgtgtctgtggatttatcatgctctttcagcaaagcagcgtgtaaataagtacttttctgcaattttaacttgagaaattgacatatcttctttgctgacactgaattttttcagtggggaaaaaagacaagtgatgtgcacagtacatttcatgaacatgaagccactcgagraataaattaataaaatgtactgtgaaaattggtttcaccttaacaataattaatcaagaagtacagattaaaaactccctacatagctgtcactacttgaggaaatgggacaaatattttcatggaatcacagattctgagaaaagatagaactcttagaattcatctagtcaaaatgtccttcaatggttaacttaactgttgtctattggactttcaggtttttgttattttttctttttcaattttaaaccacaatttttaacttatctttgaagtcttcgcacatgttgtacaata

SEQ ID NO: 130538 - DNA, 601 bp, Human
ctaattataattattaatgctcttgctttaaaacgttcaagtttaagtggtggcaacatttactaaaaattagggttttattttttctcccctgagattctctcttaagttaaagacgacattaccactcacttcattaatgcaaatatggccatattagaatgcagccgttgaacatctgcctctgtgtctgtggatttatcatgctctttcagcaaagcagcgtgtaaataagtacttttctgcaattttaacttgagaaattgacatatcttctttgctgacactgaattttttcagyggggaaaaaagacaagtgatgtgcacagtacatttcatgaacatgaagccactcgagaaataaattaataaaatgtactgtgaaaattggtttcaccttaacaataattaatcaagaagtacagattaaaaactccctacatagctgtcactacttgaggaaatgggacaaatattttcatggaatcacagattctgagaaaagatagaactcttagaattcatctagtcaaaatgtccttcaatggttaacttaactgttgtctattggactttcaggtttttgttattttttcttttt

SEQ ID NO: 130539 - DNA, 601 bp, Human
tggatgagttatctgaacaccaacaaccaacatttagtgaaaccctaaatagcacagagcacaatatgtctttccataatgtagtgaagtcaaacttaaaatgtagtgcgcatggaactcacatctgtagaaactcttaggtcccacaagactgcatctgcgtctatctttgtcatcactatttttctctaagctctagaatgtgttagatcaattctggtggacaggtcatattaccataaaaatgtggccaatattttcagtcaaataaatgcacactattgtttcaatagcttatagytttaaaactatataaaatccatagaaacaaacaacataaaaaagaaaaaacaatgaaagttatcactgagggagttattttgccaatttttagtatacaacttgtgaagaaaaatgtatagtttggcttttcaataagaattgttttagttattcctctggaaaaaaagaaaaaagttgttttacatatttttgtgaatttctaaaataaattatttttcttattaattccaaagtgattaagaaatgggattagttattggagctgcattgaggatactgagagaaataccccatatct

SEQ ID NO: 130540 - DNA, 601 bp, Human
gatctaatatgtttctgctgaaaagaacattgtgcaccctttcaatgaaattgccttccaggctggatgagttatctgaacaccaacaaccaacatttagtgaaaccctaaatagcacagagcacaatatgtctttccataatgtagtgaagtcaaacttaaaatgtagtgcgcatggaactcacatctgtagaaactcttaggtcccacaagactgcatctgcgtctatctttgtcatcactatttttctctaagctctagaatgtgttagatcaattctggtggacaggtcatattacmataaaaatgtggccaatattttcagtcaaataaatgcacactattgtttcaatagcttatagctttaaaactatataaaatccatagaaacaaacaacataaaaaagaaaaaacaatgaaagttatcactgagggagttattttgccaatttttagtatacaacttgtgaagaaaaatgtatagtttggcttttcaataagaattgttttagttattcctctggaaaaaaagaaaaaagttgttttacatatttttgtgaatttctaaaataaattatttttcttattaattccaaagtg

SEQ ID NO: 130541 - DNA, 601 bp, Human
ctttatttaatatagtggagtggtcaaatcttaaaaccaaggtctaaccctggacaaaacccctcagagatctaatatgtttctgctgaaaagaacattgtgcaccctttcaatgaaattgccttccaggctggatgagttatctgaacaccaacaaccaacatttagtgaaaccctaaatagcacagagcacaatatgtctttccataatgtagtgaagtcaaacttaaaatgtagtgcgcatggaactcacatctgtagaaactcttaggtcccacaagactgcatctgcgtctatctwtgtcatcactatttttctctaagctctagaatgtgttagatcaattctggtggacaggtcatattaccataaaaatgtggccaatattttcagtcaaataaatgcacactattgtttcaatagcttatagctttaaaactatataaaatccatagaaacaaacaacataaaaaagaaaaaacaatgaaagttatcactgagggagttattttgccaatttttagtatacaacttgtgaagaaaaatgtatagtttggcttttcaataagaattgttttagttattcctctggaaaaaaag

SEQ ID NO: 130542 - DNA, 601 bp, Human
tattatttataaaaaagttaaaattgcatcatattttggacctgatagttcatggtttgaaaagtctgagggatttttaattggcttgaagaactgaccatgaagcataaagtaaaataaagactggctttcgtggctcagagaaccagagtgtaatttaacatactttgcatttaaacaaccgcatattgctgacatggttttctttttatggttgttgttgttattgcatggatgatgcataaaaattaatcatacctttgtctgcattcaaattcctacaagttttttttttttttttaagaacacaggggaactcttgcccaattcttctgtctatccacttcagtgtgcaagccttcttgtacaatgtaattttaaattaaataaagtctcactgctacttctcctgagtatccatttggctttgctaactctgtaaaaccatctttcaaatgactcaaactacattaggaaaatagctaaaccatttatggcatctgtggaaaaaatttcttaataatttttattattttaatacaagatttcaagttagagtttatttctccatggacattaaaagaatgcctcttacttcctc

SEQ ID NO: 130543 - DNA, 601 bp, Human
tattagaaacataatgaagttattatttataaaaaagttaaaattgcatcatattttggacctgatagttcatggtttgaaaagtctgagggatttttaattggcttgaagaactgaccatgaagcataaagtaaaataaagactggctttcgtggctcagagaaccagagtgtaatttaacatactttgcatttaaacaaccgcatattgctgacatggttttctttttatggttgttgttgttattgcatggatgatgcataaaaattaatcatacctttgtctgcattcaaattcctrcaagttttttttttttttttaagaacacaggggaactcttgcccaattcttctgtctatccacttcagtgtgcaagccttcttgtacaatgtaattttaaattaaataaagtctcactgctacttctcctgagtatccatttggctttgctaactctgtaaaaccatctttcaaatgactcaaactacattaggaaaatagctaaaccatttatggcatctgtggaaaaaatttcttaataatttttattattttaatacaagatttcaagttagagtttatttctccatggacattaaa

SEQ ID NO: 130544 - DNA, 601 bp, Human
aatatacatatctgataaatctgcacaaaaatacttcagtgtattatttatttatttttattttcaatttttttagttagagacagggccttgctatgtctcccagactggggtgcagtggcatgatcatggctcattgtcacctccaagtgctgtgctcctatgatcctcctcagcctcccaaatagctaggactacaggtgcacactaccacacctggataatattttaaaattttattttttgtagagacagggtctcactatattgccgaggctgatctgaagctcctgtcctcaartgatcctcctgcctcggcctcccaaagcactgggattacaggtgtgagccaccatgcatggccatataaatattttgaatattcccacacattatagccctcactactaatcactttggggaataaaaaaaattacagactgatactcaagtattcattatatatattttaactcctcatcaaaagaaaaggattctctattaattttatttcaaattcattatgtgacctcaaaattattacatgcattgacggctctattttgatttcagtctcaaacatctctgcacaaccatcata

SEQ ID NO: 130545 - DNA, 601 bp, Human
gcaataataatatacatatctgataaatctgcacaaaaatacttcagtgtattatttatttatttttattttcaatttttttagttagagacagggccttgctatgtctcccagactggggtgcagtggcatgatcatggctcattgtcacctccaagtgctgtgctcctatgatcctcctcagcctcccaaatagctaggactacaggtgcacactaccacacctggataatattttaaaattttattttttgtagagacagggtctcactatattgccgaggctgatctgaagctcctrtcctcaaatgatcctcctgcctcggcctcccaaagcactgggattacaggtgtgagccaccatgcatggccatataaatattttgaatattcccacacattatagccctcactactaatcactttggggaataaaaaaaattacagactgatactcaagtattcattatatatattttaactcctcatcaaaagaaaaggattctctattaattttatttcaaattcattatgtgacctcaaaattattacatgcattgacggctctattttgatttcagtctcaaacatctctgcacaa

SEQ ID NO: 130546 - DNA, 601 bp, Human
attttaaatgccagagaacttggtgtccttgattatattcacagaaaactaacaatttcatttaggtcactatttaaataccagcaattgaagcaaattccaccctaaatcaatgtctgctgaattaatgactatggtaaggaaattaataatttccttgagggaatcctacagaaataggcagatacttggaaagtgctatttatttagaatattaaggacttaggaacaccttgcttgatgcaggtgtataagagacacaatgagagagatggttgcccagtcttgtgatcacctgagwgtgtgtagaatgatcacataaaaagatcaaaataactatgggaggtatgtaggatacccaatcttggcccgccaccttgtttctcttattctatttccaagacaacctttctgtcaccccactgtctattctggttcatggggaagtatctgacctcatcacccctttgggagtggcaaggaaagggactgacagtcactgaaagaagcaactttgacactaacctattaccaacaaattctctcttcatagtgaaagcaataataatatacatatctgataaatctgcacaaaaatact

SEQ ID NO: 130547 - DNA, 601 bp, Human
ttttaaaatggtttagacagttagaaaactacattaatattctaaacttaacatatttcatttaaggaggcaaccattttatacctcttgaaaggcttaggattatatttttttaaaaatcaaggaaatgaagcatatttaatatgcataaatttatattatgccattttatcttttcatcaaccctgtcaagatatgcattttacctttcatactactgaatacatggattcttagagacccaaaggttgaacaaagaggaaataaaaaaaattagaacataagagtaatcttatatacsatcagaattacaacataactctatagactcctactccagttgtctttccattgcatttctatttaataaaatgtcaagctccaaaaacctaaaaaagtgtaatgtaataatttagtatcaaaaacaagagaaaggaggaggcaaaagaaatgagtgactgccaagggagacacattccttcagcgagaatgaggtttagatttgttatatgttttagagatgattggtaaatccaggaactataggtaatttttccagccaccggataacagaaaaagagagactataaccatgaaagtc

SEQ ID NO: 130548 - DNA, 601 bp, Human
gcctggaaggacttgtcctacaagatacaaatcaccatgccatgcccttgttagtactttgcaaacgtcaggtaatgtcagcaactcagaaaatagacaataatacagtacgccttcatcggtgaagcaaaatttcctgaaaaattaaattttaggtgatatttagaaatttgctgtttttcaaaaattgtcacaacagctatcacagtctacgtttgcatgtcgaagcatttctaatcctagaccataaatgttttgcttaaaaactctttatgtgtgcagaccttgcaaaacaacaaawaacagttctgatctgatatgaaaactcggggagcaattcctctaattataacagctgggtagggagaatttctgctggcatggaaaagaacagacttctaatatggccatttacaaaggcaaatgtaaaggtgaatgattaacttgaaaatacccaatggcagaaactgattatgacttgggactattggtgaaagcacaacatggagacaggaaaacacagagatatgacagtgaaggcatgctgagagagacagaaacaataaaatgaagtatgagacagaaagagaaggtgactaga

SEQ ID NO: 130549 - DNA, 601 bp, Human
caatccccaaattacttacaaaaattacttcaaatatcactataactagggtgactatataatttatcctccaagctgggacacctttgaggataaaagagggtgctattaatatttacactggaacaacttgtgtgaagcagaagtgtcctggccaaactcggacaaacgatcatcctaacgactgttcgtctatacggaaacatacacacgattgaggctttcaacaacaaatatgtattaagcacctgtagtgtggctgggtgtataatacagttgcatctctaattaggggtgaccragttctaaaattagcaagcaaggcagaagttaaatgtatcaaaagtattcttgagcacttcttaaacctatgaattttttgaagattaatgtatcattttaacacaggtaacagatctagtttttcctctagcattaaaccaatcaacccctgcccctacctcactgtatttcagaagaagtaggagacatgcatttagggggcgatgtgtattacaatttcatattgctacatctactgtacagcaaagtgtagtcactgtgtagagatgcttatagcataagggatccacagagctga

SEQ ID NO: 130550 - DNA, 601 bp, Human
tgattttttttccagtatctaaactgcttagcaagtcaaagaaactttgagttagcctaagttaaattgtagcaataatagacattttcccaaaataatttactattaagcatacatattatttactactgagcatacataatgcaaaatcccattatagtaaactcaaacaaattcagtctcatatctcagaagtcataaaacctaagactagcaagaaaagtgttcagaggtagaaagcagttgccagcattgattgaacatcggaatggtaacagtcactaggaaatcaatgcttgaycttatagtagttgcttggtggccaggttcctaggactcgtctttctgtaggacacacaaactgtcttgttgtcagtgttctctttgaatcatgcctcagattttctgctggcccagtgttttgatcatctgtgtccctgaattacaaatgcaagactttctgcttctttcagcattcctcacccctcccaccttttctatagcagtccccaggagctcaccttttctgcacgtgaaaagaatactcactcagtataatcatttatgtgaaccacctaattaccctgcaggatatgactca

SEQ ID NO: 130551 - DNA, 601 bp, Human
atggattaattatgttttcctgtaaggaacctatgaaatcagggaagtccaagtttggtgtccccttggtatttgggatgaaaattaatacttctttcaatggtagtagttctcctttgatttaaaaaaaacttaagtggcatatacaataaggagataaaaattaaaaagctatttaaattccttactttattatttttttctcattgcattatgttatccaccccgaatacactgtaaacatggcataaggggatagtggtttaccaggaaatcacccaactggccaccgattgaactraaaaaagtaatctctatatactcttatactgggttccaggtcaaagatctgtgctgattttttttccagtatctaaactgcttagcaagtcaaagaaactttgagttagcctaagttaaattgtagcaataatagacattttcccaaaataatttactattaagcatacatattatttactactgagcatacataatgcaaaatcccattatagtaaactcaaacaaattcagtctcatatctcagaagtcataaaacctaagactagcaagaaaagtgttcagaggtagaaagcagttg

SEQ ID NO: 130552 - DNA, 601 bp, Human
tcggggcaattatcctctaggtctccttgtaatgaggagtttacgctgtcaagtgtgggaaatttacaatctcaagtgtggagcttaagtggaaaagtcctccttggtaaatataatggattaattatgttttcctgtaaggaacctatgaaatcagggaagtccaagtttggtgtccccttggtatttgggatgaaaattaatacttctttcaatggtagtagttctcctttgatttaaaaaaaacttaagtggcatatacaataaggagataaaaattaaaaagctatttaaattcctyactttattatttttttctcattgcattatgttatccaccccgaatacactgtaaacatggcataaggggatagtggtttaccaggaaatcacccaactggccaccgattgaactgaaaaaagtaatctctatatactcttatactgggttccaggtcaaagatctgtgctgattttttttccagtatctaaactgcttagcaagtcaaagaaactttgagttagcctaagttaaattgtagcaataatagacattttcccaaaataatttactattaagcatacatattatttactactg

SEQ ID NO: 130553 - DNA, 601 bp, Human
caaccgaaggagtcagtaattagtttgtagagccaactggaagtggagtagaagaagaataataaggctgatttataaattcatcctcgtatatctaacttgtttggcaaactaaattataaaaaatacatattttgcacgtatttatcttgtattcatataccttattagttcctagttattgttaaggatttgatcttttccaagtgtatgacagtatcatatacaattaaaactttaatttctagtatttatgattattttattttattgtcctattgcattaagtagaaccagcaaragatttttgagagctggcagaagagaaatcatgcctaattagttcaccattttgatgccactggaatttgcattttatagttaatgtaatatgtaatgatgatttttgtataaatagttcatgtttatagagctcatatttcaattcacccacaattttttaattagaattgatagctgaagtttattagactttcttttagcatctatgaatataatgagaggaactttctccttcatgtttttagtataatgttgggctaaactacgtgaagaataaatcctacttaggcatgtcgtg

SEQ ID NO: 130554 - DNA, 601 bp, Human
ggtttctcagcaataactagataggcccaaattagataaataaagatgttttagttgcaataagaatttggaatttagtgctatactggaccagaattttaaatgtcaggaagtttttgtgactgaacaagcacaaaaagtgaggacctacctgaggtaacaaccgaaggagtcagtaattagtttgtagagccaactggaagtggagtagaagaagaataataaggctgatttataaattcatcctcgtatatctaacttgtttggcaaactaaattataaaaaatacatattttgcacrtatttatcttgtattcatataccttattagttcctagttattgttaaggatttgatcttttccaagtgtatgacagtatcatatacaattaaaactttaatttctagtatttatgattattttattttattgtcctattgcattaagtagaaccagcaagagatttttgagagctggcagaagagaaatcatgcctaattagttcaccattttgatgccactggaatttgcattttatagttaatgtaatatgtaatgatgatttttgtataaatagttcatgtttatagagctcatatt

SEQ ID NO: 130555 - DNA, 601 bp, Human
caaggtttcaaatttactctttagattgatacattggagttggaaataacctttgaagataaagtaatagtgctgcttctgcacagcctttcaaggttgtgtatgtgggtgtgtgtgtgagagagagactgaaatagagagagagagagggaaagagagagattgatttatatttccctttttcaatatccaatttctcacaaacttgatgaaactggacagttgcacattttttcaattgctaatttttgcctacctcaaggacaaaaatcaagttatcttattgttgttttagttttcwtttccctgaatatgtttatatgccgtttgcagtgtcttgctcttatatttttccaattttattggtcgactatatcttgttattgccaatatagcagggtaatcgatatgactttttttgatatgattttagctgtagccgaatatcaagggtaaaataggcacagcgtggtcccaagtcctaacgtgcagtgctaacccccctaaacaggacatgtggagggtctgagaaaccagctctgctcaaatacacaataagctctgtgagtaaagtggagacactggcaagatggaggtctct

SEQ ID NO: 130556 - DNA, 601 bp, Human
tttccattaaaattcaaagcctgtcgttgtgtcttgctgtttaattgtagacttggggcaactaaacttacgttgaatgctgaagttagcaaacctcctaagctgatgaatgcactttgttatatcctgacacaaatatctgaaatgtaatgaaacattctacacaaacaagatcataatcctaattcatatctagtgctattcacaagagaacaccatagctgcttcatttctgaaacgaataatatcatattcctctagtgatcaagcaatcacctccaagtgagactacaatagagaytgaaaaaatgtgaaacactgtagaacttgaactgaaatgtcaaagtgctcctagtagattttgcactttaggtagtacatctttatttgatgcattctctctgatttcacaggattcatttgctctattttgctatggcctgttattagaccatagtgttgatctctgagtactttgcacatttgcatcaaaacattgttgtaatctaagcacttgagcacatgggtaccttgactatgtctcatttcacaaacgaaatgacacattccaaatcaaaccatcagcaaagggatggcaaat

SEQ ID NO: 130557 - DNA, 601 bp, Human
gataaaaagaagcaattgagttattcatgaaagagtttggaatctatatgtttaaaaagaactaccagggttgccattcttctgtggttttctcacaaattctagtcaattgtctgtaaatgaatttacttttgtttgccggatctctttgacatcacaccagaaagaaaccacacacgaggaaaagcagtagttcaccgccctggaatcagaggtctagcatgggtagcccagggctgagaaggtttccactttttcctatcactcatgtcaggccagggtgggtaggaggtagggtctmtccatgcagtgcataccccattctgcacctttctaaacaggtatggcattaagagcttatttgcttttaaaggatcagtgtagccatgagtctgaactattctgatacacaaatacttttcagaatgggaagtttctgtctgataaatgcctctgaaaagtcagatttatcagcctcattgctcttttgtatgtgcttttgagcttgtgaaggaaaaggagtggattctcagttaagacatattttcaacagcgttgactgaatagttgttatgggcataaactattcaatgcttgggga

SEQ ID NO: 130558 - DNA, 601 bp, Human
ttccgattatccatgctgggttgagataaaaatatctcttgctttaaaaaagaagggacatgtatttttaaaagtctactgatgtgctgcggttgcatttatttttatatatgtactcaggaatggaaggcaaagagaactagttccaccgtagttccctcacacctttcctgtcttctcactagaaactcattaccaatatcatactaggtgttagagactgctgatagcaaacaaagtaaaggtcagggaaattcatttgtggtttctgcccctcggggtctgtaactgctgtgtttcyggtgtttccaaattcaagtttttgctatttatccctgggctgggagatagatctaattgcaggtaagcactgacatccaggaataaagaaaaagcaaagtcaaggaataatattattctcatccaaaagtctttacagaaagcatacataaagttgggaaagaaaccagctagctcacagctattctggttattagacatccctgtggaagaagcacctttaaagatgcagatgtcaaagagcagggtaatattagctttgaatctgtgtgaaatcagttctgtgcagtatcataatgtg

SEQ ID NO: 130559 - DNA, 601 bp, Human
gcaggaaaatcatttctgtaagactgctcatcgagaattgaatatgcacactggatcctgcctccaagtcacttaaaatgaacatactcgtccctggtaactgtttctatgaccacatgataatcattaattgtcaaacaattgatagaactatttcaaatactttaaaaataaaagacttttttttttttttgcaagatgagagaaagcatgtcttgtactgtttgagtttacctgataatcagtgttatcatgatgaagtttccaaattgaagactgaaaaggcatcctgtattcttcscattcatacagcactgagttccacatatgcacacggctagcactgatgtttagattaaatcagtaataaccatgatctcccaaatggatgagtttaatccacaggttaattcaattccatacatgctctaattttattccgattatccatgctgggttgagataaaaatatctcttgctttaaaaaagaagggacatgtatttttaaaagtctactgatgtgctgcggttgcatttatttttatatatgtactcaggaatggaaggcaaagagaactagttccaccgtagttccctcaca

SEQ ID NO: 130560 - DNA, 601 bp, Human
tacacacacacatatatcacatacagatattgttctgactcttttaaaaagaacaacagccacgaatagatgatttgcagttcttgtaatgcaatagttgaactacctattacaagtcaatctgcagacgccaatatgtccaaaatgccaataagttttgtctacatgactaagtcaagcaaagtgcaggaaaatcatttctgtaagactgctcatcgagaattgaatatgcacactggatcctgcctccaagtcacttaaaatgaacatactcgtccctggtaactgtttctatgaccamatgataatcattaattgtcaaacaattgatagaactatttcaaatactttaaaaataaaagacttttttttttttttgcaagatgagagaaagcatgtcttgtactgtttgagtttacctgataatcagtgttatcatgatgaagtttccaaattgaagactgaaaaggcatcctgtattcttcccattcatacagcactgagttccacatatgcacacggctagcactgatgtttagattaaatcagtaataaccatgatctcccaaatggatgagtttaatccacaggttaattcaat

SEQ ID NO: 130561 - DNA, 601 bp, Human
aaaaaaaaaagaaagaaaaaagtgtggtatactggtatgctcactttaggcatgtcaggatataaatttcaaaatcatgtctgaattattatgaaatctactactttaatctcccaagtcattcaaataaataatttatacattacaaataaaacacacatatatatcttaaatatgcatacacacacacatatatcacatacagatattgttctgactcttttaaaaagaacaacagccacgaatagatgatttgcagttcttgtaatgcaatagttgaactacctattacaagtcaatytgcagacgccaatatgtccaaaatgccaataagttttgtctacatgactaagtcaagcaaagtgcaggaaaatcatttctgtaagactgctcatcgagaattgaatatgcacactggatcctgcctccaagtcacttaaaatgaacatactcgtccctggtaactgtttctatgaccacatgataatcattaattgtcaaacaattgatagaactatttcaaatactttaaaaataaaagacttttttttttttttgcaagatgagagaaagcatgtcttgtactgtttgagtttacctg

SEQ ID NO: 130562 - DNA, 601 bp, Human
acaacattttttaacctaggctttttttataacccagattgtctatgagattcagactattcatggaaaccacaattatgaaacattacattaataattactgctaacttaagtaaaaccaaagcacagagtttcactttagtttcattaattgaatcatgccaacatagatctttattaccataagacatcttcaagtactcagagtcattaacctaaatcattagaggtgaatttaagcaaatcgtcttcaaatcaaatgtggctaatatctaaaaaaaaaaaaaaagaaagaaaaaagtgtggtatactggtatgctcactttaggcatgtcaggatataaatttcaaaatcatgtctgaattattatgaaatctactactttaatctcccaagtcattcaaataaataatttatacattacaaataaaacacacatatatatcttaaatatgcatacacacacacatatatcacatacagatattgttctgactcttttaaaaagaacaacagccacgaatagatgatttgcagttcttgtaatgcaatagttgaactacctattacaagtcaatctgcagacgccaatatgtccaa

SEQ ID NO: 130563 - DNA, 601 bp, Human
tttattataaagaaatatttgacaatgaaaacaacattttttaacctaggctttttttataacccagattgtctatgagattcagactattcatggaaaccacaattatgaaacattacattaataattactgctaacttaagtaaaaccaaagcacagagtttcactttagtttcattaattgaatcatgccaacatagatctttattaccataagacatcttcaagtactcagagtcattaacctaaatcattagaggtgaatttaagcaaatcgtcttcaaatcaaatgtggctaatwtctaaaaaaaaaaaaaaagaaagaaaaaagtgtggtatactggtatgctcactttaggcatgtcaggatataaatttcaaaatcatgtctgaattattatgaaatctactactttaatctcccaagtcattcaaataaataatttatacattacaaataaaacacacatatatatcttaaatatgcatacacacacacatatatcacatacagatattgttctgactcttttaaaaagaacaacagccacgaatagatgatttgcagttcttgtaatgcaatagttgaactacctattac

SEQ ID NO: 130564 - DNA, 601 bp, Human
caacacaatcctgagtctgtaacttttactaaagtgctattcttgaaataggagggctataagaaaataccattaattttatctctacattttcaatctttgccgattattaagaaatctagaatagactgtgatacctcctatcttaccagatagtatggtataatactcatcactatagttagcgttacagaaaagtccactcagatataaagcatgcatactgaatcagattttgaggtgtaaatatcattagaatgcattatgtatcaaataaaaaataaaatctaaataaatattkatccattatttacaaaacctaaagtagatggggcaggggctattaaaatacattgagattcaagtgtctcaagctatttgtaaggtggtcatgcacttaacttgagacagttccacccaagacataaataacattagaagtatcccatgaggattgtaagggggttgaatttgatatttcctgatataaagtttttgaaaataagaatcaaatcacatatatccctaaaagataatacaaggagtcctctaacattggtttataagaccatgtcaatctgttatgcaatgtttttatcat

SEQ ID NO: 130565 - DNA, 601 bp, Human
atgtatctcttcatttggctttcatttgtatcctttcatatgtcctttgtaataaatcggccattggtagtaaagcatttccctgagttctgtaaaccactctagcaactgatggaacctgaggaagaggtgggaagccacaatttacagctggtcggtcagcagttccagaggccaggacttccaattagcatctaaagtgggagggagtcttgtgggactgaacccttaacctgtgagatctgacactaactccaggcagatagtgtctgaattgaattgaatcataggactcccgttkgtatccaatggagagttgaagtgtgtgaagaaaatcacatctggcatcagaagtaaagattcttgagagtatactaagagaagaaatggtttgtttcttcctattactcatggatttcaacacaatcctgagtctgtaacttttactaaagtgctattcttgaaataggagggctataagaaaataccattaattttatctctacattttcaatctttgccgattattaagaaatctagaatagactgtgatacctcctatcttaccagatagtatggtataatactcatcactatagtt

SEQ ID NO: 130566 - DNA, 601 bp, Human
ccaggcttcctggcacacagctcctaaaacccttgaaatctacaaaataatgtctttttatgtgcatttgagatgactgatggctgaaacctcctgaatagtcttaggatgggagctggttgccagaggaaccgaccacgtgatttgaggattccagctttcggcctcattcctaacctccaactgaggagaggggctgaaggttaagttgatcaccaataattttaatcaatcatgcctactaaatgaagcctccatgaaaacttaaaaggacaaggtttggagagcttccgggttgctraatacatccccttgccaggagggtagctgccccagctccacagggacagaagctcctgcacttggatgccttctgaacctcaccttatgtatctcttcatttggctttcatttgtatcctttcatatgtcctttgtaataaatcggccattggtagtaaagcatttccctgagttctgtaaaccactctagcaactgatggaacctgaggaagaggtgggaagccacaatttacagctggtcggtcagcagttccagaggccaggacttccaattagcatctaaagtgggagggagtctt

SEQ ID NO: 130567 - DNA, 601 bp, Human
aaggtaaataaatatttggtattaaaactaaaatgaagaattgagatatgatttttgattaaaaaatatttggtcttagtccaggcttcctggcacacagctcctaaaacccttgaaatctacaaaataatgtctttttatgtgcatttgagatgactgatggctgaaacctcctgaatagtcttaggatgggagctggttgccagaggaaccgaccacgtgatttgaggattccagctttcggcctcattcctaacctccaactgaggagaggggctgaaggttaagttgatcaccaatrattttaatcaatcatgcctactaaatgaagcctccatgaaaacttaaaaggacaaggtttggagagcttccgggttgctaaatacatccccttgccaggagggtagctgccccagctccacagggacagaagctcctgcacttggatgccttctgaacctcaccttatgtatctcttcatttggctttcatttgtatcctttcatatgtcctttgtaataaatcggccattggtagtaaagcatttccctgagttctgtaaaccactctagcaactgatggaacctgaggaagaggtggg

SEQ ID NO: 130568 - DNA, 601 bp, Human
tagagacggggtttctccatgttggtcaggctggtctcgaactcccgacctgaggtgatccacctgcctcggcctcccaaactgctgggattacaggcgtgagccactgcacccagcctatcattatatatttataaagatatcttatacaagatatactatgtatagtatctataaagatacatattatatgtacatatatcttttatatatataaaatagtatctatatttagtatatataattttcagaaatatattaaaaatcctatatggcattgttactgttatttttcttaatcaataatcaattataatatttatgcacacatttaaaatatctggtattctacataattctatgttctgttatatgcttacatttgatgatgaatttattttattttgaacaatttcctaatagtataccttgtagtgagttgctagtgaagaattcactcagatattatttgtccaaagtacttaaaattaaattgtgagggatgcttttgcttgttatagaattatagactgacttcttttttttaacactttaatgattactttctttttttcttcaggattcatactttctactagaa

SEQ ID NO: 130569 - DNA, 601 bp, Human
ctccccagtagctgggattacaggcatgcaccactatgcccagctaactttgtatttttagtagagacggggtttctccatgttggtcaggctggtctcgaactcccgacctgaggtgatccacctgcctcggcctcccaaactgctgggattacaggcgtgagccactgcacccagcctatcattatatatttataaagatatcttatacaagatatactatgtatagtatctataaagatacatattatatgtacatatatcttttatatatataaaatagtatctatatttagtatawataattttcagaaatatattaaaaatcctatatggcattgttactgttatttttcttaatcaataatcaattataatatttatgcacacatttaaaatatctggtattctacataattctatgttctgttatatgcttacatttgatgatgaatttattttattttgaacaatttcctaatagtataccttgtagtgagttgctagtgaagaattcactcagatattatttgtccaaagtacttaaaattaaattgtgagggatgcttttgcttgttatagaattatagactgacttctt

SEQ ID NO: 130570 - DNA, 601 bp, Human
caaactgtcttattgtgacatcggctcttagtaaatcttgagatctgttagtgtgagtacttcaaattgtttcttcaataacattgacatttccatataaattttaaaatcagcttgtaaatttctaccaaaaaaaaaaaaacctgctgggattttgacatggatcctaataaatctttagattaatttgaagagatataacatcttaacagtattgagtcttccaattcatgactatggcatgtttgtacatatttatggagtacatatgatattttgatatgagcatgcattgtgtaaygatcaaatcagggccaattggaatattcatgacctcaaacattcatcatttctttgtgttgggaacatttcaaatccactcttctagttattttaaagtatacaataaattattttaagtatagtcaccatattgtgatactgaaaactaggtctaaatcccactacttaactacatttttgtatctattaactaatctctcttcatccttctgtccacaactatctttcccagccactggtaaccatcattctactttccacccacattagatttttttttaagctcccacacatgtgt

SEQ ID NO: 130571 - DNA, 601 bp, Human
tgaaatagatatgctattgattaagcacctttttatggaaaaggccattccacacccactgaattgcagtggagactttaccataattcaggaaaatatactagtctattccaatattaaattttcctatacttgtaccaaaagcacaaactgtcttattgtgacatcggctcttagtaaatcttgagatctgttagtgtgagtacttcaaattgtttcttcaataacattgacatttccatataaattttaaaatcagcttgtaaatttctaccaaaaaaaaaaaaacctgctgggattytgacatggatcctaataaatctttagattaatttgaagagatataacatcttaacagtattgagtcttccaattcatgactatggcatgtttgtacatatttatggagtacatatgatattttgatatgagcatgcattgtgtaacgatcaaatcagggccaattggaatattcatgacctcaaacattcatcatttctttgtgttgggaacatttcaaatccactcttctagttattttaaagtatacaataaattattttaagtatagtcaccatattgtgatactgaaaactaggtc

SEQ ID NO: 130572 - DNA, 601 bp, Human
actcccttctttctgaaatagatatgctattgattaagcacctttttatggaaaaggccattccacacccactgaattgcagtggagactttaccataattcaggaaaatatactagtctattccaatattaaattttcctatacttgtaccaaaagcacaaactgtcttattgtgacatcggctcttagtaaatcttgagatctgttagtgtgagtacttcaaattgtttcttcaataacattgacatttccatataaattttaaaatcagcttgtaaatttctaccaaaaaaaaaaaaacctgctgggattttgacatggatcctaataaatctttagattaatttgaagagatataacatcttaacagtattgagtcttccaattcatgactatggcatgtttgtacatatttatggagtacatatgatattttgatatgagcatgcattgtgtaacgatcaaatcagggccaattggaatattcatgacctcaaacattcatcatttctttgtgttgggaacatttcaaatccactcttctagttattttaaagtatacaataaattattttaagtatagtcaccatattgtgatac

SEQ ID NO: 130573 - DNA, 601 bp, Human
tcattgagatagtcatttgtgttgtcttttagaaaccttttctttgccttactttttgcatttaagttcctacttcaaatctgtatgtacatataataggtggtagggattatggctcccactcccttctttctgaaatagatatgctattgattaagcacctttttatggaaaaggccattccacacccactgaattgcagtggagactttaccataattcaggaaaatatactagtctattccaatattaaattttcctatacttgtaccaaaagcacaaactgtcttattgtgacatyggctcttagtaaatcttgagatctgttagtgtgagtacttcaaattgtttcttcaataacattgacatttccatataaattttaaaatcagcttgtaaatttctaccaaaaaaaaaaaaacctgctgggattttgacatggatcctaataaatctttagattaatttgaagagatataacatcttaacagtattgagtcttccaattcatgactatggcatgtttgtacatatttatggagtacatatgatattttgatatgagcatgcattgtgtaacgatcaaatcagggccaattgg

SEQ ID NO: 130574 - DNA, 601 bp, Human
cactggagattcacttgtgctttttagtccacagtctcccccgagaggtaactactattctgacttctatcatagaagattagattttgctttttttttttttgagacagagtctcgctgtcgcccaggctggagtgcagtggcgcgatctcggctcactgcaggctccgccccccggggttcacgccattctcctgcctcagcctcccaagtagctgggactacaggcgcccgccaccacgccgggctaattttttgtatttttagtagagacagggtttcaccgtgtcagccaggatgktctcgatctcctgacctcgtgatccacccgcctcggcctcccaaagtgctgggattacaggcgtgagccactgcgcccggcccaaattttgctctttttaaaaatttcacacatattgatcgtgcagcatttattcttttgtgtctggtttctttttctcctttttatgtctgtgagatccatctgagttcttgtgtgtatcaatagtgtgttactttcactgctgtgtagtattctgtgttatgaatatgttgtaatttatttatccattctactactgatggaaatttcatttgttcc

SEQ ID NO: 130575 - DNA, 601 bp, Human
cacacaccacacacacacacacaccacacacacagataccagatcaataaatagaacatttttagcactggagattcacttgtgctttttagtccacagtctcccccgagaggtaactactattctgacttctatcatagaagattagattttgctttttttttttttgagacagagtctcgctgtcgcccaggctggagtgcagtggcgcgatctcggctcactgcaggctccgccccccggggttcacgccattctcctgcctcagcctcccaagtagctgggactacaggcgcccgcyaccacgccgggctaattttttgtatttttagtagagacagggtttcaccgtgtcagccaggatgttctcgatctcctgacctcgtgatccacccgcctcggcctcccaaagtgctgggattacaggcgtgagccactgcgcccggcccaaattttgctctttttaaaaatttcacacatattgatcgtgcagcatttattcttttgtgtctggtttctttttctcctttttatgtctgtgagatccatctgagttcttgtgtgtatcaatagtgtgttactttcactgctgtgtagtatt

SEQ ID NO: 130576 - DNA, 601 bp, Human
acaccacacacacacacacaccacacacacacacacaccacacacacagataccagatcaataaatagaacatttttagcactggagattcacttgtgctttttagtccacagtctcccccgagaggtaactactattctgacttctatcatagaagattagattttgctttttttttttttgagacagagtctcgctgtcgcccaggctggagtgcagtggcgcgatctcggctcactgcaggctccgccccccggggttcacgccattctcctgcctcagcctcccaagtagctgggastacaggcgcccgccaccacgccgggctaattttttgtatttttagtagagacagggtttcaccgtgtcagccaggatgttctcgatctcctgacctcgtgatccacccgcctcggcctcccaaagtgctgggattacaggcgtgagccactgcgcccggcccaaattttgctctttttaaaaatttcacacatattgatcgtgcagcatttattcttttgtgtctggtttctttttctcctttttatgtctgtgagatccatctgagttcttgtgtgtatcaatagtgtgttactttcac

SEQ ID NO: 130577 - DNA, 601 bp, Human
cagtacacacacacaccacacacacacacacaccacacacacacacacaccacacacacagataccagatcaataaatagaacatttttagcactggagattcacttgtgctttttagtccacagtctcccccgagaggtaactactattctgacttctatcatagaagattagattttgctttttttttttttgagacagagtctcgctgtcgcccaggctggagtgcagtggcgcgatctcggctcactgcaggctccgccccccggggttcacgccattctcctgcctcagcctcccragtagctgggactacaggcgcccgccaccacgccgggctaattttttgtatttttagtagagacagggtttcaccgtgtcagccaggatgttctcgatctcctgacctcgtgatccacccgcctcggcctcccaaagtgctgggattacaggcgtgagccactgcgcccggcccaaattttgctctttttaaaaatttcacacatattgatcgtgcagcatttattcttttgtgtctggtttctttttctcctttttatgtctgtgagatccatctgagttcttgtgtgtatcaatagtg

SEQ ID NO: 130578 - DNA, 601 bp, Human
gcccaagtattaagcttatagctacagctacagtacacacacacaccacacacacacacacaccacacacacacacacaccacacacacagataccagatcaataaatagaacatttttagcactggagattcacttgtgctttttagtccacagtctcccccgagaggtaactactattctgacttctatcatagaagattagattttgctttttttttttttgagacagagtctcgctgtcgcccaggctggagtgcagtggcgcgatctcggctcactgcaggctccgccccccgggrttcacgccattctcctgcctcagcctcccaagtagctgggactacaggcgcccgccaccacgccgggctaattttttgtatttttagtagagacagggtttcaccgtgtcagccaggatgttctcgatctcctgacctcgtgatccacccgcctcggcctcccaaagtgctgggattacaggcgtgagccactgcgcccggcccaaattttgctctttttaaaaatttcacacatattgatcgtgcagcatttattcttttgtgtctggtttctttttctcctttttatgtctgtgagat

SEQ ID NO: 130579 - DNA, 601 bp, Human
caacattatactcatcatttttctcatctaagatccacaagcttttggaaaatcagctttcctagctatttcttggctgacagcaggtaaaaagatttaagatgagaattaattacaccgatataaagttatcaagggacaagcctatgggacttgctcattggccccaaaggatataaaatgtcagagaaacagtggcagcaatatatcaatgaaccaaatgtttctgatgtttgacaaaacatattatggcaataaatgatgctgtgttctgtaatgagattgtataaagaaaaaaaamcagtttttcagcagatatgctacttaaagcaagatttctttatgcatatcaccaatagtgaacagattagtcctatataattttaataattttgcaattaagaatcatggaaaacagattaaaataaaataaacgttggctgataacaaaattaaaattgtgaaatcagactaaaatgaacatatccaagatgaagactagcctttacattcaggttgtgtttctgggttgaacgtgtgcagcaaagtcataattaacatttaagaaggaaagttaatttgaattaaagcaatatcatgt

SEQ ID NO: 130580 - DNA, 601 bp, Human
tttagtaaggggatagctatcttccattatattctacctatcagtgatgtaaaagtaaacttaaattacaagtaaataaaaatgaattatatggcgtaattttgtacttaaaatttgaggatgtgaaattgaatctttcaagttacttcaaaataactgcatcagcaatcgtcagcttagttttatttccagcatcagacaagaaggtatctcctattttctagcaatgatactcattcattcccaaagttattataatatggaattttagaatagttttgaagatacatgataaatcaartacatgtcttatgataagagagaaaacatgtcctggtgtcttctgtcttgggactttaaatcctcacttttgcacagccatgcacttctccctctgatgttgagggcatccctgatggatgcgacggaaagatatttcagagaacaggctgtgtaattagaaaaaaggatggtacatgagcctcaacattatactcatcatttttctcatctaagatccacaagcttttggaaaatcagctttcctagctatttcttggctgacagcaggtaaaaagatttaagatgagaattaattaca

SEQ ID NO: 130581 - DNA, 601 bp, Human
tcacagactcaatgtgaataggagagaaatgggcactttagtaaggggatagctatcttccattatattctacctatcagtgatgtaaaagtaaacttaaattacaagtaaataaaaatgaattatatggcgtaattttgtacttaaaatttgaggatgtgaaattgaatctttcaagttacttcaaaataactgcatcagcaatcgtcagcttagttttatttccagcatcagacaagaaggtatctcctattttctagcaatgatactcattcattcccaaagttattataatatggawttttagaatagttttgaagatacatgataaatcaagtacatgtcttatgataagagagaaaacatgtcctggtgtcttctgtcttgggactttaaatcctcacttttgcacagccatgcacttctccctctgatgttgagggcatccctgatggatgcgacggaaagatatttcagagaacaggctgtgtaattagaaaaaaggatggtacatgagcctcaacattatactcatcatttttctcatctaagatccacaagcttttggaaaatcagctttcctagctatttcttggctgac

SEQ ID NO: 130582 - DNA, 601 bp, Human
gtagggattgtttatcccaaatttacagtagagtaaactaaagctcagggagcttagagaagtcactaatacctcagaacacttaaattaactgaggtcttaaaaattaatttgtgacaaattaaatcatctaaagaagggcagcaagaaaagaagggaaaggagagaaaaacagccaagattattttcttcataagacagttatttctcttatgaaaaataaaatatactcaactgaaagtcccagaatgtggcatgaattaatccagagatcctgtgataacccggttagcagtggggmatcttgccccaaaattgggttcacagactcaatgtgaataggagagaaatgggcactttagtaaggggatagctatcttccattatattctacctatcagtgatgtaaaagtaaacttaaattacaagtaaataaaaatgaattatatggcgtaattttgtacttaaaatttgaggatgtgaaattgaatctttcaagttacttcaaaataactgcatcagcaatcgtcagcttagttttatttccagcatcagacaagaaggtatctcctattttctagcaatgatactcattcattcc

SEQ ID NO: 130583 - DNA, 601 bp, Human
tgtgaagtttgtcttacaattaattaacaaagaatctttaaatacctgaaacagcataaaataaaaccctggataaaccttaaatacaaaatttgctctaaaatgtaaacactgattacttttttgagacttatcttcaaatttaaaaaaaggtggcagattattcagaaaagcaaagcacagtcaaattgcattttttcctttctgtccaatatacctgcaggtacacaatttcatcatctctaatgctattacttggttttgcaatatagtctttgaaaaggtacttcaactaatcttytatttttcactttaattcactttttccctttaactggtgaaaagttggagaaataaagaggttacattcagcctctggtgttctgggtgaaggcgctctgctaagtgacactgcctttcttctccggacctcaacagcactcagggtgccactaggatctggctgctgcatgagtttatacaaaacagagaaaatgaatgaaattttcctagcattagtaacagtctgagaaacatttctacccttttgtctcatagaggattgtcaagtatggttctgatgatgaaaacaagagaaaaa

SEQ ID NO: 130584 - DNA, 520 bp, Human
gtcactgatgcctgcctggaattctttcatgaagctgcagctaccaggtacttcaggctgccctaaaccttatattttaagaagcactgaaaacaagagaagggagaagggcggattggagttactttggcaaaaggcaatataaatgaagctaagtgagggcttcatcgtatcttatcacagtcaccagcactagtggtgactcccttcaatgacttaaaagggatctcctccttagctcacccaaggtgctaactagttgcagctggaagaggatggtgtagcccattgagataatacycccccaccccatgtagatttctcctaagcactttatcaagaagaaactcggtggttctgagtgcctgattaggcaaaagtcaagaagtgatataaggaagaaactgaggagtgtagtgctgacaggtgggtgatgggtataagcaagagaaggaataagccctcttagctagagacatggggaatttcatctgaattaacagtcaaattaaaacttgat

SEQ ID NO: 130585 - DNA, 601 bp, Human
gcaacatgtgtaccaacaaggtgggtatctatgcatgcgcagagggagcctcatgctatcaagtggaagaaagaatgttgttctgcaattccacaagagggttagaggaagaatgacgttcctactagaactggatactgatatctgagctggtggaaagaaagaaaagatgggagtctacagtaagcatccatgtttttggtaaattaccataactggactggtgtgggaggagtgaagtggagggtggagtgagtgattaagcctgggaaacaaatgacaggcagaggaggaaaggcaygaaagaggtaatgttaagatgaaaggcttactcagagtggtcaagtattgggtctttaaagaatgcttatcacctgggcaatatggcacctccaaagggctaatcacagagaccctccaacaggtcactgatgcctgcctggaattctttcatgaagctgcagctaccaggtacttcaggctgccctaaaccttatattttaagaagcactgaaaacaagagaagggagaagggcggattggagttactttggcaaaaggcaatataaatgaagctaagtgagggcttcatcgtatctta

SEQ ID NO: 130586 - DNA, 601 bp, Human
tcattatttagaaatgaaatgtgcattaattaatttcaatctaatacaaattatattatgctcaattttaaaactgaattaatgtttgtcatatctttaaaaattacaatagtgaatttgtgatttttaaataaattataagaaatactgtcttcaccttcaatccaaggaatgacaaaacagcttttgctaacaaaactaaaatgagctattagtaatgaaaatatgacgtggtagctataacttggcctctcttgttggatagccatgattctacaacacacctgctatttattggaartgaatactgagagataggagtcccagaagataagagattgagctaacctattacttcagacatttttttcaggtaaagactttaagcatatattgaatgaggttggcagtgtctagatataaaacagaaatatctgtaaattatgttactttgaaatactttactattaatatagaaaacaatcataaaatatagtaatttagtgcataatgtaatttacaacttcctatatcatgtgggaaatataagtcctcgtgtgcagctcctggatacaccgctgttgaattcattttactctct

SEQ ID NO: 130587 - DNA, 601 bp, Human
ttccctcattaatggtgcctggatacccaatgcaacacacctacatcaaactgcatttgtaactgttggattcataatgattctacctaagatgcaagcatacggcatcattgtgccttgttgtatggatatgcttgagaagtcacatgctgaaatacatatattttaaatttgacagtatctcctacaatattttctttatattatagtaaggtattacattacagtttaaaacttatgactataagcaggtgatattatctatgaatttcatgtgaaattagcaaagggacagtctcaratgtttgctgtataaagtgtatttgaagcctgatagggttgagaaacactcagctacagtaagtaaaaacagctctcttagtggttgccttgttgagaagatcttgaaaacaaggttgaaaatacaaaagaaactgtgtggaggtctacaaagatatttatcataggtaaatcattatgtctaaaatgttatagaaatttctattaatggtggtttgtatttttaaaatataagaaatataaaagctatagacagctgtaatttggttccaaaggctttgaaattcacttttattgctgt

SEQ ID NO: 130588 - DNA, 601 bp, Human
tgtgggaaggcacatttaaattatctagatttaagttgtaactgtattttatacatacaaaatacatatatatatatatacacacacacatacatatatacatacactaatgtatattccatatactagctcttacaaaaatgcaactaccatgtaaaccaaagaaagattatcttttgttttacttgacagttaccaagaattgtttcgcatttaagaaaattatatctttgatggttccctcattaatggtgcctggatacccaatgcaacacacctacatcaaactgcatttgtaacygttggattcataatgattctacctaagatgcaagcatacggcatcattgtgccttgttgtatggatatgcttgagaagtcacatgctgaaatacatatattttaaatttgacagtatctcctacaatattttctttatattatagtaaggtattacattacagtttaaaacttatgactataagcaggtgatattatctatgaatttcatgtgaaattagcaaagggacagtctcaaatgtttgctgtataaagtgtatttgaagcctgatagggttgagaaacactcagctacagtaag

SEQ ID NO: 130589 - DNA, 601 bp, Human
aacctacttataagcatctgcacttaaatcacaactccattagacatacacaagcacacatacacacatatgctgatgtgggaaggcacatttaaattatctagatttaagttgtaactgtattttatacatacaaaatacatatatatatatatacacacacacatacatatatacatacactaatgtatattccatatactagctcttacaaaaatgcaactaccatgtaaaccaaagaaagattatcttttgttttacttgacagttaccaagaattgtttcgcatttaagaaaattwtatctttgatggttccctcattaatggtgcctggatacccaatgcaacacacctacatcaaactgcatttgtaactgttggattcataatgattctacctaagatgcaagcatacggcatcattgtgccttgttgtatggatatgcttgagaagtcacatgctgaaatacatatattttaaatttgacagtatctcctacaatattttctttatattatagtaaggtattacattacagtttaaaacttatgactataagcaggtgatattatctatgaatttcatgtgaaattagcaaa

SEQ ID NO: 130590 - DNA, 601 bp, Human
ggaccacagctgcacgtcactacactcagctaattaaaaaaaaaattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactgttcattgtcagcaaagggaagagccactgcatcaatcaaagttcaagaacctctgtgcttaaacataattggcaatattgtttttttgtatgtttagaatgctgaagttaataaacagtaattgtatgtttagaatgctgaagttaataaacagtaaagttaaataagcagtaatgcattttaaaaaataaatggtagactatatagaacttagtaacagattgactatatgatcctgtagatgtgtcctggatggcacctaggcttctggcatgaggaattggacagatgttgctgcatttattgagccagcaaacactggaggaagccaggttttgggcggaaggacacgaattcaatctcagacatattgcatttcagatgcatgtgagacatggttat

SEQ ID NO: 130591 - DNA, 601 bp, Human
ttccacctcagcctcccaagcaactgggaccacagctgcacgtcactacactcagctaattaaaaaaaaaattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactgttcattgtcagcaaagggaagagccactgcatcaatcaaagttcaagaacctctgtgcttaaacataattggcaatattgtttttttgtatgtttagaatgctgaagttaataaacagtaattgtatgtttagaatgctgaagttaataaacagtaaagttaaataagcagtaatgcattttaaaaaataaatggtagactatatagaacttagtaacagattgactatatgatcctgtagatgtgtcctggatggcacctaggcttctggcatgaggaattggacagatgttgctgcatttattgagccagcaaacactggaggaagccaggttttgggcggaaggacacgaattcaatctcagacatattgcat

SEQ ID NO: 130592 - DNA, 601 bp, Human
cattccacctcagcctcccaagcaactgggaccacagctgcacgtcactacactcagctaattaaaaaaaaaattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactgttcattgtcagcaaagggaagagccactgcatcaatcaaagttcaagaacctctgtgcttaaacataattggcaatattgtttttttgtatgtttagaatgctgaagttaataaacagtaattgtatgtttagaatgctgaagttaataaacagtaaagttaaataagcagtaatgcattttaaaaaataaatggtagactatatagaacttagtaacagattgactatatgatcctgtagatgtgtcctggatggcacctaggcttctggcatgaggaattggacagatgttgctgcatttattgagccagcaaacactggaggaagccaggttttgggcggaaggacacgaattcaatctcagacatattgc

SEQ ID NO: 130593 - DNA, 601 bp, Human
ctctgtcacccaggctggagtgcaggagcatgatcacagttcattgcagcctcaacctcccaggatcaagggatcattccacctcagcctcccaagcaactgggaccacagctgcacgtcactacactcagctaattaaaaaaaaaattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactrttcattgtcagcaaagggaagagccactgcatcaatcaaagttcaagaacctctgtgcttaaacataattggcaatattgtttttttgtatgtttagaatgctgaagttaataaacagtaattgtatgtttagaatgctgaagttaataaacagtaaagttaaataagcagtaatgcattttaaaaaataaatggtagactatatagaacttagtaacagattgactatatgatcctgtagatgtgtcctggatggcacctaggcttctggcatgaggaattggacagatgttgctgcat

SEQ ID NO: 130594 - DNA, 601 bp, Human
ctgccattctttgctctggacaaagggggtcagctggcgtgaaaattgtttggattttttttagttaagtgctgtcattttgaaacttttttttttttttttttgagacaaggtccttctctgtcacccaggctggagtgcaggagcatgatcacagttcattgcagcctcaacctcccaggatcaagggatcattccacctcagcctcccaagcaactgggaccacagctgcacgtcactacactcagctaattaaaaaaaaaattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactgttcattgtcagcaaagggaagagccactgcatcaatcaaagttcaagaacctctgtgcttaaacataattggcaatattgtttttttgtatgtttagaatgctgaagttaataaacagtaattgtatgtttagaatgctgaagttaataaacagtaaagttaaataagcagtaatgcatttt

SEQ ID NO: 130595 - DNA, 601 bp, Human
gttgtcttgtttctgtatatagtcagatagcattctgctgccattctttgctctggacaaagggggtcagctggcgtgaaaattgtttggattttttttagttaagtgctgtcattttgaaacttttttttttttttttttgagacaaggtccttctctgtcacccaggctggagtgcaggagcatgatcacagttcattgcagcctcaacctcccaggatcaagggatcattccacctcagcctcccaagcaactgggaccacagctgcacgtcactacactcagctaattaaaaaaaawattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactgttcattgtcagcaaagggaagagccactgcatcaatcaaagttcaagaacctctgtgcttaaacataattggcaatattgtttttttgtatgtttagaatgctgaagttaataaacagtaattgtatgtttagaatgctgaagtt

SEQ ID NO: 130596 - DNA, 601 bp, Human
ctgtgaggctggacctgctgccactgcaatgggcccccatttagctttagttgtcttgtttctgtatatagtcagatagcattctgctgccattctttgctctggacaaagggggtcagctggcgtgaaaattgtttggattttttttagttaagtgctgtcattttgaaacttttttttttttttttttgagacaaggtccttctctgtcacccaggctggagtgcaggagcatgatcacagttcattgcagcctcaacctcccaggatcaagggatcattccacctcagcctcccaagmaactgggaccacagctgcacgtcactacactcagctaattaaaaaaaaaattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactgttcattgtcagcaaagggaagagccactgcatcaatcaaagttcaagaacctctgtgcttaaacataattggcaatattgtttttttgtatgttta

SEQ ID NO: 130597 - DNA, 601 bp, Human
tatcaaaattatatgtatttccaaacatttttaaaaataaaaaggcaatcttgtgttttcttcacactgtgcactttgctgtttgcatgataaggcatttaaaagatgtttctggcatttaaaaacatgtgtaaggtgatgtttactatttggctatgggctagaaatcctgaggtgtcaggtgtacatacatatcttttgtaaaaagaacaaaatagagacaaacttttgaggcccctggcttcgtgttgaggctgtgggagaagaggccttttggagaaactggagctcagtgcatgcmctgtgaggctggacctgctgccactgcaatgggcccccatttagctttagttgtcttgtttctgtatatagtcagatagcattctgctgccattctttgctctggacaaagggggtcagctggcgtgaaaattgtttggattttttttagttaagtgctgtcattttgaaacttttttttttttttttttgagacaaggtccttctctgtcacccaggctggagtgcaggagcatgatcacagttcattgcagcctcaacctcccaggatcaagggatcattccacctcagcctcccaag

SEQ ID NO: 130598 - DNA, 601 bp, Human
gagcactaagccaaggcatcatgccctacactgcccagattagcaaaacagtacagtcaggatggctaaaggtgacaccaagaaaccaaagggtaagatgtctgcttgtgctctctttgtgcagatgtgcagagaagaacataaaaagaaaaacccagaggtccctgtcaatttagcagaatttttcaagatgtgctccgacaggtgaaagacagtgtctaggaaagataagtataaatctgataaaatggcaaaggcagaaaaagtaggttcggatggggaaatgaacgattatgaccarctcagggaggcgagaagatgtcccaagaaggccaccatctgaattctttccgttctgttcagaagtccacttcaaggtcaaatctgcaaatcctggcatccgtggcaaaaagctgggtgagatgtggaataacttaagtgacaggacaaagcagactgacatcactaaggcagagaagctgaaagagaggtatgagaaggacgttgctgacagtaagtgtaaaggagagtttgatggctcaaagcaccccactaaagttgcctggaaaaaggtggaagaggaagatgaagaaaacatgga

SEQ ID NO: 130599 - DNA, 601 bp, Human
gtgtgcagctgtgctctaataaaactttatttacagaaataggtgattgttcagatttggcccagggatcatttcttgcagacccatgtgctgagatttgagggttttcagaagctagttctgactgatctatttagaagtggtaatagaaagaagtgggagcatctgagaaaacaggttggttaagaattagtttgaaacacaagctccagcaagaactgaggatgactttggcagagttcagtgttgatggtgaaatggaaatggagaatatctgatggacgtaagagctatttaattkgtagagaggggcctctcagggaggcagctagctcaatgctggagagcactaagccaaggcatcatgccctacactgcccagattagcaaaacagtacagtcaggatggctaaaggtgacaccaagaaaccaaagggtaagatgtctgcttgtgctctctttgtgcagatgtgcagagaagaacataaaaagaaaaacccagaggtccctgtcaatttagcagaatttttcaagatgtgctccgacaggtgaaagacagtgtctaggaaagataagtataaatctgataaaatggcaaagg

SEQ ID NO: 130600 - DNA, 601 bp, Human
tacagagttcacaccttagcagggaaactttcacaaccataatcaaaagtcatagaaaatattactttaaaaagtgtgcagctgtgctctaacagaactttatttacagaaataggtgatcgtccagatttcaggccatcctgaaccttcatatcattatgcacttaataatgaatctgcctggaggagggactgttaaactgttttagaaaacgtgagataatgctcagacattctctttaaaaggaatatcaaaactgggtgcccgcaagcaggtgtctgagtgagggacagctacctygaagctggctctcaaagagcacaaacttgaaagctatctcaaatcgctattttggcatctgctgttattgatgctaaatgaataattcttttcttcacgtgattgaaacctgaacagaacacaagttctgaaaacacaaggtctttgtctacaaggaaagctatgaggaaccatatagagtcttagggtctataaggagagctatgctgcgtttggaaaatatgatctaaaacaattaattatatatttactgcatattcagtatatgctcaatgcagatgttgacaatttttttttttt

SEQ ID NO: 130601 - DNA, 601 bp, Human
aaatgtatcaacaattcctatgttctgtgtgtccagacacttttgattggcatattttgttgaaggagacagatggcaagacagtctgaggaagtgcagctcagctttacggagaacattttcaccttgttctagggagttttggatacagagttcacaccttagcagggaaactttcacaaccataatcaaaagtcatagaaaatattactttaaaaagtgtgcagctgtgctctaacagaactttatttacagaaataggtgatcgtccagatttcaggccatcctgaaccttcatatsattatgcacttaataatgaatctgcctggaggagggactgttaaactgttttagaaaacgtgagataatgctcagacattctctttaaaaggaatatcaaaactgggtgcccgcaagcaggtgtctgagtgagggacagctacctcgaagctggctctcaaagagcacaaacttgaaagctatctcaaatcgctattttggcatctgctgttattgatgctaaatgaataattcttttcttcacgtgattgaaacctgaacagaacacaagttctgaaaacacaaggtctttgtctacaa

SEQ ID NO: 130602 - DNA, 601 bp, Human
cttccagcgaattttttatgcaacatgagtgtacacaattgttcaacatctactcaagtctcagcataatttggctttttctttacctgaagtccatttgggaatgggaggttggagactttttttctccctgtctgatctttcttatttcaaattcatgctgttctctctgatactcattttgtctttcaaacctgaagtttcataggatatatgagcccaaaggatagagaagtcacatcagtgccttcgtgtgacattgatgtgatatctcagaagcctgtcttcactcttttccagwctcagctgctgttctcttggtaagcagaggggagcctgcaagcagtgtaggcaagtgccctgctgaggtgatttgccacagcagaagatctctttgcatagtttagtgctggaaataaaggatttaaggcagcaaaacatggcgttaggtcaatttaaataatgcgtggcaatgacagaaacagtgagcagccgatcatttgggggaaattgataaatatatagtatgcacgtattagtctgcaatagtcattactgtttctcactgtctggattgaagatcgttgattctgctctaccc

SEQ ID NO: 130603 - DNA, 601 bp, Human
tgtcatgaattgatatgtgtgtgtgtgtgtgtgtgtgtgtgtgtgtgtgtgtgcgtgtgtgtgttcaacctcagtagaaacagagatggttagagtcaataagaaaatgttagcttggaaattaggaaccttcaaaaaaccaaataatcatttgttcaataatcattgtcttgaagttgtttcaaaaagcagtcttttgttcaaagacataaagacaacaacaaagaatttggaaaactcatgatatttatcagtaaatggtaagatttgaaagttacgaaagtacttgctaacgttactygctgttcttcgataagctgtagtttaaaatgtcttcccttttatatcctttcagtacttttaaatgactctgtttttttgtatttgatcttaaggaactttgcattctaataaaagaaaaaagctgacttgaattgctatgtttttctatcaaaagaaaacaacaaatcctggtctcaacatgtctcacagttttccctggagtaagcataaaaacaaaacatattaggagcatgtagtgagcaatttaattccatagagatgtttcctgtcctgtaagtaaaaccaacaagcaaggagg

SEQ ID NO: 130604 - DNA, 601 bp, Human
aagagaatgtcatgaattgatatgtgtgtgtgtgtgtgtgtgtgtgtgtgtgtgtgtgtgcgtgtgtgtgttcaacctcagtagaaacagagatggttagagtcaataagaaaatgttagcttggaaattaggaaccttcaaaaaaccaaataatcatttgttcaataatcattgtcttgaagttgtttcaaaaagcagtcttttgttcaaagacataaagacaacaacaaagaatttggaaaactcatgatatttatcagtaaatggtaagatttgaaagttacgaaagtacttgctaaygttactcgctgttcttcgataagctgtagtttaaaatgtcttcccttttatatcctttcagtacttttaaatgactctgtttttttgtatttgatcttaaggaactttgcattctaataaaagaaaaaagctgacttgaattgctatgtttttctatcaaaagaaaacaacaaatcctggtctcaacatgtctcacagttttccctggagtaagcataaaaacaaaacatattaggagcatgtagtgagcaatttaattccatagagatgtttcctgtcctgtaagtaaaaccaacaagc

SEQ ID NO: 130605 - DNA, 601 bp, Human
aatggtagggttgggcatgagggaggagccacagtagaagttaacagaacaaatatttattggaaggtgattagtcgacagagagcgcatcatattagcaggctgaccaagctttgatttcagcctttgctttccagtgttaggtactggctttgagagttgcactccatttgttcattatgaaaatgtattatctgaccaaagaaaatgaagatttgcaaccttaggcactaactaaagagaatgtcatgaattgatatgtgtgtgtgtgtgtgtgtgtgtgtgtgtgtgtgtgtgcgtctgtgtgttcaacctcagtagaaacagagatggttagagtcaataagaaaatgttagcttggaaattaggaaccttcaaaaaaccaaataatcatttgttcaataatcattgtcttgaagttgtttcaaaaagcagtcttttgttcaaagacataaagacaacaacaaagaatttggaaaactcatgatatttatcagtaaatggtaagatttgaaagttacgaaagtacttgctaacgttactcgctgttcttcgataagctgtagtttaaaatgtcttcccttttatatcctttcagta

SEQ ID NO: 130606 - DNA, 601 bp, Human
ataaatggtagggttgggcatgagggaggagccacagtagaagttaacagaacaaatatttattggaaggtgattagtcgacagagagcgcatcatattagcaggctgaccaagctttgatttcagcctttgctttccagtgttaggtactggctttgagagttgcactccatttgttcattatgaaaatgtattatctgaccaaagaaaatgaagatttgcaaccttaggcactaactaaagagaatgtcatgaattgatatgtgtgtgtgtgtgtgtgtgtgtgtgtgtgtgtgtgtgygtgtgtgtgttcaacctcagtagaaacagagatggttagagtcaataagaaaatgttagcttggaaattaggaaccttcaaaaaaccaaataatcatttgttcaataatcattgtcttgaagttgtttcaaaaagcagtcttttgttcaaagacataaagacaacaacaaagaatttggaaaactcatgatatttatcagtaaatggtaagatttgaaagttacgaaagtacttgctaacgttactcgctgttcttcgataagctgtagtttaaaatgtcttcccttttatatcctttca

SEQ ID NO: 130607 - DNA, 601 bp, Human
agtatatggcagtaatggccaaaattaacagcagttcctagaaaaataacctataatatttttagaaatcgtaaaatataaagttccactgagtggtcatgtttttcttcagtaaatagcttaaaattaatatttttaagttatatgaacatgatttaatatatactaaacccattactaaaattcatttctttaaattctcaatgatcactctagcaagaacctgcaataacgccttcgataaaacaccttgctgtagccttccagatctctccactctgatcctgcctcccctgacccyttatatcttggtgctcaccttccatactgttctgtgtctactttgctataatgttgagcctgagcatgcactggggggtccttatgcccccatattttgtttttgtggcctcttaccatcagttatgggataaattatattccccccaaattcatatattgaagtccatacccctaccacttcagagtacaactgtatttgaagacagggtcttaaaggggcaattaaagacaaatacgatcatgaagataggccctaatccaatagtattggtatccttataaaaagaggagatttgta

SEQ ID NO: 130608 - DNA, 601 bp, Human
ctgggatatgaggaggggaaattaaatcccctgaatctgtgaggtttgctgtctccttaaaaattcagcttttccatacccctgactcatatcatagaatagtggcagtaaggcaacacatactttctttttatcttgccttcatgttcctgaaccatcagaagtagaaaataaaaatagcaatggcagcctggatagcagagaaaagcagcacaaagcaaaacgagaagccaacactagaggggcaaacctgccatgacaattactcaaccatagtacaggaatcacgtcttaggatgcrcacacaatcacggtacatcaagtgagtcacagataaattcatgttgtaaatatttagtgggtgattaccatgtagccatgttaatccaaaaagttggattttgctacatgcagaaatcattagacagtattctattaagcatagaaatagctctgtaatcttgtgtgttttctctgaaaatacagctgaattgaggaaaaaatgccaaatacgatagaatttagcttgtgtaaagtgtgctacatgtagatattaaatgtaatctcagatacttaccaaaaaacactttatatatgtcca

SEQ ID NO: 130609 - DNA, 601 bp, Human
tgtttgattgttaagctataagaagagagaaagtccttttaggactgcatataagaagtatatttaaaaagaaaagaaaagggaaacttttctatagcatcttctccattgtttaattatttcttttgtttaacgtaactagtaacttagaccttctgggatatgaggaggggaaattaaatcccctgaatctgtgaggtttgctgtctccttaaaaattcagcttttccatacccctgactcatatcatagaatagtggcagtaaggcaacacatactttctttttatcttgccttcatrttcctgaaccatcagaagtagaaaataaaaatagcaatggcagcctggatagcagagaaaagcagcacaaagcaaaacgagaagccaacactagaggggcaaacctgccatgacaattactcaaccatagtacaggaatcacgtcttaggatgcgcacacaatcacggtacatcaagtgagtcacagataaattcatgttgtaaatatttagtgggtgattaccatgtagccatgttaatccaaaaagttggattttgctacatgcagaaatcattagacagtattctattaagcataga

SEQ ID NO: 130610 - DNA, 601 bp, Human
ttctcatctttgagtcccttggggatttagtgctacctagcagcagagaattaaaaacaaaaaccactacaacaacaaaaatgtgtccctgaaacccatgctatattcaactgaatattctaatgtctttgattacaaagccatctctagcaatttaatacaattatgaaatggaaaagttggcaaatgcaaaacaatagctcgtgttcaaggtatgtctttattaggggaagtttatcgaaacagatgtttatgctatttcctataaactagattctaaaatattttattctataaagaygtattgactttatatgaaaaaattattgaaaaatctacaagatggtgaaactctttagaactatatttctattacaagtttatttttaatttcaaaaatgtactgcataaatgcagcaaaacctttattgtcacatattaaaacatgtacattattgtgtgcaaattaaaatttcattaccttaaaccaaaaagtgagttggccagatagtaaataatttaggctctaaggctgaaaagcgcttgtattaattactcaactccaccactattttgccaaagcagtcacagacaatatgca

SEQ ID NO: 130611 - DNA, 601 bp, Human
accacttatgtacaacactgccagcggtccctttttctagggccaaatcgcaagcattttgatacacgaactaatatcacagacagggcttctctgctttagcagcagttcacagctggaaatttttttcctgtttctcatctttgagtcccttggggatttagtgctacctagcagcagagaattaaaaacaaaaaccactacaacaacaaaaatgtgtccctgaaacccatgctatattcaactgaatattctaatgtctttgattacaaagccatctctagcaatttaatacaattaygaaatggaaaagttggcaaatgcaaaacaatagctcgtgttcaaggtatgtctttattaggggaagtttatcgaaacagatgtttatgctatttcctataaactagattctaaaatattttattctataaagatgtattgactttatatgaaaaaattattgaaaaatctacaagatggtgaaactctttagaactatatttctattacaagtttatttttaatttcaaaaatgtactgcataaatgcagcaaaacctttattgtcacatattaaaacatgtacattattgtgtgcaaat

SEQ ID NO: 130612 - DNA, 601 bp, Human
ctagtcattcctagcactttgcagtcagctctctttctctacggttattaaatctaccaaaggaaaacatctgatttggtcagtagtcaggtgctactcaatatagaatattcctgttgggtagactttctggccctgatcagaagggactgagataaataccacatgggcaaaccaagcaggaccacttatgtacaacactgccagcggtccctttttctagggccaaatcgcaagcattttgatacacgaactaatatcacagacagggcttctctgctttagcagcagttcacagctkgaaatttttttcctgtttctcatctttgagtcccttggggatttagtgctacctagcagcagagaattaaaaacaaaaaccactacaacaacaaaaatgtgtccctgaaacccatgctatattcaactgaatattctaatgtctttgattacaaagccatctctagcaatttaatacaattatgaaatggaaaagttggcaaatgcaaaacaatagctcgtgttcaaggtatgtctttattaggggaagtttatcgaaacagatgtttatgctatttcctataaactagattctaaaata

SEQ ID NO: 130613 - DNA, 601 bp, Human
agcatctgtgctctctctcagtctctagtcattcctagcactttgcagtcagctctctttctctacggttattaaatctaccaaaggaaaacatctgatttggtcagtagtcaggtgctactcaatatagaatattcctgttgggtagactttctggccctgatcagaagggactgagataaataccacatgggcaaaccaagcaggaccacttatgtacaacactgccagcggtccctttttctagggccaaatcgcaagcattttgatacacgaactaatatcacagacagggcttctmtgctttagcagcagttcacagctggaaatttttttcctgtttctcatctttgagtcccttggggatttagtgctacctagcagcagagaattaaaaacaaaaaccactacaacaacaaaaatgtgtccctgaaacccatgctatattcaactgaatattctaatgtctttgattacaaagccatctctagcaatttaatacaattatgaaatggaaaagttggcaaatgcaaaacaatagctcgtgttcaaggtatgtctttattaggggaagtttatcgaaacagatgtttatgctatt

SEQ ID NO: 130614 - DNA, 601 bp, Human
cccgccagtaactactgaggctctctgtaagcatctgtgctctctctcagtctctagtcattcctagcactttgcagtcagctctctttctctacggttattaaatctaccaaaggaaaacatctgatttggtcagtagtcaggtgctactcaatatagaatattcctgttgggtagactttctggccctgatcagaagggactgagataaataccacatgggcaaaccaagcaggaccacttatgtacaacactgccagcggtccctttttctagggccaaatcgcaagcattttgatamacgaactaatatcacagacagggcttctctgctttagcagcagttcacagctggaaatttttttcctgtttctcatctttgagtcccttggggatttagtgctacctagcagcagagaattaaaaacaaaaaccactacaacaacaaaaatgtgtccctgaaacccatgctatattcaactgaatattctaatgtctttgattacaaagccatctctagcaatttaatacaattatgaaatggaaaagttggcaaatgcaaaacaatagctcgtgttcaaggtatgtctttattagggga

SEQ ID NO: 130615 - DNA, 601 bp, Human
tcccccggttctctttcccgccagtaactactgaggctctctgtaagcatctgtgctctctctcagtctctagtcattcctagcactttgcagtcagctctctttctctacggttattaaatctaccaaaggaaaacatctgatttggtcagtagtcaggtgctactcaatatagaatattcctgttgggtagactttctggccctgatcagaagggactgagataaataccacatgggcaaaccaagcaggaccacttatgtacaacactgccagcggtccctttttctagggccaaatsgcaagcattttgatacacgaactaatatcacagacagggcttctctgctttagcagcagttcacagctggaaatttttttcctgtttctcatctttgagtcccttggggatttagtgctacctagcagcagagaattaaaaacaaaaaccactacaacaacaaaaatgtgtccctgaaacccatgctatattcaactgaatattctaatgtctttgattacaaagccatctctagcaatttaatacaattatgaaatggaaaagttggcaaatgcaaaacaatagctcgtgttcaaggta

SEQ ID NO: 130616 - DNA, 601 bp, Human
tgatgtttgtagctctgtcataggtgataaggcttcttgcagatacatggaaatatatgggagataggtaaataccttcagggagaattggaatgccactgcatcacacacacacaaacttccaatgtcacatcagcaattcaagcagttatgtcctcataaatgggtgcagttggcttctgaccatattcattctgtcattcttctgactcaatttctttttttgcttcatctgtttttactttatttcctctccatctttgtctctcctccttttcttgctcactgtctctctccccctgttctctttcccgccagtaactactgaggctctctgtaagcatctgtgctctctctcagtctctagtcattcctagcactttgcagtcagctctctttctctacggttattaaatctaccaaaggaaaacatctgatttggtcagtagtcaggtgctactcaatatagaatattcctgttgggtagactttctggccctgatcagaagggactgagataaataccacatgggcaaaccaagcaggaccacttatgtacaacactgccagcggtccctttttctagggccaaatcgcaagc

SEQ ID NO: 130617 - DNA, 601 bp, Human
aaatatgtgagtttgagatcatttgctaaaccataaatagggctgttgtgtgatttattcccttcacattttattttgaaaataatcaattagctatatatatattagtgagactctgatgtttgtagctctgtcataggtgataaggcttcttgcagatacatggaaatatatgggagataggtaaataccttcagggagaattggaatgccactgcatcacacacacacaaacttccaatgtcacatcagcaattcaagcagttatgtcctcataaatgggtgcagttggcttctgacyatattcattctgtcattcttctgactcaatttctttttttgcttcatctgtttttactttatttcctctccatctttgtctctcctccttttcttgctcactgtctctctcccccggttctctttcccgccagtaactactgaggctctctgtaagcatctgtgctctctctcagtctctagtcattcctagcactttgcagtcagctctctttctctacggttattaaatctaccaaaggaaaacatctgatttggtcagtagtcaggtgctactcaatatagaatattcctgttgggt

SEQ ID NO: 130618 - DNA, 601 bp, Human
caaactgattcactcattgacgcacctgaccccctaaatatgtgagtttgagatcatttgctaaaccataaatagggctgttgtgtgatttattcccttcacattttattttgaaaataatcaattagctatatatatattagtgagactctgatgtttgtagctctgtcataggtgataaggcttcttgcagatacatggaaatatatgggagataggtaaataccttcagggagaattggaatgccactgcatcacacacacacaaacttccaatgtcacatcagcaattcaagcagtyatgtcctcataaatgggtgcagttggcttctgaccatattcattctgtcattcttctgactcaatttctttttttgcttcatctgtttttactttatttcctctccatctttgtctctcctccttttcttgctcactgtctctctcccccggttctctttcccgccagtaactactgaggctctctgtaagcatctgtgctctctctcagtctctagtcattcctagcactttgcagtcagctctctttctctacggttattaaatctaccaaaggaaaacatctgatttggtcagtagt

SEQ ID NO: 130619 - DNA, 601 bp, Human
tacaattttccataatggcagcactaattcacagtcccaccagcagtgcacagcctcttctgtccctcaacctgacccatcacttcctacacccaaactgattcactcattgacgcacctgaccccctaaatatgtgagtttgagatcatttgctaaaccataaatagggctgttgtgtgatttattcccttcacattttattttgaaaataatcaattagctatatatatattagtgagactctgatgtttgtagctctgtcataggtgataaggcttcttgcagatacatggaaatatrtgggagataggtaaataccttcagggagaattggaatgccactgcatcacacacacacaaacttccaatgtcacatcagcaattcaagcagttatgtcctcataaatgggtgcagttggcttctgaccatattcattctgtcattcttctgactcaatttctttttttgcttcatctgtttttactttatttcctctccatctttgtctctcctccttttcttgctcactgtctctctcccccggttctctttcccgccagtaactactgaggctctctgtaagcatctgtgctctctct

SEQ ID NO: 130620 - DNA, 601 bp, Human
gacacttcgactgattccataagttggctattgcacatagtgccacaatcaacatgggagtgcagacatctcttggacataatgatttcgaatcttttaggtaaatacccagaaaagggattgctggatcatatggcaattctatttttagttatttgaggaacctccatacaattttccataatggcagcactaattcacagtcccaccagcagtgcacagcctcttctgtccctcaacctgacccatcacttcctacacccaaactgattcactcattgacgcacctgaccccctaaayatgtgagtttgagatcatttgctaaaccataaatagggctgttgtgtgatttattcccttcacattttattttgaaaataatcaattagctatatatatattagtgagactctgatgtttgtagctctgtcataggtgataaggcttcttgcagatacatggaaatatatgggagataggtaaataccttcagggagaattggaatgccactgcatcacacacacacaaacttccaatgtcacatcagcaattcaagcagttatgtcctcataaatgggtgcagttggcttctgaccata

SEQ ID NO: 130621 - DNA, 601 bp, Human
tggtaaccaccatctaccctctgttttcatgagtgcaattgttttacattccacatataagtgagaataaaagtgttttacattccacatataagttataagaaaaggaaaacttttctgtatgagaatgtgtggtatttgtctgtgtttggcttatttcacttagcataatgttctccaattccattcatgttattgcaaatgacagaacttcttccctttgtaaggctgaatagtatttcattgtgtatatgtatgtaccacattgtctttatctatttatgtgttgatggacacttcractgattccataagttggctattgcacatagtgccacaatcaacatgggagtgcagacatctcttggacataatgatttcgaatcttttaggtaaatacccagaaaagggattgctggatcatatggcaattctatttttagttatttgaggaacctccatacaattttccataatggcagcactaattcacagtcccaccagcagtgcacagcctcttctgtccctcaacctgacccatcacttcctacacccaaactgattcactcattgacgcacctgaccccctaaatatgtgagt

SEQ ID NO: 130622 - DNA, 601 bp, Human
tacaaagcaatgttatgatttctgaatacaatgtggaattattaaatcaagctaattaacttatccatcacctcaaatatttgacattttcttgcaacaaaaacatttcagatttactctcttagtgatatggagatgtacattactcagttattagctgtattcactacactgtgcaacagatctataaaaaatactcaaaattatttatcctatctaactgaggctttgtatcctttgattatcatttccccattccttccaccccccagcctctggtaaccaccatctaccctctgtwttcatgagtgcaattgttttacattccacatataagtgagaataaaagtgttttacattccacatataagttataagaaaaggaaaacttttctgtatgagaatgtgtggtatttgtctgtgtttggcttatttcacttagcataatgttctccaattccattcatgttattgcaaatgacagaacttcttccctttgtaaggctgaatagtatttcattgtgtatatgtatgtaccacattgtctttatctatttatgtgttgatggacacttcgactgattccataagttggctattg

SEQ ID NO: 130623 - DNA, 601 bp, Human
ttatagttatatatatatatgaagtacaaagcaatgttatgatttctgaatacaatgtggaattattaaatcaagctaattaacttatccatcacctcaaatatttgacattttcttgcaacaaaaacatttcagatttactctcttagtgatatggagatgtacattactcagttattagctgtattcactacactgtgcaacagatctataaaaaatactcaaaattatttatcctatctaactgaggctttgtatcctttgattatcatttccccattccttccaccccccagcctcyggtaaccaccatctaccctctgttttcatgagtgcaattgttttacattccacatataagtgagaataaaagtgttttacattccacatataagttataagaaaaggaaaacttttctgtatgagaatgtgtggtatttgtctgtgtttggcttatttcacttagcataatgttctccaattccattcatgttattgcaaatgacagaacttcttccctttgtaaggctgaatagtatttcattgtgtatatgtatgtaccacattgtctttatctatttatgtgttgatggacacttcg

SEQ ID NO: 130624 - DNA, 601 bp, Human
atactgacaaattatagttatatatatatatgaagtacaaagcaatgttatgatttctgaatacaatgtggaattattaaatcaagctaattaacttatccatcacctcaaatatttgacattttcttgcaacaaaaacatttcagatttactctcttagtgatatggagatgtacattactcagttattagctgtattcactacactgtgcaacagatctataaaaaatactcaaaattatttatcctatctaactgaggctttgtatcctttgattatcatttccccattccttccacmccccagcctctggtaaccaccatctaccctctgttttcatgagtgcaattgttttacattccacatataagtgagaataaaagtgttttacattccacatataagttataagaaaaggaaaacttttctgtatgagaatgtgtggtatttgtctgtgtttggcttatttcacttagcataatgttctccaattccattcatgttattgcaaatgacagaacttcttccctttgtaaggctgaatagtatttcattgtgtatatgtatgtaccacattgtctttatctatttatgtgttga

SEQ ID NO: 130625 - DNA, 601 bp, Human
tgaaaaatataaattgttgttagttgtaaatccaacatcataaaacaaatcttgtgcacaagtattttctttgcccctcatgccatcatttttgttgttttaaccaattaactctacatttaaaaatgaggagaattcacataaagctgtgatttctagcttctcttgaaaaatcagaagatttagcaaggggccctatagtccttgatggaacaatcagttggagctgagtagaacctgcctattttcattttttaaaaaatttgattggctttttttgtatactgacaaattatagttttatatatatatgaagtacaaagcaatgttatgatttctgaatacaatgtggaattattaaatcaagctaattaacttatccatcacctcaaatatttgacattttcttgcaacaaaaacatttcagatttactctcttagtgatatggagatgtacattactcagttattagctgtattcactacactgtgcaacagatctataaaaaatactcaaaattatttatcctatctaactgaggctttgtatcctttgattatcatttccccattccttccaccccccagcctctggtaacca

SEQ ID NO: 130626 - DNA, 601 bp, Human
tcatttcacaagatgaactagaatcaaggccattttcgtggaggaaaaaaatcatagaaaagggttattgatttatgccccaaatagactgccattgcaagagggctgtgaaaaatataaattgttgttagttgtaaatccaacatcataaaacaaatcttgtgcacaagtattttctttgcccctcatgccatcatttttgttgttttaaccaattaactctacatttaaaaatgaggagaattcacataaagctgtgatttctagcttctcttgaaaaatcagaagatttagcaagggkccctatagtccttgatggaacaatcagttggagctgagtagaacctgcctattttcattttttaaaaaatttgattggctttttttgtatactgacaaattatagttatatatatatatgaagtacaaagcaatgttatgatttctgaatacaatgtggaattattaaatcaagctaattaacttatccatcacctcaaatatttgacattttcttgcaacaaaaacatttcagatttactctcttagtgatatggagatgtacattactcagttattagctgtattcactacactgtgc

SEQ ID NO: 130627 - DNA, 601 bp, Human
tactaactttccctagagaatgatgcaatgaaatgtactacccaatgaacataaatagaaattattactgaagccttatttggcctttgtgacaagtgagaaaatatatgtaaatctaaatgattacaataaaaagacctataattgttaacaggaaataatatccaaacaagagactaccttcttaacagtgtagagtttaaggaaaatgcaagtagaataagtgaagaaagaaaaacaaaattggcaagagtggtataaagattaacaactacagtgaactgtagctattttcctattktcagatgaaatccttagatttgaggaaaagagccgtggtccacacccaaacaccaccattgctttggattgctgaaacaacaggaaataaagctaagacatttctggtacaaaatgacagctcttcattttagtgtcactcaggttgacaactgatgcacaggatacatgtcacaactcatcactgcctatcttgagggtatgggccttgcaagcctccagcaaaaatgaaaactctgaacaacacagtgaaatctcatttcacaagatgaactagaatcaaggccattttcgtggagga

SEQ ID NO: 130628 - DNA, 601 bp, Human
tctaattctagtattttggttttttttttcattttctattaatttctcccaaatctcatttttaccaagctttattttttaaaatagtaacttctttttactctcttttatccactctaccttttttaaaattagtaatcaaggcattccatcttttatgtaattatatccaataagagtaactgccgtaaacatttaagaactaagctgttcctaataatgtctagagcatagtcaactacatttgagtgaagagaactaggattggggtagatttactagctggctctattcattttctttttttttttttaacttttgtttagattcagtgggtacatgtgcaggtttgttacatgggtatattgtgtgatgggaaggagggaaggtgcaaaggcaaaaaactacccattgggtactatttatttgcttttaactatctatgtgtgtcccatcattaagtgtacattgttaaaataaatacaccacctagacgttaaacaccaatttccataaagctaggtgcattcttcacacttcagcatgcctcattgtccctttttggaaaatttttaatgccttatacctgagtccaccataa

SEQ ID NO: 130629 - DNA, 601 bp, Human
ttaaaaagcttctattatgcctcaattttcagaatctcctcttaatatttaaatgactttacattattattcatattattattaataataatgcccttacattattcttatttttttcttcattgcaaataatgtatactgaaagaggcttcttctccttgcttttggtcttcaaccagatgttcaatgcctttctgatattaagacttcagattctacctctgggtcccatctctatcatcaaatcttataatcatttcagtttgttccctaggtgaggttctaattctagtattttggttttttttttcattttctattaatttctcccaaatctcatttttaccaagctttattttttaaaatagtaacttctttttactctcttttatccactctaccttttttaaaattagtaatcaaggcattccatcttttatgtaattatatccaataagagtaactgccgtaaacatttaagaactaagctgttcctaataatgtctagagcatagtcaactacatttgagtgaagagaactaggattggggtagatttactagctggctctattcattttctttttttttttttaactttt

SEQ ID NO: 130630 - DNA, 601 bp, Human
tattaaaaagcttctattatgcctcaattttcagaatctcctcttaatatttaaatgactttacattattattcatattattattaataataatgcccttacattattcttatttttttcttcattgcaaataatgtatactgaaagaggcttcttctccttgcttttggtcttcaaccagatgttcaatgcctttctgatattaagacttcagattctacctctgggtcccatctctatcatcaaatcttataatcatttcagtttgttccctaggtgaggttctaattctagtattttggttttttttttcattttctattaatttctcccaaatctcatttttaccaagctttattttttaaaatagtaacttctttttactctcttttatccactctaccttttttaaaattagtaatcaaggcattccatcttttatgtaattatatccaataagagtaactgccgtaaacatttaagaactaagctgttcctaataatgtctagagcatagtcaactacatttgagtgaagagaactaggattggggtagatttactagctggctctattcattttctttttttttttttaactt

SEQ ID NO: 130631 - DNA, 601 bp, Human
tgtaaagcgtaagctgtcatgcacctgaggttcatgtgttctccaactttaaaaggttccagtaaaattcaaaggatctcaggactacccgaggtaaactggggtgagaagacgaattttaaaacaaatatatgaaactttttatagatagtattagttttctaagataaaaaagtatattaaattaaaaattccaataacatttatatatattaataaggactttttattaaaaagcttctattatgcctcaattttcagaatctcctcttaatatttaaatgactttacattattattyatattattattaataataatgcccttacattattcttatttttttcttcattgcaaataatgtatactgaaagaggcttcttctccttgcttttggtcttcaaccagatgttcaatgcctttctgatattaagacttcagattctacctctgggtcccatctctatcatcaaatcttataatcatttcagtttgttccctaggtgaggttctaattctagtattttggttttttttttcattttctattaatttctcccaaatctcatttttaccaagctttattttttaaaatagtaac

SEQ ID NO: 130632 - DNA, 601 bp, Human
gttgattcatgtaagtttctaaattcttctctaatcatttggatcacttcaaaatgtaaagcgtaagctgtcatgcacctgaggttcatgtgttctccaactttaaaaggttccagtaaaattcaaaggatctcaggactacccgaggtaaactggggtgagaagacgaattttaaaacaaatatatgaaactttttatagatagtattagttttctaagataaaaaagtatattaaattaaaaattccaataacatttatatatattaataaggactttttattaaaaagcttctattakgcctcaattttcagaatctcctcttaatatttaaatgactttacattattattcatattattattaataataatgcccttacattattcttatttttttcttcattgcaaataatgtatactgaaagaggcttcttctccttgcttttggtcttcaaccagatgttcaatgcctttctgatattaagacttcagattctacctctgggtcccatctctatcatcaaatcttataatcatttcagtttgttccctaggtgaggttctaattctagtattttggttttttttttcattttct

SEQ ID NO: 130633 - DNA, 601 bp, Human
tcttcttcttggccatcctcccctgtatcctcacaggtcttccctctgtacatgtctgtgtcctaatttcctctttgtgtaaggacaccaatcaaattggattagggcccaccctaattacatcattttgatttcattacctccttaaaagccttatcttcaaaggcaatcatattgggggttaggactccaacataccctcaaaaatttgggggaaggaggcagaattcaacccataaagcttttctttttccagttcatctgattcttgtgtattctcttattgttgctgacaattaarccacatagcatttatataggctggtggaagttggatggtgttgtgccttttaagaaacttgaaaagaaccaactgtctccacactggattttctgaacacacaagccagggaggtcaacactgatgactcacatcatgtcgctatttaatcctgtcccaccttctaacatacaatctgtcttgtcttcccaattccactttgctatgtattatctaaaatgcagaatccaaggctaattctgctctttatttccaggtgctcattcaaaatatataataagcaatgtgaaaaaaacacta

SEQ ID NO: 130634 - DNA, 601 bp, Human
cggaagtctaagtgttggcaaggttgttccctcctaagccttctcctcttcttcttggccatcctcccctgtatcctcacaggtcttccctctgtacatgtctgtgtcctaatttcctctttgtgtaaggacaccaatcaaattggattagggcccaccctaattacatcattttgatttcattacctccttaaaagccttatcttcaaaggcaatcatattgggggttaggactccaacataccctcaaaaatttgggggaaggaggcagaattcaacccataaagcttttctttttccrgttcatctgattcttgtgtattctcttattgttgctgacaattaagccacatagcatttatataggctggtggaagttggatggtgttgtgccttttaagaaacttgaaaagaaccaactgtctccacactggattttctgaacacacaagccagggaggtcaacactgatgactcacatcatgtcgctatttaatcctgtcccaccttctaacatacaatctgtcttgtcttcccaattccactttgctatgtattatctaaaatgcagaatccaaggctaattctgctctttatttcc

SEQ ID NO: 130635 - DNA, 601 bp, Human
agaattctaagagaactcatcttcactaagtctgtctgtcatcatgaactacctattatgttttgttttctcccatttctctgagaacaggaatttttacatagggaaagacttaattatttgcttagagatttctgatgattcttgatgatgaagagaaaatactttttgtattagttttctagggctgccataacaaaataccatggttggaggggtggaggacggggagttaaacaacagaaatgtatttcctcacagtctaaaaaagtctaaggtctaagaaagtctaaggtctacrgaagtctaagtgttggcaaggttgttccctcctaagccttctcctcttcttcttggccatcctcccctgtatcctcacaggtcttccctctgtacatgtctgtgtcctaatttcctctttgtgtaaggacaccaatcaaattggattagggcccaccctaattacatcattttgatttcattacctccttaaaagccttatcttcaaaggcaatcatattgggggttaggactccaacataccctcaaaaatttgggggaaggaggcagaattcaacccataaagcttttctttttccag

SEQ ID NO: 130636 - DNA, 601 bp, Human
ggatgtcaccctttctctataaccaacaaacagcgctggctgctcacaaccaccaccaaagtgcccactgctggtctgatgtgttggcagtaagacaccagctcacagattagaccacaccttcaacctcacctcccagaattctaagagaactcatcttcactaagtctgtctgtcatcatgaactacctattatgttttgttttctcccatttctctgagaacaggaatttttacatagggaaagacttaattatttgcttagagatttctgatgattcttgatgatgaagagaaaatrctttttgtattagttttctagggctgccataacaaaataccatggttggaggggtggaggacggggagttaaacaacagaaatgtatttcctcacagtctaaaaaagtctaaggtctaagaaagtctaaggtctacggaagtctaagtgttggcaaggttgttccctcctaagccttctcctcttcttcttggccatcctcccctgtatcctcacaggtcttccctctgtacatgtctgtgtcctaatttcctctttgtgtaaggacaccaatcaaattggattagggcccaccctaatt

SEQ ID NO: 130637 - DNA, 601 bp, Human
cacctatctatctatttatctattatctattatcaatatctatctttaaagtaggataccttatatattgtaaccgtattctattatcaaagtagctggctctatagtattatatgtgttcagagggtttttttcctcctttcataaatcatttttgagtcttttctacgggatagagagaatcaagtgtaaggtgtattgaagattaagttaatttatagtgcttctctttgctatcagtgtattctcaatgttttaataacaatgcatggaccccactccctatgttttaggacatagrgtgatcactgcattttgcccaagtttcattgtcacctgccaggaactgaactggacataagattcatccatgttcctgaagacccttctctgccatctggcatgcaccctgagtcagtgtccaggagcttggctgatagaaccagccactggatgtcaccctttctctataaccaacaaacagcgctggctgctcacaaccaccaccaaagtgcccactgctggtctgatgtgttggcagtaagacaccagctcacagattagaccacaccttcaacctcacctcccagaattctaagag

SEQ ID NO: 130638 - DNA, 601 bp, Human
atcatgacagactctatttaaatatccacagtttcaaagcctagcttctcccaaagattaaaaaaaaaaaaacccaaaccaaaacaaagcaaaagctattagaaaacaatattattttctatattaataaataaagaaaaacaatattaaagtagataatataaagtaaaacaatattatctaagagctgggcaacttgatgtatgtagggtttgcagctgtgtcattttaagccattcttgatattactaactgggtactacaagttaaactttaagtttaaactaaactacattatctrtctatcacctatctatctatttatctattatctattatcaatatctatctttaaagtaggataccttatatattgtaaccgtattctattatcaaagtagctggctctatagtattatatgtgttcagagggtttttttcctcctttcataaatcatttttgagtcttttctacgggatagagagaatcaagtgtaaggtgtattgaagattaagttaatttatagtgcttctctttgctatcagtgtattctcaatgttttaataacaatgcatggaccccactccctatgttttagga

SEQ ID NO: 130639 - DNA, 601 bp, Human
tctttagttttaatattttaaaaattatatatagatatgtaaattattcaaaggcagggagcatcccttctgctttgtaaagaatatttgcggtgagggttagcaaccccagctgatcatgacagactctatttaaatatccacagtttcaaagcctagcttctcccaaagattaaaaaaaaaaaaacccaaaccaaaacaaagcaaaagctattagaaaacaatattattttctatattaataaataaagaaaaacaatattaaagtagataatataaagtaaaacaatattatctaagwgctgggcaacttgatgtatgtagggtttgcagctgtgtcattttaagccattcttgatattactaactgggtactacaagttaaactttaagtttaaactaaactacattatctgtctatcacctatctatctatttatctattatctattatcaatatctatctttaaagtaggataccttatatattgtaaccgtattctattatcaaagtagctggctctatagtattatatgtgttcagagggtttttttcctcctttcataaatcatttttgagtcttttctacgggatagagag

SEQ ID NO: 130640 - DNA, 601 bp, Human
tttaagccctgggttttagattccaaatttgatacttttgtctccacataacacagatgtaaaatagtttttaaagaagcttagagagtttacagacttgttgatttttagttaagtggttaatattactaggtaattgattcagcagctgggataagataaataattaaatgaatgtttatataagcaaagagccaaaccagcaattgaatcaataaagcctactatgctttcatttttctctggctctcctttccaacttcccttgaataaaggtatcccttaaaattcagtacatgtyctttttggtctatggagatctcattctttttgatgacttcataaccttaattttgcatttctatgactgaccttcagtttgaattccagtcctgtctcctaatgtctactgaatattctcactttgagtttttttcgttatgtcctcaaagtcagtattactctatgtccccaactggctccttgtcctaaattttccttcccagacactaagcgttagccatatttaattacttagccaaataattgttatatcctattcattcttccttaaattatgtctatatattgcacttacatc

SEQ ID NO: 130641 - DNA, 601 bp, Human
ggaagactggatgttgtctttttttctaccgtattctcagcatcagagctgtgcctgatcacgatagaaactcaaagactaaatgaatacatgagtgtcatacatatatcgaatagtagactttcaattgttgcattttctaaaaaagcaggaaagagtcagggactagcatggtatatagcagagggctgacgtagttcctttaactgtattatctcatttaattattaaaaaatatggagtatctttcattctcattttagagctgaagcctctgattttagaatttaaattgcccaakctaaacttgtccaatctaaagatatacacttaggaagtgactgccagcatttaagccctgggttttagattccaaatttgatacttttgtctccacataacacagatgtaaaatagtttttaaagaagcttagagagtttacagacttgttgatttttagttaagtggttaatattactaggtaattgattcagcagctgggataagataaataattaaatgaatgtttatataagcaaagagccaaaccagcaattgaatcaataaagcctactatgctttcatttttctctggctctc

SEQ ID NO: 130642 - DNA, 601 bp, Human
atgtaatttagcaatatttttacataaaaccattatgtgtttaaatttatataaattccattttgaaatatttctcaaatatttctccaaatgtaaacaacagataaaagacacatgaatcaatgcatttgcatacatctaatctgaaggtataaatattttgggtttaaactattgatctgaatattgcactgaacactatcattattatcttaatatgttcatataaggtcccaaggtaattcgacatttttaatgtgtcctaatggtaacatgatttgactattatatttacaaaagsaacaactagcaccctactttctagcaaacaataatgtcatgtagaatctcttagagaaactgcatgggctatgtgtttctttagtaattttttcttggacaaatttaaagttgtatctttttattttcagcaagtatcatgccttgaaaaacctcccttctctgtggttctatggtaaagtatcaagggcatagactctgaaacctgatggtcgcacattcggattttgattcagctacttcttaactgactggcactgggcaattcacttaatatccctgagcatcagtttgggtatct

SEQ ID NO: 130643 - DNA, 601 bp, Human
gtatgaatatttcagcgactaaggcacgtttccaagaaataagaattaaggggaaaatgtaatttagcaatatttttacataaaaccattatgtgtttaaatttatataaattccattttgaaatatttctcaaatatttctccaaatgtaaacaacagataaaagacacatgaatcaatgcatttgcatacatctaatctgaaggtataaatattttgggtttaaactattgatctgaatattgcactgaacactatcattattatcttaatatgttcatataaggtcccaaggtaattygacatttttaatgtgtcctaatggtaacatgatttgactattatatttacaaaagcaacaactagcaccctactttctagcaaacaataatgtcatgtagaatctcttagagaaactgcatgggctatgtgtttctttagtaattttttcttggacaaatttaaagttgtatctttttattttcagcaagtatcatgccttgaaaaacctcccttctctgtggttctatggtaaagtatcaagggcatagactctgaaacctgatggtcgcacattcggattttgattcagctacttctt

SEQ ID NO: 130644 - DNA, 601 bp, Human
ttatagattacagcatgaattttgctgtggttgtgtgtttttatgagcatgtgtgactatgtatgtatctatagatagacactgcttgtaatttcttaaagaaaacagcttctacttgttttgttcaaaatgtctgaagccaattgtttttgtttgcttttagaaaaaaaaaaaactgacatcaaggagagagcataacacagcccccactaccaccaattatgcagccgagtgagtttcccacatttggggaaatcacggaaatcagcacatcagaatgcaatgggtaagctcaccctgsgaaaaaccattttcatgatcatgccatctcccctgccgggtaagaccagtctgtgaatttctctgttgtcataacatatgcccagcaaacatggatttgttatgttctacctcacttctagtgagatatatcacttaatgaaataagtgactgaaaagtcacagaagatttcaaagcaccatgttatctgccctcccttgcctcctagtccggaatcaccccctttagttatctcacctccctttatgtgatattaaagaatcatttgaaaaggccagaggttgtagctgggatcaaaag

SEQ ID NO: 130645 - DNA, 601 bp, Human
ctatggtcactggctgtaacatccttctcctgtcctgcttcccatggtcaaatgtttgtcattctcaaggtccttttaggttctgccccacctggctctttaggcccacacaacctctccccgtttctaaaaagtgtttatagattacagcatgaattttgctgtggttgtgtgtttttatgagcatgtgtgactatgtatgtatctatagatagacactgcttgtaatttcttaaagaaaacagcttctacttgttttgttcaaaatgtctgaagccaattgtttttgtttgcttttagaaaaaaaaaaaactgacatcaaggagagagcataacacagcccccactaccaccaattatgcagccgagtgagtttcccacatttggggaaatcacggaaatcagcacatcagaatgcaatgggtaagctcaccctgggaaaaaccattttcatgatcatgccatctcccctgccgggtaagaccagtctgtgaatttctctgttgtcataacatatgcccagcaaacatggatttgttatgttctacctcacttctagtgagatatatcacttaatgaaataagtgactgaaaagtcaca

SEQ ID NO: 130646 - DNA, 601 bp, Human
ctccatctcaaaataaaataaaataaaacccagaggggaagaatctatatgcacactgtaatgaaactgtgataaaacatatgctcggaagcacatccttgaggtacttcgtgagagtgcctggtaaatcaaatgtctgggatgcttgcttcagtcaatgaggcaaaggaaagtccggctgccaaattatttacttaagaagtggttataatgttattttacccagttggaactgtctgcctatactagcttagtgctcaatacagttcaattctgttgatcatttttttcgaaatctcaygtacattcttctcatctaaagatgcccgttgccatcgctaagccaccctattgtccatctcttcccagtacaacccacaccatgtgaatgttgcaacaccacttccatcatggttcatcatggttctccttgtgtaagtagctcacctattgaagcaagcctaaacctccatcgccttgcctcagtctgcagctgatggtcttccacaccattcctgcaggcagcctcttcctggcagtcaggctgggctccttgctgaatggtctgtacagtgtgctccttggtacctgttttgctttt

SEQ ID NO: 130647 - DNA, 601 bp, Human
ttcaattacattaattatctgctatgtgcaggagaaagttttgaatctaaaataacattaatttaatctcaaggttagagagagattttaaacttcctttaaaccccaaaatgccgaggcgggtggatcacccgaggtcaggagtttgagaccagcctgaccaacatggtgaaaccccatctctattaaaaatgcgaaaaaattagttgggcatggtgagaggcacctgtaattccagctagtcgggaggctagggtaggagaatcgcttgaacccaggaggtggaggttgcagtgagccragatcgcaccattgcactccagcctgggtgacaagagcaagactccatctcaaaataaaataaaataaaacccagaggggaagaatctatatgcacactgtaatgaaactgtgataaaacatatgctcggaagcacatccttgaggtacttcgtgagagtgcctggtaaatcaaatgtctgggatgcttgcttcagtcaatgaggcaaaggaaagtccggctgccaaattatttacttaagaagtggttataatgttattttacccagttggaactgtctgcctatactagcttagtgct

SEQ ID NO: 130648 - DNA, 601 bp, Human
cagttgtgaaagtgttttggaaactccaaagtgctgtggtaacataagcaattgctactgtcattgagaaatgctaccaataatacttagagaatttgatacaactcagtctgaaaaagctaagattagcagaacagagctgtctccaaatatttgaagaactattttatttaagggattggacccatttttgtatgtagttccagaggagcagatggtgaccactgtccaggcagatgtgtctcaatgtaaggacaacatctgtaatattaataattagaatgtatcctgtaattttctstctacccttggaaaccagtcgagatccagagtctttcactgggaggcttaaagcctagagcagccttggtgctagaggcggacagggataatgaactaatcttgaaccaattcatccatagcaatctcaatgctttcgttagctcttataggtatttaatacggccagaggaatgaaggtagtcttgctggtttagaagccctgcctaccacaacccctacaccaccccatcccctgcatagtctgatgtcatcactagtggaaatgtttaaacagcagtgaatatgcatgatagacaga

SEQ ID NO: 130649 - DNA, 601 bp, Human
tccagcctgatttcctcatttcacagatgagtaatcagttgctctgggagaggatgttatctgcccaaggtcacttagctaataggaaatctaatctgcgactaatgacaaatgtgtgctctttctttcacaccaagcacttgtgggcattttttttttcttgtcagtgatataggtgaacacaatttcataaaacttgcagatggacagaaactgagaggaagatctaatgtgtgagaaatgataaaataagagttcaaaagaaggttggcaacttagagaggtagaaagaaaatggcaraatacaattttatagaaatcagtgtagagttctcctctgagttaaccacacatgcacagactcctcacacatttagttatggaatgaagaaggtacatcttaagaagagcttgtaccaggacagctagttgcagaaagactagcttaagtgggtttcatgaatccaagtgcagtgtctgctgtactgaagttaatggtctgttaatttggtttagagacagaagacttgggctaaagtcccaaccaggtgtgagtattatctgggtatcatctgtaatttttaaaaatgtattcctccca

SEQ ID NO: 130650 - DNA, 601 bp, Human
agatgattaattatgtcttgggttgggtgctctctttattttcttttctctcaggctagaaaagctttggtttctataattacttctcatttatctctagttaaatgtgggcgaaattttctattaattaaatttgaattcactctaattggtaagtttaaaacgacaggaataaattatagcacatattgcaacccaaataaggctgaattaaacagatacattatgtggcaatgaagcaatgttaagaaagaagatcccacaaattcttcaagttcaaagactaaaataatttctggcrttctgttaaggttagaaaataaggattctcttttattaggcaaatgtttggaagaagcatttgaaggctaccacttatagaatcaaagataattttcctacacagagcagaaaaagaggactcactgaagactccaaattatgaactatttttaatcatttatttggcttagttatttataatcaatttactctgttgatttctaaacataaaaaatatatagatagcaaatggactatcagggacttcatgaagccattgtttttgattaaggaaaggtgtggtagctattctgcttaa

SEQ ID NO: 130651 - DNA, 601 bp, Human
tctgaatggaaaaataaaatagttgcaacatgcctttacatagacatgcattttagacagtctgtctttaaactatagtatcaggacagactttccatgtagaagagatgattaattatgtcttgggttgggtgctctctttattttcttttctctcaggctagaaaagctttggtttctataattacttctcatttatctctagttaaatgtgggcgaaattttctattaattaaatttgaattcactctaattggtaagtttaaaacgacaggaataaattatagcacatattgcaacycaaataaggctgaattaaacagatacattatgtggcaatgaagcaatgttaagaaagaagatcccacaaattcttcaagttcaaagactaaaataatttctggcgttctgttaaggttagaaaataaggattctcttttattaggcaaatgtttggaagaagcatttgaaggctaccacttatagaatcaaagataattttcctacacagagcagaaaaagaggactcactgaagactccaaattatgaactatttttaatcatttatttggcttagttatttataatcaatttactctg

SEQ ID NO: 130652 - DNA, 601 bp, Human
tttgaaacacattttaatgatttttgaaataaaaatatacatactttaaaggagagggattaaaatttttctcttaaatttgagagtttagacaaactctcaagttaagtacttgtaccacctttccagcccatatacatgtataaaacaatgttgtcaaacagatgttattttctgtctgctcttgatacatttcaataaaatacataagtaatatattcaaatacaacagccattcacattcacaggaaagaaaaggcattgttgaaataagacatgaattattgtgttcaggaggacwttggggaggcttcctagaccagagaaaatttggctatagttatgttatgtcacatatacattatgtgacaatgaagcaatattaaaaaagaagaacccacaaataactcaagttcaaagacaaaaataaattctagctttaaagttaaaagctgaaaagtgccagaattttctaactgcacaatctaaaagccaatccattgttgcctgctaattaagccaccacggggtttcatataattaatagcaaatcgtctctgaatggaaaaataaaatagttgcaacatgcctttacatagac

SEQ ID NO: 130653 - DNA, 601 bp, Human
attagtcctattatctcagctcagggttgaaagtacttaaattattaataagacaaaacagtcatctaattgttttcttttcttgtatgacatttctgtaactacagaacaagaaagaaatgtcaattatatatcaatgagtaattcctgttaaagtgcatagtgaaaaataccaagtaagaaactacaaaagctaaaatgggttagcataatagtaagatactaaacctgatgcttttcaaaaaattgttaatttggagcaaatggacagaacacactgcatttctaaacaacctaatcratagtactcaaatatctactgcagtgttctaggaacattatttaaatcaaagaatgacatagaactatcaaggaactaacttattgaggaaatatacaacaaatagtaacaaaatgcacagatttaaaactatattaaacaaacaaaacacacagatttaaaattatattaaactatattaaattatattaaactatactaaattaaattaaaactgtgtgaatattttcaatctagtaaaatcaatgttgagttaattgatctaagatattgtagaggatgcttaatgcttaaatatct

SEQ ID NO: 130654 - DNA, 601 bp, Human
taacaggagagactctgcatgtgggggcaaggggcataaggggaatctctgtgccttcatctcactttttctgagcatctaagagtgctgtaaaaacataaaagtctttttttaagtacatttatatcaagattttattcctgtggattttcctgcattcataacggaagaatcacttatgaattgtttgggtctaactgtaatttttgtacaaaccattcattgtgggctaatgtgtgctgttacattaatgctgttagtaattccctcatgtttgctatatatttttatctttacctcrttattgtatatattagtgagactacaaaacacaaacattttaactgaaatattaaatactgttttataagtgggattcattaaaacaaacatttggataatgaatgacaggttaaatttcatttaatgattaataaaataaatattgcactaaaaaagaatagcctgaaatactagtattagtcctattatctcagctcagggttgaaagtacttaaattattaataagacaaaacagtcatctaattgttttcttttcttgtatgacatttctgtaactacagaacaagaaagaaatgt

SEQ ID NO: 130655 - DNA, 601 bp, Human
cacagaagatttttagggcagtgaaaatactctgtatgatactataatcatggatacatgtcatcatatatttgtccaaacccacagaatgtataacaccaaggataaaccctaatgtaaatgatggactttgggtgctaatgatgcgtcatgtaggttcatcaattgtcacaaatgcaccactctggtgggggatgttggtaacaggagagactctgcatgtgggggcaaggggcataaggggaatctctgtgccttcatctcactttttctgagcatctaagagtgctgtaaaaacataaaagtctttttttaagtacatttatatcaagattttattcctgtggattttcctgcattcataacggaagaatcacttatgaattgtttgggtctaactgtaatttttgtacaaaccattcattgtgggctaatgtgtgctgttacattaatgctgttagtaattccctcatgtttgctatatatttttatctttacctcgttattgtatatattagtgagactacaaaacacaaacattttaactgaaatattaaatactgttttataagtgggattcattaaaacaaacatttggata

SEQ ID NO: 130656 - DNA, 601 bp, Human
agtattagacaacagaaactctcattcactgctggtgggaataaaaaaaaaatggtacaaccactttagaagacagtttgatggtttctcataacaactaaacattgtcttactacatgatccaccagtcatactccttgatatgtaccctaaaatgctaaaaacttctgtctacacgaaaacctgcatgcaaatatctatggcagctgcattcataatttgccaaaacttgaaagcaaccaagatggccttcagtaggcaaatggataggtaaactgtggaacatccaggcaatgaagtrttattcatctctaaaaggaaatgagctatcaatccatgaacagacatggaataaacttacgtgtgtattactaagtgaaaggagccaatcttaaaagcctacataccacatgattccaactgcatgacatactgtaaaaggcaaaacaatggaaacagtaaaaagatcagtggttgccaggaactggggtggggaaaagaatgaacaggcagagcacagaagatttttagggcagtgaaaatactctgtatgatactataatcatggatacatgtcatcatatatttgtccaaacccaca

SEQ ID NO: 130657 - DNA, 601 bp, Human
aatattttagtgtcaacagggaaatctctaactgtacataagataaaatatctattattttaaaaataatacataccttaaaatcatactctgaaaagactgaatcaagcaaaaaaaaagcttgatgaatgtccacataaaacagtgggaagaaaatatgtttaaaagtacatttactaacaaaacatgttcaaggtccatatgaggagaactgtaaggctctaatggaaaaatcaaagaagaaccaaatgaatgaagagatactccatcttcatgggtaggaagactcaatattgtcagmatatcagttatttccaacttgatctatagattcaattcaatcccaatcaaaatcccagtgacttagttggtggattttgacacactgatactaaagtttacacggagaggcaaaggtccaagaatatccaccacaatattgaaggagaaaaagagtgagaggactagcactacccaacctcaagactcactatacagttaccataaccaagacagtgaagtattggtgaaggaatagacagatagatcaatggagcacaggaaagagcaaagaaatagacccacataaatacagtcaact

SEQ ID NO: 130658 - DNA, 601 bp, Human
tgagtatgaaatgccaatattttaaaaaatgaattgcatagttccatcaagtcaaggcacgtgtgtgtttcctcatgatgtccatggaggcagaagtcacaaccttctctttttcttcctctcttccttttttccaattcttactacgggcttccatgagctaaaaattggttggtgttcacatagagacctgaataagtcaactccctgccctccaggattgcacagacaataagaggaagcagatatttatttagcagactcttgcaatatgttgttaggggcattatgacagaagggrgcaaaacaggcaaaatagacacagaagatatgggaggaaggagttctcagaagagtgttgaacagcatcaaaagcagtggagaagttgagtaatatgagtgcagtactgggctgaagagtgtcctccaaaaatccatgtctacctggaactctgaatatgactttatgtggaaatgtggtctttgcagatgtaattagttaagtttactttaaataaggtcatagtagtttagggtgggcctaaatctcatgactggcatccatataaaaagaggagacacatggggcaaaaacacacac

SEQ ID NO: 130659 - DNA, 601 bp, Human
gccaggctggtctcaaactcctgacctcaggtgatctgcccaccttggcctcccaaagtgctgggattacaggcatgagccactgtgcctggccagccttttacttcttaaacaaatctatggaaatcacacttctcaaaattgtgagcctcaataatttggaaaaccgggcttaataatcattaatcctcatctacaattttataaccagaaactgtactagctggaatgatatcattcaggtgcaagatatttgatgtgagtatgaaatgccaatattttaaaaaatgaattgcatagktccatcaagtcaaggcacgtgtgtgtttcctcatgatgtccatggaggcagaagtcacaaccttctctttttcttcctctcttccttttttccaattcttactacgggcttccatgagctaaaaattggttggtgttcacatagagacctgaataagtcaactccctgccctccaggattgcacagacaataagaggaagcagatatttatttagcagactcttgcaatatgttgttaggggcattatgacagaagggagcaaaacaggcaaaatagacacagaagatatgggaggaagg

SEQ ID NO: 130660 - DNA, 601 bp, Human
tgttggccaggctggtctcaaactcctgacctcaggtgatctgcccaccttggcctcccaaagtgctgggattacaggcatgagccactgtgcctggccagccttttacttcttaaacaaatctatggaaatcacacttctcaaaattgtgagcctcaataatttggaaaaccgggcttaataatcattaatcctcatctacaattttataaccagaaactgtactagctggaatgatatcattcaggtgcaagatatttgatgtgagtatgaaatgccaatattttaaaaaatgaattgyatagttccatcaagtcaaggcacgtgtgtgtttcctcatgatgtccatggaggcagaagtcacaaccttctctttttcttcctctcttccttttttccaattcttactacgggcttccatgagctaaaaattggttggtgttcacatagagacctgaataagtcaactccctgccctccaggattgcacagacaataagaggaagcagatatttatttagcagactcttgcaatatgttgttaggggcattatgacagaagggagcaaaacaggcaaaatagacacagaagatatgggag

SEQ ID NO: 130661 - DNA, 601 bp, Human
cacctgccaccatacccagctaatttttgtacttttagtagagacggggttttgccatgttggccaggctggtctcaaactcctgacctcaggtgatctgcccaccttggcctcccaaagtgctgggattacaggcatgagccactgtgcctggccagccttttacttcttaaacaaatctatggaaatcacacttctcaaaattgtgagcctcaataatttggaaaaccgggcttaataatcattaatcctcatctacaattttataaccagaaactgtactagctggaatgatatcatkcaggtgcaagatatttgatgtgagtatgaaatgccaatattttaaaaaatgaattgcatagttccatcaagtcaaggcacgtgtgtgtttcctcatgatgtccatggaggcagaagtcacaaccttctctttttcttcctctcttccttttttccaattcttactacgggcttccatgagctaaaaattggttggtgttcacatagagacctgaataagtcaactccctgccctccaggattgcacagacaataagaggaagcagatatttatttagcagactcttgcaatatgttgtta

SEQ ID NO: 130662 - DNA, 601 bp, Human
gaatcaatatgtgaaacaaatcctctgtgcatatagaagccttttatttattattattattattattttatttatttatttatttatttattttgagacggagtctcgcttttgtcgcccaggctggagtacagtggtgcgatctcggctcactgcaacctctgctacctgggttcaagcttctcctgccctcagcctcctgagtagctgggattacaggcacctgccaccatacccagctaatttttgtacttttagtagagacggggttttgccatgttggccaggctggtctcaaacycctgacctcaggtgatctgcccaccttggcctcccaaagtgctgggattacaggcatgagccactgtgcctggccagccttttacttcttaaacaaatctatggaaatcacacttctcaaaattgtgagcctcaataatttggaaaaccgggcttaataatcattaatcctcatctacaattttataaccagaaactgtactagctggaatgatatcattcaggtgcaagatatttgatgtgagtatgaaatgccaatattttaaaaaatgaattgcatagttccatcaagtcaaggcac

SEQ ID NO: 130663 - DNA, 601 bp, Human
tactgaagttaaggaagccagaaaattttcaaatagtctttatttccaaatagtctcaaatttacttttcataaagcaaccaattctgaattttaaaacagcttgtatggagttgaatttgaccttggatgagaattagcattttaatataccactaaatgatagtgatcccactgggttgaatacgaaaatcactcaaggactgtaacttcccccatctagagtctctatgtgtttgtcataaagtcatgctttatgcacacaatagatcagaggcattttgtgagcaaggagctctccytgtcccattttgatttggttcatatattctacaacctttatatgaaagcaatatcaaaggatgacttaggtcatcatgactacatcaggacaatgataatactctgcctctggcacatatattccttctcttaattctgctctttctcctccctactttatatttcagttgtcagatattagagttgacaagctaatgaaaattgaattgactactaaaaaactcacacatacaaagatagagaaattacttgaaaattccctgtttgggtcaattcaatgcagacccttgcttggctgc

SEQ ID NO: 130664 - DNA, 601 bp, Human
ggcaagaggtactgaagttaaggaagccagaaaattttcaaatagtctttatttccaaatagtctcaaatttacttttcataaagcaaccaattctgaattttaaaacagcttgtatggagttgaatttgaccttggatgagaattagcattttaatataccactaaatgatagtgatcccactgggttgaatacgaaaatcactcaaggactgtaacttcccccatctagagtctctatgtgtttgtcataaagtcatgctttatgcacacaatagatcagaggcattttgtgagcaagsagctctccttgtcccattttgatttggttcatatattctacaacctttatatgaaagcaatatcaaaggatgacttaggtcatcatgactacatcaggacaatgataatactctgcctctggcacatatattccttctcttaattctgctctttctcctccctactttatatttcagttgtcagatattagagttgacaagctaatgaaaattgaattgactactaaaaaactcacacatacaaagatagagaaattacttgaaaattccctgtttgggtcaattcaatgcagacccttg

SEQ ID NO: 130665 - DNA, 601 bp, Human
gcagaaaaggggcgattaacaacaaaatgagattcactagtttgagcatcagcttgtttcttcactctccctgcttattctgagcagtttctcaagcttggcatgattggccttttgggccatgtcattctttgtcatagggctatcccatacgatataggcttagtgggattcctggtctctacccagaagattgcacctcccccaccacacccaagctgtgacacaatggcaagaggtactgaagttaaggaagccagaaaattttcaaatagtctttatttccaaatagtctcaaatktacttttcataaagcaaccaattctgaattttaaaacagcttgtatggagttgaatttgaccttggatgagaattagcattttaatataccactaaatgatagtgatcccactgggttgaatacgaaaatcactcaaggactgtaacttcccccatctagagtctctatgtgtttgtcataaagtcatgctttatgcacacaatagatcagaggcattttgtgagcaaggagctctccttgtcccattttgatttggttcatatattctacaacctttatatgaaagcaatatcaaagga

SEQ ID NO: 130666 - DNA, 601 bp, Human
ttgctcttgctttagaattattttccctaacccacaagtgttgcagaaaaggggcgattaacaacaaaatgagattcactagtttgagcatcagcttgtttcttcactctccctgcttattctgagcagtttctcaagcttggcatgattggccttttgggccatgtcattctttgtcatagggctatcccatacgatataggcttagtgggattcctggtctctacccagaagattgcacctcccccaccacacccaagctgtgacacaatggcaagaggtactgaagttaaggaagccrgaaaattttcaaatagtctttatttccaaatagtctcaaatttacttttcataaagcaaccaattctgaattttaaaacagcttgtatggagttgaatttgaccttggatgagaattagcattttaatataccactaaatgatagtgatcccactgggttgaatacgaaaatcactcaaggactgtaacttcccccatctagagtctctatgtgtttgtcataaagtcatgctttatgcacacaatagatcagaggcattttgtgagcaaggagctctccttgtcccattttgatttggt

SEQ ID NO: 130667 - DNA, 601 bp, Human
tgtcaagcaagtttcgcagttaagcacatgattatctgaggtgtggagcagagtgaatgtgacggaaaattgaacctcactggtgatctcccaactctgtctttgctcttgctttagaattattttccctaacccacaagtgttgcagaaaaggggcgattaacaacaaaatgagattcactagtttgagcatcagcttgtttcttcactctccctgcttattctgagcagtttctcaagcttggcatgattggccttttgggccatgtcattctttgtcatagggctatcccatacgatrtaggcttagtgggattcctggtctctacccagaagattgcacctcccccaccacacccaagctgtgacacaatggcaagaggtactgaagttaaggaagccagaaaattttcaaatagtctttatttccaaatagtctcaaatttacttttcataaagcaaccaattctgaattttaaaacagcttgtatggagttgaatttgaccttggatgagaattagcattttaatataccactaaatgatagtgatcccactgggttgaatacgaaaatcactcaaggactgtaacttcccccat

SEQ ID NO: 130668 - DNA, 601 bp, Human
ggaaataaaaagcacggtaaattttagttggttttattattcttattttaatactctgattccaatatactttcttgttggctgaaccctgggatagtttccgctgaccctctgcccctgctggaggtctctaagcttcagttcactgatttgcgtatggcaatttcagcatctgctcctactaccccacagaattgtgaggatcaaggtagtaatgggtgagaaagtgttctgtaattgtcaagcaagtttcgcagttaagcacatgattatctgaggtgtggagcagagtgaatgtgayggaaaattgaacctcactggtgatctcccaactctgtctttgctcttgctttagaattattttccctaacccacaagtgttgcagaaaaggggcgattaacaacaaaatgagattcactagtttgagcatcagcttgtttcttcactctccctgcttattctgagcagtttctcaagcttggcatgattggccttttgggccatgtcattctttgtcatagggctatcccatacgatataggcttagtgggattcctggtctctacccagaagattgcacctcccccaccacacccaagc

SEQ ID NO: 130669 - DNA, 601 bp, Human
gaaaggcacagcacagagacctgtgattagttagaaacaccattttacctgtgacaaagtcaaagatcacaacattctccagtcagtcatccccagctgtggttaggccagctgtaaggcaaggggtgctctctgtagcactgattggcataagattggttgtctcaggtggctggaatgtaccactgtcaatatgtaatgtactcaacccatgggatggaatgaacagtattttaaggacctagttctttttttcctaataaggaaataccactttaatgacaagattgagacaggcatrgtgaaggaactttgtgtgtggagacatcaggagtgaaatttggtcctgtatttatgcatttccttttcctctctagcgttaatttgaggtaagaaacttaacttcctggctgggcatggtgactcatgcctgtaatcccagcactttgggaggccaaggcaggtggatcacctgagagtaaggagtttgagaccagcctgaccaacatggtgaaaccccatctctagtgaaaatacaaaaactagccaggtgtggtgatgcacacccgtaatcccagctacttgggaggctgaagcagga

SEQ ID NO: 130670 - DNA, 601 bp, Human
aaatatgaaccagtacgtgagaatgaaaggcaagactattcctatcagattctttgaaagcatttcagttcctagagtctgggaaataaaatatatctatttggggcttactctacgttcactgcttcctgtctagctttcaccctctattaaaaaggcttttgtctaagaccttcacttatttggtgacttaatattcaccctatcaatacctattgttaaatgatgcctattcacatgataattttcagagtcacaaagactgtcgcagggagagttaaagtggcaacaaaatcgatgwaaagtaagcataaagtgcactttgaaaatggctttccagtgtttcacgtgctcaaagaactgttcatgctgttcccttgatcaaaagccgtcagtggctccccatcccttaaactgcttttggcatgtgatactctgaaattgccttaaccaaccacctcatccatccatgtactcattcaaatggtaacaagtgcttactgagcatctattgcatgctgatcacctgatatagtattttctttaattccttccagcctccctggtattccccgtcttgcttccattactttatttttct

SEQ ID NO: 130671 - DNA, 601 bp, Human
taacttaatcttttgggcttcagtttgctcagctgtaaaattaagagggaggaggcaatgttctctatggcacttctcagtccttaagatcctgtcctatttagccttataatagtctttgggtgggagctattactgtagagaaaagaggatcagatttgttatctagcccttttctgcagaggtagaaatggaatttagataaatgaaaggatcagcctggaagtttcagaggctgtttccctctcttcttataagctaaacttagtggcagctaaaaaacctaataaactcctaagargaaaaaggatttcccaactgacagagaaatcttgtgtttcttcatctaataccaacccctgagcctgcaaaaaataggggtgactccaatggtcttttccgcacagaatacagtactagcaactaaagagaaaatccactttttcatacaacatagggtaacaaagtatccttagatggaactatttttgatggaaacaaacctgagtgaaatatgaaccagtacgtgagaatgaaaggcaagactattcctatcagattctttgaaagcatttcagttcctagagtctgggaaataaaa

SEQ ID NO: 130672 - DNA, 601 bp, Human
agtggtgcagcccatgcagactgtatctggctgggctatttctcttctctcccatagtagcttggttgcctgggattcatacagattctctgagtgcccattacccttccgacccattgttacgattcttaacatctgatccctaggttggaaagacaggttcacatcattcaatgaataactgtctcacctattttaattttacatatgaccttcttactgatgtgactcctgggaaaataacttaatcttttgggcttcagtttgctcagctgtaaaattaagagggaggaggcaatgytctctatggcacttctcagtccttaagatcctgtcctatttagccttataatagtctttgggtgggagctattactgtagagaaaagaggatcagatttgttatctagcccttttctgcagaggtagaaatggaatttagataaatgaaaggatcagcctggaagtttcagaggctgtttccctctcttcttataagctaaacttagtggcagctaaaaaacctaataaactcctaagaggaaaaaggatttcccaactgacagagaaatcttgtgtttcttcatctaataccaacccct

SEQ ID NO: 130673 - DNA, 601 bp, Human
aggagcgagtttgcatttctaacaagttcccaggtgatgctgatgctgtttgtctagggaccacactttgtaaatcactgcaccaagttagaatgcaaatatggcttttgctagcaaattccttcagtgtgagtatgatgagcacttgctagtagcttaatatattttactcttctgcccttgtagagcataacatggtaactatgtggacctagtaacaataaagatacagtaaccataaagacacaataactaaataattgcagggcttgcttggcacccagaaatctaaacctaataytttctcttatttcttgacctaactttctagttctctatgtggttggcaacaaatcgaaaaagtccatgaaaggatgtaacatcctacaggaacatatgtagtgactgagtatagatcagcagtcctcacaattcagtgtgcatttgtatctgggccccatgaatttcaaatcagcagttctgggttgagggatgaggtatctgctctaataagcaccctagatgattctgatgtaggtgttgtttccaacatgctttgagacaatctgacttaaagattcaacagatgtttggttgcttc

SEQ ID NO: 130674 - DNA, 601 bp, Human
taaaatagtcttaaagccaggcacggtggctcacgcctgtaatcccagcactttgggaggctgaggtgggcggatcacgaggtcaggagattgagatcatcctggccaacatggtgaaaccccgtctctactaaaaatacaaaaattagccgggtgcggtggcacatgcctgtaatcccagctactggggaggctgaggcaggagaactgcttgaatccaggaggcggaggttgccatgagctgagatcgtgccactgcactccagcctgggtgacagagcaagactccttcctccaccamcaaaaaaacaaaaaacaaacaaacaaacaaacaaaaaactgtcctagaaaagaagcaaataacagttgaatctacatattttcatacaattggcactatcctgagcccagattttttctgtcaataattattaaagatcaaattttaaaaaattaagttagtataaaaagtgctcagaatacataaatattacttgtattcatagtgttgcaaattttgagttgaaattttaagtactacaaaaaaatatttattgaggtggttttaagaataacattgaactctgatatcaaaccgaga

SEQ ID NO: 130675 - DNA, 601 bp, Human
cattactatatgtgatatagtaatcataacaatgtctggaaatatcaaactttgggttaaaattacttttgagtttagttcaaaagaatgcagagaagacattctagaaatacttagaatagctcacgttagctacgttttttcacaaagatgcataacataagaataaaataattctcacttcacactacccaccctcttaatccttgtatattctttcccaattttctttatgtctgtcaattgcctcttaaactttacgttacacatgaagaaccagaggcgaggcatggtgtttcaygcctgtaatcccagcactttgggaggctgaatcaggaggattgcttgcacctcggagtttcagtttgcagtgaggtatgatcacaccgctgcactccaggtgacagagtaataccccgtctcttccaaaaaaaatgagtaaataaaaaataatgatcaaaagagttggctaaaaataaatcagatcaaattttcaaggaattcagaaaaattggggtaatttgatctcaaactggagagagaattgaagaaactgcctgaattgctgttctccacatggacaggactgtcatatcttatc

SEQ ID NO: 130676 - DNA, 601 bp, Human
gtgacgaagtaagactccataacaaaaagaaaaaaataataataatttcttaacaaaaatagttgaacagttcctgtgatttccattctataaatggagaatctgaaaatccaaaatactcataataatgatgaagaggaagatgacagttattaaacttggagaaaaaatcagttctcggttctcatttaactgtaaactagggttaaaatgctaagtagaatacacttcctaacagaaatggaagttaaatgtcatatctttttgcctaagaacttatacggcatatcaacattgttgsaagaaaacaggaaggagtaaatatctaagtatgtacatataaacttatacaaacaaatactacagaaacattactatatgtgatatagtaatcataacaatgtctggaaatatcaaactttgggttaaaattacttttgagtttagttcaaaagaatgcagagaagacattctagaaatacttagaatagctcacgttagctacgttttttcacaaagatgcataacataagaataaaataattctcacttcacactacccaccctcttaatccttgtatattctttcccaattttcttt

SEQ ID NO: 130677 - DNA, 601 bp, Human
cggagattgcagtgacccgagatcacaccactgcaccccagcctgggtgacgaagtaagactccataacaaaaagaaaaaaataataataatttcttaacaaaaatagttgaacagttcctgtgatttccattctataaatggagaatctgaaaatccaaaatactcataataatgatgaagaggaagatgacagttattaaacttggagaaaaaatcagttctcggttctcatttaactgtaaactagggttaaaatgctaagtagaatacacttcctaacagaaatggaagttaaatgwcatatctttttgcctaagaacttatacggcatatcaacattgttggaagaaaacaggaaggagtaaatatctaagtatgtacatataaacttatacaaacaaatactacagaaacattactatatgtgatatagtaatcataacaatgtctggaaatatcaaactttgggttaaaattacttttgagtttagttcaaaagaatgcagagaagacattctagaaatacttagaatagctcacgttagctacgttttttcacaaagatgcataacataagaataaaataattctcacttcac

SEQ ID NO: 130678 - DNA, 601 bp, Human
aatacaaaactcagccgagcgtagtggcatgcacctgtagtcccagctacttaggaggctgaggcgggagaattgcttgaacctgggaggcggagattgcagtgacccgagatcacaccactgcaccccagcctgggtgacgaagtaagactccataacaaaaagaaaaaaataataataatttcttaacaaaaatagttgaacagttcctgtgatttccattctataaatggagaatctgaaaatccaaaatactcataataatgatgaagaggaagatgacagttattaaacttggagaaaaaatcagttctcggttctcatttaactgtaaactagggttaaaatgctaagtagaatacacttcctaacagaaatggaagttaaatgtcatatctttttgcctaagaacttatacggcatatcaacattgttggaagaaaacaggaaggagtaaatatctaagtatgtacatataaacttatacaaacaaatactacagaaacattactatatgtgatatagtaatcataacaatgtctggaaatatcaaactttgggttaaaattacttttgagtttagttcaaaagaatgcagaga

SEQ ID NO: 130679 - DNA, 601 bp, Human
acacatcgagaaaacactgtccccaaaccagaaagccctcatcagataccaagtcttccagcactttgatctggagttcccagcctccagaactgtgagacatatatttctgttgtgtataagctacacagtttatagtattttcgtgtagcagcctgaatagaataagatcatgtctatggtcagagcacaaataagatacagcaatctttacacttactctggcttgtgcaacaatgttatgtatcccagcatataactgccagaatggaacattccagacttactgatatagagcacytgactatatttcactatacatacagaatgacaaaaaaaaatgcaggatgaactgacaataacctttaaggatgaaaacaaactgcaagttataaaagtttttaaaaatagtagtacatacacaaacacatattttgaggaaaggttccaattttgagggatgaatggcattcatccatcttcttttctgctggagaagtctttgtgaaggaaaataatattgtgaataacaggagtgactgttatgtgatgtagaaatgaaaatgaaaactaatgcaaacagtaactgggagtgatgggg

SEQ ID NO: 130680 - DNA, 601 bp, Human
ctatgtaacactcttaaaatgacaaaaatacagaaatagagaataaaaaagggttaagatggtaaattttgtatttttatcacaattaaaatttctaagtatgcaaaaggaaaataaaccctattttacaacctccatgttcagaatccaatgttttctctacatgtgtgttagggttaggagacacgtttgactttttgtctatataaatctatataaagatttggagtttagcaaatgttgcatctgagaacatttgttacttttcaaaccagaattttatttgccctttcttcacatrgactttgaaaaatacagtccaactgagagcttcctatcagatagtttaaaaaattataaactattgtgaaataattaaagagatgactactaaagctggtgtttgctgtgatctgacatgtttgtgtccctccccaaaattaatatgttggaacctaatccccactgtaatggtatttgaaggtggggctttggaaggtggttaggccatgaggatgaatccctcctgaaatgggattagtgctcttatgagggactgaagagactggagttctcccctttcaagtgaagacacatcgag

SEQ ID NO: 130681 - DNA, 601 bp, Human
cttatttttgtgagttacatttttttcattttagcagaatgcattatattcaattagagtggggactttgtcagtcacctttgcaagtgagtctccagtgtccagaataatgcacagtagatgattaataaacacgtattaaatgagtgaatgaatgaataagtaagtggttttaaaaaatgttctctctgagcatccaggattgtatgtgggggaatacagcctaaaagaaatagcttttaaatctaagagctaggggatgtaaatattcccattgtatacttgtaagatctagagctgmaaaacaaaaacaaacgtgtcatttttattaagaattgatgctttaaatagtttatttcattttacttattaacacatgcgtgtatgttcattcggttagcatttattgagtggctaccttgtgctagactctcttctaggtgtttggggttcatgaataatcaaaataagttggatcccctgccctcaaagaccttatatttcagtagtgagaaaaagaaggcaccaaacatcaaataaatgtttgaacactagtatgtggtcagaattatgactagaatggcagaaatgacaaagaatc

SEQ ID NO: 130682 - DNA, 601 bp, Human
agtaaatatttagtgagatcctagtatttagccatcactgttcttgatcttgagaagttagaataagcaaaagttgacatagtttaccattttttgaagtgtacagtctaatgagagacaaatgtttacactaatgatcgtattattacaaattaagaaaggttcttataagaaaaggaatgatttctatgagatcacatagataaatctggcctagcttgggtggtaaggaaaagcattgaattctgaactgagatctgaaacaccagtatgagttaactagactaagagcagcgtgaaraatattcctggaaagggtgatataatatacaaagaccctggggcaggaggagagacaaggcatttgaatgaaaaagagaaaacaacgaaatcagaatgcagaatgtgaacacacagcagtaggatttgggatttgggtattaggcatgagtgaaaccagtggtcacattaagggtgagggaagagagagacgctctcatattgttttatactcagtacctgttttaagaaaaaaagaaaaaacaacaaggaagtaaaaccaaagacaggcagcccagcgccaggcctgaaaccaggcctg

SEQ ID NO: 130683 - DNA, 601 bp, Human
aggattattttctcttggttttgctttattagccgggaacacatcggccatgagtccccagattctggcaacaacttgtttgataattccaaaggttaacacaaaaggacaaacatgaaacactgaagagggaggccaggaaagcaagaaaagaggcaataccttctggggaaagagagaccctgaggaggggagaatgtcaacctgtgggttaaataactctaactagataaagctggagctgtgaaagttcaccatgctatagattttgtcctctaaaaatcagcagtgaattttcatwttatattatgaaatgttatagaaattaatgaattatattgtcttactttccaggttgttagttgaaagtgtgagactataaagtgggaagaatcataatatttgtaattggtatatatatatatacccacacacacacacacatacaccaattgcagtgtgtgtgtatataccaattggtatatatatatatgtatatgtatatattgtatgtgtgtgtgtgtgtatatatatatatatgccaattggtgtgtttatatgtgtgtgtgtgtatatctatctatatatatatataggtgtg

SEQ ID NO: 130684 - DNA, 601 bp, Human
aatagaggaaagataaagggaggcataatttaagaaattactttgtaattaagagaccccaagaatctggaaaaagacaacaaatacctgtgttcttagtaataacggttttaatggtggcgattatcatgggagtggaggtgaaggaagatgcaagaaagatactcctgagtggaacaaatgttatggaaaatatttagttcttttatgtccaacgaaaaagtgatatgatcacagttttaatttactccaacagaatttttgttagccagaacaagaatagaatttgctgtgcaaaaawtgaagtattttagtttatgtagttaggagatatcaattttgtgtcttgctatatcctaccaaaatctagtctggttactttatcttcctttatcaatattttctttcatttccttgtacttctctgcccattctgtcttgaataattgaatacaaaatgacatattttggaaaaaaaccaaatttgtgatttttactctgctggagtctatgaataaaaatccagttgttttcatcacatttttcctacccttaactatttgaattgtattttaataatattcttgcaattccatacgct

SEQ ID NO: 130685 - DNA, 601 bp, Human
aaccccatctctaataaaaataccaaaattagctgggcgtagtggcacatgcctgtagtcccagctactcgggaggctgaggcaggagactcacttgaacctgggaggcagaggttgcagtgagcggagattgtgccactgcactccagcctggcgacagaacaagactccatcaaaaaaaaaaaaaaaaaaaagagagagagagagagagacaacttttatcctgattacaggacccaggaaatttaagtatatttctaccaacaaaggagtctcgacagcaacttatatttatagggcmaaattctgttacttaagtagtttcccgggaaacaaaatggaaaattaaagcattttttggcagtaaaaatatttctcaacatttagagattaacacatcattagatacaataatttatttattaaatattatatgttactttgattcattatatttattacatgttttataacatttaataactaaatatcaaataatttgatttgaattttcacttattcaatataaatatgtattatatattttaaaatatgtattttatatgtgtgcataatttttaaatatacataaggagatgtc

SEQ ID NO: 130686 - DNA, 601 bp, Human
agtgcacggtggtcactcctgtaatcccagcactttgggaggccaaggcaggcgatcatgaggtcaaaagatggagaccatcctggccaacatggtgaaaccccatctctaataaaaataccaaaattagctgggcgtagtggcacatgcctgtagtcccagctactcgggaggctgaggcaggagactcacttgaacctgggaggcagaggttgcagtgagcggagattgtgccactgcactccagcctggcgacagaacaagactccatcaaaaaaaaaaaaaaaaaaaagagagagagagagagagacaacttttatcctgattacaggacccaggaaatttaagtatatttctaccaacaaaggagtctcgacagcaacttatatttatagggccaaattctgttacttaagtagtttcccgggaaacaaaatggaaaattaaagcattttttggcagtaaaaatatttctcaacatttagagattaacacatcattagatacaataatttatttattaaatattatatgttactttgattcattatatttattacatgttttataacatttaataactaaatatcaaataatttga

SEQ ID NO: 130687 - DNA, 601 bp, Human
tggcagtgcacggtggtcactcctgtaatcccagcactttgggaggccaaggcaggcgatcatgaggtcaaaagatggagaccatcctggccaacatggtgaaaccccatctctaataaaaataccaaaattagctgggcgtagtggcacatgcctgtagtcccagctactcgggaggctgaggcaggagactcacttgaacctgggaggcagaggttgcagtgagcggagattgtgccactgcactccagcctggcgacagaacaagactccatcaaaaaaaaaaaaaaaaaaaagagagagagagagagagacaacttttatcctgattacaggacccaggaaatttaagtatatttctaccaacaaaggagtctcgacagcaacttatatttatagggccaaattctgttacttaagtagtttcccgggaaacaaaatggaaaattaaagcattttttggcagtaaaaatatttctcaacatttagagattaacacatcattagatacaataatttatttattaaatattatatgttactttgattcattatatttattacatgttttataacatttaataactaaatatcaaataat

SEQ ID NO: 130688 - DNA, 601 bp, Human
tttggcagtgcacggtggtcactcctgtaatcccagcactttgggaggccaaggcaggcgatcatgaggtcaaaagatggagaccatcctggccaacatggtgaaaccccatctctaataaaaataccaaaattagctgggcgtagtggcacatgcctgtagtcccagctactcgggaggctgaggcaggagactcacttgaacctgggaggcagaggttgcagtgagcggagattgtgccactgcactccagcctggcgacagaacaagactccatcaaaaaaaaaaaaaaaaaaaagagagagagagagagagacaacttttatcctgattacaggacccaggaaatttaagtatatttctaccaacaaaggagtctcgacagcaacttatatttatagggccaaattctgttacttaagtagtttcccgggaaacaaaatggaaaattaaagcattttttggcagtaaaaatatttctcaacatttagagattaacacatcattagatacaataatttatttattaaatattatatgttactttgattcattatatttattacatgttttataacatttaataactaaatatcaaata

SEQ ID NO: 130689 - DNA, 601 bp, Human
tgtatcctttaatgctactattctgacactaaccacttctttaaaacaaaaaggcagagtactcttaagattacttataaagaaaagaatatcgtgaacttttagaaagattttacagtcctgaagttgaaacaaaatatttgtagttaacactcaaaagcagaaaattaagttgactaatgtactttatttatataaagttgtatgtagtcaaaaatttttaatattgggctgtgactaatgcccacaggagaaaaaaaattagttaattggttgtgtgtgtacctcaaataaaagcatrattatgtacgagtttaagagacaacttttggcagtgcacggtggtcactcctgtaatcccagcactttgggaggccaaggcaggcgatcatgaggtcaaaagatggagaccatcctggccaacatggtgaaaccccatctctaataaaaataccaaaattagctgggcgtagtggcacatgcctgtagtcccagctactcgggaggctgaggcaggagactcacttgaacctgggaggcagaggttgcagtgagcggagattgtgccactgcactccagcctggcgacagaacaagactc

SEQ ID NO: 130690 - DNA, 601 bp, Human
gtctttttactgagacagggcagggcacctaagcatattgcttaccagttaaaaacctatctcaaaatcagctatgagtgacatgctgagagctgacttagtgggtcacttagtggaagtcaggggaatctggctctgcctcctgggcttcgggtgtctctgcccagaacctggctcactgatgctcatcctgttgctacaaacaccagaaacgtaggtccacaggattctcttctgatcgtcactgccataatgtccaaaacatgaatggtgcttgcaacaccatcagcaacttagggakgtattgtctccattatgaattcactgtgttgaatatggaagagaagaagatgcttgatgtagaggaagtaatttattctcggtggataccttaaggattctgacactatatcttttcagatgaaatgttcacatcataggactccaaagaagtcaattccacagcacctttctgtgagctgtgcccgtgacttcacagataggtgattctttctgtagaactattgccttcagttgcttgtgatagtggagactggtatattttcagccttcttatttgtggctaaataattaatgcaca

SEQ ID NO: 130691 - DNA, 601 bp, Human
ctcagattagaataagatcccatccaaataaatgttctggctttctactgagttctgcatctccatatatcctccaattagttttctcactaataaatgagagtccactgagtcaatgtccaggccatgcgcccgaaaaaaaagattgataaaacagtacatgttcatgcatttattgtgagtaaaacaaaatggaatgctataaatctggcttctccccaagagactaataaatatattggttgaaactatactttctcaaacaaaaggattagactttggcatttcacttgtctttttcctgagacagggcagggcacctaagcatattgcttaccagttaaaaacctatctcaaaatcagctatgagtgacatgctgagagctgacttagtgggtcacttagtggaagtcaggggaatctggctctgcctcctgggcttcgggtgtctctgcccagaacctggctcactgatgctcatcctgttgctacaaacaccagaaacgtaggtccacaggattctcttctgatcgtcactgccataatgtccaaaacatgaatggtgcttgcaacaccatcagcaacttagggaggtattgtc

SEQ ID NO: 130692 - DNA, 601 bp, Human
acctcagattagaataagatcccatccaaataaatgttctggctttctactgagttctgcatctccatatatcctccaattagttttctcactaataaatgagagtccactgagtcaatgtccaggccatgcgcccgaaaaaaaagattgataaaacagtacatgttcatgcatttattgtgagtaaaacaaaatggaatgctataaatctggcttctccccaagagactaataaatatattggttgaaactatactttctcaaacaaaaggattagactttggcatttcacttgtctttwtactgagacagggcagggcacctaagcatattgcttaccagttaaaaacctatctcaaaatcagctatgagtgacatgctgagagctgacttagtgggtcacttagtggaagtcaggggaatctggctctgcctcctgggcttcgggtgtctctgcccagaacctggctcactgatgctcatcctgttgctacaaacaccagaaacgtaggtccacaggattctcttctgatcgtcactgccataatgtccaaaacatgaatggtgcttgcaacaccatcagcaacttagggaggtattg

SEQ ID NO: 130693 - DNA, 601 bp, Human
atacttcttactttgggatgaataataatgaatataatcccatgccaaataaataaaaaattaataagggtacaatctacatatgcatttttgatagccctctattaaaaataaatttgaagttcaacctgtctggttatagaccatgaaagacacctagctagttttaaataggtccaacactgtgctattctatatgtatataaaatatagatggaaaatagatccttactgtccttgatctttttgaaaataccactggactaaaaaatatacacaaagttttcatttttctttaatwgattttattattgcagaaaataataatttttggttttcttctaaaaatgttgtatacctgttctgaaaaatattccttaggggctaaaaactaaaacattaagggcttgactttatgctaactgtaattaggaatgtgacctaatgtcatgtagaaatttcctttcaatattccccataaaagtgtgaattatcaaatgctgtctcatgcaggagacaatttattcagtgtgctgaataactttcattcactgagagctaatagttttccaaggggaacagcctttgttagtggcagatg

SEQ ID NO: 130694 - DNA, 601 bp, Human
acagtttgttaaatactattatgctcaatgccatggtctgcattaattgatgagcagcacaaagcttactactttacaattattattaatgtcagaaatattcacagatgatttttatatacttcttactttgggatgaataataatgaatataatcccatgccaaataaataaaaaattaataagggtacaatctacatatgcatttttgatagccctctattaaaaataaatttgaagttcaacctgtctggttatagaccatgaaagacacctagctagttttaaataggtccaacastgtgctattctatatgtatataaaatatagatggaaaatagatccttactgtccttgatctttttgaaaataccactggactaaaaaatatacacaaagttttcatttttctttaatagattttattattgcagaaaataataatttttggttttcttctaaaaatgttgtatacctgttctgaaaaatattccttaggggctaaaaactaaaacattaagggcttgactttatgctaactgtaattaggaatgtgacctaatgtcatgtagaaatttcctttcaatattccccataaaa

SEQ ID NO: 130695 - DNA, 601 bp, Human
aagttctttctctcttatacaatcctgtccatttggcctacgtgcctagagcaggggacagccaaagcactttttccctctctgaaatggatgctacatcacaccacagtcctgggtgccgttagctaagagggcagctttgtgacatcagaggccgctccagggtgggggcctagttcagccatactgttgtccccatgtgcctcttttttttttttttttttttgagacggagtctcacactcttgcccaggctggagtgcagtggcacgatcttgcctcactgcaagctccacctccygggttcacaccattctcctgcctcagcctcccgagtagctgggactacaggcacccaccaccacatccggctaattttttgtatttttagtagagatggggtttcactgtgttagccaggatgatctcgatctcttgaccttgtgatccgcccaccttggcctcccaaagtgctgggattacaggcgtgagccaccgtgcccggctccccatgtgcctcttgttttcccaggtgttgtcaggttatgggcagtgccctcctggagttacacaaagttaacagtatccagtcttgccttta

SEQ ID NO: 130696 - DNA, 601 bp, Human
tgttcatggcttcctattactgttggtgatgataattaaacaggtataccatcagaatgacagtatgactttaggccaattgtgcagcctgcagaaattatccctgctgtgtattaggcatggaaacagcatcaaaagtacaccacatgtatactgaccacggtttgtttttgtttttgttttttgagacagggcctcactctgttgcctaggctggagtgcagtggcacaatccctgcttactgtagtattgacctcaggtgatcctcccaccttagcctcccgagtatctgggactacrggcatgcactaccacacccagctattttgtattttttatagagacaggattttgccatgttgcctgggctgatctttaactcctgggatcaatctagtaactcatggcaccacccacatttgccatttttactgctttgggagtccacctaattcataaatccatggtaagattccttcctgctttggaataaaatggcaccggcctccccagcaaaaccacagtgttgtgtattgcatctccaactgtagattaccctaactctgtgtagttctctcctgctttcttgtactcatttgc

SEQ ID NO: 130697 - DNA, 601 bp, Human
cctaattcataaatccatggtaagattccttcctgctttggaataaaatggcaccggcctccccagcaaaaccacagtgttgtgtattgcatctccaactgtagattaccctaactctgtgtagttctctcctgctttcttgtactcatttgctgtcctgaagttgttaataaacttaattttgtcacatacagtactttgttaagagtagcttgaggaaagacgtgagaacctttgacaaaaagctctctcatgaaagtatttacctgctttctttctctgcaataatttaaaattgatwaaagcaacctgagctcttattttcacatgggcaaaacatttgtatactggatctcttctcatattcagcttatgatcatgaatagtcagaactttgccacagataacagggaacaatgatcaagaactgtttctgctggcagaatccagttgatgtttttgaagggctcagactgcacagctctgagctcagtggagagcggtcctgggctgaggtctggccttaatactgcaactccacttagaaaattgtgcaggcgaggtgttgtaaaagcactatgctacatcttttgagatgggg

SEQ ID NO: 130698 - DNA, 601 bp, Human
aaattgacagggttctgagaggcatatccctgctaggatcaactttggaattgaactgatcaaagtcacaaggagtacagctgtaggattgttacgtaagatccaaaagcagtgaaaagcaacacttggtgttagaattaagattacagtactctggagggagggaggcagagcctcagtgaaggtacaggggcttctgtcttggtgatctgccctggggtctgtggggcaggctcacgggcacacctgccttggaggagtttgcaaagctgactgcttatttctgttggtattatacttycgtttttaagaaatttattttagaaaaatgtcagttcaaaacaacaatcagggctgggcacgatggtttatgcctgtaatcccagtgctttgggaggctgaggtagaaggatcagttgaggccacgaatttgagaccagcctggggaacatagcaagacttcatctctacaaaaaaattttttaaaaaatagagcatggtgtcatgtgcctgtggtcccagctactcaagaggctcagttgggaggactgcttgagtccagaagttggaggctgcagtgagcagtgattgcaacactgca

SEQ ID NO: 130699 - DNA, 601 bp, Human
cttcatctctacaaaaaaattttttaaaaaatagagcatggtgtcatgtgcctgtggtcccagctactcaagaggctcagttgggaggactgcttgagtccagaagttggaggctgcagtgagcagtgattgcaacactgcactccagcctgggccacagagtgagaccctgtctcaaaaaatgagccataaaaaaacaaaaacaaccatcagaacaacaaaatgtcagaacttttagagttcctgcatccacaaggggaccctacccaccaagtgccagcctccgtcccagaggtcaggatggacagagcccctgctctggtgtagtgtgtatgttccacacaggctcagggacctgctaagccgtaggcgtctcagaatgaggaggggcatcgcattgctggagtgaagttcacagcggggcatggaggatgagcgagcatgtagtcagaaccgcatggggaggccttactgggctgtgcacaggactcaagcatctccactgggtgatcacaaacagttgaagatttgagcaggggcatcccatgttcctctgcagagctggggaggaattggggatgaagaaacgtggaaagctcag

SEQ ID NO: 130700 - DNA, 601 bp, Human
cagaacttttagagttcctgcatccacaaggggaccctacccaccaagtgccagcctccgtcccagaggtcaggatggacagagcccctgctctggtgtagtgtgtatgttccacacaggctcagggacctgctaagccgtaggcgtctcagaatgaggaggggcatcgcattgctggagtgaagttcacagcggggcatggaggatgagcgagcatgtagtcagaaccgcatggggaggccttactgggctgtgcacaggactcaagcatctccactgggtgatcacaaacagttgaagrtttgagcaggggcatcccatgttcctctgcagagctggggaggaattggggatgaagaaacgtggaaagctcagagaggagaacacactggtccatagagagccgtggatgccggcggcgctgtaatggagatggaggagtgtagatccatgccccgcccgcctgtgcatttaccaggattgcctctcatgcctggattaaccattccttgcgactgcaacttgtggggcacacgagatggggaattttctctctacttcttccaagtttccactcagtgaagccgtggatggagcccca

SEQ ID NO: 130701 - DNA, 601 bp, Human
ggggcatggaggatgagcgagcatgtagtcagaaccgcatggggaggccttactgggctgtgcacaggactcaagcatctccactgggtgatcacaaacagttgaagatttgagcaggggcatcccatgttcctctgcagagctggggaggaattggggatgaagaaacgtggaaagctcagagaggagaacacactggtccatagagagccgtggatgccggcggcgctgtaatggagatggaggagtgtagatccatgccccgcccgcctgtgcatttaccaggattgcctctcatgcytggattaaccattccttgcgactgcaacttgtggggcacacgagatggggaattttctctctacttcttccaagtttccactcagtgaagccgtggatggagccccaagggcactattgctacactggaggaacccaaggtcgttgtggatcccgaaagaagggacttggggcaggtggcttaggagagtcaaacctggtgtggaaaccctccaggcagcagtgaaggtaacaattgtttacggaaaactatcaaccattttctaaattgagttcttgtgaaagtaaaatatagatatgc

SEQ ID NO: 130702 - DNA, 601 bp, Human
acatttttaaagcattaagatcatgcacgatctttaaagacaatgtatacagacgtcacatgtcttgtgaaaggaagtctggctcgtgcaccaggttctgaccacctctctatggggaaggaagcccacattaggtgctgtgtgctggatccaggagccaagtcgctttccttctggtatagctacctgctgaaagtgatagtggctgttggtgccgttgaggtttttctctttttttttttttttttttgagacggtgtcttgctctgtcacctaggctggagtgcagtggcacaatctyggctcactgcaacctccacctcccaggttcaagcgattctcctgcttcagcctccctagtagctgggactacaggtgtgtatcaccacacccagctaatttttgtatttttagtacagatggggttttaccatgttggccaggctggtctcgaactcctgacctcaaataatccacctccctcagcctcccaaagtcctgggattataggcatgagccaccgcacccggccagtttctctcattttaaagcacaccaagtcttaccacaagaatcatgctcagcaatttatcttaagatc

SEQ ID NO: 130703 - DNA, 601 bp, Human
agcgattctcctgcttcagcctccctagtagctgggactacaggtgtgtatcaccacacccagctaatttttgtatttttagtacagatggggttttaccatgttggccaggctggtctcgaactcctgacctcaaataatccacctccctcagcctcccaaagtcctgggattataggcatgagccaccgcacccggccagtttctctcattttaaagcacaccaagtcttaccacaagaatcatgctcagcaatttatcttaagatcagactggcctggaattctttcctccctccctccctccctccctccctcctgcccgctccccccttccctttcttccacctgcataatggctacaagaagtagcaggtggggatcagggtaactggctgtaaactgcaaccagggaaggcagccctgccccgggtaactaaaggccctttagttagggttagcctgcataaatacatgtaatgagagcagcaacagcttgcaatttatacagcactttgcaatttaccaggcggcttaacacttacaggcatttttttatatcagtggtaaagactctagaattatgtctaggaagaattaga

SEQ ID NO: 130704 - DNA, 601 bp, Human
gctgggactacaggtgtgtatcaccacacccagctaatttttgtatttttagtacagatggggttttaccatgttggccaggctggtctcgaactcctgacctcaaataatccacctccctcagcctcccaaagtcctgggattataggcatgagccaccgcacccggccagtttctctcattttaaagcacaccaagtcttaccacaagaatcatgctcagcaatttatcttaagatcagactggcctggaattctttcctccctccctccctccctccctccctcctgcccgctccccscttccctttcttccacctgcataatggctacaagaagtagcaggtggggatcagggtaactggctgtaaactgcaaccagggaaggcagccctgccccgggtaactaaaggccctttagttagggttagcctgcataaatacatgtaatgagagcagcaacagcttgcaatttatacagcactttgcaatttaccaggcggcttaacacttacaggcatttttttatatcagtggtaaagactctagaattatgtctaggaagaattagagggcttcagactagtgggaagggggtcggt

SEQ ID NO: 130705 - DNA, 601 bp, Human
agcacggaacaggtggaccgcacccaggcgctccagagcacttatgtctcagtaacgtttgtttgtccaaagcagcatacgatccagccccgctgcccacccttacctgggaaacggggctcctctcatagacccacagtgctccccctagcctgttcatacgtgccctcacatctgagctgctcctgaccctgagagccgaagtgagctgagactcacccctctggagctttttagggaggatagaggtgcgtgcataccttgttgagaaagtgccacaccggatcctgcatgtgtcccyagccataacagcgaactggtatggggatgacaacacaatggcagccatcacctgggctcctgctgcgtgtcaacaccccgctgagtgccatcctcagttactgggccctcataacagccccacgggtaccaggggtttccttgtgttacagatgaagacatgtagatgcagagagatgttacagaaagtgccaaagccaagcacgaggaggcagagaggctgggctccagagtgttctgagaagctggcacaagtacggttcggctgtgtctttgccaaccacgtgccacctgcgtgttc

SEQ ID NO: 130706 - DNA, 601 bp, Human
atacctgcaatctcagctacttgggagacggaggcacaagaatcgcttgaacctgggaggcggaggttgcagccaagatcgcgccacctcactccagcctgggtgacacagtgagaccctgtctcaaaaaagaaagaaagaaagaataaaggtaaatatcctggagttattccagtctggggaaattcagggtggttcaggaaataatgtaccacagagccaccagacacagccagtaacagcggtgctttcaccctaggagcaacatcactgacatacgggtgtgtgagtgcccagcacrtcgtaggatcttggtggaagggaaggaggaagaaatagctgcagagcagggtcagcgtgttgtgtgcttgggaggtctgctcatcgtgatcctggcctcctactttcgctcacacccctggcagtggaggtgcctgtcactgcagacacaggcctggagggtcgatgagtgcgtgtgaaatcggggtgatgagacagcgagtgaggtttattaattgcagatgtgtattgaatgcctgctccatgcccagatctgaggccacgatggtgactttgtttgtccttcccaaggagataaata

SEQ ID NO: 130707 - DNA, 601 bp, Human
gctaatttttttgtatttttagtagagacggggtttcaccattttggccaggctggtcttgaactcctgacctcaagtgatctgcccaccttggcctcccaaagtgctgggattacaggcatcagccactgtgcccggcctggtttttgttttctaaagctaaactactagaggtaaaaagtttcctgggtcaacttcctaaggtcaattaggaccttagagagcggggaggaaactacatgacacctgacaacaacaggaacctgaagggacagttttggagatgggctgagatttcgtrcaagggaaattggtgcccaaaagggacatggaagactggggaagctgtcaagaatacatttactgctttttctccatggtggtcaggaatttagaatttcttcttccttaaacgtacgcagttcttaatggtgagattattttctgccagcaggacacttagaagagaaaggtcagttgacgaatatttttgctttgctcgacacgtttctgccagcctcagctggagagctctatgctcctgccctgcccagatccctctctgcagctacgggatcagctgaaggtgcctgctgctgct

SEQ ID NO: 130708 - DNA, 601 bp, Human
aagctgctgcagactgaactgcaactggccaagctgcctcagatcgtgttccccccattcatatgttgaaatcctaacccgtaatatgatggtattgggaggtgattatgtcatgagactgatgccctcatgaatgggattcgtgcccttataaaagagacctcagagagcacccttgctgcttctgccatgtgaggacacagcaaggaggcaccatctgtgaactaggaaatgggccctcaccagacaccgaatctcctggggccttgacatggggcttccagcctccagaatggtgagmaataaatgtctgtaattttactttataagtcagttggtttacagtattttgttataggcgcctgaaccaattaagataccatcagatctctaaggtttcttctagaacttaaacaccgtaattttatgatgatagatttaaagtgcttgagatgcttttcagtgtaagagttaaaatcctgctcactgctgagcatgtctatgaaacagcatcttgctttttttttagttactttcattctttcattctttttcatgcaaagatatagcagtttatacattattgaacaagctgtagata

SEQ ID NO: 130709 - DNA, 601 bp, Human
ttgaccccaaggtgagcaggctccagggacatgctagcgaatgtgctcttccaaaatgcaacatagaaagactggtgagcaggggccctggatgatgggggcttccagtctgccatgttctggttggctatggtttcattatggtagctaaagacagcccaaatctgagaagtgggtatgaggatttgcctgtcttgttgagaaaatatgttaaaattctatgagaaaagaatcatgttaccctgttaaacacacattggacttcaaattgtgcttctgttacaactggaagcagtaggtrgttttactttaatgaaagatgaggcgatgaagcggagatgtgtagaaaaactacacagagagaatgaaaggaaactgggatctgggtgccgcctctttacctacaaggtaatgagtttgccttcgaattagagagaggcagtcgcttagagcctggaccactcagggacttgccctcggtctggacgcacagctgcagtgctccgtctcccagacatgcatgaatccctgcttgttctgcagcagaaaccgtccctttgagatgtcccggctgccacctggcggggtcacagctccaggt

SEQ ID NO: 130710 - DNA, 601 bp, Human
ctgtagagaaagagaaaaggtttctctctgcttgggcatgcaagcaggcagggagggagtggagtagattcttggcaccccaattcagagtcctagtttcatttcctatagaaatcatattacagatgataatgctttccataaaaaccattctggacaccagccgctatcagaactatgctccttcactattatggattgaatgggaatttactgggagtacagtctgtgccacatcactggtgggtatgttgggccaattcctttacctcctgtagcctcagtttccttatttccacarattaagaagttgcccactttgtcacaggactgttgtgagggtttagataacatagtaaagtcaggtccctctccatctccagacacctgcctcttgaatttcactgcaccagcagctacatacaacattgctcccatggaagagtgtttgcttcccaggtgtcaaagtctggcaggcaggctttctattttgatggccatccaacactggtaggatcatggccaagtgtttttaaagaggactttggccctcttttggtaaagtattgttcagagcaacaagaaagccacagcttagtta

SEQ ID NO: 130711 - DNA, 601 bp, Human
ttctggcttactcttgtgtttcccatgcacatgcataaaatgtggtacaaagagaaacggcagaggccattagcataaatgaatcagtgtatttgctctgaaacgtacgtggcctcacatgcctcctggcgccgcgtgggcacatgtcccagggtagtggcagtgggaggggggcagcagcccagctctccaccattgaggacaatcagcctttttaccctcttcacctcctgcccactcagcaaggccatagaagcacaagtaattcttaggactgatcgccctttactctagtttaagraagaaaaggagaaaggggtacaagctacccatggaagtgcttggaggaagtcattttgaggagtctacaaatgactaaacctccacactgattaaggtagaggtcgaagcagagctgtggtgggagcactcatctctcaggacagctgaggaagggccagtctgcttgtgtggggtgtgtccccagctctggggctgacatgctttcctctcctagaatgttccggaattccgtgcattttaacacagttaaaacatttttaccttagggcttttctagcatttttcctcatgcacagga

SEQ ID NO: 130712 - DNA, 601 bp, Human
ctctccagtagctggggccacagatgtgcaccacaggtggctaattttttttttttttttttttttttttttttttgcagacacggtctcgctatgttgcttaggctggtctcagactcctggcctcaagcaatcttcccgcctgggcctctcaaaggctgggattccaggcgtgagccactgtgctggccctgtgacatgtttttatggataaaatagatcaatttaattctcaactttaagtaacttcgcaactacaggaggcagctgccagcaaccgtatttttctcatggtaattamagtttgtaagcactgtccatgtgtcgtccccttgtatttaaccgccagagaaactgcgtggaaatcccggtaggctagggagtgtggtggtgcccaagtgccctgcgccactgagccttgctgtgtctccacaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtc

SEQ ID NO: 130713 - DNA, 601 bp, Human
gcacacatagcagcaccgtctttgtctgaggttccacgtggcctgatgctgtgcagggcagcttgtcctgatggatcttgccgtgacacgggccattttcagctgttagtgtgcatgccttgttccatggggattctgcaagagccctgaggtgtgtgtgtggcttcttttctcctgacagcagaaccatgccaggtttgctgtatttcctgttcataaccaaggcgttctcagctgtcatctgtgactaccagggacctgtcctggtggacaagtggacaagtcctttgcttgttttttycccaccatccactgcctccccccgtccccatgtgttttcctgctcattttggcatttctcaggttagagctggctttcgcagccaccactaggccaccaagagcccttaggttcatgatctgacataattccttcgcagcatgccaggatggaaaggtttctgaggggttcagcctccctgcaggactcagtcaggcatctttatttaatttcctttttttcttgcagtctttgggcctgggcctttaattgaggttatcacatgaggcctggcttctggataagcacagctgttttttt

SEQ ID NO: 130714 - DNA, 601 bp, Human
cacgggccattttcagctgttagtgtgcatgccttgttccatggggattctgcaagagccctgaggtgtgtgtgtggcttcttttctcctgacagcagaaccatgccaggtttgctgtatttcctgttcataaccaaggcgttctcagctgtcatctgtgactaccagggacctgtcctggtggacaagtggacaagtcctttgcttgtttttttcccaccatccactgcctccccccgtccccatgtgttttcctgctcattttggcatttctcaggttagagctggctttcgcagccaccactaggccaccaagagcccttaggttcatgatctgacataattccttcgcagcatgccaggatggaaaggtttctgaggggttcagcctccctgcaggactcagtcaggcatctttatttaatttcctttttttcttgcagtctttgggcctgggcctttaattgaggttatcacatgaggcctggcttctggataagcacagctgttttttttggaatggatcttcaataaaatatcctgagtgattgcagtgtaaatgagctagacccttgcttgacgatattgaggggtgcgtatt

SEQ ID NO: 130715 - DNA, 601 bp, Human
tagaactgaagcttttgttgagtgggatttatctcttgaagtatatttctgttgagttttttggggggcttttttgtgtttttgtttgtttgttttttactgtttagagtttgaaaataaacgtgctgtatttgctgtgtttctgctgatgaattaggaggaggtagattgtcagagcaatgtgaaagctgcttccagggtttcatggttaggctccgtgatccatggtgtttcttcataaatgagttaatgttaagatgacttaaccttaggttgctgtgagcagtgcctgtaggcatcwttccagtttcaaagataacaagttatttttaattgccaggctttttgcccagtaccaaatggaagttttaagcctggatttttgtaatagttctaattttaagcatatttaactcttgaagatggaaaggcctgcaagatcatgcagtacaggctgttatctggaagtttagtgctcatcacctgattctgattctcaaatgggccagagcccttgaagactctgccttctcactctggctggctcttcaatgctgacctttaaaacagacaacatccagcatcaccagcaaacttgcta

SEQ ID NO: 130716 - DNA, 601 bp, Human
tgtgtagattattgatgcttggagacttcagcgtggctggagatcagtccagggtctgtgtggaaggcctggtgaatcacacaaagggcatttctaccctcatcatttcataaagtccaaagtgaaagataaggagaagttttaaggtttaaagaaccaaaagtacctggagcaaggcccctccctcccgtttcctcatgactattgtgcttagaagaaaatcgcattaatacataagctttcaggaatggaggaggaaataaaggatattaaagtctgtcctcggcattcatttttttcsttctatgagaaaacaatgattaaatcttgagagagggagaggcgtatctgatcaggacatctgttttataaaactgcaaaggtgcttttcagcaagtatttgaggcaatggatcaagctggcaaagccatagagatgggatcaaagagtgtgctctctactgttcttttctaaaagtacccacttatcgcgagcacaaattgcaaagagatgaggtgtaagaattacctaaaggaatgaataatggaagaggtagtcaaaattagaaatttttaagtctgcacgtttgttgaacaccaga

SEQ ID NO: 130717 - DNA, 601 bp, Human
agaaccattgattcaaaaactatgagaatggaaaaatcattccttataaggagtactcatagaaggacataacaggaagaagtggtctgatgtttgaaaatttgaagaatttgcccagtagtcagcacagagaaattactatataccaagtaagtacagtgtttggagatggaaagtgtaggaaatgcggacagtgggaggtagcacaaaggtggcaattaaagaggagaaatcaaaggggagatgtttcaaaacccggggactgagtctagttaggttttagtccaatcatagaaaattktaatgagtgtcctgtccatctatgatggcttaaaaagatgtccataaattctttggtactctttgcttcagaaggtggagcctgaccctcttcccttcagcatgggctgcactgagcaactcacttctaatgaccaagatgtggcagaagcgatggagggcagcttccgagatgggcattgtggctgcctctttgctctctcttgggtcacttgatctagggtgagccagctgtcatgttgagagtacattcaggcagccctacagagccccctaggggttcatgtgagcagactgcctt

SEQ ID NO: 130718 - DNA, 601 bp, Human
gcctgcatccccagtctagccttcagatgactgcagcctcagccagcatcctgactgcatgtttcaaaaatgtgttaagattctttgacaagcttaaatgtagagtactctaccatactatcagtactctagtacttgttgaggagcaagtgtggcatggtcctttttcatccgatttcttgaaatctgttctagaaagccaaccgtggaaggactgcaacagatgagaataggactgatggagttgctttcatgggaatcattccctggctccctctggaggcagagttgttttgggtcrggagtaactccatctccatcagatgcagggactggtggctcactttgaaaggaggagaccatacagcagtgtcccagctgtcccttcaggggaaattccctatgagagatgtctggagcagagccagagtcctcaggacagaattggaaaagtatccacagactggagctccctccatcatgggctgctttgcccataaatggcattcccatctttttctggtgaccaaacatttgttggtggctccagcactgccgatgtttgttccagattttctttcttccagttctcaaactgcat

SEQ ID NO: 130719 - DNA, 601 bp, Human
ctgcagcctcagccagcatcctgactgcatgtttcaaaaatgtgttaagattctttgacaagcttaaatgtagagtactctaccatactatcagtactctagtacttgttgaggagcaagtgtggcatggtcctttttcatccgatttcttgaaatctgttctagaaagccaaccgtggaaggactgcaacagatgagaataggactgatggagttgctttcatgggaatcattccctggctccctctggaggcagagttgttttgggtcgggagtaactccatctccatcagatgcaggractggtggctcactttgaaaggaggagaccatacagcagtgtcccagctgtcccttcaggggaaattccctatgagagatgtctggagcagagccagagtcctcaggacagaattggaaaagtatccacagactggagctccctccatcatgggctgctttgcccataaatggcattcccatctttttctggtgaccaaacatttgttggtggctccagcactgccgatgtttgttccagattttctttcttccagttctcaaactgcatcagagtcccctgaagggcttattaaaacac

SEQ ID NO: 130720 - DNA, 601 bp, Human
cagaattggaaaagtatccacagactggagctccctccatcatgggctgctttgcccataaatggcattcccatctttttctggtgaccaaacatttgttggtggctccagcactgccgatgtttgttccagattttctttcttccagttctcaaactgcatcagagtcccctgaagggcttattaaaacacacggtgctggaggttaaaacacagatggctgggctccaccccagaatttctgctacagcagggttgaggcagagcctgagaatttgcatttcttttttttttttttttwtttaattattttgagatagggtctcactctgtcatctaggctggagtgcagtggccctgtcatacctcactgttgccttgacctcccgggctcaagtgatcctcccaccctggcctcccaagtagctgggaccacaggtatgcatcaccacacctggctaattattttaaattttatgtagagatagggtcccactatgttgcccaggctgatctcaaagtcctggcctcaagtaatcctgccaccatggcatcccaaagggcagggattacaggtgtgagcttccatggctggcccttg

SEQ ID NO: 130721 - DNA, 601 bp, Human
ccaaacatttgttggtggctccagcactgccgatgtttgttccagattttctttcttccagttctcaaactgcatcagagtcccctgaagggcttattaaaacacacggtgctggaggttaaaacacagatggctgggctccaccccagaatttctgctacagcagggttgaggcagagcctgagaatttgcatttcttttttttttttttttttttaattattttgagatagggtctcactctgtcatctaggctggagtgcagtggccctgtcatacctcactgttgccttgacctccygggctcaagtgatcctcccaccctggcctcccaagtagctgggaccacaggtatgcatcaccacacctggctaattattttaaattttatgtagagatagggtcccactatgttgcccaggctgatctcaaagtcctggcctcaagtaatcctgccaccatggcatcccaaagggcagggattacaggtgtgagcttccatggctggcccttgagaatatgcttcctaaccagttctcagaggatgctcatgctgctggtcttgagagcacacttggagaacatcttaactagttcatct

SEQ ID NO: 130722 - DNA, 601 bp, Human
cttccatggctggcccttgagaatatgcttcctaaccagttctcagaggatgctcatgctgctggtcttgagagcacacttggagaacatcttaactagttcatcttcacacttcacttagaggtgttcagtggtcatatgtaacggtgtatgttagtatacagattgttctttttcagatttcctacagaaaatctacttagtttaaattaaagaacactccccaacttttagcactcctgcttggcataaattggttctacatccttaacttttaaaggtttctgctcaggagcccacraaattaaaaattacctcttctgctgcgaaaattttattgctgcaactcatgcatgcatacaggcacacacacaccatgatgttaaattaaggagcttgaattaaaagcaaatttcccttatgtagaaagtcatctgttgatcatttggcttaattaaaattgggtgtatcttacatctaccatgattcactcccatactgcctccactaaaaatgatgccacattatctctaaattgagcctggcttatagtaaactctataagtgagactgcccttcatcttttcctaaagatacaact

SEQ ID NO: 130723 - DNA, 601 bp, Human
tgttcctttcattcttttctgttaacagctatggctgctgggtgagcccagctgccttgcacaatttgagtcttctcagacactcattcccctgagttgtcattggtagaaatggagtgattccttgttttgcaagggttgcacacttctcatcaaacatttatttgggcttttgtgaactctgtaatagacaatggcctagtcctttgttaactgtctggaggtcctgctgggaggtcgcagagcagggctgagctgctggaccctcagagcaggaagtttctgggctttgagaaaagcrgaaaactggtctgggaattccaggaagaatttcggatgttaggctgtggtcctgccactggccaggcatgtccgaggtaccagccctgcctcggagagcacatgctcagctccacattgtccagagggctctcctgcccccacacgcacttatacattcacacagatgaactcacacgctacgcatactctcacacactctcaatactcacatactccctctcacatctgcgcacgctcacacacttagagctgcggtatctcatgctcctctttcatgcaactcttttttttgtttgtt

SEQ ID NO: 130724 - DNA, 601 bp, Human
gctttgagaaaagcagaaaactggtctgggaattccaggaagaatttcggatgttaggctgtggtcctgccactggccaggcatgtccgaggtaccagccctgcctcggagagcacatgctcagctccacattgtccagagggctctcctgcccccacacgcacttatacattcacacagatgaactcacacgctacgcatactctcacacactctcaatactcacatactccctctcacatctgcgcacgctcacacacttagagctgcggtatctcatgctcctctttcatgcaactcttttttttgtttgttttctttttttttttcatagaacttactgccctgtgcagccatctgtacacctctatttatctgttccccacaccagattgtcacagagcatatgtcctgcatgcacacacatgtatccagggcaccgcctgcctggcatgtgttagtaactaattgttattcatttaatgaattgatcaaaacttgatatttttgtacaaagaacatttatcgttcagtatcttctttcctgcatgcttttcagcaaatgagataaaagaccaatttttttttttttttttttttt

SEQ ID NO: 130725 - DNA, 601 bp, Human
tgtttctaaaatattctgaaatagaaggcacatcacagaatttaaatatttttcaataaaatctgtaatcaaaccatagttcagcttcctctgggatattgtgaactatgtttaaaatgcgaccggaattttccactgctgttcatatttttaaatgcttagaattagaaaaattagccaggcatggtggcacatcgggaggctgaggcaggagaatctgcttgaacctgggaggcgcaggttgcagtgagccaagatcacaccattgcactctagcctgggcaacaaaagcaaaactgcrtctcaaaaaaaaaaagaattagaaaaattttgatgtcttaatttctaatagggttagacatcagaagtagtaaaatttctagctactgcctgcatgcaaaccactcttaataaattcccagtttatcaaaaaatagtttgggaaatgaaaaacagcaaatttcttgagcagtcagggcaacactgtatattccatagtgaagtgctgtatattccataatgagtttgcacttttcaaataactaaaacgcatttagcactgaaactgggctaagcagaatttattttttctttggttcag

SEQ ID NO: 130726 - DNA, 601 bp, Human
tgggctaagcagaatttattttttctttggttcagaatttcagaatcgtggactacctccaggtctttctgaacatcagatgccgttctagatataaaacagagacccggctgggcgtggtggctcatgcctgtaatccgagcaatttggaaggctgaggctgggaggggggtggggatcacctgaggtcagaagttcaagaccagcctggccaacatggcgaaaccctgtctctactaaaaatacaaatattagccgggcatggtggcaggttcctgtaatcccagctactcgggaggcygagacaggagaatcgcttgaacccgtgaggcggaggttgcagtgagccgagattgggccactacactacagcctgggcaaaagagtgaaactccatctcaaaaaaaaaaaaaaaagcagagacccagtgtttgagcaatgggtggtttggatttagacgcacaagagatgtggatggatttagacacagctccccgctgtggcccggctgtaactgtgttctgtttcctccccagcccagcgacttctccgtgtcccttaaagcgtcagggaagaacaaacacttcaaggtgcagctcgt

SEQ ID NO: 130727 - DNA, 601 bp, Human
gggctaagcagaatttattttttctttggttcagaatttcagaatcgtggactacctccaggtctttctgaacatcagatgccgttctagatataaaacagagacccggctgggcgtggtggctcatgcctgtaatccgagcaatttggaaggctgaggctgggaggggggtggggatcacctgaggtcagaagttcaagaccagcctggccaacatggcgaaaccctgtctctactaaaaatacaaatattagccgggcatggtggcaggttcctgtaatcccagctactcgggaggccragacaggagaatcgcttgaacccgtgaggcggaggttgcagtgagccgagattgggccactacactacagcctgggcaaaagagtgaaactccatctcaaaaaaaaaaaaaaaagcagagacccagtgtttgagcaatgggtggtttggatttagacgcacaagagatgtggatggatttagacacagctccccgctgtggcccggctgtaactgtgttctgtttcctccccagcccagcgacttctccgtgtcccttaaagcgtcagggaagaacaaacacttcaaggtgcagctcgtg

SEQ ID NO: 130728 - DNA, 601 bp, Human
agagacccggctgggcgtggtggctcatgcctgtaatccgagcaatttggaaggctgaggctgggaggggggtggggatcacctgaggtcagaagttcaagaccagcctggccaacatggcgaaaccctgtctctactaaaaatacaaatattagccgggcatggtggcaggttcctgtaatcccagctactcgggaggccgagacaggagaatcgcttgaacccgtgaggcggaggttgcagtgagccgagattgggccactacactacagcctgggcaaaagagtgaaactccatctcaaaaaaaaaaaaaaaagcagagacccagtgtttgagcaatgggtggtttggatttagacgcacaagagatgtggatggatttagacacagctccccgctgtggcccggctgtaactgtgttctgtttcctccccagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggag

SEQ ID NO: 130729 - DNA, 601 bp, Human; identical to SEQ ID NO: 122849

SEQ ID NO: 130730 - DNA, 601 bp, Human; identical to SEQ ID NO: 122848

SEQ ID NO: 130731 - DNA, 601 bp, Human; identical to SEQ ID NO: 122847

SEQ ID NO: 130732 - DNA, 601 bp, Human; identical to SEQ ID NO: 122846

SEQ ID NO: 130733 - DNA, 601 bp, Human; identical to SEQ ID NO: 122845

SEQ ID NO: 130734 - DNA, 601 bp, Human; identical to SEQ ID NO: 122844

SEQ ID NO: 130735 - DNA, 601 bp, Human; identical to SEQ ID NO: 122843

SEQ ID NO: 130736 - DNA, 601 bp, Human; identical to SEQ ID NO: 122842

SEQ ID NO: 130737 - DNA, 601 bp, Human; identical to SEQ ID NO: 122841

SEQ ID NO: 130738 - DNA, 601 bp, Human; identical to SEQ ID NO: 122840

SEQ ID NO: 130739 - DNA, 601 bp, Human; identical to SEQ ID NO: 122839

SEQ ID NO: 130740 - DNA, 601 bp, Human; identical to SEQ ID NO: 122838

SEQ ID NO: 130741 - DNA, 601 bp, Human; identical to SEQ ID NO: 122837

SEQ ID NO: 130742 - DNA, 601 bp, Human; identical to SEQ ID NO: 122836

SEQ ID NO: 130743 - DNA, 601 bp, Human; identical to SEQ ID NO: 122835

SEQ ID NO: 130744 - DNA, 601 bp, Human; identical to SEQ ID NO: 122834

SEQ ID NO: 130745 - DNA, 601 bp, Human; identical to SEQ ID NO: 122833

SEQ ID NO: 130746 - DNA, 601 bp, Human; identical to SEQ ID NO: 122832

SEQ ID NO: 130747 - DNA, 601 bp, Human; identical to SEQ ID NO: 122831

SEQ ID NO: 130748 - DNA, 601 bp, Human; identical to SEQ ID NO: 122830

SEQ ID NO: 130749 - DNA, 601 bp, Human; identical to SEQ ID NO: 122829

SEQ ID NO: 130750 - DNA, 601 bp, Human; identical to SEQ ID NO: 122828

SEQ ID NO: 130751 - DNA, 601 bp, Human; identical to SEQ ID NO: 122827

SEQ ID NO: 130752 - DNA, 601 bp, Human; identical to SEQ ID NO: 122826

SEQ ID NO: 130753 - DNA, 601 bp, Human; identical to SEQ ID NO: 122825

SEQ ID NO: 130754 - DNA, 601 bp, Human; identical to SEQ ID NO: 122824

SEQ ID NO: 130755 - DNA, 601 bp, Human; identical to SEQ ID NO: 122823

SEQ ID NO: 130756 - DNA, 601 bp, Human; identical to SEQ ID NO: 122822

SEQ ID NO: 130757 - DNA, 601 bp, Human; identical to SEQ ID NO: 122821

SEQ ID NO: 130758 - DNA, 601 bp, Human; identical to SEQ ID NO: 122820

SEQ ID NO: 130759 - DNA, 601 bp, Human; identical to SEQ ID NO: 122819

SEQ ID NO: 130760 - DNA, 601 bp, Human; identical to SEQ ID NO: 122818

SEQ ID NO: 130761 - DNA, 601 bp, Human; identical to SEQ ID NO: 122817

SEQ ID NO: 130762 - DNA, 601 bp, Human; identical to SEQ ID NO: 122816

SEQ ID NO: 130763 - DNA, 601 bp, Human; identical to SEQ ID NO: 122815

SEQ ID NO: 130764 - DNA, 601 bp, Human; identical to SEQ ID NO: 122814

SEQ ID NO: 130765 - DNA, 601 bp, Human; identical to SEQ ID NO: 122813

SEQ ID NO: 130766 - DNA, 601 bp, Human; identical to SEQ ID NO: 122812

SEQ ID NO: 130767 - DNA, 601 bp, Human; identical to SEQ ID NO: 122811

SEQ ID NO: 130768 - DNA, 601 bp, Human; identical to SEQ ID NO: 122810

SEQ ID NO: 130769 - DNA, 601 bp, Human; identical to SEQ ID NO: 122809

SEQ ID NO: 130770 - DNA, 601 bp, Human; identical to SEQ ID NO: 122808

SEQ ID NO: 130771 - DNA, 601 bp, Human; identical to SEQ ID NO: 122807

SEQ ID NO: 130772 - DNA, 601 bp, Human; identical to SEQ ID NO: 122806

SEQ ID NO: 130773 - DNA, 601 bp, Human; identical to SEQ ID NO: 122805

SEQ ID NO: 130774 - DNA, 601 bp, Human; identical to SEQ ID NO: 122804

SEQ ID NO: 130775 - DNA, 601 bp, Human; identical to SEQ ID NO: 122803

SEQ ID NO: 130776 - DNA, 601 bp, Human; identical to SEQ ID NO: 122802

SEQ ID NO: 130777 - DNA, 601 bp, Human; identical to SEQ ID NO: 122801

SEQ ID NO: 130778 - DNA, 601 bp, Human; identical to SEQ ID NO: 122800

SEQ ID NO: 130779 - DNA, 601 bp, Human; identical to SEQ ID NO: 122799

SEQ ID NO: 130780 - DNA, 601 bp, Human; identical to SEQ ID NO: 122798

SEQ ID NO: 130781 - DNA, 601 bp, Human; identical to SEQ ID NO: 122797

SEQ ID NO: 130782 - DNA, 601 bp, Human; identical to SEQ ID NO: 122796

SEQ ID NO: 130783 - DNA, 601 bp, Human; identical to SEQ ID NO: 122795

SEQ ID NO: 130784 - DNA, 601 bp, Human; identical to SEQ ID NO: 122794

SEQ ID NO: 130785 - DNA, 601 bp, Human; identical to SEQ ID NO: 122793

SEQ ID NO: 130786 - DNA, 601 bp, Human; identical to SEQ ID NO: 122792

SEQ ID NO: 130787 - DNA, 601 bp, Human; identical to SEQ ID NO: 122791

SEQ ID NO: 130788 - DNA, 601 bp, Human; identical to SEQ ID NO: 122790

SEQ ID NO: 130789 - DNA, 601 bp, Human; identical to SEQ ID NO: 122789

SEQ ID NO: 130790 - DNA, 601 bp, Human
ctcatccaaaaacaccctcccagacacacccagaacatatgactgaatgtttgggcaccgcatggcccagtcaagttgacacatgaaagtaaccatcacagtagctaaaactgaaatccacaatttaggataacagaggaaattcacttgactcaccccaaagtcaaaatgccagcctagtctccaggaagacacagttctcagccactagagaaagcacacgtgttttgtttcagatggtcatcttgaggaagcgaactcagtataacgcaacttgagatggacacttaataaatgtggytttgatcaaattctcataataaaaccgcacagaagaacccaatgtctaatgtttccattcacccaagctcaaggaactttgtacctcagggcatctgagtcagagagccgcttagcgactcaggcccggtgctgacaaaggaggctgcctgagtcactgaggctgagtaactggccctcggcacaggacaggagtaaactactcctgatatctagtctgtttttttttttttttttttttttggcaatattctattgggcgtttttgactgcaatttaaatatctttcagtactggaaat

SEQ ID NO: 130791 - DNA, 601 bp, Human
gctttactcagtctacccattcatatgtcaatctcatccaaaaacaccctcccagacacacccagaacatatgactgaatgtttgggcaccgcatggcccagtcaagttgacacatgaaagtaaccatcacagtagctaaaactgaaatccacaatttaggataacagaggaaattcacttgactcaccccaaagtcaaaatgccagcctagtctccaggaagacacagttctcagccactagagaaagcacacgtgttttgtttcagatggtcatcttgaggaagcgaactcagtataaygcaacttgagatggacacttaataaatgtggttttgatcaaattctcataataaaaccgcacagaagaacccaatgtctaatgtttccattcacccaagctcaaggaactttgtacctcagggcatctgagtcagagagccgcttagcgactcaggcccggtgctgacaaaggaggctgcctgagtcactgaggctgagtaactggccctcggcacaggacaggagtaaactactcctgatatctagtctgtttttttttttttttttttttttggcaatattctattgggcgtttttga

SEQ ID NO: 130792 - DNA, 601 bp, Human
cagtttttttgttctattcaggccttcaactgtttggacaaggcccactcacattatggagagcagcctgctttactcagtctacccattcatatgtcaatctcatccaaaaacaccctcccagacacacccagaacatatgactgaatgtttgggcaccgcatggcccagtcaagttgacacatgaaagtaaccatcacagtagctaaaactgaaatccacaatttaggataacagaggaaattcacttgactcaccccaaagtcaaaatgccagcctagtctccaggaagacacagttytcagccactagagaaagcacacgtgttttgtttcagatggtcatcttgaggaagcgaactcagtataacgcaacttgagatggacacttaataaatgtggttttgatcaaattctcataataaaaccgcacagaagaacccaatgtctaatgtttccattcacccaagctcaaggaactttgtacctcagggcatctgagtcagagagccgcttagcgactcaggcccggtgctgacaaaggaggctgcctgagtcactgaggctgagtaactggccctcggcacaggacaggagtaaac

SEQ ID NO: 130793 - DNA, 601 bp, Human
ggctgaggatgagtgtgaagtctaagttcacaccaggcaagacaccacccacgagcactgggatggacctgggagaccagacgctgctccagacccctcgtgacatccccatgcagagagcatgttttacagcaagaggaaagccaagactcccaggagcaaagtagtgatcaaatcttaaaaaaagggagaatgacagttggtggggagactttttaaatagatgttaccagagagctgtaatagtcagggttttctagaaaaatagaaccaacaagagatgtacatagagagatttatygcaatgatttagctcacacaattacgaaggtgaaaaagtcccaagacctgcagtcagtaggctggagacccaggagagccgatggtgcaaattgcagtctgaaaagaggagactctatagacccaagaagagccgatgtttcagtgtgagtccaaaggcggaaaggaccaatgtcccagctcaagcagtccggcaggggggcttccctcttactcagtttttttgttctattcaggccttcaactgtttggacaaggcccactcacattatggagagcagcctgctttactcagtctacc

SEQ ID NO: 130794 - DNA, 601 bp, Human
gcaggggtctcctctcacctcccaagtgcggctcactgttcactctcccagctatctgaggtgcctatgacccccacccccatgctggcctttctcttggcatccagcagcttccatgaatgactggccacctccttctcactgcagtcctgccactctgtggggtttctctggcgcactgcaacaggactctgtcccgagaggcttgcacagttccttctgcttccttcattgactgcctgcttcttagtgactccaaaagttgtattaacccaagcagacaggtctatttccttgttgrctgacaagctccatatttacatactgcaaggacattctggcattaattctgttcacccatgaaaacagggcagctgcttctgccacagacatcccacatctcactcaagaccatatgacgggaggatcttgaagccgcagacagaatcaggctagtaaaggcgtgggccaccgaaggctgaggatgagtgtgaagtctaagttcacaccaggcaagacaccacccacgagcactgggatggacctgggagaccagacgctgctccagacccctcgtgacatccccatgcagagagcatgt

SEQ ID NO: 130795 - DNA, 601 bp, Human
ggttctgcatgaggcaatgtttgaataaggtaaactgctgtcttctgaattatcttttgaatattgaatactaaaaataaagggaaaacaataaatatcaaatttctgatctgaagtccatgactacaagaggagttacacttgttttgatgtcgttcagccttttgaacccagccgacaagaatgtgttgagtaaccactgttttccatgtgctacgtgaggcactgggaagctgagataaaacacacagtctatgaaggagttccagtctagttctagctccaaataatttaaatcacytttaagatcccatcttgtcatttaatctcaaaacacatcaattgcagccatgcaggacaaccatagctgcacacgctagaatggcgggtggcctcgggtccgtcaatcacaccagtgtggggaccaagggagactccatcctgcatgctatggctctaccatgccttccctgagtgagttacgaacacttctacacctacaaaacgaaaaccacccactcttcttcatggcaggggtctcctctcacctcccaagtgcggctcactgttcactctcccagctatctgaggtgcctatgac

SEQ ID NO: 130796 - DNA, 601 bp, Human
cttggagtccctaaagagagaggatctcttgagcccaagagttcgaggctgcagtgagctgtagtgctgccactatactccagcctggaccacagtgtaagacccggtctctaaaaaaaaaaaaaattttatatcagttggatatggtgatgtgtgcctacagtcctagctacctgggagactgaggcaggaggactgcttgagcccaggggtttgaggctttagtgagctatgatggcacctgtgaaaagctactgcactccagcctgagcaacagaatgagaccctggaaaaaaaaaaagaaaagaaggaaagaaagaaagaaagagaaaaaagaaagaaagaaaaaaagtatctagcatccacttgaaatctatttttaaattgttggattttaaacaatcttagtttgtaaggtataaaattgactatgcttaccactgtataatatatttacagattaatttaataagcctttactaaatgcatgtacagacaggtgtcagaggtgtattatagtttacataaactggtaacttccaacttaaaaaaaataaataaacatcttcatctctggtggttctgcatgaggcaatgtttg

SEQ ID NO: 130797 - DNA, 601 bp, Human
gcaccattttattttcctacggatgggagtatctacacacaaaaaccgctcacccccaacactcttcatttgtctagctaaacgggttgttttaaacagaaattctgataaaacggagagggccatcatgtcaaggaaagttgctgttttataaactagaataatggatcaagccttggagtccctaaagagagaggatctcttgagcccaagagttcgaggctgcagtgagctgtagtgctgccactatactccagcctggaccacagtgtaagacccggtctctaaaaaaaaaaaaaawtttatatcagttggatatggtgatgtgtgcctacagtcctagctacctgggagactgaggcaggaggactgcttgagcccaggggtttgaggctttagtgagctatgatggcacctgtgaaaagctactgcactccagcctgagcaacagaatgagaccctggaaaaaaaaaaagaaaagaaggaaagaaagaaagaaagagaaaaaagaaagaaagaaaaaaagtatctagcatccacttgaaatctatttttaaattgttggattttaaacaatcttagtttgtaaggtataaaattg

SEQ ID NO: 130798 - DNA, 601 bp, Human
aagcccttcctgcatgcagcccttcaacacatgcaaaagcagcttcggtaagtcagtccctgtatctttagatgtcaccagggatccgcaagggatattcaattacttatcaataatcaaccagagctttccagagacaattaggaaaactggtctatgtgggctcttttaaaaaatacattataaaagtgcagtgttttcatgcaattgccccgtcttctaccaaccgtaagcattgggaagggtgcccactacctgtcgctgagacctcaccagcagggaacacacacaggaccagggsctttgtgaatacttgtggaatggatgaacaaatgaattgacgggtggatgaatacaaacatgtcagagtacaaacatacaggcaaaaatcaagcatgaaaaattagaaacatattatgtgaacaatccactctgcatagcaaacccaacatgtaatgtggtttggcatatgacatcatgagcttccatcgctgccctcgtccctccttccagataagctgctgcttccgcagcggatataactcttcttattgtgtttggactccaatcccatgtgaacacacagctgcacagtccagga

SEQ ID NO: 130799 - DNA, 601 bp, Human
agatccctacaggtaaagcctgaagaggtcagattagcaaaagaagtctatttaagcatccttttcaatgcaccttttattgactacctactttgatctgaccccaatgggcccattttctcctccccctttgaaaccccaagtgcttctccctatcaaccctgctgcaggaggctcctctaacatagccatttcctaaggagaaatctgtgaacgtccccaagcccttcctgcatgcagcccttcaacacatgcaaaagcagcttcggtaagtcagtccctgtatctttagatgtcaccrgggatccgcaagggatattcaattacttatcaataatcaaccagagctttccagagacaattaggaaaactggtctatgtgggctcttttaaaaaatacattataaaagtgcagtgttttcatgcaattgccccgtcttctaccaaccgtaagcattgggaagggtgcccactacctgtcgctgagacctcaccagcagggaacacacacaggaccagggcctttgtgaatacttgtggaatggatgaacaaatgaattgacgggtggatgaatacaaacatgtcagagtacaaacatac

SEQ ID NO: 130800 - DNA, 601 bp, Human
atgccaggaagctttttttttttttttttttttcttgagacagtgtcactctatcacccaggctggagtgcactggccctatcttggctcacttcagcctccacatcctaggttcaagcgattctcctgtctcagcctcccaagtagctggtattacaggcgtgcatcaccgcacccagctaattttttttttttttttaaccagaaagatttcgatcaaaggaggggctgccatgatagacagcctcccttggcttgctggctcaggccttggagttccaggagcctggcagatccctayaggtaaagcctgaagaggtcagattagcaaaagaagtctatttaagcatccttttcaatgcaccttttattgactacctactttgatctgaccccaatgggcccattttctcctccccctttgaaaccccaagtgcttctccctatcaaccctgctgcaggaggctcctctaacatagccatttcctaaggagaaatctgtgaacgtccccaagcccttcctgcatgcagcccttcaacacatgcaaaagcagcttcggtaagtcagtccctgtatctttagatgtcaccagggatccgc

SEQ ID NO: 130801 - DNA, 601 bp, Human
caggacaaaaaaaggaaggaggagggtaaatgaaatgaggcagaagagaggcaaggaccctgcatgccaggaagctttttttttttttttttttttcttgagacagtgtcactctatcacccaggctggagtgcactggccctatcttggctcacttcagcctccacatcctaggttcaagcgattctcctgtctcagcctcccaagtagctggtattacaggcgtgcatcaccgcacccagctaattttttttttttttttaaccagaaagatttcgatcaaaggaggggctgccatgayagacagcctcccttggcttgctggctcaggccttggagttccaggagcctggcagatccctacaggtaaagcctgaagaggtcagattagcaaaagaagtctatttaagcatccttttcaatgcaccttttattgactacctactttgatctgaccccaatgggcccattttctcctccccctttgaaaccccaagtgcttctccctatcaaccctgctgcaggaggctcctctaacatagccatttcctaaggagaaatctgtgaacgtccccaagcccttcctgcatgcagcccttca

SEQ ID NO: 130802 - DNA, 601 bp, Human
tcatcttctaagaggacactagagttctacaaagagcagagagcatttctactccaaccaacagggcagagcataaaatgagcaactgctgctacctaggagcacagcaggatgcactgtgtgaaagcaggcccctgaaggagttccacacagttacatactgcacaagccctgagcatcagaataaaaagtccatgagctaataagcaagctcagagcttcccttctattacaacatgtttaaaagtatacctattgtcctgtattagaaatctcctataacttgcattttttttttttkttgagacagagtcttgctgtgtcacccaggctggagtgcagtggcatgatctcagctcactgcagcctccacctcccgggtttcagtgattctcctgcctcagcctcctgggttgctgggattacgggcacacgccaccacactcagctaatttgtgtgtgtgtgtatgtgtgtgtgtgtatgtgtatttttttttttttagtagagacggagtttcaccatgttggccagactggtctcaaactcctgacctcaggtgatccgcctgccttggcctcctaaagtgctaggattacagtc

SEQ ID NO: 130803 - DNA, 601 bp, Human
ctacttgggaggctggggcaggagaatggcgtgaaccaagaggtagagcttgcagtgagctgagatcgtgccactgcactccagcctgggcgacaaagcgagactccgtctaaaaaaataaaaaaataaatctaagagaataaactctgaaaataagtagggctccacatttgctcaaagtacgactgaggttatgaatgtcatcatggtgaatgtcatcatcagtgatatgatgaatatcattatcagtgataccagctcccagcaggaacagtagcagctgctatctgctcagtgggtycacctgggaggaggcacttggccctgtggttcagctcctaattctacagaattctttctgagagtggtggatccctcttctaccttgttcctcatcttctaagaggacactagagttctacaaagagcagagagcatttctactccaaccaacagggcagagcataaaatgagcaactgctgctacctaggagcacagcaggatgcactgtgtgaaagcaggcccctgaaggagttccacacagttacatactgcacaagccctgagcatcagaataaaaagtccatgagctaataagca

SEQ ID NO: 130804 - DNA, 601 bp, Human
tatctatgacaacttcctcattctatggatggaaaaactgaagcccacgcatatttatgaaaaagagggtccactgagctttctcaaatagccgtctgacttacagaaaatgaactcccagtctaacttgaaaggccgtctgtgtgggtcaggacaagcaccagccctgctagggaagggagacagtctacagcctctgttaatgtctgcagagctccatttatgttggcagctggtgaaaggggtacacctgttttcctctgaggtaataatcgtgatcacggtgctcatatacctgatrtgtgttttccacttcctctgattctacaggaccaggacagaaaaaaacaaaaacaaaaaaaatctggccaggtgcggtggctcacgcctgtaatcccagcactttgggaggctgaggcgggtgaaacacgaggtcaggagattgagaccatcctggctaacacggtgaaaccccatctctactaaaaatacaaaaaaaaaaattatccgggtgtggtggcgggcacctgtagtcccagctacttgggaggctggggcaggagaatggcgtgaaccaagaggtagagcttgcagtgagctg

SEQ ID NO: 130805 - DNA, 601 bp, Human
aagatgaggctcttgagcacttgaattattattctgaagcccaacgtataaatatcctttgtaccgcagccatctcgagttggagcagccatgctggcacaagattcaatgctttcctgtaattgttcagttattggccttgaaagttgctgtcatttatttcatcacaattgagagctgtttttccaacatatatgtttttccaataaagggtgtgatttagctgtgggacaagaggctcactgcccattccatgcccacaaacataagaataataatttgggaatttgaaataagaacsatgaaaggacagagaactataaattgcggaattgtaaaagctggaaacaaatccccagattatctatgacaacttcctcattctatggatggaaaaactgaagcccacgcatatttatgaaaaagagggtccactgagctttctcaaatagccgtctgacttacagaaaatgaactcccagtctaacttgaaaggccgtctgtgtgggtcaggacaagcaccagccctgctagggaagggagacagtctacagcctctgttaatgtctgcagagctccatttatgttggcagctggtgaa

SEQ ID NO: 130806 - DNA, 601 bp, Human
cgctggggtctacttgagcggggagggaggatggcaggagagagaggagcagaaaacataacacttgggtactaggcttaatacctgggtgatgaaataatatgtacaacaaacccctgtgacaagagtttacctgtataacaaacctgcacatgtaccccgaacctaaaataaaagtttaaaaaaaggggtctccatgcccggcacactgcatttttctaggatgaatacgcagtgtgaataagcagcaagtgatgggccctcctcttatgaccattcctataaaatcatgttagaatgwtcctggagagaaaaagcctaccacaggaatagctggtgtggagaaacggccatagggcattaaaaacacagacaattttcttcaggaataaatggcaatattccatttgctaaaagtggaaagttttctctgttcttaaataggtacactgggctgggtgcagtcactcacgcctgtaatcccagcactttgggaggccgagacaggtggatcacctgaggttgggagcttgagaccagtctggccaacatggtgaaaccctgtctctactaaaaatacaaaaaaaaaaaaaaaattagc

SEQ ID NO: 130807 - DNA, 601 bp, Human
gaggccattatccttagcaaactaatgcaggaacagaaagccaaatactgcatgttctcacttgtaagtgagggctaaatgagggaacacatgaacacaaagaggtaaacaacagacgctggggtctacttgagcggggagggaggatggcaggagagagaggagcagaaaacataacacttgggtactaggcttaatacctgggtgatgaaataatatgtacaacaaacccctgtgacaagagtttacctgtataacaaacctgcacatgtaccccgaacctaaaataaaagtttaaaawaaggggtctccatgcccggcacactgcatttttctaggatgaatacgcagtgtgaataagcagcaagtgatgggccctcctcttatgaccattcctataaaatcatgttagaatgttcctggagagaaaaagcctaccacaggaatagctggtgtggagaaacggccatagggcattaaaaacacagacaattttcttcaggaataaatggcaatattccatttgctaaaagtggaaagttttctctgttcttaaataggtacactgggctgggtgcagtcactcacgcctgtaatccca

SEQ ID NO: 130808 - DNA, 601 bp, Human
caacctccgcctcccaggttcaagtgattctcctgcctcagcctcccaagtagctgagattacaggcacctgccaccacacccagctaacttttatatttttagtagagacagggttttaccatgttggctaggctggtctcaaactcctgacctcgggtgatctgcccacctcagcctcccaaactgctgagattacaggcgtgagccatcacgcctggtcacattccacttcttgaaaagcacaaattattttttactgtgtcagaaaaagctatctcagttttaaatgcaggtaaggrctgacaccagagcccccatcctgtccggctgtgacccggccttgcatcttccccttctccctgcctccaaaatagaaaggcaggcatagaaataatacgtccatttctataaaaagattttccgtgagctcctctttatgattcatgatttgaataggaagaaatcacagtggcaaaagggagggagatctgacctgggaaacctgagattagatgcaatgagggcactaatacccttgacctgggagtgcaagctgcccttgcacaagaaaaactgccaaagtccctgaggatgaatca

SEQ ID NO: 130809 - DNA, 601 bp, Human
agggggctggtgctgtacctctttcgtctctgctcaaggcagaggtctctttcgctacaagatggaaaccatccctcaactgtcactaaatccctgggaacagaaagtgatggtgcagccttctgattcctgtctttcctaagaatgatgtgatcagagaaggaaatagaaggaacacatgttggatgtgctagaatgatccaactgcatgcatggcctaagtcaatcagtcagcggcaatgtgctgatattaacgaccagggaggagagcagcaaaaatccctacagagcacaaagcaaygagagcagaaaagagatagtaaaatgccatgaactgacttggtgcccattcagttgggaattcctttagagatgccaaaggaatcccattttgtagccagtttcacggcactcaggatgacagccacatgaggggtttcactggagtgttttagaagccgtttgcgggtgaaggtatcagagagttcagagctatggatgggtcccccagggtgtccttcagcaatccaggttggaacaagagtctgctgagaagcgcaggtcagggttcaccaccctcaaccacggggcagttggtaca

SEQ ID NO: 130810 - DNA, 601 bp, Human
gaaaagaataaggaagtagtcagcagaaaggtggcagtctggagcttaccctgtcagctgctagaagagtacgagtgcgagtgcaagggcttgtatctacatactagaaagaccctatgaagcagacccctggttctccccagttttttttgggtcttttttgagacagagtcttactctgtgtcccaggctggagtgcagtggcatgatctcggctcactgtaacttctgcctcccaggttcaagtgattctcgtgcctcagcctctcaagtagctgggattacagatatgcaccaccaygcccagctaatttttgtattttcagtagacacagggtttcgccatgttggccaggctggtctcgaactcccggcctcaattgattcacccgccttggcctcccaaagtgctgggattataggctttgagcctatgcccctggcctggttctccccattttatagatgtggagatgtgcacggaagggtcaagtaactgacccaaggccacacagcaagtgagacacagagcctgggctggaactgggcagtctggtggctgagctctcatgcttgtcctgttaaatacatgaaaagggac

SEQ ID NO: 130811 - DNA, 601 bp, Human
tccaaaatctgtccttgaaagtgagacttaccttttgccagatgatatctgaacctctcacctacgtaagtatttcttttccagctaaagcttttataattatatttttctcgggctatctacttcttcctcaaactggacatttttattgatgtttccaaaatgaaaagcgacaaagagagagggtgaagcttctgaaaggtgtgtggaagggacgtgtcacgaaaagaataaggaagtagtcagcagaaaggtggcagtctggagcttaccctgtcagctgctagaagagtacgagtgygagtgcaagggcttgtatctacatactagaaagaccctatgaagcagacccctggttctccccagttttttttgggtcttttttgagacagagtcttactctgtgtcccaggctggagtgcagtggcatgatctcggctcactgtaacttctgcctcccaggttcaagtgattctcgtgcctcagcctctcaagtagctgggattacagatatgcaccaccacgcccagctaatttttgtattttcagtagacacagggtttcgccatgttggccaggctggtctcgaactcccggcctc

SEQ ID NO: 130812 - DNA, 601 bp, Human
gctttacttccagaaaaaaacaggaacatttttttctatcattgcttccactacaaacccaactacccgattatttttgaaagtcaagaaaagcacgcctaaagcatcaaaagccccaaatgccaaggtctcgcttcaactcaatgtctctttttgttccaaaatgtacaaaatcatacagtgtaaccccacgtatctcaaaacattaatccgggttgaaaagttcagcacaattcactcctggcttgacagcagccttgatgattttggctccatttgggagactcttgtttatttgctyataaaacatgcgtggaaggatgacggcttttaagggtctttccactaaatcactggagaaacagcaagtgatttttgttttgtttttatttcagccactggtcagggatgattagccccaaatatccaaaatctgtccttgaaagtgagacttaccttttgccagatgatatctgaacctctcacctacgtaagtatttcttttccagctaaagcttttataattatatttttctcgggctatctacttcttcctcaaactggacatttttattgatgtttccaaaatgaaaagcgacaa

SEQ ID NO: 130813 - DNA, 601 bp, Human
tctcatttaagtaggtcaggactctcaaaattagcctaattcccataggcatgccaacatttaaaactcacacacatgaacatgtcctttagagggaagtagctgaggcctgtggtggctgtgctattttaagagaagagattggccaccagacctaagagcacagttcctctatcaggtatctccccgcctgccaggattgtgggctttacttccagaaaaaaacaggaacatttttttctatcattgcttccactacaaacccaactacccgattatttttgaaagtcaagaaaagcaygcctaaagcatcaaaagccccaaatgccaaggtctcgcttcaactcaatgtctctttttgttccaaaatgtacaaaatcatacagtgtaaccccacgtatctcaaaacattaatccgggttgaaaagttcagcacaattcactcctggcttgacagcagccttgatgattttggctccatttgggagactcttgtttatttgctcataaaacatgcgtggaaggatgacggcttttaagggtctttccactaaatcactggagaaacagcaagtgatttttgttttgtttttatttcagc

SEQ ID NO: 130814 - DNA, 601 bp, Human
cccaggctggagtacagtggcgcaatcttggctcactgcaacctctaccttccaggttcaaatgattctcctgcctcagcctcccaagtagctgggattacaggtgcacgccaccacacccagcttatttttgtatttttagtagagacggggtttcgccatgttggccaggctggtctccagctcctggcctcaagtgttccacctgcctcggcctcccaaagtgctggaattacaggcgtgggccactgtgcccagccctattttttctttagttggttgaatttttgaagcccagaaygtaggcagatcccccaaaaactctgtaatcagtctacgaaaatattttgttaatgctaacaggtatccaagaaaaggttcaggaagcatgtaatgtcagaggatcataaaattgtattagcattgtctattctccactattacactggccatacaaatcaataatctttaccctttgagatcacagcattttcccagagtaacttaatagaaataaagattacaattcagtggctacatagagaggatgttcaaactatataacaggctctgaagtcttgcctgtctcatttaagtaggt

SEQ ID NO: 130815 - DNA, 601 bp, Human
tgagaagagtaggggcctctgactgaaggtcacttgattgaggccaggtggtcaccatctcttactcataaggactgaccacatctggcccgagagtcacatagacagggtcctgcccgaggctgcaggtagcaggtggcatcgcatgctaggtgaggaccctccgggtctgggctcaaattgtacctcggatacttcctaatccctttaacccttggcaagatcctcatcctctctaggcctcagcggctactccataaaatggaatgaaaaaagttcctacctatagggtgttaggagmaatttagatcatgcagtttaggcatttacaagtgcctggaacaagtcatcaggcaatacacagtggtttcaaagactaccactagaaactaaaccctgaatgctagtttctgatctgcagatcttttgttcttgtttattattttttttttctctttgtagcaccctccaagcacatgggtgggtatggtggccagtccaatttcatggcattgcttgcagacccatggaacattcaaagtctaggttacgtgtgtcgcccagggcttaaaatcaccaatttgttaaatgcacagtatta

SEQ ID NO: 130816 - DNA, 601 bp, Human
ggcgctcttcccagaaaagggtccagaaagaccagcgagggaggcctgtgttacaccgaggacagaagggtgggtttttcaaacctgaccttacacctttcactaggcttggtcagaaaccttccaaaatatactaggggcatctagatttaacctgtatgtgtgaaaaccttcgtctcctatttcagagccctgccaggttgctttctgccaaaatatcactgaacatttctgtccattaccaaacattaactgagacttttacagccaatttgatcatcacttcaatgtttcctattarctacaaaagctggaaagagagtttgtgaaacaacttgagcctcaattctgcaatgtaatcatcaccatctaaaggggcccatgagaagagtaggggcctctgactgaaggtcacttgattgaggccaggtggtcaccatctcttactcataaggactgaccacatctggcccgagagtcacatagacagggtcctgcccgaggctgcaggtagcaggtggcatcgcatgctaggtgaggaccctccgggtctgggctcaaattgtacctcggatacttcctaatccctttaacccttggc

SEQ ID NO: 130817 - DNA, 601 bp, Human
tatgaaaagatattttctgcttgagatcatcaggtttccaactgtacattctttcaaatccttacaaataaagatgcagaaaaatggacaacagcagaaatgacagcactgtgttggcatgtcacaggtgctccctagacgttaactcactcaattaccccgacagtcccgtgagctaggaaccccagtgtatagacatggaaacggaggcttataggtggcaggacttgtccccttcgcgcagcttgtcaaaggtggagccagggagatttggttccggggtccagcctcggtgcatgcraggtcactgctgagcgctgtgcacctctgctgctatgtcttgtggctgaacttttggttttatgcactgacaggccaagttcgtgcactgacaggcccttctcatgaaatccatccagacagctttgcttctgatcctaggaccctgcttgattaaattcccttcacagacagatttttgtcttttaggaggaaatccaaataaatacgcgttttcagtgctcgttacaaactctgtggacaaattctacacggaagaagatccaagaaggtaatttgctcattgagaacttaaaaacca

SEQ ID NO: 130818 - DNA, 601 bp, Human
attcttcagatccatacgatttcacttcagacatggattctcatgtcattcatgctcagcgttatgaaaagatattttctgcttgagatcatcaggtttccaactgtacattctttcaaatccttacaaataaagatgcagaaaaatggacaacagcagaaatgacagcactgtgttggcatgtcacaggtgctccctagacgttaactcactcaattaccccgacagtcccgtgagctaggaaccccagtgtatagacatggaaacggaggcttataggtggcaggacttgtccccttcrcgcagcttgtcaaaggtggagccagggagatttggttccggggtccagcctcggtgcatgcgaggtcactgctgagcgctgtgcacctctgctgctatgtcttgtggctgaacttttggttttatgcactgacaggccaagttcgtgcactgacaggcccttctcatgaaatccatccagacagctttgcttctgatcctaggaccctgcttgattaaattcccttcacagacagatttttgtcttttaggaggaaatccaaataaatacgcgttttcagtgctcgttacaaactctgtg

SEQ ID NO: 130819 - DNA, 601 bp, Human
tatccggttttaaattcctctagagagaaattgaaaacaaaaagaaagaaaaaaaaagtcttttatacttcccagaaaaaaataccaaggctaatcttgtgctcacagaaatgtcatacattgcagtaaaatgttgataaacatgtacgattaggcccacacacttcctttctggttttgtatttttccattgcagaaacattcctaacatgggctgtgcctgttgcttggctccgaatgtgtcctttttgagactttagctgagctttagtggcaagtggcctggagggagccctggacycctcagttaatggaaggtggctctgggtggcagggtcacccagactgaaacgtctggctctcatcctccctccttcgcaccccattccaccagggctggcaccaaccattcttcagatccatacgatttcacttcagacatggattctcatgtcattcatgctcagcgttatgaaaagatattttctgcttgagatcatcaggtttccaactgtacattctttcaaatccttacaaataaagatgcagaaaaatggacaacagcagaaatgacagcactgtgttggcatgtcacaggtgc

SEQ ID NO: 130820 - DNA, 601 bp, Human
attgtgaacagcaaacatgagtgtaacagagatagcacttcgatgctgagaggaacagggtaagaaatatggacaccttgacagacttgctcaagaactttaagatggaaatatccggttttaaattcctctagagagaaattgaaaacaaaaagaaagaaaaaaaaagtcttttatacttcccagaaaaaaataccaaggctaatcttgtgctcacagaaatgtcatacattgcagtaaaatgttgataaacatgtacgattaggcccacacacttcctttctggttttgtatttttccrttgcagaaacattcctaacatgggctgtgcctgttgcttggctccgaatgtgtcctttttgagactttagctgagctttagtggcaagtggcctggagggagccctggactcctcagttaatggaaggtggctctgggtggcagggtcacccagactgaaacgtctggctctcatcctccctccttcgcaccccattccaccagggctggcaccaaccattcttcagatccatacgatttcacttcagacatggattctcatgtcattcatgctcagcgttatgaaaagatattttctgc

SEQ ID NO: 130821 - DNA, 601 bp, Human
cctgtgaagacctagtgccaagtgacccttttcttttcttctatctatctgttctgtctgtctatctatcatctatctgtttagagacaggggtcttgctatattgcccaggctggtctcaaactcttggccttaagtgatcctcctgcctcagcctcccaaagtgctggaattacaggcatgagccaccacgcccggctcaagtgactctttccaaacagaaaagctccaaaccgatttttagtttcagttattagcaccatgccggtagcttaattttgctatttcattagtactccaytgtgaacagcaaacatgagtgtaacagagatagcacttcgatgctgagaggaacagggtaagaaatatggacaccttgacagacttgctcaagaactttaagatggaaatatccggttttaaattcctctagagagaaattgaaaacaaaaagaaagaaaaaaaaagtcttttatacttcccagaaaaaaataccaaggctaatcttgtgctcacagaaatgtcatacattgcagtaaaatgttgataaacatgtacgattaggcccacacacttcctttctggttttgtatttttccat

SEQ ID NO: 130822 - DNA, 601 bp, Human
gagcctgtgcttcctatcacactctgaatctttacctgtgaagacctagtgccaagtgacccttttcttttcttctatctatctgttctgtctgtctatctatcatctatctgtttagagacaggggtcttgctatattgcccaggctggtctcaaactcttggccttaagtgatcctcctgcctcagcctcccaaagtgctggaattacaggcatgagccaccacgcccggctcaagtgactctttccaaacagaaaagctccaaaccgatttttagtttcagttattagcaccatgccrgtagcttaattttgctatttcattagtactccattgtgaacagcaaacatgagtgtaacagagatagcacttcgatgctgagaggaacagggtaagaaatatggacaccttgacagacttgctcaagaactttaagatggaaatatccggttttaaattcctctagagagaaattgaaaacaaaaagaaagaaaaaaaaagtcttttatacttcccagaaaaaaataccaaggctaatcttgtgctcacagaaatgtcatacattgcagtaaaatgttgataaacatgtacgattaggcc

SEQ ID NO: 130823 - DNA, 601 bp, Human
tacatttccttatgaagacagtcctatcaatgagaatatctgccaccttaaagctccacgttggtaactctaccactctacttttgtaggtgctttttcattttaaatctaaaattctttttcttaattcttcatacctattttgagccatacaataactctatgaaataaagttttattcttatagatgagcagattcaatgtaacgacaccaaaaagtgttttctccaacattcccactgcccttccacctgaaatgatccgacaaaactaaactgtgctcctgttttttacctggcaygtcagcccctttgcagattgaccccaactcgctttccaacctgaccctctgctctggtcccctcttcctcatctccatgcctttgaccatactctgtccctggcctttgaatgccctttcccttctccccaaaaggccaaatcccacttggctgcaagtcccagctgaaatctcatctgttctgcaaagcttccttggccagggcaatgctggcttcagggaagccatgtgccacgccggcgacctagtttgtatgtctccttccaaatcctatttggaaactcgtaggtaactaattat

SEQ ID NO: 130824 - DNA, 601 bp, Human
ggtgggtcctcagtgggaacagaactggcccacctccctgctgcagtacagggtggtgggcttcctgggccagaaatgcctgaatgcctgctgcatgcaagcaggatgggagagcatgaggtcccacagtccacatctcttgtatcactgtgggtcaagcgcccgcccctctgggatcccaggagcacgtgattaaattgcttggttatttcaccctaggggttcaattcaagggcccaaatgccagattgactaaacttaaatcctggctctgccctatgccacgtacatcaccattggsaagtaattgaacctctcttgccagatttctgacctgtacagcaggaataatggacccactactggctgtaacaagcatgtataacagttgctggtatgtattacaattgctcaatggatgttagtataagtcattatttagaccacagctaataatgagaagagttgcctcaatgtgtcacttgctgaacctacatttccttatgaagacagtcctatcaatgagaatatctgccaccttaaagctccacgttggtaactctaccactctacttttgtaggtgctttttcattttaaatc

SEQ ID NO: 130825 - DNA, 601 bp, Human
gctccggtcattaagtccccagatggaggaaagagcacatcagcatgcctgcacagacatggaaaagctggctaagacatgcacatgggtccaaggcactgcagaattccatttttcctacagttaatatttatggcacaaaaatgcaatagctacagtttaagactgattcattgacacgtgacacttgaaactgtccctctaaatgtggatattatccacatgttactggactaagcatccatgcaagacttggagaccttctgcaggcgcagcctgtccccccacaccctgctctatyggatcccacctcgcaaggtgaaggccgcattctctcaggacaacctggtctgctatatcccctgggaaccatttcgccttggctcctgccagatgctgccctttcccttcaggctggtgtagagtggacacctgaaagtgctccccatcccattcgggttggggcatgcagagatccaggttttgtcctaagaaacaaaagacagagtgccttccacaaagtgcctttgcctgcccagggctgcgttatctcggcatcattccctggggccatctgcactcagctccgcaacgtttctct

SEQ ID NO: 130826 - DNA, 601 bp, Human
agtatttcagatttgcaagaagcaaaagctctggggattggttgcacagccatctgaatgcacttactactgaacagtactcttaacagtggttaagaaggtaagtgtgatgttctgtgtattttaccataattaaaagaataaaaaagtaagttttggccaggcgaggtggctcacgcctgtaatcccagcactttgggaggccgaggcgggcggatcacctgaggtcatgagttcgagaccagcctggccaacatggttaaaccccatctctactaaaaatacaaaaattagccaggcrtggtggtgcatgcctgtaatcccagctactcaggaggctgaggcaggagaatcttgaacccgggaggtggagggtggaggttgcagtgagccaagatcgcaccattgcactccagcctgggcaacaagagtgaaactgtctccaaaagaaaaaaaagtaagttttgattgttatgtagcaggtaaaaaacaccgtttcagaagttacctctgtccccctgtgcaggcgagccacctcatagaggactgctcgtttggggaaaagctgcagaatgttttccatgacccaagagtcactgtc

SEQ ID NO: 130827 - DNA, 601 bp, Human
cgatgatcttgagcagtaagatatacataactcccacatgcttagcattccactaatggaatactaggcgtaaatgggcttgatgggggtagtatttcagatttgcaagaagcaaaagctctggggattggttgcacagccatctgaatgcacttactactgaacagtactcttaacagtggttaagaaggtaagtgtgatgttctgtgtattttaccataattaaaagaataaaaaagtaagttttggccaggcgaggtggctcacgcctgtaatcccagcactttgggaggccgaggcrggcggatcacctgaggtcatgagttcgagaccagcctggccaacatggttaaaccccatctctactaaaaatacaaaaattagccaggcatggtggtgcatgcctgtaatcccagctactcaggaggctgaggcaggagaatcttgaacccgggaggtggagggtggaggttgcagtgagccaagatcgcaccattgcactccagcctgggcaacaagagtgaaactgtctccaaaagaaaaaaaagtaagttttgattgttatgtagcaggtaaaaaacaccgtttcagaagttacctc

SEQ ID NO: 130828 - DNA, 601 bp, Human
agagggctaacctgtcttttgtatttttagcttaaagtattttcagaaatctgaggggaacatcacctgtgctttattggttattttgacaagtgaaatagaggacaaactgctttgatttgagttgatgtctacacatgtgaactcatgagaaacagcaaagcccacaatccacatggacatcatcatcgttcgggaacaggcatggtctccattctttccatgcacacgccccggcttcaaaaagacatctgaaacactagtgatgaccatcattaccccatctgtgagctccaggcayggcacagccctgcaaggtaaatgttattactgaaggtcagagaagttccgtaacttgcccagtcacatacctggcacggagctaagccaagcttcgagctcaagtcctcctgatgcgaaagttatttccactgaaccagcccaggcaaaatcctggtcgggtctgtgttactctttgctttcaaaacagatagccttgaggagatgtgtgtgtgtgttcatttaaaaaaatccagaaacgaccaaactctggcaactttctagaacatattttgtacctaaatgaatgtggctcagtatt

SEQ ID NO: 130829 - DNA, 601 bp, Human
agggctgttcacgcgatggccctgaagaagagcctgcccacgatgtctctgttactgaaaccgaagtcgaagctggagttatgctgaatgtaggatgtgaagacatggatcttggccttgattagaaagtcctaaaacaccagctaactcggaaccaaaactagaacaaacagttctcttttgctgaagtatgtgtgtgtgtgtgtgtgtgtgtgcgcgtgcgtgtgcacatgtgtgcatgtatgtgtgttttcccggaacctggaaccaaactagttatttgatttagtgatctctttgygcattttgttttagttcaaggaattttaaaaatgtgaacgctgagacactttgaagacagtcatgactatggcctttgtgaggggtgacctcttgtgctatccctgttggaagtttgcttcctagaacatctgggaataggattattgctgacgcaagacgataaagaatgaaggagaggtcaggagttcaagacaagcctggccaacatggcgaaaccctatctccactaaaaatacaaacattagccgggcgtggtggtgcatgcctttagtcccagctacttgggaagctgaggcag

SEQ ID NO: 130830 - DNA, 601 bp, Human
tgaccccaaatcatcatccatttatacatgaggcagaaacagagtattaggctctgcacggtttcctgggcaggcttccagttggtaggtatcctgaacagggcacaggagggctgttcacgcgatggccctgaagaagagcctgcccacgatgtctctgttactgaaaccgaagtcgaagctggagttatgctgaatgtaggatgtgaagacatggatcttggccttgattagaaagtcctaaaacaccagctaactcggaaccaaaactagaacaaacagttctcttttgctgaagtatgtgtgtgtgtgtgtgtgtgtgtgcgcgtgcgtgtgcacatgtgtgcatgtatgtgtgttttcccggaacctggaaccaaactagttatttgatttagtgatctctttgcgcattttgttttagttcaaggaattttaaaaatgtgaacgctgagacactttgaagacagtcatgactatggcctttgtgaggggtgacctcttgtgctatccctgttggaagtttgcttcctagaacatctgggaataggattattgctgacgcaagacgataaagaatgaaggagaggtcaggagttca

SEQ ID NO: 130831 - DNA, 601 bp, Human
gggagacggtcaggagagactgtgtgtgtgggtgctacctctgtgggtggccgtgagctgggggaggaagggaatttcaggcagagaaagagcacagacacagaagatctggggacggggggcatgtcagattggagggaccacaggccaggggcgaggtgggagggccccccggcctggctggactggaagatatggctgcctttttgccttttatgtctgtgtagagattccattgatcctgaaggcagtggacagctgcttttcaacaggagagtgaagtgctcagactgggggacgrgtaaggatgtgggagtggaggggcgtgagggtgggagaagtgagacaaaaactgagcacacatgggagaggccctgagaagacagacgtgtgcttttgagtaaaagatgagggagagaaaggagccccgcagaaaactcgactccacacttggcttcatcttgcctgaggaataagagaaccctccatatttgccttttaaaaatgacatacggcatttttaaagtgccaacacaaaattaaaataacaatctctttatgcccagctttatcttagaaaggatatgtttctattgctgtc

SEQ ID NO: 130832 - DNA, 601 bp, Human
ccccacatacacacacaaaaaaaccatgagggacacagtcccatcaacacacaaggcacctttattgccatcctcggcacctggcccagttgcggctgtgccctttttgactgtccgtctagaacaccaactctacaagggcagaggaccaggtgcacctcggctcacaccctacgaatgctcagctcgagcccagtgcctggcacgcaagggcaccatgcacacttggtgaaataactgaatgagtacaaattcagcaggtagaagggaagaaaagagaaactatctatggtggtgggaragtgggggctgatgcaggagatgtatttttaagggggatacccaccattttcttactctaacaatttgactgcataacactgccccacgtgcacagcaaaaagatcccgttactgcccatgatagaacctgtatgtccctgcttcgtaagtactctaaatactcctctgcagttcaaggtcaaactggaaagtcaacacgagtgtctggaaccaagtcaatgtgaacagggggtcagaggaacgtgcacaaggcttgaagctagactggctcacgcatgagaaaggagtgcctcctgacc

SEQ ID NO: 130833 - DNA, 601 bp, Human
tttttttttgagacggagtctcactctgtcacccaggctggagtgcagtggcgtgatctcagctcactgcaagctccatctcctgggttcaggccattctcctgcctcagcctcccgagtagctgggactacagacgcccgccactatgcccggctaattttttgtatttttagtagagacagcgttttaccatgttagcctggctggtctcaaactcctgacctcgtgatccgccctccttagccttgcaaagtgctgggattacaggggtgagccaccacacctggcatcctacatatmtttctaaactatttcccatatgtcagtctcttcagtatttctttattatcaaaaacaaagcaaaccaacatgatgaaaccccatctctactaaaaatacaaaaattagccaggtgtggtggtgcacgcctgtagtctcagctacttaggaggctaaggcagaagaatctcttgaacctgggaggcagaggttgcagtgagtcaagattgcaccactgaaccacattggccaggccgatttcaaactcctgacctcaagtgatccacccacctcagcctcccaaagtactggaattacagg

SEQ ID NO: 130834 - DNA, 601 bp, Human
gagaattatcacgattgttatttaggatcattttctcagcttcctgtacttccaagaccagacatttgagattatataaaataagcagggtgtgtgttggggggcaatgtgtgagagggaatttgggatggtgacacgcagcgatcttttaattcaaaactaagctgtacaatctatggaattcaattgtggggtgatgaatcctaaaacaaacattacatgaagcaattgaaattcaagtaaaaatagtggaaggactttgaattcacaaagattttcttcaacctccatgcatactttygtcacttgctctttggatctctgacattcattctgatcaagcagcccagaagccaaaggattttgccaatgaatatggggcaattatgactctcatggcattcttgtcgagttctgaaataagtctgatcagatcaacaccagttcgagggcaactctacgtgcagggaatgcacagggcacctggagcctcagggacatggcgcgtgcacctcaggcatggcgacagcagtggccgcaagcctgcatggtcatatgcagcaataccggcaggtggcaggagcgttccttctcctaactg

SEQ ID NO: 130835 - DNA, 601 bp, Human
aaagatgacagaggaagagcaactcagatgaacttccgttaggtcttgatgagaagaacaaaccaaaataaaaataaaaaggggagagaacagggaagagggttcctaaaataaaagcaggaatgagagctcaatctaagaataaagaaaaaaacaggagtttgtgaccagtctggccaacaaagtgagacaccgtctctactacaaaaaaaaaaaaaaaaaattaggtgggtttggtggtggcacctgcctgtaatcccagctgctcaggaggctgaggcaggagaatcacttgaacccrgaaagcagaggttgcagtgagttgagatcatgccactgtactacagcccaggtggcagagtgaaactgtctcaaaaaaagaaaaaaacagaagcataaaaggagaggaaataaagagaaataaaatttaaaataacagtaaagaacaaatggggccaggcatggtggctcacgcctgtaatcccagcactttgggaggtggaggcaggtcgatcacctgaggtcaggagttccgagatcagcctggccaacatgttgaaaccccgtctgtactaaaaatacaaaaaaaaccggctgggca

SEQ ID NO: 130836 - DNA, 601 bp, Human
acacgaagcactccttgtgccagggctgctcccggtaagtgacccctcccgtggtgatgggctgcagggacgagggggagagttagtgtggcctctgtgcttggcagacatcttcagtctcagctactgccactggacgatgcaagatcctcatccagaaacgtccagtttgttaagtcaccaagaagctgctttacaaacttcacagtcactcgtcaccctcaccacacgctttcattccagtgtcataggccctggctttcccgttagtgaaactggagcttggggttgccctcagccyttcccagggatgctggggatctaaggcatagggtgcctcagtggtgttgccacctttctgagcagggaagcagcacagtggaggggtcgggattcaatacagcatcaaggagacctgggtttgaatcctaaccctactccttaccagccctgtggctgggagcaggtcatgataaagatctctgcacttcagttttctcatccaggaagtgagggtgatgaggttaattgggcaagttgatgaggagtccttacttagaagcctggcagggctggtggctcacacctgtaatctcaggac

SEQ ID NO: 130837 - DNA, 601 bp, Human
ttattgtgcttttgtgatgtcacaggctcacagactgcagttttagcgataatccaacccaaagcagaaactaaactggagcactggccatatggttgtgatcaggtgggctgcagaggaaggaatcattacttgctgaagcatagccagtgcaccaaggagaggaaagcagataggcagaaaagtctgctgtgttcagagccttagggaggtctggggagttgagggatatagacagggtcacaggctaaaatgctaggccttgttcaagcttccaatcgcccctggaaatgggaacccmgggacactcaccgctgatggggttggtgcacccagcacacttcttggcatacaagtcacagaagcagttcaggcagtaggcaaagtcatcgcgagctgtgaagcgctgcccagacagctgcttcctgcaggcggtgcacacgaagcactccttgtgccagggctgctcccggtaagtgacccctcccgtggtgatgggctgcagggacgagggggagagttagtgtggcctctgtgcttggcagacatcttcagtctcagctactgccactggacgatgcaagatcctcatccagaaacg

SEQ ID NO: 130838 - DNA, 601 bp, Human
gcctggtctgccagccagccagattttgggctctcacttagctgaattctttgggggaatacaatatgaaaaactccttagaatgtaccctctgccctcatatagctatggccttgtggtagaagtttcccattaagatgttttggagtacaaccgtcccactaagatgctaggggacacttctaagaacacagcacagctgctaagcctgaaaaggccagtttttattgtgcttttgtgatgtcacaggctcacagactgcagttttagcgataatccaacccaaagcagaaactaaacyggagcactggccatatggttgtgatcaggtgggctgcagaggaaggaatcattacttgctgaagcatagccagtgcaccaaggagaggaaagcagataggcagaaaagtctgctgtgttcagagccttagggaggtctggggagttgagggatatagacagggtcacaggctaaaatgctaggccttgttcaagcttccaatcgcccctggaaatgggaaccccgggacactcaccgctgatggggttggtgcacccagcacacttcttggcatacaagtcacagaagcagttcaggcag

SEQ ID NO: 130839 - DNA, 601 bp, Human
taatacagttggtttttacctagtgttttttctcagtgccacaataaccacaattcacattcatatctaatgttttacatttaaaagtgcttttatatagattgtatcactttataaagcttaatgttataaacatttacctcaacagaagttactgctgaaaacagcattaaagatgaatatgttctggcaaaagattacattttccccctaaaagattccaagggaaatctggtatataaatgaccagaaacagatattttaacataggtaaagtgtaaatactgtgcttttcttcatrttttaatttcacatggaaatgtaatgagctctgcattacacatgagagtactgttttagcgacctgggaaggtgagttagctgagttaggtgaacttggttctaggcctaagggaaaggaaagtcaaggacaagtacacagggggtgtatagatgtgtttctgtagttacactgaaaagccacacaggaaagccaggccaccgggtactccaagtgtctgccaccttcctctgataggaacgaaccagtcaactgaatgcaacgggattgcaaatcccacatcataaaacttctcctgtg

SEQ ID NO: 130840 - DNA, 601 bp, Human
gatattgtcgcagtgggaagatcctgagaaagctgcagacagatagaatggaatcaaatatttaaggtacattggtccgtgattataatacagttggtttttacctagtgttttttctcagtgccacaataaccacaattcacattcatatctaatgttttacatttaaaagtgcttttatatagattgtatcactttataaagcttaatgttataaacatttacctcaacagaagttactgctgaaaacagcattaaagatgaatatgttctggcaaaagattacattttccccctaaawgattccaagggaaatctggtatataaatgaccagaaacagatattttaacataggtaaagtgtaaatactgtgcttttcttcatgttttaatttcacatggaaatgtaatgagctctgcattacacatgagagtactgttttagcgacctgggaaggtgagttagctgagttaggtgaacttggttctaggcctaagggaaaggaaagtcaaggacaagtacacagggggtgtatagatgtgtttctgtagttacactgaaaagccacacaggaaagccaggccaccgggtactccaagt

SEQ ID NO: 130841 - DNA, 601 bp, Human
catcattcaaaaggatttttacatttgggtgtgccttactcgattacaaaaatttcaaaccatcttcccacctagggcctagggcgagttttctctttccctgggactgaactatcacaaagcactaaagggtttaagcaaacgtgagtatcactgaaaagcactagaagaaagtctcaatgtggctggaagaaaccagaaggcaagattgcctgggtgagaaagaaaacataaaaatctgtgtgtgagatcacaagcagcaacttctctgtgttgaattcagatgtctttcccacagtcrgggcacaggatgtcgtccctctctgtgaggaagccacgccccaccagtgagagggagcacttcttacagttaaagcagtcgttatgccactgccgttcctcaaaggagatgtattttgtgccaccaagtcctgttaacagagagaaaataataccggatgaagaaagttagaatcaggcaactgggactgaagaaggaattctggtttgatccatttcaaagtttggattgtgtaatatggataatgtgaatttctagtgactgggtgttgggaatccatatgtaaatcagattctatgc

SEQ ID NO: 130842 - DNA, 601 bp, Human; identical to SEQ ID NO: 28807

SEQ ID NO: 130843 - DNA, 601 bp, Human; identical to SEQ ID NO: 28808

SEQ ID NO: 130844 - DNA, 601 bp, Human; identical to SEQ ID NO: 28809

SEQ ID NO: 130845 - DNA, 601 bp, Human; identical to SEQ ID NO: 28810

SEQ ID NO: 130846 - DNA, 601 bp, Human; identical to SEQ ID NO: 28811

SEQ ID NO: 130847 - DNA, 601 bp, Human; identical to SEQ ID NO: 28812

SEQ ID NO: 130848 - DNA, 601 bp, Human; identical to SEQ ID NO: 28813

SEQ ID NO: 130849 - DNA, 601 bp, Human; identical to SEQ ID NO: 28814

SEQ ID NO: 130850 - DNA, 601 bp, Human; identical to SEQ ID NO: 28815

SEQ ID NO: 130851 - DNA, 601 bp, Human; identical to SEQ ID NO: 28816

SEQ ID NO: 130852 - DNA, 601 bp, Human; identical to SEQ ID NO: 28817

SEQ ID NO: 130853 - DNA, 601 bp, Human; identical to SEQ ID NO: 28818

SEQ ID NO: 130854 - DNA, 601 bp, Human
attacaggcgtgagccactgcaccaggactgtggctttttaaatatactgcacttcccggagaagcatccacaaaaaaacacgaggccagatcagaaccaggctgtgcattcaccaccttcattgaaatatttacctttacgggattcttttacttccttgctcagtacccagccctgggggcatcactcctgagccttgacactcagctgcttactacccaagatccacttgtctgtggcactgctccagaaacgaatcctactggacatgcctttagcctggctgactgccggatgcaraacattacatgataatatggattgttgataatcatctccctaatcaagtctaattgctgctctagaacaaaacccagaaaagatggatggactggcgaataagtggttatagtgccatctagtggcaaagtgacaacatacaccctgaatttattatctcccccccactaattccttagtgagaatccagcgaaaagatttccctgcattatttaaaccgtattattagcaatctcctcatgagattcctgaggctttaggtatgaacagggcagataaatcatcaatttgctcatttac

SEQ ID NO: 130855 - DNA, 601 bp, Human
gctcagtacccagccctgggggcatcactcctgagccttgacactcagctgcttactacccaagatccacttgtctgtggcactgctccagaaacgaatcctactggacatgcctttagcctggctgactgccggatgcaaaacattacatgataatatggattgttgataatcatctccctaatcaagtctaattgctgctctagaacaaaacccagaaaagatggatggactggcgaataagtggttatagtgccatctagtggcaaagtgacaacatacaccctgaatttattatctmccccccactaattccttagtgagaatccagcgaaaagatttccctgcattatttaaaccgtattattagcaatctcctcatgagattcctgaggctttaggtatgaacagggcagataaatcatcaatttgctcatttactttttaaaaagatttttaaattgaaatattatttgcatatgatgaaattaactttttaaaagtgtacaattcaggggttttagtgtattcactaaattgtgcaaccatcatcactaattctagaacatttttgccacattaaaaagaaactctttaccca

SEQ ID NO: 130856 - DNA, 601 bp, Human
cagccctgggggcatcactcctgagccttgacactcagctgcttactacccaagatccacttgtctgtggcactgctccagaaacgaatcctactggacatgcctttagcctggctgactgccggatgcaaaacattacatgataatatggattgttgataatcatctccctaatcaagtctaattgctgctctagaacaaaacccagaaaagatggatggactggcgaataagtggttatagtgccatctagtggcaaagtgacaacatacaccctgaatttattatctcccccccactmattccttagtgagaatccagcgaaaagatttccctgcattatttaaaccgtattattagcaatctcctcatgagattcctgaggctttaggtatgaacagggcagataaatcatcaatttgctcatttactttttaaaaagatttttaaattgaaatattatttgcatatgatgaaattaactttttaaaagtgtacaattcaggggttttagtgtattcactaaattgtgcaaccatcatcactaattctagaacatttttgccacattaaaaagaaactctttacccattagaatcat

SEQ ID NO: 130857 - DNA, 601 bp, Human; identical to SEQ ID NO: 28819

SEQ ID NO: 130858 - DNA, 601 bp, Human; identical to SEQ ID NO: 28820

SEQ ID NO: 130859 - DNA, 601 bp, Human
gtcaagctaggagagggaagaagtgtctcctctccttatatggaagtttctgtatgttcaaaggtggcatagagagagatgtacattccatgatactccttggtcagccaagcagccattcaggaaaactttggaattcccagcaactttgtcaatgggaaatgctgtgggatggccacgggaaagagggaggtgttgtcttccagcagtcattgactactttcgatgcagaactttaagaaacccgcttgctatcagcttccagtcagaacagcacttgtaaagggttgatccttaaacwtcgctaaatgaacacatctctgtcttgtggttccaggaattttaatccttgaagctagatggtatgagaacagctttttttctgaagccaggcttgaatggtaggggaaggaatgtggactttggggttaggcagacatagttttgatattttagctgggtggctttgaccttcaacctgtctgaagttatcatttctcttagaatgttattgatagtagagagtgtctggcttagggtggatgctcagaaatagctctctctctctttcctccccctttctttctgtcctcttctctca

SEQ ID NO: 130860 - DNA, 601 bp, Human
tgatctcaactccaggtatcagctcttttccaccttgcacctccctctccccaacatcagtgtatgccagtgctctgctttccaaccctggagtccaccaggaaattctcatgtttggtagtgaagggactgcaggttctgagggcttgcaagcatctgtggctgctgctattgttccagcaggtggcagcttctcctgctaatgtttaaactatgtgtcccacagggcccgttgaaatcccaaatagcataaaaaataaacatttatttggacaatattaacgatatatttaaatcactatgaaaatctctattatgccgtgtccttagacacctttgaattccttaatgttatattttaaacaacttaacaaacccctctatccatggggtgcatagcttgtgctaggatataagttattctgtaagtacaaggatttcctttatagagttccattttccaacttgacttttagagaaaaggctgctttcattgtgaatattaagtaaaaatataagggccagggacaaaatatgagtaaagacctaagacaattcttggcctattataagccctcaacgaacactagctgctatcatc

SEQ ID NO: 130861 - DNA, 601 bp, Human
ctgaggttggggcccaaggatggagaaggcagggcatgggctgtggcaggtactatgcattgctcatttggggactggagttgaggggtgatcgggaatgcagcctggccatactccagcatccttggcctggaagaaggtcagttcatgtcccgggatacaactgcttagccctgggactgtgaccagggctgggcgacaggcaggtccctggacaggaggcctctgtgtggctgtgccattgtcataggtagctttggacaccgttcccagctccctaggaggcagccatatcaggccygcactcttgtcgctggaaggggactaagttagcagaggacagcccaggggccctgctggctggggccatgcaactcaccactgagctctctcctttccttctctacagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctca

SEQ ID NO: 130862 - DNA, 601 bp, Human
actagctagctgccctcccagtatcttaccaagtcttgctaaggttgaaatagtacaggaatctgaataattgcgagcgcttccacaacttacacacagcacccggcggtgcaagcctgggtgacacagttcaatttttaaaacgtcttcatataggggaaacgccagacaattaaagctactaagtagaaaatactggaggaaacaatcgcggttgttcggggacttagtttcctccctcacattaggaataatgaacacatatcctatctacgctcaaaatatcatctggcggcaagtrttaagaaccaatcccgcgccctgcacttgcgttacaaccattaatgagccgctcttccgggccctcaaacagccagcggcgaaacagccaagcaaggcctaacagggccccacgaggacgcaccaggaagtaatgaagtcacccgtgcctgtcaagaggcacggcgctaacagaaggctcccaggagcttaaccggatgctcatctggcaacaacggcaagaatcaggcccggcgttccctgcgcagcccggtcggagcccagacaaccggcccgcgggccaagctccggccttcggtgc

SEQ ID NO: 130863 - DNA, 601 bp, Human
attagttgcagttaaaaaaaaaaaaaagcagagacgctcagtcaaaagtataattgttacctttatatatccttttactatgacccctttgataattgttttagaagccaaaatgtatacaaagcaacatgtttttatttagaaacttaaccatgaaaataaaaatacatgatttctgaacagatacaagtaagactagactaatgccaggttaatctctggatctctataggaaaagtgaagttcatttctcattttaagaaaaaacatgtattgaatgtggcttccattatggaaaaamtattttttcaaaatataaataaaaaagaaaaagaaaaagaaaaagaaacatgtaggtttaaccagtagcacgtgctacaacttcttcaggaaacactgcaacatttactctaggggaaaaaattactttcccctacagacacgtaccatattctgttgttgttcactaacaatgttttcagtcttctcaacaaaggaaaaccatccagtttcctgatctcattgtcagaaaaatcaatagcatcaaactggtctaacgtagcacctagattttcaatgacgggaattttataccctataa

SEQ ID NO: 130864 - DNA, 601 bp, Human
aacctatgagaaatatttctatctgaaggaaatcccactcaccacccagtacctttaaagacattatctatacaccaagtgctttttttccaataaagtttacacagagctgatgaaggcagggtcaaaaaagatctcaatttcaataagtaacagtctagaaattagttgcagttaaaaaaaaaaaaaagcagagacgctcagtcaaaagtataattgttacctttatatatccttttactatgacccctttgataattgttttagaagccaaaatgtatacaaagcaacatgtttttawttagaaacttaaccatgaaaataaaaatacatgatttctgaacagatacaagtaagactagactaatgccaggttaatctctggatctctataggaaaagtgaagttcatttctcattttaagaaaaaacatgtattgaatgtggcttccattatggaaaaaatattttttcaaaatataaataaaaaagaaaaagaaaaagaaaaagaaacatgtaggtttaaccagtagcacgtgctacaacttcttcaggaaacactgcaacatttactctaggggaaaaaattactttcccctaca

SEQ ID NO: 130865 - DNA, 601 bp, Human
acccttttctgaggccacagggtcagcaacagaagtgggattttagacactgcctggggctaattccactgtcataccatctagtggaacctgagaaaaggtgcaactcctgggtggcacaaactacttaactcacttcatgattttttgtgcaggcagcacagaaatacaaataattctggattcccagctcaggtacaagacacaacaactatactataggggaatggttaacctatgagaaatatttctatctgaaggaaatcccactcaccacccagtacctttaaagacattatcyatacaccaagtgctttttttccaataaagtttacacagagctgatgaaggcagggtcaaaaaagatctcaatttcaataagtaacagtctagaaattagttgcagttaaaaaaaaaaaaaagcagagacgctcagtcaaaagtataattgttacctttatatatccttttactatgacccctttgataattgttttagaagccaaaatgtatacaaagcaacatgtttttatttagaaacttaaccatgaaaataaaaatacatgatttctgaacagatacaagtaagactagactaatg

SEQ ID NO: 130866 - DNA, 601 bp, Human
gattttgtaaattttctgtaggaagcacatagtacctttaaccccacccaccaaatacattttccttctgtgcaacttaccagttccacgagactattattggtgagaatgagttctgtcagacagggcagagcctgatcaagtccctcacctatacggctaaaataaaaatagagtcttagtaaaagtgaaaattaaataagctaacaattttatctacctccttgctcagaggatcacagagagacacttagagatccttcttccaacaccctgataaagaggaaacaaagcaaaaagracccttttctgaggccacagggtcagcaacagaagtgggattttagacactgcctggggctaattccactgtcataccatctagtggaacctgagaaaaggtgcaactcctgggtggcacaaactacttaactcacttcatgattttttgtgcaggcagcacagaaatacaaataattctggattcccagctcaggtacaagacacaacaactatactataggggaatggttaacctatgagaaatatttctatctgaaggaaatcccactcaccacccagtacctttaaagacattatc

SEQ ID NO: 130867 - DNA, 601 bp, Human
aatccagtgtgtattttatagttctagcacatctcaattataagtagccacctgtagttactggtactatattgaacactgcaattgtagaaaacaacataggagtttataaccctggaataggggaaatttaaacatcaaaagggctacaataaagaagaagattgattcattggactgcacctaaattaggaacttctctaacaagacatcctaagtcaaaagtcaagtaaaagtaggaaaatatttgcaacatacggctgcagaacccaaaaggcccagatcctgaattaagaaaaakacaagaaagaggatactgagatcattttctagattttgtaaattttctgtaggaagcacatagtacctttaaccccacccaccaaatacattttccttctgtgcaacttaccagttccacgagactattattggtgagaatgagttctgtcagacagggcagagcctgatcaagtccctcacctatacggctaaaataaaaatagagtcttagtaaaagtgaaaattaaataagctaacaattttatctacctccttgctcagaggatcacagagagacacttagagatccttcttccaa

SEQ ID NO: 130868 - DNA, 601 bp, Human
gcaaagagctttaaatacaactctaatttctctaacagcacctatcatgagacacattgcctataaatatgtatttcgggttgaatacttcacacacttcagaaaggacatggccatggaccagtgctgtcttatgtttgtagtcaagcatctccttgagaatctgaaggatgctatggaccttgtccacaaggaaaggaacacagttcattctcaacaatcaggaaaatacgggaggaaggttaagtcacaaaattaagttatacgatttttttttttttttgagatgaggtcttgcacyattgcccagactggagtacagagacatgatcatgtctcactgcagcctcgactgatggctagggctcaagtgatcctcccactttagccactggaatacctgggaccacagatgcacgctaccacttttggcattttttttttttttttttttgagacggagtctctttctttgcccaggctggagtgcagtggcatgatctcagctcattgcaacctctgcctcctgggttcaagcaatcctcctgtctcagcctcccaagaagctgggattacaggaacccaccaccacgcccggcta

SEQ ID NO: 130869 - DNA, 601 bp, Human
gaccaacatggtgaaacttcgtctctactaaaaaaaaaaaaaatacaaaaattagccagatgtgatggcgcccacctgtaatcccagctactcgggaggctgaggcagcaggagaatcacttgaacccaggaggcagaggttgcagtgagccgagatctcgccactgcactccagccactccatctcaaaaaaaaaaaaaaaaaattcaaccatacagtttttaagagagaaatctaaactacaagaggtacagacaagctgaaagtaaattttggatggaaaacgatttatcatgcatayaactaaccaaaacaaagattgtttcgaggtaaaagaaacctcaaggtaaacagcattaatagagatcgagggtcacaacataataaaaagtttccgttcaccagaaagatatgaataatttaaaatttgtatgtatcaaataaggcaacttcaaaatatacaaaactaaaatcgacagaacttcagggatagtcaaatccactaccatgctgtgagattctaacatacctctctcaataactgataagcccagtagtcttcatctttgcaaagagctttaaatacaactctaatttctct

SEQ ID NO: 130870 - DNA, 601 bp, Human
aaaagaataaatatgtaacaacccgaaggctgctgaaatgttgaaggtcactgtactgtattgtttagcagggtaaaggtgtcaaagtttaaaattaaatgttgaaggtcatggtacagtgatcttaacatttaattttaaacttttataaatatgtgtgttttaattcctacgatgctaactcaagattgaaagagagtaatttctaaaccatcagaagaaaaaatggaatgacagaaggagagcatctacaataaaggagagaaaacggattgaagaacgggtgggacagacaggaagmcccagaacagagagaagacaaactggaacacaccagtaattacattaaatgtaaacagactaaatataaataattcacttaaaagagctttcagactggattgtaaaaaattccaaccagagctgggcgcggtgactcacgcctataatcccagcactttgggaggccaaggcgggtggatcacaaggtcaggagttcgagaccagcctgaccaacatggtgaaacttcgtctctactaaaaaaaaaaaaaatacaaaaattagccagatgtgatggcgcccacctgtaatcccagctac

SEQ ID NO: 130871 - DNA, 601 bp, Human
taaaacatagtgcaataaggatagcaaaaaaacaaaaacctatggttaccagctacaaccaagctagatggcaaggcattctgcagtaactctaaaataggaacaagtagagacaacccatgttgagagcaacaaggcttgcagggtgacggcctttgtacaggaagaagcagaggggaggcgaggagccgtcttacaaactggagaactccagtgactgagaaaagcaggcccaagaccagcatgttccaataatgactacaggggtctgtgataagggctgcaggggcaagagcaattkgggccctcactcttaatagaaatcatgtcccaacacggccctgccctgaagagaaactgctggaacaggcgcaaattgggtagatggtggggaaggggtgtgtgtgtgcaagaggcacaatgagaaaaaaaagtacagataaaaacagggagagcagagccagaaattctcaaaaagcaagctgccatcttcaaatatgtcacaaaaaccaccagagggagctctagagcttgatactgttttacccccactgaagatgatccaaaaaggaataaagaacaaagtggtaacatttgttac

SEQ ID NO: 130872 - DNA, 601 bp, Human
ttttgcatttttagtagagacggggtttcactgtattagccacgatggtctcgatctcctgacctcgtgatctgcctgcctcggcctcccaaagagctgggattacaggcgtgagccaccacgcccagtgggcagggtgaatttttaatcttctccaattgttccataaaacatagtgcaataaggatagcaaaaaaacaaaaacctatggttaccagctacaaccaagctagatggcaaggcattctgcagtaactctaaaataggaacaagtagagacaacccatgttgagagcaacamggcttgcagggtgacggcctttgtacaggaagaagcagaggggaggcgaggagccgtcttacaaactggagaactccagtgactgagaaaagcaggcccaagaccagcatgttccaataatgactacaggggtctgtgataagggctgcaggggcaagagcaatttgggccctcactcttaatagaaatcatgtcccaacacggccctgccctgaagagaaactgctggaacaggcgcaaattgggtagatggtggggaaggggtgtgtgtgtgcaagaggcacaatgagaaaaaaaagt

SEQ ID NO: 130873 - DNA, 601 bp, Human
cttcagcgtctaagaacaacaaaggtatactgtcttttgaaagaaggtacatttatcctagctgcccctgaaaatctctttaaataaaatttgcagggacaaggaatagtatagcttaaaaatgatcgaattaatggaaagaaggcagggtgattttttttttttttttttttgagacggagtctcgctctgttgcccaggctggagtacagtggcgtgatcttggctcactgcaagctccgcctcccgaattcatgccattctcctgcctcagcctcccaagtagctgggactacaggcrcccaccaccatgcccggctaattttttttgcatttttagtagagacggggtttcactgtattagccacgatggtctcgatctcctgacctcgtgatctgcctgcctcggcctcccaaagagctgggattacaggcgtgagccaccacgcccagtgggcagggtgaatttttaatcttctccaattgttccataaaacatagtgcaataaggatagcaaaaaaacaaaaacctatggttaccagctacaaccaagctagatggcaaggcattctgcagtaactctaaaataggaacaagta

SEQ ID NO: 130874 - DNA, 601 bp, Human
aagtgggctttcctgctagcgccagcttcagcgtctaagaacaacaaaggtatactgtcttttgaaagaaggtacatttatcctagctgcccctgaaaatctctttaaataaaatttgcagggacaaggaatagtatagcttaaaaatgatcgaattaatggaaagaaggcagggtgattttttttttttttttttttgagacggagtctcgctctgttgcccaggctggagtacagtggcgtgatcttggctcactgcaagctccgcctcccgaattcatgccattctcctgcctcagcytcccaagtagctgggactacaggcgcccaccaccatgcccggctaattttttttgcatttttagtagagacggggtttcactgtattagccacgatggtctcgatctcctgacctcgtgatctgcctgcctcggcctcccaaagagctgggattacaggcgtgagccaccacgcccagtgggcagggtgaatttttaatcttctccaattgttccataaaacatagtgcaataaggatagcaaaaaaacaaaaacctatggttaccagctacaaccaagctagatggcaaggcattctgc

SEQ ID NO: 130875 - DNA, 601 bp, Human
tctcaatagcaggagataagaaattgctttcctacaggaatctcaaagtggctgctgagccatgatttggaaaagaaaacaatggcaaagctgatgggactctggagcaacctattcacactgggaactgcaagccagaatcttggtgtaagtgggctttcctgctagcgccagcttcagcgtctaagaacaacaaaggtatactgtcttttgaaagaaggtacatttatcctagctgcccctgaaaatctctttaaataaaatttgcagggacaaggaatagtatagcttaaaaatgatygaattaatggaaagaaggcagggtgattttttttttttttttttttgagacggagtctcgctctgttgcccaggctggagtacagtggcgtgatcttggctcactgcaagctccgcctcccgaattcatgccattctcctgcctcagcctcccaagtagctgggactacaggcgcccaccaccatgcccggctaattttttttgcatttttagtagagacggggtttcactgtattagccacgatggtctcgatctcctgacctcgtgatctgcctgcctcggcctcccaaagagctggg

SEQ ID NO: 130876 - DNA, 601 bp, Human
atacatgtgccatgttggtgggctgcacccattaacttgtcatttacattaggtatatctcctaatgctttccctcccccctttccccaccccacaacaggccccggtgtgtgatgttccccttcctgtgtccaagtgttctcattgttcaattctcacctacgagtgagaacatggggtgtttggttttttgtccttgcgatagtttgctgagaatgatggtttccagcttcatccatgtccctacagaggacatgaactcatccttttttatggctgcatagtattccatggtgcataygtgccacattttttaattatctgattacattaaggtcaaggctggtaaaagtaatgttattttaaagggcttcattttgtcacaatatgtaattcccataccttaggtaagtcagcgatttgagagatgccagagggtccagatcaccctgtcaagcaatagccacaggtaagaacgcgaataccacacgctattttgagattctgaaatggagagtgcttttgaagcaagttgtcttttcattatttactgaatttttactctctagcaacaagcccaatactagcacatcacaaatgt

SEQ ID NO: 130877 - DNA, 601 bp, Human
aaagcaatttcaaattaagagaagacacagtggtcttctttctttggtagagctccctgaagaaagttcattctcctagctccaaggaggggatcccagggaactaagaaggcaattaaatgaataataaaataatgaattcctaataaagggaaaaatcatcctaacacacggagctgcacgaaagtaggttacattaagttctccgctgggaacgtatctaggcagacaatccactgttaagactgctcaccgtggcctcagcactttgcgaacttcggaatagccagcattacataaragagctccaacttaaaagttctatcataaactctgctattagaaaaaaatgtgatgtaacattttccctcccacttttattacaaactaatggtaaaatttactcatttagacaattttaataatcagtaacaaaaatataaagaaaaacacacaactctataatggctcacaagcaacagattactacttacttttagtttcactttctggaaatccagtactctgacttgcggaactttataaatcacatacaatctgtaatgcttcttattggttaccggatttcttaggatactac

SEQ ID NO: 130878 - DNA, 601 bp, Human
aagtgcgatctcggctcaccacaacctccacctcccgggttcaagcgattctcctgcctcagcctcccgagtagctgggattacaggcgcgcaccaccacccccggctaattttgtatttttagtagagatggggtttctccatgttggtcaggctggtctcgaactcctgacctcaggtgatccgcccgcctcaggctcccaaagtgctgggattacaggcgtgagccactggcacccaacccatcaaatactttatcttcaaagagcatttaaagagatttcatatattagatttgatktaaggaggcactactctggcattccagagtcatggcatctaaatggttgtgagttacactctgagtgtaacattaatttgaacatacaaagaacaccatttgttcacctgatctgcgttctctgccagggatctgaccagactgcagcaaccccttcagcctctccacttcagccagagttgaagcatttgctatggcattctggaggacagagggcaatggagatggatgattaacttcaaccaagtatcagctacccagaaaactaagtgtcaatcacctacagaaattcacagcaac

SEQ ID NO: 130879 - DNA, 601 bp, Human
ataaagcaggcattcagatgtcagaacagttaccacttatcaaaaactcgctaatgttgagccttgtgctgtgttcagtctctcagcctctcggcaaccttttgaggtttgctactattgttatctcagatttaaagatgaggaaagacttgaagaaacttgtccaaaggcagagctggtgaagctgagatttgggcctcggactgcttggctctagagcctgtgttcctaactactgaggtatcatgcacacacgcaaatatatataggtaaaagtccacatggctatcgctagtgttcrgtgcactccatggctgaagtaattctagcttcaacttttacataaaaccccccacagtgctgtaacttaactttcttcatgaaataccttttttttttttttgagctgcagttttgctcgttgcccaggctggagtacaaaagtgcgatctcggctcaccacaacctccacctcccgggttcaagcgattctcctgcctcagcctcccgagtagctgggattacaggcgcgcaccaccacccccggctaattttgtatttttagtagagatggggtttctccatgttggtcaggctggtc

SEQ ID NO: 130880 - DNA, 601 bp, Human
aaacgctgtctctactaaaaattaattagccgggcacggtagcaggtgcctgtaatcccagctacttgggaggctgaggcaggagaatcgcttgaacccgggaggcggaggttggcgtgagccgagatcgcgccactgcactccagcctgggcaaaaagagcaaaactccgactcaaaaaggaaaaaaatgtctttttaatttttagctcccagctcaaacattatttccctaggaaacttccccaagacggcagtctgagtggctgtccccagttacattcatatcaaaacttgtaagaygtatttcagtactttttatcttatatccctagtgccccacatgcagcctagcataaagcaggcattcagatgtcagaacagttaccacttatcaaaaactcgctaatgttgagccttgtgctgtgttcagtctctcagcctctcggcaaccttttgaggtttgctactattgttatctcagatttaaagatgaggaaagacttgaagaaacttgtccaaaggcagagctggtgaagctgagatttgggcctcggactgcttggctctagagcctgtgttcctaactactgaggtatcatg

SEQ ID NO: 130881 - DNA, 601 bp, Human
acgcctgtaatcccagcactttgggaggccaaggcgggtggatcatgaggtcaggagatcgagaccatcctggctaacatgtgtttttagtagaaaccctgtctctactaaaaaaaaaaaaaatacaaaaagttagccatgcttggtggtgggcgcctgtagtcccagctactcgggaggctggggcagaagaatggcatgaacccaggaggcggagcttgcagtgaggtgagattgcaccactgccctatagcctgggcgacagagcgagactccgtctcaaaacaacaacaacaacaamatcagtcttcaccttacagactcccagaggcccacaaaccatacagtagagaattactggtcttaaaaaatttctttttggctgggcacggggctcacgcctgtaatcccagcactttgggaagacgaggcaggtggatcacggggtcaagagattgagaccatcctggccaacatggtgaaacgctgtctctactaaaaattaattagccgggcacggtagcaggtgcctgtaatcccagctacttgggaggctgaggcaggagaatcgcttgaacccgggaggcggaggttggcgtga

SEQ ID NO: 130882 - DNA, 601 bp, Human
cggccttggcctcccaaagtgctgggattacagatgtgagccactgcacccagccttaactcccttttaaacttaagtttaatctcatcctaagaaacaatattcatgaaatcacaggtttgatgtgctaattttatttttctaatacttaccaaaataaatgccaccacttaacatagaaaaaattgttcccatgtgacctaaaatcattcctcagtcacccctgaactggctagtagcgagcatatgtggagcggtggtgagggcaggatagcctggttataggaaacctcagaatagraaagacctgggttcaaatccccactctgccacttactagctgtgtgactttggacaagttgtgaaacctctctgagatttatttcttcatgtaaaatgtcaccgataatgataactcagtggtgtaagaatgatctatttaagattctaggcagagtccctggcaggcagtaagcactaaatagatgacagctatcattaataatagcagttatcataatgaggtcatgtgaagacccattttctaacctcagctacatgcactgctggccagtaatttctagataccctaggtggggat

SEQ ID NO: 130883 - DNA, 601 bp, Human
tcatgtgaagacccattttctaacctcagctacatgcactgctggccagtaatttctagataccctaggtggggatattgatggagcataccccatgaggctgagctgccaaggcattcatcagttgtaagtccattttttagcaggatcctcagaccctcctctggtcatgagggagtgatcagaggacatctcagggccacgttgggccatgaggtcctttgcatcctgtccttgcccatctcagcctcttgtttttaaaagttgttccaaaccttgaggcccggttgtaggggaggakatctcctttctggcctttgatttggaaaaatggtttttctgatgtcgggaacaagcagtagggtagccactgtttaaaggagggtgtcagccaggacacggaaattgctgttgcccctgaatgtgtttctcagggtggaggaactctcaggccgtactcttgggtgcatttccctaagggtgcatccacacagaaactcgagctccccttccttccttcccagtcagcccggccagtccacatgttccccgggtgagggtagctccctcccagggtaagcgcttctctctgaggagcctc

SEQ ID NO: 130884 - DNA, 601 bp, Human
taaaagttgttccaaaccttgaggcccggttgtaggggaggagatctcctttctggcctttgatttggaaaaatggtttttctgatgtcgggaacaagcagtagggtagccactgtttaaaggagggtgtcagccaggacacggaaattgctgttgcccctgaatgtgtttctcagggtggaggaactctcaggccgtactcttgggtgcatttccctaagggtgcatccacacagaaactcgagctccccttccttccttcccagtcagcccggccagtccacatgttccccgggtgagrgtagctccctcccagggtaagcgcttctctctgaggagcctctggtttcttcctgcaacgtaagccagcgtcaaccctcaagctgccaaactggctttttcaaaaacatttctgttttcacccggcatgagctcatcggtcggcaatgtccgtgtggactaatagcaggctagagaggatgtgccctgggcaccccccgccctgaaccctgtccttaagtgtcagtatcatcttaggagcagaggctacaaagccaccttcatcttcaggctgccccattgtcctggcacgactgtgttt

SEQ ID NO: 130885 - DNA, 423 bp, Human
caggaagcaaagagggacagaagaaagatccattcctttctcttcttagtcgggctgatatgaccggcaggcaggtccacagttgcttagaagcaaggtgggaacagctggtgatgagccaaktttccactttcctttggtgatgtggggcataattaagtcacactggtgagacttaggaatgtgaaaatcccaactgttaagaaacagtgcctaaaaatctaaagactcaagcaccgtgcctaaaatcttgattttctgaaataatgtgttctaagtaagactcagcacaggtggggaagagcatcctccacctcgtttgttttgtgttctcgcctgataaagaggcttagtatatgaaaaacacgaggcatgaacgtgaacgagttggcagtccctgccttccagaagggcttgctccag

SEQ ID NO: 130886 - DNA, 601 bp, Human
tcctgggtaaatccagcccggcccgggttccctgtggggatgtgaggcagccacggctctctcggcccaaatgtggatccgtggtggatgaagtccgttcttcttcaagtgctatcttgatttcttcccaggccgggttccctccaggagtggtgaacattgtgccaggattcgggcccacagtgggagcagcaatttcttctcaccctcagatcaacaagatcgccttcaccggctccacagaggtaaccctcctcacagggtgctggggaaagtgaaaggggcgtgttatttgacaccygtgagcttttcctttgacaggctttaatatgatttgtttttcttctaaatttgaccatgttttagtacataacaaccagttaaaaaaagtcactggtctagtttccaaactaaataaatatctaatagaactcagaagccttagaagaaaagattgagagataagataaagtagaaatgtaaaatattcatctgtcaaacaccataattaagattaagagataaataacaagctcagagaaaaatagtcgtgatgcatgcagtgctccaagaatttatatccgtcatatgcaaagtgctc

SEQ ID NO: 130887 - DNA, 601 bp, Human
ggacatcaaaatgccagctttacttctagcagaaagctgccttctactgccaaaacgatatggcttgagtggcacctgagaggctgcctgtttctgcgccttagcgttaagtttacctgcctgttcctgcagagctggggtcacgaggagcaggtctggcttctcctccagagccccctgggaggagtggggagggcaggtgctgcccactcccagtcattcattctcccctccaagtcacatttcctatcatatgttttaagatccctgaagagtggaggtgctctttccttgtgtctcmgacctgataaatcagaggagggcagtagcaactgatccttcaaattacccgctttgcctggttctaggcctgcacccctgccctgggaaagcaacctgcccagcagtttggggatagcttgcgtcttgacagccaaacgacacagcgttaaaatatatgctattgttggctgccatgtccacaagagggaaggaagggctggccgggcattcattcacctgctgacagggtcagctatcaaaaggtgtgacttcccaagtgccttgaaacacctttgccttaaagaatagcctcccagac

SEQ ID NO: 130888 - DNA, 601 bp, Human
aggaagggctggccgggcattcattcacctgctgacagggtcagctatcaaaaggtgtgacttcccaagtgccttgaaacacctttgccttaaagaatagcctcccagacctgtccacgggtgccagaaattcctgtcgtggagaacaaagcctttcacttcacactcagataaggttggaattgcaaatatccccaagaaaaatgaccctggcacaatttcttactaaggtgtaaatgactgatatcagttcctttctggcagctggctttcacaatgggagaaaggacaggaggaggayacaggctctcaggaaggaaaggggagctgggtgtgaagatggactttccatttcttgcctgggtcagtgttcccttgtggaagcaccattagtgctatgaatagcaagtggtttttggagccacacggagcatttctggcactgtgactcacatttggagtcccaaacagccaggactcctgttttgctttcctgtgccaccgtatctggatacgccacctgcactgaagttcatcttcctcctcttggggaggaaaactgcagctaaagcacaggactaattgtgtttggggcttggtt

SEQ ID NO: 130889 - DNA, 601 bp, Human
ggcaattagaattgcagctgtcaccagtcctgctttaacaacttaatcgcttcctctcgctctgcccgcctccctcgcccctccccctccagtggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcaggtaatccccctggtgtgtgtgaamccatggtgcttgtctaggggctgaagcaggcagtcccatggcaaccgcctacagggtccctctccgtgaaaggaatgctgacctgtcctgcccaggaggctttcttttctttagaaactgatcagaaacacaatcctgtcaggtcccgggggctcacgaaagggggcaggacacactgaggcatgggaggagggcgctattcccagggcagaaggccatctgcctgaaccctccactctccaggatgacctccctacagaaaaggggctgtaggctggctgaaggcagcagagtgcaggc

SEQ ID NO: 130890 - DNA, 601 bp, Human
gcctccctcgcccctccccctccagtggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcaggtaatccccctggtgtgtgtgaaaccatggtgcttgtctaggggctgaagcaggcagtcccatggcaaccgcctacagggtccctctccgygaaaggaatgctgacctgtcctgcccaggaggctttcttttctttagaaactgatcagaaacacaatcctgtcaggtcccgggggctcacgaaagggggcaggacacactgaggcatgggaggagggcgctattcccagggcagaaggccatctgcctgaaccctccactctccaggatgacctccctacagaaaaggggctgtaggctggctgaaggcagcagagtgcaggcagcgtgtggcctggagtctcagtcgcagcccgaggccctcaagcccacgtgggttacaggacaaggt

SEQ ID NO: 130891 - DNA, 601 bp, Human
tggctaacattccttctcctcagtcattgcctgcccagcctgtgccccaaacccagcggtcagtgacacaaggttgtctaatggcctcggctggatttcagatctgaacgcaaacatgaccacaagtcattattgaatccgccgtgagttttaaagctaatccacaatcagtgggaaatatgtgaactgatccccatacagaagaaacttttttaccccgtcgttatttgtaagtctctttctgtggctcttttcttggcttatgcctgatgtctgagtcttgacttttgaggccagatayaccgatttcttccaagagaacagatagaggcagaatgggtgctgatttcatcagtgcatttatgccaccgctcaaagtccttctgaaagctcactaaagccgtctaacctcagcatattattttagaatgctgttggggtttctttttcttccaaagtgctttttcatctacggtaataagattttactctgagaggacttacagctgtctaaatagtcctgtctgtctcatgcctgtaaaacagctagctgacctagatccgggtccacggccgggctagcgctcacaggaatgctcca

SEQ ID NO: 130892 - DNA, 601 bp, Human
atggatcatggcttgacaagaacatgcagagggaggatggctgatcatgttgaaggccactgaaaacatgagatggcagccactgcccagaaggaagccaggctgtacttcttgtttgtgtcttgcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggaggtacaagrgggctgtggcaaggctacgacttgcggggcctttcaaacacgagtccttccctagggcccagggatcccagaaatccttgtgatctgagtgtttttttgtttttgttgctgttgttgtcgttgttgttttttctgtgtggtctttcccctctcctttggggtccctagggaagccgttttgtcctgcctctggcgaactccaagcatgatacagcaggtaccttgtttgttctagctagttttcactcatggctcaccctctctgggagcagcaagccctctctgattttctaacacacc

SEQ ID NO: 130893 - DNA, 601 bp, Human
gtcagtcatgcagccgcaggtggagaactgttgccacctgtgggttttgccaggaatcaattcaagaacctgtggattcagggcccaaagccgccttcagtgcccctagactgaatttcaagtgttcactcaaggaacatgtcacagctggaatttttattgacattttccaccacggacgtcttgaaaatgagggaaattaaggagactcccccactcccataagagtgtaaatctttctctttcaactccactgttacactagacgggaactggttcccacacagcatttgtaagaggmgagctggatcccaggaggttagaccctggaggtggtattttggggcacataaaaggatgagtccctgccaagggctttctggggcaggtatttcagaggcgtcttccttgagattgttatgtgccgtgatggcatgaagctcagctccttaaacatccctgtgacgagaggtcctggggaacccggaaggtattttggcaggccaggcaccatcctgccggcttataattatgtctaatattgaatcaattacaagctcccttcaaaatcacctttaaatgttcaagccttagttcttcc

SEQ ID NO: 130894 - DNA, 601 bp, Human
ttctgccttagagtctggaacggtctggtgagttgactgtgtgtgtatttcagctctcctgagttgcttcttgctaagttcattattcttctattaactgagagtttctcattgtttacattgtatattatgtaccaagccctgtctcagtgcttccttccatcctcatgaccatcttctgaggtagctgccattatgtctccatttcagagatgagaaaattgaggcacagagagatgaagtgacttgcccagggtcacacagctagcagatggccgagagggctccagtacctgtgcckgtggcccctgtgctgtactgcccctccaactttattttccattctgattctaaaagcagttcatgcccatctgcaaaatgtggatactagtctctgcctcatcagtaattctgcagattatgttttgtgatccccatattaaagattaatgaattgaggctcagagaggttgagcaataagcccagaatcatataaccaggaagcaggagaacttttgggtcagttctgtctcatttcaaagctaattcttattcctctacaccctgatttttctttttctttctttctttctttttttt

SEQ ID NO: 130895 - DNA, 601 bp, Human
aaaattgaggcacagagagatgaagtgacttgcccagggtcacacagctagcagatggccgagagggctccagtacctgtgccggtggcccctgtgctgtactgcccctccaactttattttccattctgattctaaaagcagttcatgcccatctgcaaaatgtggatactagtctctgcctcatcagtaattctgcagattatgttttgtgatccccatattaaagattaatgaattgaggctcagagaggttgagcaataagcccagaatcatataaccaggaagcaggagaactttkgggtcagttctgtctcatttcaaagctaattcttattcctctacaccctgatttttctttttctttctttctttcttttttttttttttttttttttgagatggagtcttgctctttcccccaggcaggagtgcagtggcacactctcggctcactgcaacctccacctcccaggttcaagcaattctcctgcctcagcctccccagtagctgggactacaggtgcacgccaccacgcccagctaatttttgtatttttagtagagatggggtttcaccatgttggtcaggctagtcttg

SEQ ID NO: 130896 - DNA, 601 bp, Human
ctgtgccggtggcccctgtgctgtactgcccctccaactttattttccattctgattctaaaagcagttcatgcccatctgcaaaatgtggatactagtctctgcctcatcagtaattctgcagattatgttttgtgatccccatattaaagattaatgaattgaggctcagagaggttgagcaataagcccagaatcatataaccaggaagcaggagaacttttgggtcagttctgtctcatttcaaagctaattcttattcctctacaccctgatttttctttttctttctttctttcttttttttttttttttttttttgagatggagtcttgctctttcccccaggcaggagtgcagtggcacactctcggctcactgcaacctccacctcccaggttcaagcaattctcctgcctcagcctccccagtagctgggactacaggtgcacgccaccacgcccagctaatttttgtatttttagtagagatggggtttcaccatgttggtcaggctagtcttgaactcctgacctcaggtgatccatccatctcagcctcccgaagtgctgggattacaggcataagtcatcatgcctg

SEQ ID NO: 130897 - DNA, 601 bp, Human
cagagctggctagagcaacccgggagtggagatgtgtggtttccagccggacactgtcttctctccccagctcaggattttattagcctgtgtggacaaacattttgtaggatcagtgttcccaaggaaccatctgtgacaacaccccaggttcctgggacatctctagggacccaaactcttccttttatttcactagtctgtcctatttatatacaaatgtagtcccttgtttgcacttcttccagcgggaacagactcaaacgcttcccctcaccttgggccttggttggggcctttktgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttgaccatgaaacccctttgcagaaattgcatttcctccctctagtggc

SEQ ID NO: 130898 - DNA, 601 bp, Human
agactcaaacgcttcccctcaccttgggccttggttggggcctttttgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttgrccatgaaacccctttgcagaaattgcatttcctccctctagtggcctgtttgcatttgagttctgtgagcccctgcttcatcacttgttacacctgcccctccagggacaggcagccagggctggggtcaccagggtcccctcttgggccctccaacagcaacagtactggcaacagctgggatttgctgagcacagactctgcagcaggctcggttgagctctctgtgcctgttccttcataccatcctcacgcccatccatgagatgggtccagctgttttcagatgagaaaatggca

SEQ ID NO: 130899 - DNA, 601 bp, Human
tgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttgaccatgaaacccctttgcagaaattgcatttcctccctctagtggcctgtttgcatttgagttctgtgagcccctgcttcatcacttsttacacctgcccctccagggacaggcagccagggctggggtcaccagggtcccctcttgggccctccaacagcaacagtactggcaacagctgggatttgctgagcacagactctgcagcaggctcggttgagctctctgtgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacaggga

SEQ ID NO: 130900 - DNA, 601 bp, Human
tgaagcctgtccattagccttcccccttatccctgtggctggcttcgccttcagcggacatcagtaattgttgaccatgaaacccctttgcagaaattgcatttcctccctctagtggcctgtttgcatttgagttctgtgagcccctgcttcatcacttgttacacctgcccctccagggacaggcagccagggctggggtcaccagggtcccctcttgggccctccaacagcaacagtactggcaacagctgggatttgctgagcacagactctgcagcaggctcggttgagctctctrtgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgtgtggtcatttgtctcctttcatctgctgccttcaaccagctgggtcattagggctggggaacccagaccccacacagtcctcctcccagaggccag

SEQ ID NO: 130901 - DNA, 601 bp, Human
ccagggtcccctcttgggccctccaacagcaacagtactggcaacagctgggatttgctgagcacagactctgcagcaggctcggttgagctctctgtgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgygtggtcatttgtctcctttcatctgctgccttcaaccagctgggtcattagggctggggaacccagaccccacacagtcctcctcccagaggccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggact

SEQ ID NO: 130902 - DNA, 601 bp, Human
tctctgtgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgtgtggtcatttgtctcctttcatctgctgccttcaaccagctgggtcattagggctggggaacccagaccccacacagtcctcctcccagasgccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggactcactggacacagcccatgtgtcctcctgccagttagcctccatcgggacttttttgaatgtctgttttttaggcccttggcctatattttc

SEQ ID NO: 130903 - DNA, 601 bp, Human
gatgggattctgtcacaggtctttttaactacagagactccagtggccacctctaccttcatctcttcctaaacaagcacacatttttcttcacctgacagcagatcaagcgcttagaaggatttaaatctctccaaagctgcctcttgggtcttggaagggaagctaccctgaagacggcccatggtgccagggaaggatcacctgagccctgcaagatttaaagaaaggaactataccaaggatgtgaacccaaaagctgtggcctccccatgtccactctgtgctaacgtctgcttcyctcatgccccctaggctggcctcactgcctgacagctggtccccagctgtgcactctgaggccagcttcaggcccttggtgttcttcccactggtcctctggccacatccccagccaatagctttgggcctctgcctcttctgtctcctcttcaagcagctcccaattgccatctaaaagttatcaacccagtgtaatttctgcccctccctcgttcacagacaccccaccgtccaccaggctctctcgttttgctctctattgccaccccagggaattcacctctttactttttttaaa

SEQ ID NO: 130904 - DNA, 601 bp, Human; identical to SEQ ID NO: 124762

SEQ ID NO: 130905 - DNA, 601 bp, Human
gcatgctgctctcaggcacgttcggacttttcattcaaccatttattcagtaaacacttcttgatctcctactatgtgccaactgatgacaggcacggacatgcagacaggcaatggcaccaccaggcggccaatgcggagaggagggaagcccaggcagctgggctgcggggacctcagggagtcccctggaccaccccaggtcgggagtggcatctagaagagaaaactgcagggcaggcaggtgctggagagaaacagtgtgaaggctgggaggcagatgaggtcaggccaggcaccrgcaaacagctgcagtgagtgctgagaggagagagagatgcaagggccttgaaaggctggccagggagtttgggcttcattctgagaacaagcgggtgctattcatcgcagtaagcagaggagtgacatgatcagacttgcaatttagaaggctctctggggctggagaggggatagagcaaaactgaaggcagggtcccactaggaggccactgggccatccagatgagcagtagtggtggctgactaaggccctggcaggtcctgttctctttgatctcttgaccaaacagcactttct

SEQ ID NO: 130906 - DNA, 601 bp, Human
ccaccaggcggccaatgcggagaggagggaagcccaggcagctgggctgcggggacctcagggagtcccctggaccaccccaggtcgggagtggcatctagaagagaaaactgcagggcaggcaggtgctggagagaaacagtgtgaaggctgggaggcagatgaggtcaggccaggcaccggcaaacagctgcagtgagtgctgagaggagagagagatgcaagggccttgaaaggctggccagggagtttgggcttcattctgagaacaagcgggtgctattcatcgcagtaagcagargagtgacatgatcagacttgcaatttagaaggctctctggggctggagaggggatagagcaaaactgaaggcagggtcccactaggaggccactgggccatccagatgagcagtagtggtggctgactaaggccctggcaggtcctgttctctttgatctcttgaccaaacagcactttctactgattagtataatgggcctcacagtccccagctacctcttgaatcacggtgatgacggtgtcagcacagttctagggcggggatatcatctgtggccatgccctgggcacccctggg

SEQ ID NO: 130907 - DNA, 601 bp, Human
gtgctgagaggagagagagatgcaagggccttgaaaggctggccagggagtttgggcttcattctgagaacaagcgggtgctattcatcgcagtaagcagaggagtgacatgatcagacttgcaatttagaaggctctctggggctggagaggggatagagcaaaactgaaggcagggtcccactaggaggccactgggccatccagatgagcagtagtggtggctgactaaggccctggcaggtcctgttctctttgatctcttgaccaaacagcactttctactgattagtataatggrcctcacagtccccagctacctcttgaatcacggtgatgacggtgtcagcacagttctagggcggggatatcatctgtggccatgccctgggcacccctgggtcactccggctcccaccagctctgtgtaactttctcctccctccactgtttgaccaggcgcaacatgcatcagatgacggacgggctggataagccaggtcagatccgctggccactggccatcacgctggccatcgcctggatccttgtgtatttctgtatctggaagggtgttggctggactggaaaggtaagggat

SEQ ID NO: 130908 - DNA, 601 bp, Human
gtgacatataataagcctgcggcatgtcctgatgtgactgacctttctgagcagtaggtgtgactgtgcctgattccagacaagagaaagtgaagctaagagaaaatacaacattgaccctaagttacgcagcttgtgggtgacacagatgagtttgaattcccttttcctagctccaagtacaatgggttttctcttggattgtggctgccttccttaatcctgcagaatctcggggtcaagtcagggaggtgaagctaagccagtgaactgtccatgctgaccgggaaacaggctcacrttagactctgagatacaaaggtcatcaaacttgaacattgctcttccatactagtgagcaaagaaatgcaattttagacaatgatcatcagtttggcaaaaaataattgtttaaatgatgatacctagtgctggccttgtgacagaaaggcactctctgtaatgccaggtgaagttccatttctcgaaagcaacaaggtaatatggatcaaaagcctgtgatgaatttattccttttaattcagtagttccacctctaaaaatttttcccaagagtggtataataattttgtagctgaag

SEQ ID NO: 130909 - DNA, 601 bp, Human
agatgagtttgaattcccttttcctagctccaagtacaatgggttttctcttggattgtggctgccttccttaatcctgcagaatctcggggtcaagtcagggaggtgaagctaagccagtgaactgtccatgctgaccgggaaacaggctcacattagactctgagatacaaaggtcatcaaacttgaacattgctcttccatactagtgagcaaagaaatgcaattttagacaatgatcatcagtttggcaaaaaataattgtttaaatgatgatacctagtgctggccttgtgacagraaggcactctctgtaatgccaggtgaagttccatttctcgaaagcaacaaggtaatatggatcaaaagcctgtgatgaatttattccttttaattcagtagttccacctctaaaaatttttcccaagagtggtataataattttgtagctgaagatttatatacaggggtgtttaatttggtgttatttagagtcacataaaattggaggtaacctgaatgcatagcagtggggaagcttaaaagagaatggtaggaccttctgagggactgttttgtgcaattaaaacgtcaaattgtt

SEQ ID NO: 130910 - DNA, 601 bp, Human
gaacattgctcttccatactagtgagcaaagaaatgcaattttagacaatgatcatcagtttggcaaaaaataattgtttaaatgatgatacctagtgctggccttgtgacagaaaggcactctctgtaatgccaggtgaagttccatttctcgaaagcaacaaggtaatatggatcaaaagcctgtgatgaatttattccttttaattcagtagttccacctctaaaaatttttcccaagagtggtataataattttgtagctgaagatttatatacaggggtgtttaatttggtgttayttagagtcacataaaattggaggtaacctgaatgcatagcagtggggaagcttaaaagagaatggtaggaccttctgagggactgttttgtgcaattaaaacgtcaaattgttcatgaggcaataaaacaacgtttagtgaacaaaatgggaaacaaacctgtatgtactgcgttttttttaactctaaacatgttacatggaaaggcaagtacctaatttgaacctcattttgtaagaaaatgtgattgcatctgcaaaggagagtttcagaggagcattaaagtaggaacatccctgc

SEQ ID NO: 130911 - DNA, 601 bp, Human
gtgtttaatttggtgttatttagagtcacataaaattggaggtaacctgaatgcatagcagtggggaagcttaaaagagaatggtaggaccttctgagggactgttttgtgcaattaaaacgtcaaattgttcatgaggcaataaaacaacgtttagtgaacaaaatgggaaacaaacctgtatgtactgcgttttttttaactctaaacatgttacatggaaaggcaagtacctaatttgaacctcattttgtaagaaaatgtgattgcatctgcaaaggagagtttcagaggagcattraagtaggaacatccctgcatttatgtgttcgtcagacaattcttgagtgtctactatatacggtggactgttctagacatggggatgtgaacaacacaagccctgccccccacataacttacattctaggtgctggttaaaggaactttcattttatgtgtgtgtgtgcatatgtaatttaaaagttttcctgtcaccacatgcaatacttggataatttagaagtcaaaaaataggaggggacaggggaagggaaaaaccaaatgtgagctggttggctcagactccaaggaggagctt

SEQ ID NO: 130912 - DNA, 601 bp, Human
aagccctgccccccacataacttacattctaggtgctggttaaaggaactttcattttatgtgtgtgtgtgcatatgtaatttaaaagttttcctgtcaccacatgcaatacttggataatttagaagtcaaaaaataggaggggacaggggaagggaaaaaccaaatgtgagctggttggctcagactccaaggaggagcttcagataagtggccaaggagagcaaggatctgggaaggcttcctggaggcggaagaactggaatcaagcccagagccacaacagatacggatgtaggggaaatgggggaggaggaagcaagggtgtacaggaggaggggtcaccagtcacccactttcctcccaggtggtctacttttcagccacatacccctacatcatgctgatcatcctgttcttccgtggagtgacgctgcccggggccaaggagggcatcctcttctacatcacacccaacttccgcaagctgtctgactccgaggtgagtgcccctcccagcccggattctgagccaccacttagcagctttgagataagcttttgcatctttctgaccctcactgtagaccaggtttgttgc

SEQ ID NO: 130913 - DNA, 601 bp, Human
aatcacaagagtattgattggggaagtgataagtgtccatgaaatcttcacaatttatgttcagagattgcagtaaaggcaggtgtaagaaattataaaagtattaatttggggaactagtgtcaatgaaatcttcacaatctatgttcttctgccatggcttcagccggtccctctgtttggggtccctgacctcccgcaacactttggctcaattcagacatgttcatcaccatactacaaagaccactaaatccatgcttttgtctcagctccaaaaatgttctcgccaagtgggccrtgcccactctgctcaccacacagtcatcaatgccacagaacccaaggaaaaccccagacagcccttcgctgcacagccaggcaagcagccaacaggtggaacccactgtatgcagggcagaggcccctgaggctcatggaggccacacggctggtcccttgaagaagtgggctggttccgtgaaaggagcattctctgctccggttctaatctccccttcaagggcagccaccatctcgtttctctgcaattccccaaccattcccccacccccatccggagccagacccagggaggtta

SEQ ID NO: 130914 - DNA, 601 bp, Human
tctgccatggcttcagccggtccctctgtttggggtccctgacctcccgcaacactttggctcaattcagacatgttcatcaccatactacaaagaccactaaatccatgcttttgtctcagctccaaaaatgttctcgccaagtgggccatgcccactctgctcaccacacagtcatcaatgccacagaacccaaggaaaaccccagacagcccttcgctgcacagccaggcaagcagccaacaggtggaacccactgtatgcagggcagaggcccctgaggctcatggaggccacacgrctggtcccttgaagaagtgggctggttccgtgaaaggagcattctctgctccggttctaatctccccttcaagggcagccaccatctcgtttctctgcaattccccaaccattcccccacccccatccggagccagacccagggaggttacaatctctttccttctcattccgagatttcctgatctcttagacacccccaccaactactcaaacacaatacatgccaaacaaggctccaaagccttctcctccaccatgctccccatcacagaagggtcccatggtccagtgcccaggg

SEQ ID NO: 130915 - DNA, 601 bp, Human
tccttctcattccgagatttcctgatctcttagacacccccaccaactactcaaacacaatacatgccaaacaaggctccaaagccttctcctccaccatgctccccatcacagaagggtcccatggtccagtgcccagggtggagacctcagcattgtcctggactcttccctcaccctcatcctgcaaaccagccaataccagcacctgcccctccatcccctacatatctctctatctggttgcctctctgcacctgcactatcctcactactggccaagccatgccatcccccatcragatgatggccacagctcctcactggtcctcttgcctctgggcacaattactatggccccacatcccccaccctctttctgcacctggaaaaaggggctgaaaacactcactcaaaaggttactctgaagatgaaatgaaataaggcttagaaaatgggcagtgtgctggaaaggctgtaggtgatgagtaccttttatttttcttcttttttgcacttctctgttcaggccccgggctggcgttcctggcatacccagaggcggtgacccagctgcctatctccccactctgggccatc

SEQ ID NO: 130916 - DNA, 601 bp, Human
ccacatcccccaccctctttctgcacctggaaaaaggggctgaaaacactcactcaaaaggttactctgaagatgaaatgaaataaggcttagaaaatgggcagtgtgctggaaaggctgtaggtgatgagtaccttttatttttcttcttttttgcacttctctgttcaggccccgggctggcgttcctggcatacccagaggcggtgacccagctgcctatctccccactctgggccatcctcttcttctccatgctgttgatgctgggcattgacagccaggtgagggcgccccccccgcaccccaggagctctccatccccagactcctcagtccccgagtaaacagggagaggaggcaactcttaggctgccaagaagatgaccaaaaattccaggtccctagaatgttccactgcatgaaatttcaggaaacagctcagccaccttctccattttccagaaggggaaactgatgcccagaggggagggactctcctgaggtcacaaagtgagtcacaggcagaatcaggctggaccctgggctctcctggctcggtgctgctgggcctcccgtccttccttagagggccaggctt

SEQ ID NO: 130917 - DNA, 601 bp, Human
ctctagcaacatgagttcagcactgcgggtctgatttttataatccacaaatcacccccaccccccccccaccagatccaaatgtagttctgctccagagttagtattcattcatcccttcattcatagttgtcaaatacctactatgggcctggcatgaccccagaaatttggcaattaatgtggcagatactaccatgtctgctgtcttggagcttacattttggtggacaagactgacagacaaattagatgattttggagagtgtcaagtgccctggagaaaagaggacagcagcayagagaatggccagtagcacaggaggggcgctccctcagacaaggtagtcaagggaggtctctctctccaagaaagcgacagttgagctgagacttaaatgatgagaaagagccagccagagaaagatctggggaaagagagcagagtaggtgcaaaagccctgaggcatttgagggacgagggaagccagagtggtggaggcagagggagtgaggcagtgggtgggagacgaagaaccagcccatgcggaccttgcaggccaagacatttgggtgggatgggatgggatgggatgggatg

SEQ ID NO: 130918 - DNA, 601 bp, Human
tccaccccagctcccattcccccacccttctgagtctccagtgtctattattccacctgtgcccagtgtttagctcctacctttaagtgagaacatgcagtatttgacttcctgtttctgagttgttttgcttaagatgatggcctccagttccatccacgttgctgcaataggcatgacttcattctattttatggctgaatagtattccatcgtgtatgtataccatatttcctttatccagccatccacggatggacacttaggttgattccctatctttgctattgtgaataaacaagagtgcaaatatctttttgatataataatttcttttcctttggatagatagccagtagtgggattgctggatcaaatggtggttctatttctgattctttgagaaatctctgtactggtttccatagaggttgcactaatttacactcccaataacaccttctctctctaactgttccaacacggtcagatcctcactggtcagtgactctgcttataatttgagcagtgcccgaagccgctctggtgaacttcaagacaccagtttggggtttggggtttttctttttcatgagatttg

SEQ ID NO: 130919 - DNA, 601 bp, Human
cctcccaggttcaagcagttctcctgcctcagcctcccaagtagctgggattacaggcgcccgccaccacacctggctaatgtttatatttttagtagagacggagtttcaccgtgttggccaggctggtctcgaactcctgacctcaggtgatcctcccacctcggcctcccaaagtgctgggattacaggcatgggccaccgtgtccggcagattgccagtttcttatagcatctgaccatcagggagaaacagcccctgcccaggaaagcctttgaaggaatggctgggatagatgtygagtgggagggacattgagagtggcaggggtggaggggatcatcatgtcagtctccttttgttggtagatatcttcacattaaagtgacttgctcacctacacaacccacttgctgtgagaattgggctattgaaaaatacttggtaacgaggacccccagagcataacccccatggtacagacaaggaaactgagactcagagaggttaggtgacttgcccatggtcacactgtgagaaagtggtagaaccaggctttgaccctgaagcacccacagctcatccatccctcctgctccc

SEQ ID NO: 130920 - DNA, 601 bp, Human
aaactgagactcagagaggttaggtgacttgcccatggtcacactgtgagaaagtggtagaaccaggctttgaccctgaagcacccacagctcatccatccctcctgctcccaatgtcacaggtgtcaaccgattctatgacaatatccaagagatggttggatccaggccctgcatctggtggaaactctgctggtctttcttcacaccaatcattgtggcggtaagaacaaggcctgactagccctgttaggatgaggctagaccaagccctggggggactcaggtccagggagaaacytctagaggcagaggcaggtgggagaggcccccagaaaccctgttccttaataatacttctctctaccatttgttgggcatctattctgcaccctgcatggtacaagacacattatatcatcctccacaaacctcagaaaggaggcattattgtcccactttaccgctgcaggatctggggctcacctagccagcatcacccagctagtcagcactgggattcgaaccaagcccagtctcttggcacttggagactctccttctcagggtccctcatccccacaagcaggagctgaagcag

SEQ ID NO: 130921 - DNA, 601 bp, Human
agaagaggggataacaaaggagaggcctggggataaaccaaacttaaaagtagaagcagaaagtatgtttctagaagagggaggggaggagaggttggaaagcatgtgcaaaggtccaggggtataaactgcattgggtcaactgaacggagatcagtgtggctggaaggtaaagtggaaaggggtgcgaggaggggacatgacaagagatgaggttgggatgtaagaaggtccagccagatcatgaagggctttgaaaaccaggacaagaactttgaactttatcctggcagcaatgggktgtcatgaagggcttggaacagacggagggtgggatcacatttgcccagggctcactctagatctcatttgtagggttgatatagagaaaatgtggtcttacccacaaagaaagacaaagcacaaaagacctgctgcctgcagcaggggcctcaccatcacatagggttctctgtccatgcccacactttgttaaattgcactaaattcttgagggaagcaaagaagtgctggaggtgccaggcaggtgcctcattgatgaggtgtgtgcaggctgaaaagatgccacggggagaagtgg

SEQ ID NO: 130922 - DNA, 601 bp, Human
actctagatctcatttgtagggttgatatagagaaaatgtggtcttacccacaaagaaagacaaagcacaaaagacctgctgcctgcagcaggggcctcaccatcacatagggttctctgtccatgcccacactttgttaaattgcactaaattcttgagggaagcaaagaagtgctggaggtgccaggcaggtgcctcattgatgaggtgtgtgcaggctgaaaagatgccacggggagaagtggagagtcggagtgtgagggctgccccggaaggccctggatgagttgctgtccactrtagttccctgggaaatgcacctgccagacccaggggaagcgctctcaggtctgagatacagggaagcctggctgcaggttatgtgctgccgtggagttactggcccatcttcctccaacctcagatgaagaaactggggaaccacaggggttgagtaagcaggttcccagctcaggaagctgtgagcagagctagggcttgcagccctttcttcccaatgcaagtccaaagctttcattttccatgatccactggagagcctcaaacagcagctgggtcttagcgtggcaagaggttagg

SEQ ID NO: 130923 - DNA, 601 bp, Human
agatctcatttgtagggttgatatagagaaaatgtggtcttacccacaaagaaagacaaagcacaaaagacctgctgcctgcagcaggggcctcaccatcacatagggttctctgtccatgcccacactttgttaaattgcactaaattcttgagggaagcaaagaagtgctggaggtgccaggcaggtgcctcattgatgaggtgtgtgcaggctgaaaagatgccacggggagaagtggagagtcggagtgtgagggctgccccggaaggccctggatgagttgctgtccactatagtkccctgggaaatgcacctgccagacccaggggaagcgctctcaggtctgagatacagggaagcctggctgcaggttatgtgctgccgtggagttactggcccatcttcctccaacctcagatgaagaaactggggaaccacaggggttgagtaagcaggttcccagctcaggaagctgtgagcagagctagggcttgcagccctttcttcccaatgcaagtccaaagctttcattttccatgatccactggagagcctcaaacagcagctgggtcttagcgtggcaagaggttaggggggt

SEQ ID NO: 130924 - DNA, 601 bp, Human
ccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctcygaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggac

SEQ ID NO: 130925 - DNA, 601 bp, Human
ataattaacatcttcatccaagtaactatctacaatgctgaactggaactacctttggcatattcctagacaccgtcctttacgttagactcctgctttacattagtccataaattattcctctttataaggctgttcaaccagttatatagtcaaataactctctttgaagttgacattcctttgtgtgacttaagagagtatactgagacagacttggtcaaattcctccctgaaatgagtctccactttctgcagaatagatgtcaagtaactgctattaaaaacaaaaggagataastaggttagttgacaaggataggttcctgtgacctctccttatcttgtagataacagcacttcacattttgaatgcttgcatgccatgtttttaatcatctctttggaatagtacctgcaattaatgtccagctctctaaattatagctgatggaatccaccttcccaattttgaaaattgaggcaatggttggactctgtcaacacttctcttcatcacaatatttttaaagatgactttaacaattcctttattttatccacacatgctttcaatattttgtagtgtaatttctccaaa

SEQ ID NO: 130926 - DNA, 601 bp, Human
acttaacaatgagcataatatttgtagaatagttttaataagttttaaagaagttaggagaaggaagagagttcggtatgatggaaatattgagtaaggctttccagaggaaatctaagacttagctgaggttttaaaacaagatcaggatgttggacatcacaggacctgtaggatttaaatgtggcaaacagtaggaagagtattctagacagaggaaaggaaaggattcactgcagggatcagatgtgtgtgtgggtgtgcatgtgtgtgtttgatgtgtgtgtgtgtaccctgtgtrtggcggaacgggtaatgctgagccttcccaggccatagctttgaagtatttatttgtggagaacaccacttttccatttctagcttttcgtttccccttgttcaatctttgtggggcccacacctacacatcttgtagatctcaaactaagctctgcttcttaaaacctttccctgaacttccaagcctaaattgcatgccttattatgttttcctgtaacacattgtgcttcctttgtagaattattatgatatgaataattacttgctgaatttttactattatactgatacttgtgg

SEQ ID NO: 130927 - DNA, 601 bp, Human
ccacacctacacatcttgtagatctcaaactaagctctgcttcttaaaacctttccctgaacttccaagcctaaattgcatgccttattatgttttcctgtaacacattgtgcttcctttgtagaattattatgatatgaataattacttgctgaatttttactattatactgatacttgtggagagaggtaccatttctgtttagttccccattttatacacagtcatctaatacaagtgctcaatggctcataagcactcagtgaaaacgtgtgctatggccgggcgtggtggctcacrcctgtaatcccagcactttgggaggccgaggcgggtagatcacaaggtcaggagttcaagaccagcctggccaagacagtgaaactccgtctctactaaaaatacaaaaaattagccgggcatggtggtgggtgcctgtaatcccagctattcgggaggctgacgcagagaattgcttgaacccaggaggtggagtttgcagtgagccaagattgcgccactgcactccagcctgggcgacagagcgagactccatctaaaaaaaaaaagaaagaaagaaagaaacaaagaaacaaagaa

SEQ ID NO: 130928 - DNA, 601 bp, Human
ctttatatgcttattctaacagattttttctatttttaaaatttatttctttttacatcttaagcttttttattaaaaataaagacaaaaacacacaccttagcatggacctacacaaggtcaggatcttcagtttcactgtcttccactgccacatttctcactggaagatctttagggacaataacaagcatggaacagtcctcgcctatgaatacaatgccttcttctggaataccttctgatgaaactgcctgaggctgttttacggttaacttatttttataagtaaaactagtaycctctaaaataacaataaaaggcataatatagtaaatacataaaccaataaaatagtactttattatcactatcgagttttatataccgtaggtaattgtatgtactatgctttttatatgactggcagcacagtaggtttgcctgcacgaacatctccacgagcatttcagttatgcattgtgctatgacattacaatggctatcagtcactaaggaatgggaatttttcagccccattataaacatatgggaacatgattgtgtatgtggtccatagctgacagaaacattgttattt

SEQ ID NO: 130929 - DNA, 601 bp, Human
gatgcaatcttttggagtgtctcctggagtcaataagatgcctgttttaccgtgaagagcagcacaatgaagaggttgcccaatagcagtggttacttttattatgttgtctttctgccttcaatcaagagcatgacacttggacatagctttttaaagtaaaaaggaaactgaaaggctcagtatgtgggacatagataagaaaatgagacctaaatagggtgtattgggcaacaatacagggcttaaatagaaagaggaagaccaaaagaaagcaaagaatgtcctaagaagagctgggtttttttttttttttttttaacaattttgttgcctattagttttcttcattcctggggatggttgggacatttttccacatcggcatgttatggccttgattatctacctaaatcaaaccagaggaaaatcattttagtttatttttatcttaacattggatctgtttcagcgcgtcctggaaattagtagttgcatgttgtcaccgtctattttgtacacagtgaaaaggtatttggctgtgtttctatttacattcactgtccttgataaatactaattggccagtgattgtaagtct

SEQ ID NO: 130930 - DNA, 601 bp, Human
ctatttattctacaaagctcaccttaagtgtcacgttttcagggacatgtttgccaatgtactgtacaggggcacatgcagattcttcatgtccccatcacaacctgtcatgacatcacactgaactgagtttgtgtggtctaagtctgtccgccccaacctttactcaaaacgttccttaaggaactaggattggattgtttttatttctttgtttttgtttttaatccctgaaatttcgtcctttagaatgtagtaataggtacctaataaatatttttggcatatgtgaatgaatgartgagtgaataaataatcagattagttgatgaaagattctaagggaagattaggtagtgtgattataagagaaagatcctgaagaatgcttgggaatggatcctttactcatacatgattttgttcatcagcttatatgtaggatcacagtcatttggaaaatattggtccattgaaatttatacattttccaaatggtgacacacttcattatacagtgtcaaaagttagccttcatgactatcaccactgatctcatcaggaagttttaagtattggatagctataagctcacaatggc

SEQ ID NO: 130931 - DNA, 601 bp, Human
atgtactgtacaggggcacatgcagattcttcatgtccccatcacaacctgtcatgacatcacactgaactgagtttgtgtggtctaagtctgtccgccccaacctttactcaaaacgttccttaaggaactaggattggattgtttttatttctttgtttttgtttttaatccctgaaatttcgtcctttagaatgtagtaataggtacctaataaatatttttggcatatgtgaatgaatgaatgagtgaataaataatcagattagttgatgaaagattctaagggaagattaggtartgtgattataagagaaagatcctgaagaatgcttgggaatggatcctttactcatacatgattttgttcatcagcttatatgtaggatcacagtcatttggaaaatattggtccattgaaatttatacattttccaaatggtgacacacttcattatacagtgtcaaaagttagccttcatgactatcaccactgatctcatcaggaagttttaagtattggatagctataagctcacaatggcagtcctagatagtgcagccgtggattgaaaaagtgttctagtttcctctttttaag

SEQ ID NO: 130932 - DNA, 601 bp, Human
tggatagctataagctcacaatggcagtcctagatagtgcagccgtggattgaaaaagtgttctagtttcctctttttaagccaagaatccatccttaaatataagaagaaaatcaggccgggcaccgtggctcacacttgtaatcccagcactttgggaggccaaggtgggcagatcacctgaggtcaggagttcgagaccagcctggtcaaacatggtgaaaccccatctctatgaaaaatacaaaaattagccgggcatggtggtgggtgcctgtaatcccagctactttggaaactraggcaggagaactgtttgaacctgggaggcggaggttgcagtgagccaagttcgtgccactgtactccagcctgactgacagagcgagattccatttcaaaaatatatatatatgtatatatatgaaaaaatcaatagacttggtcttagaataaatattaaaatctaaaataataagtttatataaaaaattagcaaagtggaattacttcttatgtttacatttaagaccaagaaaaacttcaagatttcaaaataataaattattagacaataatgaaattacaaacattataacaa

SEQ ID NO: 130933 - DNA, 601 bp, Human
acaaagaatttcttttatgttttcttctgtaagttttatagttgtaactttcgtacttaggtttacgatttgtcgtagtctgtttattttgctataaaagaatacccgatgttggataatttatttacaaaagaggtttatttggctcaatgttctgcaggctgtgcaggaagcatggcaccagcatttgcttctagtgagagcatgaggctgcttccactcatggcagaaggtgaaggggagccagcgtgtgcagagattactgagagagagaggaagcgagggagagagagaggagacrccaggcttttgtgtaacagccagctcttgaaggaactagtagagcaagaactcactggctatcgtgagaacggtgccaagtcattcatgagggatctgcccaatgactcaaacatctcccatttcactccacattcaacactgaagattagatttcaacataaagtttggaaggttcgaatatccaaaccatggcatggtccattaagatttaatttttgtatatggtatgatgtgtggataaaagtttatttctatttctatatggatttccagttgttccaatggcatttttattaaa

SEQ ID NO: 130934 - DNA, 601 bp, Human
aatgttctgcaggctgtgcaggaagcatggcaccagcatttgcttctagtgagagcatgaggctgcttccactcatggcagaaggtgaaggggagccagcgtgtgcagagattactgagagagagaggaagcgagggagagagagaggagacaccaggcttttgtgtaacagccagctcttgaaggaactagtagagcaagaactcactggctatcgtgagaacggtgccaagtcattcatgagggatctgcccaatgactcaaacatctcccatttcactccacattcaacactgaagawtagatttcaacataaagtttggaaggttcgaatatccaaaccatggcatggtccattaagatttaatttttgtatatggtatgatgtgtggataaaagtttatttctatttctatatggatttccagttgttccaatggcatttttattaaaaaacaaacaaacatattttctttcctgattttattgccttgacacctttgttgtaaacacaattgtggatctctatctcattgatctctttgtcacccctttcaaactgatacctcactttcttgattactttaactttttaagtttt

SEQ ID NO: 130935 - DNA, 601 bp, Human
gtttaactgattgcaatggctaggacctaacttctgtacaatattgattagaagtggtgagagcaggcatctttgcttggtcctgaataatagtggaaaagtgttcagtctttcatcatcaagtatgactcaataattatagttttcatagatgctttctgatgggttaaaaaaattatgattgcagagcttgtctcacttgttctcattattagtgttggagtgggagtctcttgtgactttctgcaatttaaccagaagtcaaagaccctgtactttgagctaacttttgtgctctgtrtagtaagtatttctatttacagaaagctacaaatataggtaacaaaagaaaaggatttcatatcctcacaatccttctttcaaacttgctgtttcccaatccacagatcttaatgtaatctgtactcagttacagtgtagtactttatcactataactccttattttcttccactttcagtctactattcttattcaaaattttgccttaaaagccataaacatctttctaatttaaaaatcaaatgatattttctcagtcctccttaccctcttcagacttgtgacatacacttctttt

SEQ ID NO: 130936 - DNA, 601 bp, Human
tagtaagtatttctatttacagaaagctacaaatataggtaacaaaagaaaaggatttcatatcctcacaatccttctttcaaacttgctgtttcccaatccacagatcttaatgtaatctgtactcagttacagtgtagtactttatcactataactccttattttcttccactttcagtctactattcttattcaaaattttgccttaaaagccataaacatctttctaatttaaaaatcaaatgatattttctcagtcctccttaccctcttcagacttgtgacatacacttcttttygaacacgtgtcctctttcatattcattctcattgtacttttctaattgctgcttctctgtcatagtcataatactttctccagtccttaaacatgaggattccctggagttctaaatttggttatcttctctctatatatgtagcctcttgatcttaaacagttttagttaaactcctgactataatggtttctgctatggggaggagcacaaattcatctctaatctgttacacatttctgaagtaaatactccgattttcaaaagcacctccaccctagattccctgctacctcagtt

SEQ ID NO: 130937 - DNA, 601 bp, Human
cactttgggaggctgagcggggcggatcacgaggttaggagttcgagcctgaccaacatggtgaaaccctgtctctactaaaaatacaaaagcattagctgggcgtggtggtgtgtgcctgtaatcccaactacacaggaggctgaggccggagaatcgcttgaaaccgggaggtggaggttgcagtgagccgagatcacgccactgcactccagcctgggcaatagagtgagactccatctcaaaagaaaaaaaaagaaaagaaaattcagtgtgtgtgtgtgtgtgtgtgtgtgtgtgtatataccccactcatatcaggctttgaagaaaattaaagaaaggaatattttttgtccttttatgaaacagtaaattttgattgaattataaatggatctactgacaactcattttaaaatgtatttccaataagcaagacattttagaaactctgatttagctttcttttatttgtattttatgttttttctggttcatgttttgccccctatattgattatagctaatagcctaatattaatatattttattgagattagttaatattaattgagtggccaaatgatggatgattctg

SEQ ID NO: 130938 - DNA, 601 bp, Human
actttgggaggctgagcggggcggatcacgaggttaggagttcgagcctgaccaacatggtgaaaccctgtctctactaaaaatacaaaagcattagctgggcgtggtggtgtgtgcctgtaatcccaactacacaggaggctgaggccggagaatcgcttgaaaccgggaggtggaggttgcagtgagccgagatcacgccactgcactccagcctgggcaatagagtgagactccatctcaaaagaaaaaaaaagaaaagaaaattcagtgtgtgtgtgtgtgtgtgtgtgtgtgtgtrtataccccactcatatcaggctttgaagaaaattaaagaaaggaatattttttgtccttttatgaaacagtaaattttgattgaattataaatggatctactgacaactcattttaaaatgtatttccaataagcaagacattttagaaactctgatttagctttcttttatttgtattttatgttttttctggttcatgttttgccccctatattgattatagctaatagcctaatattaatatattttattgagattagttaatattaattgagtggccaaatgatggatgattctgt

SEQ ID NO: 130939 - DNA, 601 bp, Human
aatcccaactacacaggaggctgaggccggagaatcgcttgaaaccgggaggtggaggttgcagtgagccgagatcacgccactgcactccagcctgggcaatagagtgagactccatctcaaaagaaaaaaaaagaaaagaaaattcagtgtgtgtgtgtgtgtgtgtgtgtgtgtgtatataccccactcatatcaggctttgaagaaaattaaagaaaggaatattttttgtccttttatgaaacagtaaattttgattgaattataaatggatctactgacaactcattttaaaatktatttccaataagcaagacattttagaaactctgatttagctttcttttatttgtattttatgttttttctggttcatgttttgccccctatattgattatagctaatagcctaatattaatatattttattgagattagttaatattaattgagtggccaaatgatggatgattctgtgctgagtgtttctgataaggcagtcaagtatagaaacatggatggtttttcatttagctgatttcacagcaaagtgcaaaaggaggataggaaattacatgagcattgttgatttctttat

SEQ ID NO: 130940 - DNA, 601 bp, Human
tgtgtgtgtatataccccactcatatcaggctttgaagaaaattaaagaaaggaatattttttgtccttttatgaaacagtaaattttgattgaattataaatggatctactgacaactcattttaaaatgtatttccaataagcaagacattttagaaactctgatttagctttcttttatttgtattttatgttttttctggttcatgttttgccccctatattgattatagctaatagcctaatattaatatattttattgagattagttaatattaattgagtggccaaatgatggwtgattctgtgctgagtgtttctgataaggcagtcaagtatagaaacatggatggtttttcatttagctgatttcacagcaaagtgcaaaaggaggataggaaattacatgagcattgttgatttctttatcaagcacagaccttggaaatgcataaactctatgtatagtgagatttcactttttctgaaaaaagttgaaaaacaacactaataataagtaaaatagaaaaagagaatatataggaaaacaaaaaaaatggcttgtcaaattgtgtgtcatttacataggtgtgtttgtg

SEQ ID NO: 130941 - DNA, 601 bp, Human
ggattgcctgagttcaggagttcgtgaccagcctgggcaacacggtgaaacctagtctctactaaaatacaaaaaaaaaaattagccgggcgtggtggcgtgcgcctgtcgtcccagctactcaggaggctgaagcaggagaatgacttgaacccgggaggcagaggttgcagtgagccaggagtgtgccactgcactccagcctgggctacagagcgagactccgtctcaaaaaaaagaattatcactgaatccatatttagaagaacagttagcttataaaagcaataattagagacargattccttgtataacaaatactaatcatttcccaatatggcattctgggaaaataaaatcagataccacaggatttctatttaagtttggttgttatgagattttgttttgttttcaaatttccacattgggaataatatgaattaataaaaaatagtgagtagtgcaatggcataaggcttgcttgatttataaaatagttttggcttaacgagtagaaaatgaggtttaaaattcaacatagtcacccagtttttatattctaatatttcattaaaggaattagacatgcaacttatt

SEQ ID NO: 130942 - DNA, 601 bp, Human
ccgggtgcggtggctcacatctgtaatcccagcactttgggaggccgaagtgggcggatcatgaggtcaggagatcgagaccatcctggctgacacagtgaaaccccgtctctactaaaaatacaaaaaaaaaaattagcctggcgtggtggcgggcgcctgtagtcccagctgctcgggaggctgaggcaggagaatggcgtgaacccgggaggtggagcttgcagtgagccgagatcgcaccactgcactccagcctgggcgacagagcgagactcctcaaacaaacaaacaaacaaamaaaaaaaaaaactcatcattacagaagagggaaaataagggtgtgtgtatgtaagtatgtatgtgtgtgtgtgtgtttatgtatgtctctacatcaaggatgtagaggttttactttacttccaggccttcctgcctgaccaaaatttaaaagaggagaaattatgatgtcatgtaatcatcaagttcattatgtcacctaaaagaaatctatcaattagcccaattatttaatcaaggatttgttgtcactttaaaagtttcatcagattattttacctaaattataatgtactctgtg

SEQ ID NO: 130943 - DNA, 601 bp, Human
aaagttctataaacatttcctactacaaagtgaaaagaaacctattttaaaagactggtttatgggattttatgtaatatttttcaatttttgagtaaggaaaactttctaagttttcagtctacctgaaaattaagcctttttccttatttatgaaaatagttgttacaatttgtactgaagtatacaaactttatccttactaaggcaatttgcttttaagttttctcctccttttggctactcttaaaaatctggactttcaagtttaatcttaaaaagctcatatctttttaatcayagatattggcatgtccaggtaccaggtatgatggtagacatttgatacagctaattgcttttgtgatggatacataatttttaggcttgcctcttccctgtaacttttttcgatttttttattatttatttatttcaacttttattttaagtttaggggtacaagtgcagtttgttacataagtaaacttgtgtcatgggagtttgttgcacagattatttcatcagccaggttttaagcctagtacccattagttatttttcttgatcccctccctcctttcaccctttacagtccaaa

SEQ ID NO: 130944 - DNA, 601 bp, Human
ccaggttttaagcctagtacccattagttatttttcttgatcccctccctcctttcaccctttacagtccaaaaggccccagtgagtgttgttcccctctatgtgtccatgcgttctcattgtttagctctcacttataagtgagaacatgcggtgtttggttttctgttcctgggttagtttgcccaggataatggcctccagctccatccatcttcctgcaaaggacatgatctcattcttttttataactacatattattccatggtgtatatgtacgacattttctttatccagttkatcattgatgggcaattaggttgattccatgttttactattgtgaatagtgttccaacaaacatacgtgtgcatgtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagcca

SEQ ID NO: 130945 - DNA, 601 bp, Human
ataatggcctccagctccatccatcttcctgcaaaggacatgatctcattcttttttataactacatattattccatggtgtatatgtacgacattttctttatccagtttatcattgatgggcaattaggttgattccatgttttactattgtgaatagtgttccaacaaacatacgtgtgcatgtgtctttataatagaatgatttatattcttttgggtgtatacctagtagtaggattgctgggtcaaatggtatttctgtctttaggtctttgaggaattgccacactctcttccmcaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagag

SEQ ID NO: 130946 - DNA, 601 bp, Human
ttctaagtccaatactaaaattctaatatataccagaataattcgttttagtaataattctatgccatcctcagacctaacctataatcttccatttcttattgtcttccttttgtttttatgtacccttttttgctagttattgtagttagattttgatataactgaaatagtggcattcagttaataaagctcttttccctgaaaattaatacaaaatagtggtactattatttgtataaatagttatttagtattatctattacactctttttgattactttgaagttgttcaaaaaytggatcccagccaggcacagtggctcatgcctgtaattccagcactttgtgaagccagggcaggaggattgcttgagcccaggagttacagaccagcctgggtaacatagtgagaccttttctctactaataataatgaaaaaaactctccaagctccccaaccccaaccaaaactggacctgcgtaggctgttatttttggagaggagtgactagaggagatgaggaaataactttgctcctatagtcaaaattatattttaattaaaatgctttagttaatatactcggttttctaca

SEQ ID NO: 130947 - DNA, 601 bp, Human
caggccctttacagaaaaggttaaagcacttttaaagcttaaagctgatcattgatttgaagcttaaatcagaagagaagttattaaacaataatagaattatgttgagatgtagtaaagactaagaaacaaatatttattacattaagtcccaaaacaaatgtgggtaaaattattagatatttaggttttgtagaacctaagtaatcattccccctatagccatattacctttggaccacttcagtagtctattgaggtagaccgcttccattctgttctggcagaacaaattttctastcataaatgcataggattttcttttgtcccttcttgaagttccataaattatatatgagcatagattttgtttataactttaggtaacagagccttggcagcttcttctggcctgccagcatccataatcttcctctatacctaatgtcccatgacatcccatggggatcagatactgaatttagcttccttgtttgtcccagttcagaaaatgagttgttcattgttctaaacttattagatgacttacatgtgacaatttacaggctgttgcttatgggaacatattaagggcattga

SEQ ID NO: 130948 - DNA, 601 bp, Human
ctatacctaatgtcccatgacatcccatggggatcagatactgaatttagcttccttgtttgtcccagttcagaaaatgagttgttcattgttctaaacttattagatgacttacatgtgacaatttacaggctgttgcttatgggaacatattaagggcattgaggagcatagaaaataaaaaaaaaaaacctaattgaacttcaactctaaagattcaaatataaggctgaatcttggatgtttcagataccactagccaatgaacaggaaattatgttcctcactgaattttaatatraatttgtaaaccatattttgaagataaaaatctaagttgattaacaaagcccgattgtgtagaaactgctctaatttagtaatattagtttggagttatagaaaacacattggctttggagtcagctgaatctgcatttgaaccctagttcagtcattctctagcatttgaaatgagagaaaactacctaaacttttgagcttctcacccattggggataataatacctgtgttatgtggttgctgtgaggattaattgtaaacatagagttcccagcactgtgtcaggcacatagtact

SEQ ID NO: 130949 - DNA, 601 bp, Human; identical to SEQ ID NO: 20320

SEQ ID NO: 130950 - DNA, 601 bp, Human; identical to SEQ ID NO: 20321

SEQ ID NO: 130951 - DNA, 601 bp, Human; identical to SEQ ID NO: 20322

SEQ ID NO: 130952 - DNA, 601 bp, Human; identical to SEQ ID NO: 20323

SEQ ID NO: 130953 - DNA, 601 bp, Human; identical to SEQ ID NO: 20324

SEQ ID NO: 130954 - DNA, 601 bp, Human; identical to SEQ ID NO: 20325

SEQ ID NO: 130955 - DNA, 601 bp, Human; identical to SEQ ID NO: 20326

SEQ ID NO: 130956 - DNA, 601 bp, Human; identical to SEQ ID NO: 20327

SEQ ID NO: 130957 - DNA, 601 bp, Human; identical to SEQ ID NO: 20328

SEQ ID NO: 130958 - DNA, 601 bp, Human; identical to SEQ ID NO: 20329

SEQ ID NO: 130959 - DNA, 601 bp, Human; identical to SEQ ID NO: 20330

SEQ ID NO: 130960 - DNA, 601 bp, Human; identical to SEQ ID NO: 20331

SEQ ID NO: 130961 - DNA, 601 bp, Human; identical to SEQ ID NO: 20332

SEQ ID NO: 130962 - DNA, 601 bp, Human; identical to SEQ ID NO: 20333

SEQ ID NO: 130963 - DNA, 601 bp, Human; identical to SEQ ID NO: 20334

SEQ ID NO: 130964 - DNA, 601 bp, Human; identical to SEQ ID NO: 20335

SEQ ID NO: 130965 - DNA, 601 bp, Human; identical to SEQ ID NO: 20336

SEQ ID NO: 130966 - DNA, 601 bp, Human; identical to SEQ ID NO: 20337

SEQ ID NO: 130967 - DNA, 601 bp, Human; identical to SEQ ID NO: 20338

SEQ ID NO: 130968 - DNA, 601 bp, Human; identical to SEQ ID NO: 20339

SEQ ID NO: 130969 - DNA, 601 bp, Human; identical to SEQ ID NO: 20340

SEQ ID NO: 130970 - DNA, 601 bp, Human; identical to SEQ ID NO: 20341

SEQ ID NO: 130971 - DNA, 601 bp, Human; identical to SEQ ID NO: 20342

SEQ ID NO: 130972 - DNA, 601 bp, Human; identical to SEQ ID NO: 20343

SEQ ID NO: 130973 - DNA, 601 bp, Human; identical to SEQ ID NO: 20344

SEQ ID NO: 130974 - DNA, 601 bp, Human; identical to SEQ ID NO: 20345

SEQ ID NO: 130975 - DNA, 601 bp, Human; identical to SEQ ID NO: 20346

SEQ ID NO: 130976 - DNA, 601 bp, Human; identical to SEQ ID NO: 20347

SEQ ID NO: 130977 - DNA, 601 bp, Human; identical to SEQ ID NO: 20348

SEQ ID NO: 130978 - DNA, 601 bp, Human; identical to SEQ ID NO: 20349

SEQ ID NO: 130979 - DNA, 601 bp, Human; identical to SEQ ID NO: 20350

SEQ ID NO: 130980 - DNA, 601 bp, Human; identical to SEQ ID NO: 20351

SEQ ID NO: 130981 - DNA, 601 bp, Human; identical to SEQ ID NO: 20352

SEQ ID NO: 130982 - DNA, 601 bp, Human; identical to SEQ ID NO: 20353

SEQ ID NO: 130983 - DNA, 601 bp, Human; identical to SEQ ID NO: 20354

SEQ ID NO: 130984 - DNA, 601 bp, Human
tgagagcatccgaattccctcctctgtccctgattggttgaagaactggggagcaccgaccagccccctgcggctcgactcgccattggctgggaagaggtggcaatcagggcgggccaaggcggctgttctcgctccagctcgatgctgcctccccggcccggttgcgctgtagccgctgccgcctctgcctgggtcccttcggccgtacctctgcgtgggggctgcctccccggctcccggtgcagacaccatggtaagtgctctcagccgggtgcggcccgaacctcacccctcctckgccggcctggcagcgagggaactggccgcgcagccggagcttggctcgggggccctgggcgctcactgccggccacgggagcagcctcactccttgcccgcgcccagtcaggggaggtgggaacgccgcgagtcgtggcgggggcgatcggtgcctttgcttcccaggcgggtttgccgctccacaccgcagcttcctgagctcgggaaggggaggtgcggcggaggcgtggggtcttcccggctctggccggccccaccagtgtgggaggctgagcgccagcggaagggaaggctccgg

SEQ ID NO: 130985 - DNA, 601 bp, Human
tggcaatcagggcgggccaaggcggctgttctcgctccagctcgatgctgcctccccggcccggttgcgctgtagccgctgccgcctctgcctgggtcccttcggccgtacctctgcgtgggggctgcctccccggctcccggtgcagacaccatggtaagtgctctcagccgggtgcggcccgaacctcacccctcctctgccggcctggcagcgagggaactggccgcgcagccggagcttggctcgggggccctgggcgctcactgccggccacgggagcagcctcactccttgccckcgcccagtcaggggaggtgggaacgccgcgagtcgtggcgggggcgatcggtgcctttgcttcccaggcgggtttgccgctccacaccgcagcttcctgagctcgggaaggggaggtgcggcggaggcgtggggtcttcccggctctggccggccccaccagtgtgggaggctgagcgccagcggaagggaaggctccgggttcgcgtccccgcgctgcccccgatgcccagcctctcccggagcggtgacaggtgaggagggtgggaagatagcgtgggggtggggcggatggtgacgg

SEQ ID NO: 130986 - DNA, 601 bp, Human
gcggggctgcgagggcgagaaccgcggaaaggagcccctaggggtcaccacggcttcccgacccggcctgagcgtgggaacgcgctgccggcgctcccaggctcagcaggccgggcagctcccacgcgtgcagagccccgagggaccacacgggcctccgcgaggttcctgcgcccggaggccttagaaacaaacggaagactttggctcctttatgatttacacacctggcgtaagttaggcctttttggtatgctgaaacacgcgggagattatttcttgagcaacagtgaattaagckcatttattcatttttaaataaagtgaaaattggaagttttttgttttccccaaatcccactgcccaccccccccgccccaacccctatcccccgtttttttctactgtgttgaagacttacagttctaggaggcattctactttcagtcctggagctttgagcccagtattggggatgtgaacggaaataccacacccacctgagagtttaaacctgttggaatgactgatgggtcagcatgtctgcaggcaggttgactatttcactctaataaagttgtctctcctttttcctctcac

SEQ ID NO: 130987 - DNA, 601 bp, Human
gattcaattgacgagaatttaactctgcaaaatcaagctgagaatattgttccattctactttaaaaaattatttattaacttactaatttatctttaagtagcttccaacagtattcataatttgtctaaaggataaaaattccaatcatccacaacacaatttttctggtaaaaatgaaacaagttatattggtcttttcttaaataaaattgcctcaaggttatgcccctgcaagggaaaaactgttagtcacactggtgttggtaatccaggtgttagtgttgattctttatttgtytaagcatcttttggtggaccccagctgattttgggtgtggtttagtgtctgggctagagaacatggttgaactctctgcactgagggcattaaagctgctccttggtttccaacccaatacccctgagtaattactaaatgctccctgggagagcatttgctttccacagaaaagaatcttgctgcctggggagaggggaggagaacctggaggagtgtaattgaaaaatgctccttgggtgattctggttcctcctcccctccctaccctctgcttcagggaatattaaagcagtcatt

SEQ ID NO: 130988 - DNA, 601 bp, Human
aatcaagctgagaatattgttccattctactttaaaaaattatttattaacttactaatttatctttaagtagcttccaacagtattcataatttgtctaaaggataaaaattccaatcatccacaacacaatttttctggtaaaaatgaaacaagttatattggtcttttcttaaataaaattgcctcaaggttatgcccctgcaagggaaaaactgttagtcacactggtgttggtaatccaggtgttagtgttgattctttatttgtctaagcatcttttggtggaccccagctgatyttgggtgtggtttagtgtctgggctagagaacatggttgaactctctgcactgagggcattaaagctgctccttggtttccaacccaatacccctgagtaattactaaatgctccctgggagagcatttgctttccacagaaaagaatcttgctgcctggggagaggggaggagaacctggaggagtgtaattgaaaaatgctccttgggtgattctggttcctcctcccctccctaccctctgcttcagggaatattaaagcagtcattggtccaagatgctttcagttttaactttta

SEQ ID NO: 130989 - DNA, 601 bp, Human
ttgaactctctgcactgagggcattaaagctgctccttggtttccaacccaatacccctgagtaattactaaatgctccctgggagagcatttgctttccacagaaaagaatcttgctgcctggggagaggggaggagaacctggaggagtgtaattgaaaaatgctccttgggtgattctggttcctcctcccctccctaccctctgcttcagggaatattaaagcagtcattggtccaagatgctttcagttttaacttttataagaaattgaatataagaggaaaaacatttttttttgtctcagtaagtaccaaactcttattttttcttttggtctttgagaaactatctaaattgatgtttatacaaatttacattatacttttttgcttcactaggaaatggccatccatccttcatgagaaaggatgggaaaagatgccaaacatttaatgacaaataaaaccctaagtaacagattccagacagcagacagaaaattctaagtggataagggccaaaaatgcttcattgtaaactcagtatccacttacactcttaccaacaatataaccatttcacaaaagctttgaattc

SEQ ID NO: 130990 - DNA, 601 bp, Human
cttaatatccattgtatcaaagcaaattaaaacaaacaaaagagcacatcaccatgttttgccgtgtttattcagattttcatatttttgaaggtgtgatttaaacttctatacctttctgtagatctgcttaagtagtaatgagcctatgtatgttttaaagtagtaaggatactttatattataaagcaatttcaaatttccaaagttttgttctctctataattttggttgactgctacaacatccatttgaaataggaaaggactttacagctcaatttttttaataacaaagttgrttttccaagaggttaattcccatatgtaattacttattgtcccagagaattacatataggaaactgaaaagtcagaacttcagcccttgttcttctgttgccaggtttaatgcttcttttaagatataactgtgaaataggaactaatgtagtatacatacaaaaatgaaaccacatttattttcttacccagaaacttcctcagtacaaataaacacattaatatacagactaaggaaacaagtaaaccagatcattgttaggatcaggatccttttctgtagaaagatctgccagtta

SEQ ID NO: 130991 - DNA, 601 bp, Human
aaaagagcacatcaccatgttttgccgtgtttattcagattttcatatttttgaaggtgtgatttaaacttctatacctttctgtagatctgcttaagtagtaatgagcctatgtatgttttaaagtagtaaggatactttatattataaagcaatttcaaatttccaaagttttgttctctctataattttggttgactgctacaacatccatttgaaataggaaaggactttacagctcaatttttttaataacaaagttgattttccaagaggttaattcccatatgtaattacttaytgtcccagagaattacatataggaaactgaaaagtcagaacttcagcccttgttcttctgttgccaggtttaatgcttcttttaagatataactgtgaaataggaactaatgtagtatacatacaaaaatgaaaccacatttattttcttacccagaaacttcctcagtacaaataaacacattaatatacagactaaggaaacaagtaaaccagatcattgttaggatcaggatccttttctgtagaaagatctgccagttagcctgaaatacagaggaaggcgttgcattgtattgtg

SEQ ID NO: 130992 - DNA, 601 bp, Human
tactaatgtttgaagttatcttttgcagctggaactggatgcccaagtgtatactccatcacatacctgctattgagctctttgcatagggctcttccagaacctggaccatgtctgtgagcagcatggcaggcacctaggtgataaggcgggtcatcacatgatctcagggagtttgtgggtgtttcttttgagttttattttggttctgatgatctgaggtatcccccagaaatcaagctgggtcttggagtctttattttccttgcattctgtgatttttgagaattaaaaaaaaaaatcagaggagtacatcacttaatttggcgtgtcggaaggatctttgcacattacggtgagcatcagaaatcagaaaatctgtattctcactcttaatgtacccagatctagttttggcaaacatttactaagcattgttatgatttgcaagaacaaagtcctttctactttcttgcctttctccagaataaggggctctagcaaatgtttctctttaatgtgttggaaaactatagttatgggttgatgctctgcagacatcaataggaaaacacacttaaggaaatgaatgctataaaga

SEQ ID NO: 130993 - DNA, 601 bp, Human
tcaataggaaaacacacttaaggaaatgaatgctataaagaaatctaactggctagatccgagggtgacagctcagcagacgtgagtacttgcagctttttcattctctcctttgcctccttgttcgttaaagaggaaatggtgggagaaaaaatgtctttattgtttatgtctagcaaaatgaagcatctttttctgtgtcaaactatatcaaaagatagtgaagttaaagtggattttattccaggtaaaagtagacattctgaagtatttattggacctcctcgttactgtggctttkgttctgttgcatattctggtctacttccccttcattgttgaatcatgaaatatgaaattgttaaatttattgaaattctttgtggtcaatcttcagataacccaaacatggaaacctttcactcaacttgtcctacatacccttagcattccagccccatgggcctgtttttagtttctcagccataccgagccttaaatgtgtccgtttaacacctgtgcttgctatggtctccttttcttcaccctcccaaccctcctgtaaatgtaaacacctctcagctttgagatgtcaaagcaa

SEQ ID NO: 130994 - DNA, 601 bp, Human
gttaatagtgacattgctgtgccaaataaacatttcttatatcagcaaaggcagaagatagagcaatatagcaatacataatagcaattccttttggaagtgtcagagttcttttatgttttctcatgtcatgtggatgtattggaaggactaagaactctattgttagaatgacaatttcatatgtcaaaagacaattactagattggattcaggacatgattgaatcctttagcaagtttctaaaaggcagggatgtgtggtgctgtttaaagtcagtgtcatagactgtaactcagtrtttagaatactgaaattaaatttgaaatccagctgagctctcaccatgtcatgctatttcgaatgtaatatgtcacgtatattaaacacataccatatggttctgcagtcacagtcctagatgctttatactcattatctcagttaatcctcatcaccaccacagaaaatagattccttcattatcctcattttgcaaatgagagaatagaggcgtaaaagaaagcctgcctcaaacactcagctattaattattagagctgggatttgaacacagataaagttgtaattatcatgttat

SEQ ID NO: 130995 - DNA, 601 bp, Human
gtctcttcctgacaattgcatgtcaggaagaaacatgcaattatgtatcaagactgttgttgtttcccctaaaactaaggtatgggtgtcactcaggagagtatttattgttactgtttacagtgattggatgagtgagtgaacacattgacatgaaaggactgacctttactaactaaaagggggttcaggcaggaagtcgttactggatttaaagggcctgtctctccacttggcagctccctcaagccagagtctctcctttggggttcaggcttactgagaatcattagattaggcyattgaaaacttagaggctattcatgctccacagccacttagaaaaaagcaatataaagttttacttttttagatgttatatatagttactatccacagtttatagtgggagattttagttttaataatggttggggacaatgcaacattatggtaccaattcagctcactacaatggaccattctaggatttattatcaaaacgacacctacgtactgttttttaatacagcatgtgttctgataatgttgtttatgggatcaatagtatcttggagctgtcattggtcagtttgattgt

SEQ ID NO: 130996 - DNA, 601 bp, Human
cttgtgttgagattatgttttcaacatgcctgtgttcaggctctcccatttcaaaatactccatggaaaacttctttaactgaaatatagcagtcttgtcatattcttaacttactctaaaaatgtacagtagcaggagctcagggtcagaatatgaattcagtttttctgtgttcacatattgtagttaaggaatatctccttgtatgtgaagttataagaaatgttacctggatattttggacaaattgtatacctagttttaaaaaataaataataaaaaatattctttagtttgaawgcaaatgatggacttttgttagtaatgtttgattacttgtttgttttttttttttttttgtagggagcttggaaatgtgtggggaaattgatttcattaattcattcactaatttttaaacatgtatacctttattaagcacatgtgcacctttattaagcacatgtgcaattccaggcacctgggttaggcaccagtaattacattaaagaaaaaaatcccaacttaccaaacaccaccactataaaaataccaactacctctttgtgaaaaggtaattagtataaataaaggatctgc

SEQ ID NO: 130997 - DNA, 601 bp, Human
tccatggaaaacttctttaactgaaatatagcagtcttgtcatattcttaacttactctaaaaatgtacagtagcaggagctcagggtcagaatatgaattcagtttttctgtgttcacatattgtagttaaggaatatctccttgtatgtgaagttataagaaatgttacctggatattttggacaaattgtatacctagttttaaaaaataaataataaaaaatattctttagtttgaaagcaaatgatggacttttgttagtaatgtttgattacttgtttgttttttttttttttttgtagggagcttggaaatgtgtggggaaattgatttcattaattcattcactaatttttaaacatgtatacctttattaagcacatgtgcacctttattaagcacatgtgcaattccaggcacctgggttaggcaccagtaattacattaaagaaaaaaatcccaacttaccaaacaccaccactataaaaataccaactacctctttgtgaaaaggtaattagtataaataaaggatctgcttaaattccaacaaataagagtaagtaggaagttgattgctactgggaaactatttcac

SEQ ID NO: 130998 - DNA, 601 bp, Human
atgttacctggatattttggacaaattgtatacctagttttaaaaaataaataataaaaaatattctttagtttgaaagcaaatgatggacttttgttagtaatgtttgattacttgtttgttttttttttttttttgtagggagcttggaaatgtgtggggaaattgatttcattaattcattcactaatttttaaacatgtatacctttattaagcacatgtgcacctttattaagcacatgtgcaattccaggcacctgggttaggcaccagtaattacattaaagaaaaaaatcccracttaccaaacaccaccactataaaaataccaactacctctttgtgaaaaggtaattagtataaataaaggatctgcttaaattccaacaaataagagtaagtaggaagttgattgctactgggaaactatttcacttatacgtattcaacttctaaacagttactgtggctacagatacaaagaatgtgattatttctgattttgttgccaggtgagaattcgatctttatttttaaagcccttaggggcaacagagcttgtttgtttcttggctattttagtttgtaaattctatcag

SEQ ID NO: 130999 - DNA, 601 bp, Human
caggcacctgggttaggcaccagtaattacattaaagaaaaaaatcccaacttaccaaacaccaccactataaaaataccaactacctctttgtgaaaaggtaattagtataaataaaggatctgcttaaattccaacaaataagagtaagtaggaagttgattgctactgggaaactatttcacttatacgtattcaacttctaaacagttactgtggctacagatacaaagaatgtgattatttctgattttgttgccaggtgagaattcgatctttatttttaaagcccttaggggcracagagcttgtttgtttcttggctattttagtttgtaaattctatcagcaaatctgcatactaagtgcaccttaattatttgattctgactaaaaatgactaagattttgttgtcattcttcccttctcttcttccacttgccatttcctctttctcctttttcccttcttccttcatcttctccaactactataacttaccagttagaggaagtatcaggcattaagtgtgcaagaagtactaccctgagatttttgcataggttaattctgctaaccaacacaatgaccggaggtaac

SEQ ID NO: 131000 - DNA, 601 bp, Human
tatgacatagatgaaatcaagggagtttctctttatctaggtttacttgttagccaatgaaagtgcttttaaacttgaacctctctaaatatttattattgtctgctgacctctttcattgagtaattcactgaatagaaaaatttaacgcttaagccaagcagagtcattgggtatgtaaatatggcaagtcatagtatttgaaaatagtgaaagactatgttcacttgggatttggtaggacttttaaaaataaaaataatagtagtaagcagcaacagactgtaatacaaactaggakgcatgaagattgtagtgctgttggttattatttgatagatgagcactcttgaacacagtttaatccaatttacttagagtttatatgatattttttgtcatctaagaagcattgaaaaaaatgacagtatgtccaaaattttcagaaaaatcttaaattgtggttctcagggaaacctgtggtttttctcacatgtaaaataagtacaatttaaataataaggtaattgcataatttccctattatgtaattatataattacataataataatgtaacaatgtatacataatgcaacaat

SEQ ID NO: 131001 - DNA, 601 bp, Human
cataatttccctattatgtaattatataattacataataataatgtaacaatgtatacataatgcaacaatttaaacaaaattggagctcaaaaaataattctgaaagaatgaatgagtctataaaatttggtgaatgtacttggctgaatttggataatttaagcccatataaattctacttgtcacaaaaataaattttaaattactagaagtgttattcttgcctttgctcttgaggaaagaacttaaaagttatgggatagcaaagtgggagatgcagaattatgagataatattayttgaattatgtaaattgtttatgtaatctgaatattagcttacttcctaacttttcttaaatttactggtcgccctctgtgacttcaggtagcagataaaaaaacagccctaaagctaaggagagaaggaagcctgcagtgtgggaagggaagccattaaaactttcctcaaagaacagtggcagctatattttgcagagtgctgggaaatggttattatcacatctctgtgctttctggaggttaaaacatttgacagcatgaagtccgattatatataaatttacctaaaagttagaa

SEQ ID NO: 131002 - DNA, 601 bp, Human
ggggtttctgaggaaatggctgttcccctgttttatgcagagggactgtggattctgcttgtaccttgtttatttatgggttactagagattggtgagtgtttcaaataaacagagtttattacagaaatttatgtgatttgatttattccaattggaagaaacagaatggtgaaacatgaataaatttctacttattgtatctttaattagaatattctgtcagagtctccaaaattttaatctatagatcagtgttgtttcaaaataaaatgttaatagcaaaatgacaaaacataagktatccatatccgtcaaactatttatcccattcctaggaatttgttctgtttttacatagaagtgtaagaagctataaagatattcataacattttttatacttgtggaaaaaataaaaacatctaactacctaccaagacttcaatatgtctacaatgcaattttatgcagccatggtatagaagtataattatgatatgaaaagatatccatcaaatattcactcaaatgggttttaaagcagtatgttctatatataagtatattcaagcatgaacaacttgaaaattataatagcag

SEQ ID NO: 131003 - DNA, 601 bp, Human
gcagagggactgtggattctgcttgtaccttgtttatttatgggttactagagattggtgagtgtttcaaataaacagagtttattacagaaatttatgtgatttgatttattccaattggaagaaacagaatggtgaaacatgaataaatttctacttattgtatctttaattagaatattctgtcagagtctccaaaattttaatctatagatcagtgttgtttcaaaataaaatgttaatagcaaaatgacaaaacataaggtatccatatccgtcaaactatttatcccattcctargaatttgttctgtttttacatagaagtgtaagaagctataaagatattcataacattttttatacttgtggaaaaaataaaaacatctaactacctaccaagacttcaatatgtctacaatgcaattttatgcagccatggtatagaagtataattatgatatgaaaagatatccatcaaatattcactcaaatgggttttaaagcagtatgttctatatataagtatattcaagcatgaacaacttgaaaattataatagcagtgattatctcaggatagtggaggcttattttctctt

SEQ ID NO: 131004 - DNA, 601 bp, Human
ctcaagcccttcacctctttcaagtaaatggcagttatcccaacgtccaaccaggccaagcactgtagcctcatgttacctctcctacccgttccctgatagctacttttccccctcctctgttccagccacattggcctctgctgtcctctgacaccccaggcatgctcctgccttgccctttgcacttgctcttccctctgcccagaacacaatctctctaaattgctcgtggcttactctcggagctccttcagactttcttcaaatgccagcttctcagtgaggccttcctggctgytgtccttgagctctccactgctctactctgctttatttttctccaaagtataatacttagcattatatgttatttattaattttatgttgtgtctgttttcccagaatatatgtattgcaagaagtcagggatttttgtctgttttactaaagattgtacccctagtacccagaacaatgtctggcacctaatagggactcaacaaaacttgctaaacatctattaacccaaaagttatttaatttattatatttaatggcaggtattgtattgagcagtagagtactatgtactgttaa

SEQ ID NO: 131005 - DNA, 601 bp, Human
cactgtagcctcatgttacctctcctacccgttccctgatagctacttttccccctcctctgttccagccacattggcctctgctgtcctctgacaccccaggcatgctcctgccttgccctttgcacttgctcttccctctgcccagaacacaatctctctaaattgctcgtggcttactctcggagctccttcagactttcttcaaatgccagcttctcagtgaggccttcctggctgttgtccttgagctctccactgctctactctgctttatttttctccaaagtataatacttascattatatgttatttattaattttatgttgtgtctgttttcccagaatatatgtattgcaagaagtcagggatttttgtctgttttactaaagattgtacccctagtacccagaacaatgtctggcacctaatagggactcaacaaaacttgctaaacatctattaacccaaaagttatttaatttattatatttaatggcaggtattgtattgagcagtagagtactatgtactgttaatcttgctaaaatatacttaaatatatcattttaatttagggagggggatatgacatcatt

SEQ ID NO: 131006 - DNA, 601 bp, Human
catctattaacccaaaagttatttaatttattatatttaatggcaggtattgtattgagcagtagagtactatgtactgttaatcttgctaaaatatacttaaatatatcattttaatttagggagggggatatgacatcatttctgctctctcactagaattttaggtacatgatgatgtttaaacaaatttgcccaaaaaaaccaaattctatttcagagataaagccattgtttatacaattattatacttatagtagctatttttttaacttcaacttttctcttctgtctttcttrtttttgttttccagaaaagaggcacagttagatgaagaaggacagtttcttgtcagaataatatatgatgactccaaaacttatgatttggttgctgctgcaagcaaagtcctcagtaagttgaatgcaactttccttctttggccaagttacacgtagaagctcacagaatgcatggttcaagatcacaacgcagggttacagaagtggtgcagagcatttgtacaacctgcatagttgtgtggtgggcatccacatatcatgttaggctcaggctatgccaagtcttatttttccttt

SEQ ID NO: 131007 - DNA, 601 bp, Human
acagttaatgggaaatcacatacattttaaatgtgatggtagttaagacaacttttttgagaacaattttgcctcatgaaagccttttaaaaaaatattaaaaccttcagtaatttttcctaaataaattattagatctctttccattaagatttatgtatgtgttttcatgtcagagttccatatattatcaaaaactgaaaaaaagcctacattttcaataagaagggattggttaaataaattattgcatccatatgttgaataagatagcaattaaaactgatacacagcactttgrgaggccgaggtgggtggatcacttgaggccaagagttcgagaccatcctggccaacatggtgaaaccccctctctactaaaaatacaaaaattatccaggtgtggtggtgggttcctgtggtcccagctactcaggaggctgaggcaggagaatggcctgaacccgggaggtggaggttgcagcgagccgagatcctaccagtgcactacagcctgggcgacaaagtgagactctgtctcaaaaaactaaaaaaaatgtgatacagaaaatttaagttttaggaaatattaatgattgtt

SEQ ID NO: 131008 - DNA, 601 bp, Human
gttgcagcgagccgagatcctaccagtgcactacagcctgggcgacaaagtgagactctgtctcaaaaaactaaaaaaaatgtgatacagaaaatttaagttttaggaaatattaatgattgtttattaagaaaaaagcaggacaccagggtacatgttatatgtaatcaagttattaaatatacatatttatataaagacttttgtatcaaaatattgtcatgtgcattcttgatgattttaaaaatctgtgttttttggaaaaaagaagtagtatatcaaatatatgctttaaaatggycaaaattaagtacagggtgagtatctcttgtctaaaactcttgagaccagaagtgtttaggctttcagattttttttggattttggaatacttgcatatccataagaagatatcttgaggatgggattcaagtcgaaacataaaattcacttatgtttcatgtacaccttatagacataggctgaaggcaattttgcacaatattttaaatgattttctgcatgaaacaacattttgactgcaatccattacacgagttcaggtgtagaattttccacttgtagtgtcacgttggtgacc

SEQ ID NO: 131009 - DNA, 601 bp, Human
atgatacaatcttgcgtgtcctgggctctaatgtcagagaatttctacaggtaagcaatttgaggtcctatagttaaaagttctgtgtttataactctcaaatatagactctagaatacttttgttcactcagctgtacaagagtgtcttgcttctgaaatggaatcgtagtcacctttttctaattcacataaaatcatcgttattggagcgtctcgaatacattttagcattatattttttctttaacttctggttgctgatactgaatatgcaagttgtaaattaatgttccctgaaraactccaggtggtcttttgtgatctgttcaactgccctttttttggggtaatggctctatatcctagtgattgtggttttatgtgttagacatttaatatggccttattttctatttacaaaacattcctagtttgtagatataatcgagcaatgtatcagtatttatgaagttctacctggagctcaatgtttaggaaaaagtagtagggttttcaggtgttctgtcaccaaaacatacttaagatccattatcattagttaaatattaattaatctactgtacgagggaaaataggaa

SEQ ID NO: 131010 - DNA, 601 bp, Human
tcttgcgtgtcctgggctctaatgtcagagaatttctacaggtaagcaatttgaggtcctatagttaaaagttctgtgtttataactctcaaatatagactctagaatacttttgttcactcagctgtacaagagtgtcttgcttctgaaatggaatcgtagtcacctttttctaattcacataaaatcatcgttattggagcgtctcgaatacattttagcattatattttttctttaacttctggttgctgatactgaatatgcaagttgtaaattaatgttccctgaaaaactccagrtggtcttttgtgatctgttcaactgccctttttttggggtaatggctctatatcctagtgattgtggttttatgtgttagacatttaatatggccttattttctatttacaaaacattcctagtttgtagatataatcgagcaatgtatcagtatttatgaagttctacctggagctcaatgtttaggaaaaagtagtagggttttcaggtgttctgtcaccaaaacatacttaagatccattatcattagttaaatattaattaatctactgtacgagggaaaataggaaacagtccaa

SEQ ID NO: 131011 - DNA, 601 bp, Human
ttcataggacactctatttccccagccacagtagttttcatactgcattatcattcccatttgatggactggaatgtaaacttcaggaagccagagatcatgtataatctcttaatgtttgtaccttcacagatgcaatctgtatatctgagaataaatgaatatcttttttaaaaaagtgaatatttgttgtttgtgcaaaagcagaaaacacacaataggaagcaaacacaccaatagatcaagctgaattatttgcctcaggataacccatttcgagtgagatcctgtaattttttttacggatgaatcatagattgaaatataaaagaagagacatacactagaccaatttccttttcaggtgaacatcctaaattactgtttattatttaatttacagggtacattgcttgtatctgttgacacttttaaaatggtcgttctgacatttccattttaagcttttagggaacactaaaatagctactgaaatcataacatgggagactatttgattatgccttagctgagcaactctgactcactcatcatagcaagcagaatttccttggaagttgcctgtccacagcctctcagt

SEQ ID NO: 131012 - DNA, 601 bp, Human
aactagcgcctctgttcagcctgccatgggattttcttcaattcctgttggctccaggttttgacttattaaatacaacattgtgatttggccaccaggaacaatctgagattgatgactgatctaattcttaaatgtttgtgcaaagggttattttaggaaatatgaggattttcctgaacagctgtaaaattctaatacttccctaaattatttatatttcttaagaaaaaagagcaccattcactttatttttaactttggaattttaaaaaagagctgttttctcagcatccacaaygccaatttctataatccaataataaaaatagttttattttttaaaaacttatgaaggaagataagaagtattccagaattgtaaggcttttcagtttgaataactggtatatattttcataatttttcaaaatattgattaattgttacatgtagtattatatagactggatcttttttaacatgagtttaaaagcaatagaataagagaaatattttaactgtttttctttaattaaaatatttccttggagaggatggtaatgataaattgatatagctttaaagctatttccattta

SEQ ID NO: 131013 - DNA, 601 bp, Human
ctcagcatccacaacgccaatttctataatccaataataaaaatagttttattttttaaaaacttatgaaggaagataagaagtattccagaattgtaaggcttttcagtttgaataactggtatatattttcataatttttcaaaatattgattaattgttacatgtagtattatatagactggatcttttttaacatgagtttaaaagcaatagaataagagaaatattttaactgtttttctttaattaaaatatttccttggagaggatggtaatgataaattgatatagctttaamgctatttccatttaaataattttagtgactctggtacagtttctttttaaatagagattttcaatgtttcttttagaaaagaatctctatatcttttcagttgaaaagctatttaattctcaagaagcagctccaggaagaaaaggcaggaaaagtattatgaaagcattcacttcctactccaatctcatgctatttactttggtgtttctcatcatctagggtttgatgttccattttacttaggtcgactttgtttaaatgttttatcttcaaattccaaaatgacttttttcttat

SEQ ID NO: 131014 - DNA, 601 bp, Human
gaagtccattgcaggtcttactggactatattcagcgtgctgtgctggtgggacgggactgtgtttctttatgttggcttttggggataattgttttcttcctcattcaagtattgacagaattcagttccatgcagttatagggctgaggacccagtttccttgactgtcagcaggcagctgccctaaagtcctggagacctctctccagtccttcaacagtctcctacatctcagaaccagtcgcatggtgttgaatccttctcatactcccatctctttgaccttttgtcattgcacrtctctctgtcaccatgtagcagggaaagcttcttgacttttaagtgcacagtcacccatgtgactaggttgggctcacctggataatccaggataatcttcccaactcaaggtccataaccctcatcacatctgcaaaatccctttcaccatgcgatacaacatattcacagggattaaggcaagggaatctttcagagacagttgttttttcagcctcgtctgaaatgtgctaagtgctttatatacatgtttaaagttatctccattttgccagaagaaataaagtcttagaaaaatt

SEQ ID NO: 131015 - DNA, 601 bp, Human
ccaaaacagtggaaagaccagcaatcttctatatttggcctgggagtgcattatacaggatatttttttccttctggcagcagatttttctttctaattatatagtgttcaaggctacaagaaatttactttgcattccctgtgaacacacaccagctgggaagcagaaggatatgtgacgactgagctgtgggtttcagcatgcaaaatatccataatatggatagtcaaattctaaggcaatataaaattaagtattattttatagatcattttctctttgtcgatttttgtctgcccygaaatatagttggaatgtctaattttgtgaatgaaagtgtttgtttttgtttttgtttttaatcaagttacttggtgaaagaagccaggtctggtactttaaaaattgtgctgttattgataatacacactcttagttttgagtgatgatttcaaggtactgatagggcaaccgtacaacaaagagaaccactgtttctctttacctctggcccttacggtttctcccagtcaggctgctttttatgtgttcagcatgttcatacccaagagtcaattctcagtagctttaaacttgagg

SEQ ID NO: 131016 - DNA, 601 bp, Human
ttttaatcaagttacttggtgaaagaagccaggtctggtactttaaaaattgtgctgttattgataatacacactcttagttttgagtgatgatttcaaggtactgatagggcaaccgtacaacaaagagaaccactgtttctctttacctctggcccttacggtttctcccagtcaggctgctttttatgtgttcagcatgttcatacccaagagtcaattctcagtagctttaaacttgaggccaaagtggggagatagatacctttttccaacctttctttgtttatagaaaacctawtagacagttctttcttatagatcatagatatattgtaacacacttgggaggtctaaaacccttaagtggagtattatccaaaattaaaatagtaacatttaaataaattagaaagatattccacatatttaatctagtaaagttatgttagagttcatggttttctttctttcagaagttggtgttagttcttacgtggcactttttggtgatttccaggtgcatcgttagttttctacaaccattagtaatggcggaaaccacgattactgttgcaccaacctaatagaaagtaggact

SEQ ID NO: 131017 - DNA, 601 bp, Human
tcatacccaagagtcaattctcagtagctttaaacttgaggccaaagtggggagatagatacctttttccaacctttctttgtttatagaaaacctaatagacagttctttcttatagatcatagatatattgtaacacacttgggaggtctaaaacccttaagtggagtattatccaaaattaaaatagtaacatttaaataaattagaaagatattccacatatttaatctagtaaagttatgttagagttcatggttttctttctttcagaagttggtgttagttcttacgtggcacyttttggtgatttccaggtgcatcgttagttttctacaaccattagtaatggcggaaaccacgattactgttgcaccaacctaatagaaagtaggactgtgtataacatggcattatcaaatgcagacatttaaaaattaaagccttgggtaaagtatcacaattcatccatgattgggaatctcactggtattcaatcaaaatagtatatacctcacatttccaatctttttttttttttgagacagagtctcactctgtctcccaggctggagtgcagtggcgcgatctccgctcactg

SEQ ID NO: 131018 - DNA, 601 bp, Human
agtatcgcctgggcgcagtggctcacgcctgtaatcctagcactttgggaggccaaggcggggggatcacgaggtcaggagattgagaccatcctggctaacacggtgaaaccccgtctctactaaaaatactaaaaaaatagccaggcgtggtggcgggcgcctataatcccagctactcgggaggctgaggcagaagaatcgcttgaacccgggaggcacaggttgcagtgagccgaaatttcgccactgcactccagtctggttgacagggtgagactccattatcaaaaaaatagaraaaaaaaaaaaaataaagcaaaacaaaacgaaaaacaaaaaaaaacacagcatctatactgagtgaacgtatatgcatattgtatgcactgttggttttatttttatttaaccagactgagaaagaggtaggttcatagaaacttcagaaagaaacacaaattaggacacacttggaaactactattactgtggtattagaatctttggcatgggagattgatggctttagcaaactgtatgaaattcaagtatttacttaattatatggttcactttataaaatatttaaattctcttc

SEQ ID NO: 131019 - DNA, 601 bp, Human
cgcagtggctcacgcctgtaatcctagcactttgggaggccaaggcggggggatcacgaggtcaggagattgagaccatcctggctaacacggtgaaaccccgtctctactaaaaatactaaaaaaatagccaggcgtggtggcgggcgcctataatcccagctactcgggaggctgaggcagaagaatcgcttgaacccgggaggcacaggttgcagtgagccgaaatttcgccactgcactccagtctggttgacagggtgagactccattatcaaaaaaatagaaaaaaaaaaaaaaataaagcaaaacaaaacgaaaaacaaaaaaaaacacagcatctatactgagtgaacgtatatgcatattgtatgcactgttggttttatttttatttaaccagactgagaaagaggtaggttcatagaaacttcagaaagaaacacaaattaggacacacttggaaactactattactgtggtattagaatctttggcatgggagattgatggctttagcaaactgtatgaaattcaagtatttacttaattatatggttcactttataaaatatttaaattctcttctgaccatttattc

SEQ ID NO: 131020 - DNA, 601 bp, Human
tgggaggccaaggcggggggatcacgaggtcaggagattgagaccatcctggctaacacggtgaaaccccgtctctactaaaaatactaaaaaaatagccaggcgtggtggcgggcgcctataatcccagctactcgggaggctgaggcagaagaatcgcttgaacccgggaggcacaggttgcagtgagccgaaatttcgccactgcactccagtctggttgacagggtgagactccattatcaaaaaaatagaaaaaaaaaaaaaaataaagcaaaacaaaacgaaaaacaaaaaaaaacacagcatctatactgagtgaacgtatatgcatattgtatgcactgttggttttatttttatttaaccagactgagaaagaggtaggttcatagaaacttcagaaagaaacacaaattaggacacacttggaaactactattactgtggtattagaatctttggcatgggagattgatggctttagcaaactgtatgaaattcaagtatttacttaattatatggttcactttataaaatatttaaattctcttctgaccatttattcaagtgcttcaatatgaacttctgaaatatttg

SEQ ID NO: 131021 - DNA, 601 bp, Human
aaaatagccaggcgtggtggcgggcgcctataatcccagctactcgggaggctgaggcagaagaatcgcttgaacccgggaggcacaggttgcagtgagccgaaatttcgccactgcactccagtctggttgacagggtgagactccattatcaaaaaaatagaaaaaaaaaaaaaaataaagcaaaacaaaacgaaaaacaaaaaaaaacacagcatctatactgagtgaacgtatatgcatattgtatgcactgttggttttatttttatttaaccagactgagaaagaggtaggttcrtagaaacttcagaaagaaacacaaattaggacacacttggaaactactattactgtggtattagaatctttggcatgggagattgatggctttagcaaactgtatgaaattcaagtatttacttaattatatggttcactttataaaatatttaaattctcttctgaccatttattcaagtgcttcaatatgaacttctgaaatatttgcattttataggtatattttatgtgtttaattttttcaaaagcactgttttgacttctcgagggattctcacattaagtttatcaggtccag

SEQ ID NO: 131022 - DNA, 601 bp, Human
ttaggacacacttggaaactactattactgtggtattagaatctttggcatgggagattgatggctttagcaaactgtatgaaattcaagtatttacttaattatatggttcactttataaaatatttaaattctcttctgaccatttattcaagtgcttcaatatgaacttctgaaatatttgcattttataggtatattttatgtgtttaattttttcaaaagcactgttttgacttctcgagggattctcacattaagtttatcaggtccagagataccagacaatttgaaccacatrgttaatactagatcatgtcataaagtgatataccaatgagaagttaaaaatatgattagaaaagctatttgttttgccagtttgatcaaagcaaaaaaattagaattgaataattaattcataagtttaggatacatataattcaatttctctagttaaatagaaacagagtagaacatcaaaagtaggcctgtcatttaaggttgactctcttgccttgtctatgagttagggaaatcaaccttaatgtggtaaaattttcaaattataaataaggatactaatatttaaccagtatag

SEQ ID NO: 131023 - DNA, 601 bp, Human
aaatcaaccttaatgtggtaaaattttcaaattataaataaggatactaatatttaaccagtatagtaagttattctgacagtgaggtagtaacatcccagttttgctacaaaatatatctaaaagaatatatacaatagcatctatagttattgtgatttgtttttaaaaattgcagagaatgcgacagggtactcctgaaaaaaaaaaaagaaaagaaaaatgaacaacattttgtttttatttagctgtaactgaagaaatgttgtcccaaactttttctgttttgggtctggttgcmgttgagatcgagttttccctttgtaagagggctcattgcttgcaatttcttaacccaaaaagaagaggaaaatctatactttaataatgtatttgcctgtgaataatactttagaaaagtaggatttttttacattatagatattagctcacaattacgattacttctttagaatgaattcctagatttgcaattaaatcaaagaatccacaaaattttaaggaatttttatgcctattgtcaatttatccttcagaaagattaatcaaaataccccctcatcagtggtatttgagatgc

SEQ ID NO: 131024 - DNA, 601 bp, Human
atactttagaaaagtaggatttttttacattatagatattagctcacaattacgattacttctttagaatgaattcctagatttgcaattaaatcaaagaatccacaaaattttaaggaatttttatgcctattgtcaatttatccttcagaaagattaatcaaaataccccctcatcagtggtatttgagatgcctctttttcagtaccttacccaatttaatattgtaacttttttttctttttttgagacagagtctcgttctgtcgcccaggctggaatgcaatggcatgatctcgkctcactacaacctctgcctccccaggttcaagcaattctactgcctcagcttcccgagtagctgggattataggcacccaccactgcgcctggctaatttttgtatttttagtagagatggggttttgccatgttggccaggctggtttcaaactcctgacctcaggtgacctgtccgccccaccctcccaaagtgctaggattacaggcgtgagccactgcacctggcctggtattgtaactttatgtatttgatagttgatggttaaaaatgacattgcatttatttttgaatatgaa

SEQ ID NO: 131025 - DNA, 601 bp, Human
tgtattaggtaatatgcagtttattgtaagttacacaaattgtttaattgtgaactaagtgtatttgagcataccacaactttccctaggacaactatttttttataataatcacatacagaaacagtaggaatgttatgtaagaatagtatacttgttacagtgaaaaaaaatgggtaactttttagtaacagtcacctttcacatgtttatttattcactgaataaatattcattggatatctaccatctgtaaatagctttaaaaatcaactattgatggtgttaagggaaaaggggrgattttaaaaagaactaaaacacaaaatgatagagatgatgatggattcagtagaaaaagcatcaaaggaagcagttgggatgatgatgagaaactgctgttgacttctatgacagatccattggtaaaatcctttatgcttactctttttttcttaaatactaacttttggagttgtatatggcatacgtttagagatactttttgcttgtaattaaagagacttgaaaattcaggattagcccagttggatcaggtgaaatggaagcagagtagtgtgctgtcctggctctggtattg

SEQ ID NO: 131026 - DNA, 601 bp, Human
atttattcactgaataaatattcattggatatctaccatctgtaaatagctttaaaaatcaactattgatggtgttaagggaaaaggggagattttaaaaagaactaaaacacaaaatgatagagatgatgatggattcagtagaaaaagcatcaaaggaagcagttgggatgatgatgagaaactgctgttgacttctatgacagatccattggtaaaatcctttatgcttactctttttttcttaaatactaacttttggagttgtatatggcatacgtttagagatactttttgcttrtaattaaagagacttgaaaattcaggattagcccagttggatcaggtgaaatggaagcagagtagtgtgctgtcctggctctggtattgactctacctgtcccttactgtatgaccttgaacttattacttcacttctctcagcctgtttctctttgttctggcatgagaatagaaagcatatgaaaaatacttagttcattgtaagcaatcaatcagtgttacctattgttttcacttttagccctctagataaatattaagagagggtttgctcatgtttttggtattttaatttcat

SEQ ID NO: 131027 - DNA, 601 bp, Human
atatggcatacgtttagagatactttttgcttgtaattaaagagacttgaaaattcaggattagcccagttggatcaggtgaaatggaagcagagtagtgtgctgtcctggctctggtattgactctacctgtcccttactgtatgaccttgaacttattacttcacttctctcagcctgtttctctttgttctggcatgagaatagaaagcatatgaaaaatacttagttcattgtaagcaatcaatcagtgttacctattgttttcacttttagccctctagataaatattaagagagkgtttgctcatgtttttggtattttaatttcatttcaagccatacacatttaacataacactgtacattttaaaagataaattttcattttttctccttctgaaaatgcattgtaaatttatgctagcttacatttgaatattagtcatctgaatccatatcagatttcatgttcttgtaactatttaatgtccatttaatcactgagttgtatagattgagatttgagttgatagttcagctaagtttcccttgaattataataattataattttctagttttaaatataactgagctga

SEQ ID NO: 131028 - DNA, 601 bp, Human
aaggtaatcaagatattatttcattaaatgtgagaaaggtatgtcacaaattagaagtattcaggggggaaaattatcacattctctgagaaagtatagagagataaaacccagacctcaaaggaagatctatttaaaaggcaataacattgatttttggtttgcctgaggagcagtggaactctatcaactgattaaaattaacagaggtaaattttagagactgtctttctgagacggccttgtttcacatcaaaaaaccaacatcttttactccctgtacagctacagtgccttattytagaaatcagaactaaaaaggatttttttttttggaacttcactcaaaaccacttatttattctttcttaaattgtctattgttcttagtagcgtttttgtgggtgaataaaagtgatgaaatattcacacagttgataatttagatagtgctgggatctcacggtttctgttcttgggatagatacagcaaaagtcattttcctagagtacccattgaatcctttctgtatttggaactgactgtttgcagctgctctatgaatacagggtgggagaatggggaggcttggcttattct

SEQ ID NO: 131029 - DNA, 601 bp, Human
cctcaaaggaagatctatttaaaaggcaataacattgatttttggtttgcctgaggagcagtggaactctatcaactgattaaaattaacagaggtaaattttagagactgtctttctgagacggccttgtttcacatcaaaaaaccaacatcttttactccctgtacagctacagtgccttattctagaaatcagaactaaaaaggatttttttttttggaacttcactcaaaaccacttatttattctttcttaaattgtctattgttcttagtagcgtttttgtgggtgaataaaagwgatgaaatattcacacagttgataatttagatagtgctgggatctcacggtttctgttcttgggatagatacagcaaaagtcattttcctagagtacccattgaatcctttctgtatttggaactgactgtttgcagctgctctatgaatacagggtgggagaatggggaggcttggcttattctttgagagtctggtaatgtatgttggaaccataccggaaaatcagggggataaaaaagattcacaaaagcttgaaataattatgtgaagagtagcacagttactgtcctgaattca

SEQ ID NO: 131030 - DNA, 601 bp, Human
tttagagactgtctttctgagacggccttgtttcacatcaaaaaaccaacatcttttactccctgtacagctacagtgccttattctagaaatcagaactaaaaaggatttttttttttggaacttcactcaaaaccacttatttattctttcttaaattgtctattgttcttagtagcgtttttgtgggtgaataaaagtgatgaaatattcacacagttgataatttagatagtgctgggatctcacggtttctgttcttgggatagatacagcaaaagtcattttcctagagtacccrttgaatcctttctgtatttggaactgactgtttgcagctgctctatgaatacagggtgggagaatggggaggcttggcttattctttgagagtctggtaatgtatgttggaaccataccggaaaatcagggggataaaaaagattcacaaaagcttgaaataattatgtgaagagtagcacagttactgtcctgaattcagacgggacagtcacttttctgcagtgttgcaaggcagccactaggcttattacaggcagaactctgacagaaggccctctcctgttctaatgatgcactt

SEQ ID NO: 131031 - DNA, 601 bp, Human
tttcattagtaaaatctttgattgttttattttctttataggtatgctaatttttgttttgctttatgaacattgctgctgagaatatattgcattaatccaaaattctgcaaagtcaccccttttaaagaattttggataggattaattcaaaattcttcaaattattaatcccagattctccaaagacataactaaattttttccttttagagtaattattattcagagtggccagaagtaatgactttgcattaaaaaaattcaagccaaagatataaccttatgccattttaaccarttaggttttgttgtcgttgttgttgttgtttgagatggagtctcgctctgtcacccagactggaatgcagtggcatgatctcagctcactgcagcctcctgatcccgggttcaagcaattctcctgcctcagcctcccgagtagctgggactacaggcgctagccaccacacccagctcatttttgtatttttggtagagacgcgtttcaccatgttagccaggctgatcttgaactcctggcctcaagtggtctgcccacctcgcctcccaaagtcctaggattacagatgtgagccac

SEQ ID NO: 131032 - DNA, 601 bp, Human
aaattctgcaaagtcaccccttttaaagaattttggataggattaattcaaaattcttcaaattattaatcccagattctccaaagacataactaaattttttccttttagagtaattattattcagagtggccagaagtaatgactttgcattaaaaaaattcaagccaaagatataaccttatgccattttaaccaattaggttttgttgtcgttgttgttgttgtttgagatggagtctcgctctgtcacccagactggaatgcagtggcatgatctcagctcactgcagcctcctgmtcccgggttcaagcaattctcctgcctcagcctcccgagtagctgggactacaggcgctagccaccacacccagctcatttttgtatttttggtagagacgcgtttcaccatgttagccaggctgatcttgaactcctggcctcaagtggtctgcccacctcgcctcccaaagtcctaggattacagatgtgagccactgtgcccagcctcaaagagtacatttttaaaaagcagttaactttttacttgtcagattatcactaaaataataaacattattatgttgttggaaaaatgac

SEQ ID NO: 131033 - DNA, 601 bp, Human
aattctattgtcttcagcctgatgttttgaatggtaggaggtggcaggatcagattccttgacagaaatcgggattgcattgtcatgtatataagttgagactgatcttgcctcatttctccatatgacagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccytggaagatgaaaagaaaaagacagacacgtaagaatgtaacgcttggagcactactgttattcataacataatgtgactctactatatttaagtttgagaaccagactaaaaagccatgtgacctgtaatagctctggtgtagtaaataaaatctttcacattgcttttaaaaagaaattatgcttaaggaaataaaccagtcttaatggtggtggaaatatgtctgctatttttagaagccaagttggaataatataggccaaaatatcttttggaaaatcatgagaataactcaaatt

SEQ ID NO: 131034 - DNA, 601 bp, Human
ttagattattagatttagaatttggtttttgtagatatttgggtttcaaggtgatgtcattagaaaccatttactattaattttctttaaagctaagtagttttactgttcatacttactattcaaatatagctttaatatttcataaaacattcaatgtttaaaagttgaaaatgaaagaccggagaaattctactatgactaggaaaaacattgagagctcagctccattttgcatatttaaacttcccacatatgcccttttgctttagagcaaaaggcaggaagaaaaaggcaggarggcttcatttgttcctcttcagtcttccaatccagagcccataggtctagtttctgcttctttccctctaaattcaccagctgtcatcctcctcctgtgtgctcacatttgtcccttagcatgatcccatagtagtctcagttgtacctaaagaaatacaataatttattttctagaccaacttcctctggttttatcagtttcttctatggaggagtgaggcatgaatgagactggagagaaattctgcttcttttaatattacttaccaaaaatagagacatatttcttattctaaga

SEQ ID NO: 131035 - DNA, 601 bp, Human
catctctagatatctggggtaatataactacacaaggactatttattttatagtcattttctgaggtacactctagcatgtggtgagcacatcatacaaacaaatgattaatgaccgtgataaatcactgaacttgaaatggtggctctccatgccgtcaagccatcactgttttaggtagaaatgtaaaaaattattcttctgaattataaagttatctgaggtgagaaattaattgcttactaaaggaaaaataattctatgtctgtacctgcccgtcatcaaagaccccaagtgtccrtcatgtgtgtaaattataagtaattgcaaggtttcattttgttggagttgaatatattagaattttaagagaattaaagggggagggaagcttaaagttgctggtagacttgaaaaaatatgttttttgttagggtaataaatgaaacagtcttttttatgctaaccgtgaacatctaaatatatgtactgttaggtggagactgttggtgacaagtatatgacagtgagtggtttaccagagccatgcattcaccatgcacgatccatctgccacctggccttggacatgatggaaatt

SEQ ID NO: 131036 - DNA, 601 bp, Human
tgtactacattctttcatagacatggagatttatctacctgtttgaaattatctagtccgtttcatgtactgaaagtcatggggatgagaaaaaaacctcttgtaccttctagtttattttttaaaacctctttcatgtctcatgtaagttactagattcacatctttgaaatcttcagacttcaaatgtttctcttgagataggatatttccctggggagatagagatttcatggagggcttttgaagttgtccataatatgcttgaaattcttatagacatctcttacgatgttatatsatgactctacattattctgtaatataaagtaagcaaaaattcatgtgttacaggaacagaaaaccaaacaccacatgttctcactcataagttggagctgaacaatgagaacacatggacacaaggaggggaacatcacacaccgggacctgttgggagtttgggggcaaggggagggagagcattaggacaaatacctaatacgtgcggggcttaaaacctagataatgggttgataggtgcagcaaaccaccatggcacatatatacctatgtaacaaacctgcaccttctgcacctg

SEQ ID NO: 131037 - DNA, 601 bp, Human
taaaaaataatgtttatttaaggcatggctggaaagaactccaggtttagagccacatggatttaacttctggggaaagcttgaaaaaaatatcaccagaggcctggaagaggaattcataaggattcaggtatttagatgacatgagttaatataaattcaatacagaaatattcaaaattttattttaattattttttgcttttctcttaaccttttctctttctcatatttttttcttagacaaatgtattttcttggactatgtgacatgattgatttcattttctttatgtgtgayaaatattatactaaaataagaccttcattgcacgggagaattttgtctatgataactagctgagattaatattatttttcatttctattgaaaattctatattagaaccaattttagacagaactaggcccacagtggactaacgaaccaaatctatttagccctgtagctttgcttttgctcttgtatatttactgggtgctttctggcagctctcagacaatgtcagttttctcctacttaaaagatactgttgattgctcattgcccttatctttcaggtctctcatcctcttggca

SEQ ID NO: 131038 - DNA, 601 bp, Human
ttctctatctcttttacttgctcttatttctctctcagaccaataaatggtagagttttgtagtccattggcttagatcctttctgttctatctctatactctttcattagatggtgtcatttatacccactgcttcaatatctacttagccaccataattctcaaacatttatctctggtttatatatccccttagatttcagaacatgtatataataccttacttgatatttcctcctggtcctctcaaaaacacaccaataaaaccaaacttgaacatttccccttccatccactctygtaccaacattgtcttctctgcattaaagaattttttctcctataatccatctaggctgtcgtcagactcttatcaatcagtgatccttggctccgccctcttgtttcaccacttcttcaagctatcatcaagtcctaccaatgttacctattagctctcaaatatcatcctttaatctaccactaccactcaagtgcaaccctccatcgtttttcacctggactataataatatctgaactgtgctcccccaccttcccagtatgcctctattccaatttagtctccacattgcagtct

SEQ ID NO: 131039 - DNA, 601 bp, Human
tgccatatttttcctaaaggctaaagaagagtctgaagaaaaagaggaacaggtggctgaatttcagaagcaaaaagaggtgctactgtccttatttgatgagaaacgtcatgaacatctccttagtaaaggcaggtatttttactttatgaatcttttccctggaatgtgtgaatatgagatcaagacatcattttataagactatcaagccttacttgggagaaatagaatgaaaattgatattctactgatagaaacaaaaatggagtaaatgtttttggtgataaacctattttaaygggtttccatgcccagattatttgaaaaacattagaaaaaaatttatagtctctgccagatatacgggatatcaagatgaattgcatatagtttctcaagtagttcacagcctaatagggacagaaatgaagacaaatcattgtaacagtaaacactatggtagaggtaagaaaaggaaggaatagctaccgtgaaagcaagtattgatgtcgccccattgttttagaattaagataaaatctttaacgtggtctataaggccttttatgatctcatattcatgtggtccagccatacta

SEQ ID NO: 131040 - DNA, 601 bp, Human
gaacaggtggctgaatttcagaagcaaaaagaggtgctactgtccttatttgatgagaaacgtcatgaacatctccttagtaaaggcaggtatttttactttatgaatcttttccctggaatgtgtgaatatgagatcaagacatcattttataagactatcaagccttacttgggagaaatagaatgaaaattgatattctactgatagaaacaaaaatggagtaaatgtttttggtgataaacctattttaatgggtttccatgcccagattatttgaaaaacattagaaaaaaatttrtagtctctgccagatatacgggatatcaagatgaattgcatatagtttctcaagtagttcacagcctaatagggacagaaatgaagacaaatcattgtaacagtaaacactatggtagaggtaagaaaaggaaggaatagctaccgtgaaagcaagtattgatgtcgccccattgttttagaattaagataaaatctttaacgtggtctataaggccttttatgatctcatattcatgtggtccagccatactaagtttcttttattagctaagtttagttatttggatttatcatcaaa

SEQ ID NO: 131041 - DNA, 601 bp, Human
tataagactatcaagccttacttgggagaaatagaatgaaaattgatattctactgatagaaacaaaaatggagtaaatgtttttggtgataaacctattttaatgggtttccatgcccagattatttgaaaaacattagaaaaaaatttatagtctctgccagatatacgggatatcaagatgaattgcatatagtttctcaagtagttcacagcctaatagggacagaaatgaagacaaatcattgtaacagtaaacactatggtagaggtaagaaaaggaaggaatagctaccgtgaragcaagtattgatgtcgccccattgttttagaattaagataaaatctttaacgtggtctataaggccttttatgatctcatattcatgtggtccagccatactaagtttcttttattagctaagtttagttatttggatttatcatcaaagagtctttttatgtgttctctgggcttggaatgttcctgccctctttctctcttcctccctcctttgtgtgtgggtgagttctttcatacaaatctgcttgactgaccaagataccaggaaaagcatacatttagactttcggcacaatt

SEQ ID NO: 131042 - DNA, 601 bp, Human; identical to SEQ ID NO: 103945

SEQ ID NO: 131043 - DNA, 601 bp, Human; identical to SEQ ID NO: 33786

SEQ ID NO: 131044 - DNA, 601 bp, Human; identical to SEQ ID NO: 33787

SEQ ID NO: 131045 - DNA, 601 bp, Human; identical to SEQ ID NO: 33788

SEQ ID NO: 131046 - DNA, 601 bp, Human; identical to SEQ ID NO: 33789

SEQ ID NO: 131047 - DNA, 601 bp, Human; identical to SEQ ID NO: 33790

SEQ ID NO: 131048 - DNA, 601 bp, Human; identical to SEQ ID NO: 33791

SEQ ID NO: 131049 - DNA, 601 bp, Human; identical to SEQ ID NO: 33792

SEQ ID NO: 131050 - DNA, 601 bp, Human; identical to SEQ ID NO: 33793

SEQ ID NO: 131051 - DNA, 601 bp, Human; identical to SEQ ID NO: 33794

SEQ ID NO: 131052 - DNA, 601 bp, Human
tcagtgtagccacttctttctcacatccaaaaatcacctgggatataacaggtgaatgcagaccctttaaatagtggatgtacactcagatatttccgaattacataaataacactcatagtagacacacattttggatacccaaaagaatatacacaagtactaacttataaacacacacgaataccccacgagtataaagatacacacacacacacacacacacacacacaggcaaacaacttttggacacaaactcatatatttttacatcttttaaaaatacatatactgtaatgarcacactgagtcccttatataaacacacaggccctaacttgcagacccccggaaggacgccagcgtgaacattcagaaacagagaaaaacacagacaaactcacagatatttggactgatgcagaagtgtgtgaacagataggtgaaaaaacataacaaacacgccgcagttagacagtctctacgaaaatgcggcgcgccccctcctcctccagggtcaccctgcgtggggaccaaggcctggccgtgtcccggagtttgcacatctggagcccgtatcgcggtcctacctgtcctgctg

SEQ ID NO: 131053 - DNA, 601 bp, Human
tctcataggaaccagacctggacaaccctttgagcaccagcttggacagcttctcagcttccctctcttctccagccctgacccaggctggagtggacagatggaagtgcagtctcacttgaactgtcgcccttttccaggcaggcagctcttccccaacccatcagtgaggagggggcgtggctctctagattttaaggcttggccagcctagggctcccgtatctcaccccaccccaagccccacccagtccagctatgcagaggaataaaatgctttattgattaaatgattattcargcaattgaactaatcaaagagcccatcgaccgccatgaattacattcttctacacagcttgtcgggagagccagcccgaggactgcgcagaccctctccatgacactcacacatccccgcctcattccccacacatacacaacacccacttccaggctcaggtctctctgaaagtccatctgctgagaagcccactgccagggagaagggccttctgagaattgaggatggagaagaggagtttccaggtaacttttcctgagccctcatcctgggagcactcttctgcctcagatctct

SEQ ID NO: 131054 - DNA, 601 bp, Human
tggaatatggttctgaaggaagaaaaaagaagtctattggcccatgaaatacccagaagttgggagaaggaagaagctctcataggaaccagacctggacaaccctttgagcaccagcttggacagcttctcagcttccctctcttctccagccctgacccaggctggagtggacagatggaagtgcagtctcacttgaactgtcgcccttttccaggcaggcagctcttccccaacccatcagtgaggagggggcgtggctctctagattttaaggcttggccagcctagggctcccgtttctcaccccaccccaagccccacccagtccagctatgcagaggaataaaatgctttattgattaaatgattattcaggcaattgaactaatcaaagagcccatcgaccgccatgaattacattcttctacacagcttgtcgggagagccagcccgaggactgcgcagaccctctccatgacactcacacatccccgcctcattccccacacatacacaacacccacttccaggctcaggtctctctgaaagtccatctgctgagaagcccactgccagggagaagggccttctgagaatt

SEQ ID NO: 131055 - DNA, 601 bp, Human
ggtgtggggcgctgtctgagactctgactggcctctccctacaacttactgccctccaactggcctggcccggagccctctacgggtccaagccagggttctccgaaagagctgaaatgtcgccgccggagccttgaaaggctgcagctcgctgcccaagctacgcgttgccggaggcgggattcccaggtgcctcagcccgggcggccaagtgcgttgtttcaggtcccctgcctgggatccctgcactttgcaaagttagctgcgcggctgcagaggtccgagatccttccggccttartacctgacccacggtccggcacccccaacccggtcccggcgggagagtgagagaagcgagctcgccgcctacttactatgcatggatgcaaacgggtcgtgcttacagtgtatttccatcggggcgctccagactgcaggccggcccacgccgccgcctcccggcgccaaggggctgcccagggcggatagggagcctcgccaccaggccaggcactgtgcgagctgggctcagaaaacactgctggagcttcggggtctctctcagagcctccctgctggagaccgcccggagctgcgc

SEQ ID NO: 131056 - DNA, 601 bp, Human
ccaaaccttgaggaatcgtttgggctgggaccagaacagggggctcctctgcacagagctccccaccgctttggtggattacttcagactcagaaaattgacacaaagagaaactgacctgcccgcagccagccctggctgcctacacaagctttcccctgcttgccaggccactcagcactgcgtggcagacacggacatgctcgccccgggaagctcaccttcactccagccgggtctctgctgcctttgttaaataggggacctgcggctaggaaagctggatcccaggctgttgggrtgggggggagcggggtgggaggaccaggcatggggacggctcctagcccgggagcaactccctgacctgaagcccgcagagaccccgagcggcacccgagccgaggctgccgaagcctgtcaccttcctccagcctggctctgcagcaaacagaaaggaaacgcgattcgttccacttggaatttccttgaaatctccgaatctaatccggcgttaactcaccgtgagaggagcgctcatctcacaggaggctgtggtaatgggtgaattggcaggatccctgcgggccaggcagccagg

SEQ ID NO: 131057 - DNA, 601 bp, Human
cagggagcggtaacaggaagaagaaactgactgggccaggaggaaggtgacgaagtgggacttgatctgagcctctactacctcagccaccttccaggatctactgtaccccccactccccattgctagcaagttggggccccagagcaggcctacattgtgcaagaaaacagctttgggcctcagaaccgagagtgcttccagagaagccaaggtcttgcacctgctctggaagctagactggctggggcccagcccccactgtgctgccagggagattgaaaatgggagggagcacttcccacggagggggcgattgaaggccggacaaggaggcacagacattagcggttggctaacctgcacctgaaagaagccgccttctccacactgatgctcagccgagagaccaccaggtctgatgctatctccccaagggctagggcacaacctctgggccaccgagcgctgggcggaaggacacagtgagggcctgtggatttccaccagtgaggagagaagtgcaggggctggtgctccccatctgtccccacagttgctccttggctgagccaagggcttgctcacctctcagagcatt

SEQ ID NO: 131058 - DNA, 601 bp, Human
caggggcacagggaaagggcagggaagaagtctccctaatggtattgatacatgtggagagtcaggcagtagacatatacatggttagactagacagagagagagctttgcatatgtgtatacccactgccctctctctggaatctgagtccctccctctccccttctgtgaaccctctgaagcttcattttaatgcctttgtcagatggtcagggagacccaagaaccagctccagctgtgccaatgtgaacttcttgagtcagtccttttgtctctctgacctcaatatcatattctgyaaaatgggtgaagctgaaggtttaggccaccgtcaggtaggaccctggctatgagtgttttataactggtaaagatacctaggggaaccgctcaggaagagagcaggaggttatcgtgctgatgaaaatgatgagcctggaatagtgggtggggactcctccaaactcagaagcccatttcctggaagtccctgctcctctccaaagaagctatccggctctgaagcagtggtggggggaagcagtggtagggggacggaggcagggagcggtaacaggaagaagaaactgactgggcca

SEQ ID NO: 131059 - DNA, 601 bp, Human
caatccactcaagtttcccatgaatatttcccaaaaacgtccaggctcaggcttatttcaaggaaaaacacaattttatagataactgaagtacttagttgcagttctaagctggatttctgattttcaaaatgatctttattcagttttgattgttctaaaagacataagaaaaaggaaaaccattccaaataggattttgcagttagaaacataattgcatagtttttctaaaacagaaagactgcagccaccctggccaagagccttcagaaggctttgttctggggctgggaacacytatttaaaaaggttgtacagatctttcaagagcaggctggatttaagtaaaagaaaataaattcaaaattggtataagctcatctgggaaaacaaagggcaggcaaaggaagcttaaacacccagcacacttttgatatgacctgggagtccaggtattatggtccatctgcaatagcctgttctctatgtcactgacaattgagactttctgcccaaaacacagtggcaaccttcagaggacttaaattccaaaagcagtcctgcaggacatttatgagcactgggggctgttttgtat

SEQ ID NO: 131060 - DNA, 601 bp, Human
tggctttgttttggggctatggtgagacccagatggtctaggggtcctttaggcgtcattgcaacccgggtactgcctggctagataaacctgtgtcagtcactttgcctgtctaggtttgttttctcatcttaaaacgtgcttcattggatcatgcggaggctactgagaaaataaacgggagtgctaaaaggctgcacggtcctatgggagaagcctcattgttagtattttgtttgcagcaaatcgccaggtcaagtggcaactttcaaatgtcatatttgaaagttggtgtttgggttttttttttttcctcttctctaatttaatatatactttggatgcttgtcactgcgatggaaataaaaacatagagaaggaaaatactgcagcccaacataacaaggttgataataacccaaaactgaaaataacagctgacttttaaaagtggaatatgcttccaaaaacattaaaatgaaacattgaactctggttatgtgatattaagtcctacgcggggacccaggctcacctaggatatataagggaaattcccaagaacgtcttactcttgagttctttagaacaattcaccagg

SEQ ID NO: 131061 - DNA, 601 bp, Human
caggctaacaatttacaaaatagcaggactcaaaatgtgaacacatgcactcccacagcgatctgtgcatttgaatcatcacagaaggatccactatcaggacaagaggctctcattctagtctgaccgaccacctcattctgccaggagtgagggtctcctacgcccacacaagctctgcactgatgatggtagggtgtgatttggagaaatggaaactgtccaagttttcaggctgctcccttctcttttctctgcagagtttagagaaccatcatttctgttcatctctgaacttcayccctgactctttgggtttaaatggagttgaaatttcatcatctacaacagaaaactttcttccatacatttatttttaaagctctgagagcgcccttccatgtgtcttggatcagactggaaaggaaagggagctgtgtggctgccaggaagatcctgtgcatgactcccagggtgtttctctggttctttctctccctgtgtgagattccatgtatgagttggggagagggcaactcctttgctccagagcatcttagcctcctggacaacacctctggagttgaagatgcacatcaga

SEQ ID NO: 131062 - DNA, 601 bp, Human
gctaagaagcactgcccctttaatcggacttgtgctgcctagcttgccagggacccaacctctccccatcgtcttttgcctggcctgcttccctcattaccttatctgcctggccccatgtaaggcattagattttgtgacccccatggactacctaaggttatcttgcgaacccccaattatatgtgtactctacgttgggaaacctgtgggtccccaaagcctgaccaggggtttggctgatgttcctctgcagagcaggccagctgcctgtcatgttgttttgtgtcgtggaaatccygcaaagagccagaagtaaggggctcataaaacacaatggagcctcttataatccataaaaagaacaggagttatcccctcctccccaaaacctaccatcatcattgctatcccctcagcaattttgtccaggtgcatcaggcttctaagtgcatgtcagaaccccaccctggacaaagagcccctctggaacagaccaagaaactgtgtgcctgattctcctctatctcccctgtaccatgcatgatgtcagggcctctgtcaaggtttgccaagagaagaaaaacaggctaacaattta

SEQ ID NO: 131063 - DNA, 601 bp, Human
cccacagcacaggtccaggcagaaaacatcagcgggcccgtgatctctcttgaccacacatcccatgccccttcacagtctttgccacatctgtaaccactgctctatttgcctcatacatttctttcacatcacttcaattttgacttaaataaatttattttataaggcaattgtagttccctactgtaagtgggtaggtgggagtgttgagggggagttcacaaactcactggtttggtgtgttacttacgtttttctaacatacattaaaataaatgtattagaaaacaatgtgcayccttgcatctttgcattatagaggatgtaaaccgatgctctgtaaataagttatgctcatcctgcaaggcatttttaattgaaattagttgcctctgttaaaaaaatatatagattaagctaggtgtgatggctcacacctgtaattccagcactttgggaggctgaggtaggaggattgcttgagcccaggagttcgataccagcctgggcaacatagggagacccccatctctacataaaaaaaaaattaatttaaatatagagatttcacatacagaaatatccatgcatacatcta

SEQ ID NO: 131064 - DNA, 601 bp, Human
tgctaccaaaattagaattaagagcagaactaacaaaacatcttccccagggccacctccagcccgggacaagttttgttagcctgcacagtatatttgtttttatttgaattagttgctaatatttttaagttgggagatttttcataaatatctgaattctagcttctcttgaaaaatcagaacacccaacaatactggcctcacattctcacatgacccaaccagttggtactaaatagagctgcccctctaagctgggagtgccacttgtactcccgaccccttggccacggtgctrgaatagaagaaggaagaccccattcaacccaccgtttgggtcagctttgggatggccacctccaatggacactcagactggatccagcgatccctgcaggttgtgcagcctcccagcacgtttgtccataagaagtcaaatgaacaaggtgatctgtgtcccaggaaatcccccacaagcctaacagaactagttcagtgatgcttaaccccttgtcagtcatggtttcctaggctggtcccctggaaggtaacaggaagtcacatactcctaggggtgaaccgtggagatgcccctgtg

SEQ ID NO: 131065 - DNA, 601 bp, Human
ccagcctgggtgacagagtgagaccctgtctcaaaaaaacaaaaaaaaaaaaaaagaaagaaagaggaaatggataaacaatctcagaaggcctgctaccaaaattagaattaagagcagaactaacaaaacatcttccccagggccacctccagcccgggacaagttttgttagcctgcacagtatatttgtttttatttgaattagttgctaatatttttaagttgggagatttttcataaatatctgaattctagcttctcttgaaaaatcagaacacccaacaatactggcctcacrttctcacatgacccaaccagttggtactaaatagagctgcccctctaagctgggagtgccacttgtactcccgaccccttggccacggtgctagaatagaagaaggaagaccccattcaacccaccgtttgggtcagctttgggatggccacctccaatggacactcagactggatccagcgatccctgcaggttgtgcagcctcccagcacgtttgtccataagaagtcaaatgaacaaggtgatctgtgtcccaggaaatcccccacaagcctaacagaactagttcagtgatgctta

SEQ ID NO: 131066 - DNA, 601 bp, Human
gcacctgtagtcctagctacttgggaagctgaggtgggaagatcacccgagcctgggagatcaaggttgcagtgaaccatgattgtgcctctgcactccagcctgggtgacagagtgagaccctgtctcaaaaaaacaaaaaaaaaaaaaaagaaagaaagaggaaatggataaacaatctcagaaggcctgctaccaaaattagaattaagagcagaactaacaaaacatcttccccagggccacctccagcccgggacaagttttgttagcctgcacagtatatttgtttttatttgamttagttgctaatatttttaagttgggagatttttcataaatatctgaattctagcttctcttgaaaaatcagaacacccaacaatactggcctcacattctcacatgacccaaccagttggtactaaatagagctgcccctctaagctgggagtgccacttgtactcccgaccccttggccacggtgctagaatagaagaaggaagaccccattcaacccaccgtttgggtcagctttgggatggccacctccaatggacactcagactggatccagcgatccctgcaggttgtgcagcc

SEQ ID NO: 131067 - DNA, 601 bp, Human
cctgtgactgttgtggagaagaaagaggacacagatagaggtcgatgtgagtggatcacttgagtccaggagttcgagaccaccctgggcaacacgatgaaaccctatctctacaaaaaatgcaaaaaattagccaggcatggtggtggcacctgtagtcctagctacttgggaagctgaggtgggaagatcacccgagcctgggagatcaaggttgcagtgaaccatgattgtgcctctgcactccagcctgggtgacagagtgagaccctgtctcaaaaaaacaaaaaaaaaaaaaaaraaagaaagaggaaatggataaacaatctcagaaggcctgctaccaaaattagaattaagagcagaactaacaaaacatcttccccagggccacctccagcccgggacaagttttgttagcctgcacagtatatttgtttttatttgaattagttgctaatatttttaagttgggagatttttcataaatatctgaattctagcttctcttgaaaaatcagaacacccaacaatactggcctcacattctcacatgacccaaccagttggtactaaatagagctgcccctctaagctggga

SEQ ID NO: 131068 - DNA, 601 bp, Human
tgcacccataaaaattaaaaataataataataataaagcacaagtggcccccttggaagctggggaggggaaggtagccactctcacactgttttaagaatgcatcagggttgtcctttataaagggggatctcagagttataggcaagcctctgaagctgcccccaggggtgagagattttgctcatctgcctttagcagtcaccaagtaaaaacaaagagcatcagcttacactgagaagaaactgtagtgggaagaacaagactgtaattgaatcataacaactctaaacaaattttraattttaaatatgacaggctgtcaagactcatccaataagaacacactcaggaccttttctaagccagggacagttgggctgagttggcagtcacaccaaattgcccgtcccttacctgctgagcgtgagcaggaccctggctgccgtactgcagagcacactagacgttccaacagagaaaggagctcagcatcaaactcttcctatgaataaggaaactaaaacccaagatgctcaaatgacttgcccagaattgcacagcgagtcagcccagactcccagcccccatgccccagcac

SEQ ID NO: 131069 - DNA, 601 bp, Human
cacaaggcgagggcggtgggggagtaaagatgctcaatgggtgcaaaaaaatagaaagaatgaataagacctagtatttgatagcacaatgaggatactatagttagtaataatttaactgtacatttaaaaataactaaaagagtgtaattgggttgtttgtaacacaaagaataaatgtttgaggggatgcataccccatttttcatggtgggttattactcattgcatacctgtaccaaaatatctcatgtactcataaatatatatatatgcctactatgcacccataaaaattaawaataataataataataaagcacaagtggcccccttggaagctggggaggggaaggtagccactctcacactgttttaagaatgcatcagggttgtcctttataaagggggatctcagagttataggcaagcctctgaagctgcccccaggggtgagagattttgctcatctgcctttagcagtcaccaagtaaaaacaaagagcatcagcttacactgagaagaaactgtagtgggaagaacaagactgtaattgaatcataacaactctaaacaaattttaaattttaaatatgacagg

SEQ ID NO: 131070 - DNA, 601 bp, Human
ttgaatcccatccctcttacaatttaccagctacatgaccttgggtaaattacttaacctctctatgcctcagtctcttcatctgcaaatgggactaagaatcatttctatctcataggattactattaggatcaaattaatgaattacttaaaacagtggtagctacatactaggtgctccttaaatgtaagatgttattttcagtggtgtctttgtaaagattaatgactagcttccgtcttaaaatattcatatttttcacatttgctttaaaaagcacaaggcgagggcggtggggkagtaaagatgctcaatgggtgcaaaaaaatagaaagaatgaataagacctagtatttgatagcacaatgaggatactatagttagtaataatttaactgtacatttaaaaataactaaaagagtgtaattgggttgtttgtaacacaaagaataaatgtttgaggggatgcataccccatttttcatggtgggttattactcattgcatacctgtaccaaaatatctcatgtactcataaatatatatatatgcctactatgcacccataaaaattaaaaataataataataataaagca

SEQ ID NO: 131071 - DNA, 601 bp, Human
aaggagcctcttgcccttttctaatcagtcagcttaagtgttccctcaaatacattcagattgtttgtttgttttccctaatattcaaaccacttattttaactaagcaaactcgaagcatattggacaaccagaaaactcatggcatttgggagaagagtgggtcataataaaatgtccagttctgggagtgaggttctctttttggtcacctggaagtaagctggcatctgacctaatgtttatatttttgtgtatgtcactttctctgtgtgtatgtgtctacagagatattgctggwtatgtcaatatatggatataccagacataaatatagttacaaataaatatatggcaaaaaagtcactgtagttcagcttaaaatccttacttttcaaatcattgtctgactattaaatttgtatgtaaaaaagcaaagaaaattatgttttcctcattttcttttaaaatagttataaatatcactgggaaagcattatcaattgttataaatcattaagaggctgcagtagcacagtgtacaggctctggaactagaccactagagtttgaatcccatccctcttacaatttaccagct

SEQ ID NO: 131072 - DNA, 601 bp, Human
gtagacgtccagcaaggaccacgcatgcgcaagacagcaagtccggcgcatctgagagcagcagaacagggccacgcgaaaagctccttcggatctaccagaaagctccttccttggcatttgggagaagagtgggtcataataaaatgtccggtttctttggaaaagttatattccagtctcaaactattaccttttgaaaggacatttattagagttttttctcattataacagtaatatacgttcattgtagactctttggacagtatgggaaagtataaagaagacatctaaaaacsgtattttggtgtatttcctttataccaacattcctgggcatatttagaaatatccatttttctcttaacaaaatcaggattatgccatgtatacagttttttttgttgtggtggttgtttgttttgagacagagtcttgctctgttgcccaggctggagtacagtggtgcgatctcagttcactgcaacctccgcctcccaggtttgagtgattctcctgcctcatcctcccaagtatctaggattacaggcatgcgccaccatgcccagtgtttttgtttttttgcttttttgtttttc

SEQ ID NO: 131073 - DNA, 601 bp, Human
ccacagggctggagccagtgatatcctggcctgtcttttcagagaccttgctcacactctaatagaaattccactgtgaccttgaccaagtacattccattgtggacctccgatacaatgacggagttggaacagaccactctgcttattttaagtaaccaaatcattttcggaaaagaaaaaagatcttatggaaaaaccccgtacataaaagagataatagcagtactgccttcccttggccatctgaccgctctaacatccttctgcagaaccttaggctctgaagagtttgtagacktccagcaaggaccacgcatgcgcaagacagcaagtccggcgcatctgagagcagcagaacagggccacgcgaaaagctccttcggatctaccagaaagctccttccttggcatttgggagaagagtgggtcataataaaatgtccggtttctttggaaaagttatattccagtctcaaactattaccttttgaaaggacatttattagagttttttctcattataacagtaatatacgttcattgtagactctttggacagtatgggaaagtataaagaagacatctaaaaaccgtattt

SEQ ID NO: 131074 - DNA, 601 bp, Human
tgcgcggagaaagacgggcggtcagggccgcagagggctgagggcggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaagggaagggtgggcactgagaaggactgacccctgcagaaaggaacacggggacacggggacaggaagggctttcgcttaaattccrgcctatccatggatgcaggaagcaggggatggagaggagaaagaggggagccggggcccaccaacagtcagtgcttaaaaaaaaaaaaaaaaaaaaaaaaacctgaactactcgttaggcatttcaccacctgcctgcacacccaacccaaccttgggtgcaaacacaactacctgagcacaaactcacgcgcacggctaacaaactccaaaccgcagagtgccccttctttttatagttttcttgctgccttttctccttccagtttcccccgatttgattttaatattaattatgaca

SEQ ID NO: 131075 - DNA, 601 bp, Human
ctaaggttttacaggctcccagggggtcttttctcctctcaaacccattaatgtcagccagtactggcagcccatacaggggaaaggagccccagttaaggtgtccggtgtccaggatggaggtggctggctctggagacccaggcaccacagggccaggcccgtggaggggctgagaaaaaccaaccgggaagattgtcatctttgtaatcccccccaacacccccgcacttcttccttccagacccaaggacaaagatgagatgattattaatttcctcagcaccgccccccaacaccrtcatcagggctgaaggccttctctgtctgctgagacgtgtgcagggcctttcagagaacccacccctccgccctccgcacgtgtgcccctctcacggtttggccagccccctctctctggtccaaagctcctccacaaagtggacttgggtgtggagcccagcacaccctgccctcgggccgcatatctgcacgcacacagggtcttcttaaaggccaaagctcaggccacaagggctctgccaggcccgctgcttctatccaaggggtgaccatgggggaggccagcaagaatgccaca

SEQ ID NO: 131076 - DNA, 601 bp, Human
gctcatgcctgtaatcccaacactttgggaggcctaggcaggcacatcacttgaagtcaggagtccaggatgagcctgggcaacatatcaaaacaccgtgtctatttattaagaaaaaaattttaattaaaaagtaaaaaagatcatccaataccacatctgattcttgatactctgttggcagcccaacaagtggccacttagtctctgcttacatatccccagagatagggcactcattacctcccgaggcatctccttttatcctaggccactctcatatgtgcaacttggttctttwtaaactgaggtgaaatcacctctgcatcagccacacactttaaggccatgcaatgagatctcattccttcctccttccatgtcagccctccaaatacttgaaggcagcaatccagtctcgcttattctgctcttctttgtgccaaaatatccctagaggcttgaggtgttcccagatgctgtatcagatccctcttcgcccaggacacaatcccatttgtcaccgcccctcttaaaggtcaatacccccaaatgggctgcagtcctcctccgggcatgatctgagtagtacggagtagtc

SEQ ID NO: 131077 - DNA, 601 bp, Human
actggactgccccctaagtcttcctgaggatcaggactctaccatatatatcagaactggaaagatttcaaagatcacccaggccaggaacagtggctcatgcctgtaatcccaacactttgggaggcctaggcaggcacatcacttgaagtcaggagtccaggatgagcctgggcaacatatcaaaacaccgtgtctatttattaagaaaaaaattttaattaaaaagtaaaaaagatcatccaataccacatctgattcttgatactctgttggcagcccaacaagtggccacttagtytctgcttacatatccccagagatagggcactcattacctcccgaggcatctccttttatcctaggccactctcatatgtgcaacttggttctttttaaactgaggtgaaatcacctctgcatcagccacacactttaaggccatgcaatgagatctcattccttcctccttccatgtcagccctccaaatacttgaaggcagcaatccagtctcgcttattctgctcttctttgtgccaaaatatccctagaggcttgaggtgttcccagatgctgtatcagatccctcttcgcccagga

SEQ ID NO: 131078 - DNA, 601 bp, Human
gcctccgtcaaagtctaagccacccacatctctctacctctctccctttccaaatcctgccgtgctggtcctctccctgcacatgctcaccagagtcccagacttggcacaatctctcttgcctttgattggaatgccctctcctccctttacccagctctcaaatgccacctcctatgaggagcccccaagatccttttggtcaaaactggccctccctgccttactctttcccccagtgtcacctcacccactgccctgctcatcagaggaatttcagcttgccagtcttgctcgccascttaccctctgtggttggatcctatcacccgttcacctctgcaagatctgggcaggagggtggccccaggaaatgccctcagagcaaaactcaagtctaagctggggatgactgtgaactaggcagcagagtaagcaactccaccttgcaaagcctcagtcacctcatccgaaaaatgggcaaggaccctcagctgtcttcctcttagctctccattgcctctcttaccccatgattcttctctcaggctgctgatggtaccgcactggaggccagaaccctcacaaatccatggtttgc

SEQ ID NO: 131079 - DNA, 601 bp, Human
agcatctgagacacatagctcaaaactatctccctaaatgcttctagactaaatgttcgaaagcctccgtcaaagtctaagccacccacatctctctacctctctccctttccaaatcctgccgtgctggtcctctccctgcacatgctcaccagagtcccagacttggcacaatctctcttgcctttgattggaatgccctctcctccctttacccagctctcaaatgccacctcctatgaggagcccccaagatccttttggtcaaaactggccctccctgccttactctttcccccartgtcacctcacccactgccctgctcatcagaggaatttcagcttgccagtcttgctcgccaccttaccctctgtggttggatcctatcacccgttcacctctgcaagatctgggcaggagggtggccccaggaaatgccctcagagcaaaactcaagtctaagctggggatgactgtgaactaggcagcagagtaagcaactccaccttgcaaagcctcagtcacctcatccgaaaaatgggcaaggaccctcagctgtcttcctcttagctctccattgcctctcttaccccatgattc

SEQ ID NO: 131080 - DNA, 601 bp, Human
cttgagcatctgagacacatagctcaaaactatctccctaaatgcttctagactaaatgttcgaaagcctccgtcaaagtctaagccacccacatctctctacctctctccctttccaaatcctgccgtgctggtcctctccctgcacatgctcaccagagtcccagacttggcacaatctctcttgcctttgattggaatgccctctcctccctttacccagctctcaaatgccacctcctatgaggagcccccaagatccttttggtcaaaactggccctccctgccttactctttccyccagtgtcacctcacccactgccctgctcatcagaggaatttcagcttgccagtcttgctcgccaccttaccctctgtggttggatcctatcacccgttcacctctgcaagatctgggcaggagggtggccccaggaaatgccctcagagcaaaactcaagtctaagctggggatgactgtgaactaggcagcagagtaagcaactccaccttgcaaagcctcagtcacctcatccgaaaaatgggcaaggaccctcagctgtcttcctcttagctctccattgcctctcttaccccatg

SEQ ID NO: 131081 - DNA, 601 bp, Human
gcattcagccataatctgcctcctgcagcttcctttaaccagccccagctcttcctccagaggccacagagatcttacctgctgctgaagaacagttcatctgagacttggacatagtggccatatacccgagtctggtcttggaggcaggcatcctaggaagaactctagaatctctatactgaaagggcccttcgccaatccactggcctaacaatattctagttagtttgtttgtctttgctccagaactctactcggagctttctatggaagcccaaaataccaaacaaaagcaccsttgactgaggatagtagaggtccctccactcaccctcgttactaattgtgaaccctctaaaggaatgtgactgatccactctaccaaggagcacttactgagcacctactatgtgccaagcacttgtattagagctgtgttgtccaatacagcagccgctagtcctatgtagctactgtgcacttgaaatgtggccagtacaatcgaggagctaatttttttatttgatttgattttaattttaattttaaaatagaagcagtgtaaaatatttgtcccactaaacacagctttattgtt

SEQ ID NO: 131082 - DNA, 601 bp, Human
ttgtccagcgcctgctcacacctctgatgatggagagctcactacctttctaagataaagcttccattcttggcccagcctggctgcttctgaaagccgtatgttgcattcagccataatctgcctcctgcagcttcctttaaccagccccagctcttcctccagaggccacagagatcttacctgctgctgaagaacagttcatctgagacttggacatagtggccatatacccgagtctggtcttggaggcaggcatcctaggaagaactctagaatctctatactgaaagggcccttygccaatccactggcctaacaatattctagttagtttgtttgtctttgctccagaactctactcggagctttctatggaagcccaaaataccaaacaaaagcacccttgactgaggatagtagaggtccctccactcaccctcgttactaattgtgaaccctctaaaggaatgtgactgatccactctaccaaggagcacttactgagcacctactatgtgccaagcacttgtattagagctgtgttgtccaatacagcagccgctagtcctatgtagctactgtgcacttgaaatgtggc

SEQ ID NO: 131083 - DNA, 601 bp, Human
acttgcagacacagtactggcacagaagcattggccacccaggctagaacaggcctgcctcaaaagtcacagagtccgaaccagaatgtcatccttgactcttctgctcctcatttgtccagcgcctgctcacacctctgatgatggagagctcactacctttctaagataaagcttccattcttggcccagcctggctgcttctgaaagccgtatgttgcattcagccataatctgcctcctgcagcttcctttaaccagccccagctcttcctccagaggccacagagatcttacctgytgctgaagaacagttcatctgagacttggacatagtggccatatacccgagtctggtcttggaggcaggcatcctaggaagaactctagaatctctatactgaaagggcccttcgccaatccactggcctaacaatattctagttagtttgtttgtctttgctccagaactctactcggagctttctatggaagcccaaaataccaaacaaaagcacccttgactgaggatagtagaggtccctccactcaccctcgttactaattgtgaaccctctaaaggaatgtgactgatccactc

SEQ ID NO: 131084 - DNA, 601 bp, Human
ggtgctgactcagcctccattcccctcacccagcaggattcctgagccatgccacagcttcctcgacgaaagctctcagttcaaaccaaccaagagacaaagcgacatctcataactgggtggcaccccagcctgaccctcagagccatcccgcaggcctcccaggcatccgtgtgaaccggggctgtgccgagaggctgcgctggggatagaaatgatttgtggcccctgccctgtcaagtccacatgagtggcagcctcagggtcaggcagcagaagggaaagacaagtgggtagatgsacttgcagacacagtactggcacagaagcattggccacccaggctagaacaggcctgcctcaaaagtcacagagtccgaaccagaatgtcatccttgactcttctgctcctcatttgtccagcgcctgctcacacctctgatgatggagagctcactacctttctaagataaagcttccattcttggcccagcctggctgcttctgaaagccgtatgttgcattcagccataatctgcctcctgcagcttcctttaaccagccccagctcttcctccagaggccacagagatcttacctg

SEQ ID NO: 131085 - DNA, 601 bp, Human
ttctacgtgatgcccccaccacgaccacaccccagcagaaccttggtcctgactccttcttagacaaaaagagaactcagggaacaacccacctctctacatgaggggacatgtagacacctctctacatccaggggacagcacacagagggccagggaggggacctgcccttggaaagccccagcagaggccaagacaaaatggtggtaacctccttcctgcccccaaagccacactgggaaaaggagatggagagcctgcctgttcacccatactccacactggaccctaaagaatccytgggtctcagccagttgtgaaggaccaatgacccaacactggaaatccccacaggggagtgggctggttccagaaagccaggccaggtccaggctcaaggacagcattccaggtggcaggccctgagtgggcaatggcctggagacgggaagctgagccaacacacagggactggaggcacaggaggaatgagcaggaggaaagggaggcccgcgagagaagggcagggcttctctcaagaactgaggtcagtgcggggggacgtgtgggcagcaccccatggggagataagactgatgg

SEQ ID NO: 131086 - DNA, 601 bp, Human
aagcatggctaccaggctgccaattcccccctgggttctacgtgatgcccccaccacgaccacaccccagcagaaccttggtcctgactccttcttagacaaaaagagaactcagggaacaacccacctctctacatgaggggacatgtagacacctctctacatccaggggacagcacacagagggccagggaggggacctgcccttggaaagccccagcagaggccaagacaaaatggtggtaacctccttcctgcccccaaagccacactgggaaaaggagatggagagcctgcctgktcacccatactccacactggaccctaaagaatccctgggtctcagccagttgtgaaggaccaatgacccaacactggaaatccccacaggggagtgggctggttccagaaagccaggccaggtccaggctcaaggacagcattccaggtggcaggccctgagtgggcaatggcctggagacgggaagctgagccaacacacagggactggaggcacaggaggaatgagcaggaggaaagggaggcccgcgagagaagggcagggcttctctcaagaactgaggtcagtgcggggggacgt

SEQ ID NO: 131087 - DNA, 601 bp, Human
tcgggcccagcagccccagatgactgttgccttgtgggttgccaggctgccagctgccccagggttgccagatctgatttttcttccccaaagaagccaggcatccatccatacatgaaatttcctgattttgcaatgttggtaactaattcaaaatcatcatcaatacagggcaagccaaggaaagcatggctaccaggctgccaattcccccctgggttctacgtgatgcccccaccacgaccacaccccagcagaaccttggtcctgactccttcttagacaaaaagagaactcaggkaacaacccacctctctacatgaggggacatgtagacacctctctacatccaggggacagcacacagagggccagggaggggacctgcccttggaaagccccagcagaggccaagacaaaatggtggtaacctccttcctgcccccaaagccacactgggaaaaggagatggagagcctgcctgttcacccatactccacactggaccctaaagaatccctgggtctcagccagttgtgaaggaccaatgacccaacactggaaatccccacaggggagtgggctggttccagaaagccag

SEQ ID NO: 131088 - DNA, 601 bp, Human
gcggggagcgcatgagaactcgggcccagcagccccagatgactgttgccttgtgggttgccaggctgccagctgccccagggttgccagatctgatttttcttccccaaagaagccaggcatccatccatacatgaaatttcctgattttgcaatgttggtaactaattcaaaatcatcatcaatacagggcaagccaaggaaagcatggctaccaggctgccaattcccccctgggttctacgtgatgcccccaccacgaccacaccccagcagaaccttggtcctgactccttcttaracaaaaagagaactcagggaacaacccacctctctacatgaggggacatgtagacacctctctacatccaggggacagcacacagagggccagggaggggacctgcccttggaaagccccagcagaggccaagacaaaatggtggtaacctccttcctgcccccaaagccacactgggaaaaggagatggagagcctgcctgttcacccatactccacactggaccctaaagaatccctgggtctcagccagttgtgaaggaccaatgacccaacactggaaatccccacaggggagtgg

SEQ ID NO: 131089 - DNA, 601 bp, Human
tgagcggggagcgcatgagaactcgggcccagcagccccagatgactgttgccttgtgggttgccaggctgccagctgccccagggttgccagatctgatttttcttccccaaagaagccaggcatccatccatacatgaaatttcctgattttgcaatgttggtaactaattcaaaatcatcatcaatacagggcaagccaaggaaagcatggctaccaggctgccaattcccccctgggttctacgtgatgcccccaccacgaccacaccccagcagaaccttggtcctgactccttcytagacaaaaagagaactcagggaacaacccacctctctacatgaggggacatgtagacacctctctacatccaggggacagcacacagagggccagggaggggacctgcccttggaaagccccagcagaggccaagacaaaatggtggtaacctccttcctgcccccaaagccacactgggaaaaggagatggagagcctgcctgttcacccatactccacactggaccctaaagaatccctgggtctcagccagttgtgaaggaccaatgacccaacactggaaatccccacaggggag

SEQ ID NO: 131090 - DNA, 601 bp, Human
gcgttggctctcacgggggctctcgctcactgaatcaaagtgaaacttggggacccaggagcgaggaggaaccgaaacctgagcccccacccgtgggacaggccctgggcactagggaaaggccccaggagcccctccaattggccacctggcctcagatgccctgcgttaccacagaggcctccagcagttgtctatctgggtctcagctgaggtgcccacagctacaagatcaggacagagatcacaggggagagtggcccgccaggcagggagatggaaaccaggtcctcaccatctstgccactaactgccccctgcatacccttgggccaagcctgcgccctctgtgcctggactaccctacctgcagggtatagagcacatgacctgccaaggagtgtggctgcttggccactgccctaagttcttgcctccgctaccctacccacctctggcctgtaagcctgactacccacttccctgaccacacacatacacgcacgcacactcggccccaccggccagttccaggatctgcctcccattagcttcagctgccacaggcagagactgagccaaactggtttctttagagttc

SEQ ID NO: 131091 - DNA, 601 bp, Human
aaccaggtgcacaaacagagagggtgggggttcagcggcgttggctctcacgggggctctcgctcactgaatcaaagtgaaacttggggacccaggagcgaggaggaaccgaaacctgagcccccacccgtgggacaggccctgggcactagggaaaggccccaggagcccctccaattggccacctggcctcagatgccctgcgttaccacagaggcctccagcagttgtctatctgggtctcagctgaggtgcccacagctacaagatcaggacagagatcacaggggagagtggcccrccaggcagggagatggaaaccaggtcctcaccatctctgccactaactgccccctgcatacccttgggccaagcctgcgccctctgtgcctggactaccctacctgcagggtatagagcacatgacctgccaaggagtgtggctgcttggccactgccctaagttcttgcctccgctaccctacccacctctggcctgtaagcctgactacccacttccctgaccacacacatacacgcacgcacactcggccccaccggccagttccaggatctgcctcccattagcttcagctgccac

SEQ ID NO: 131092 - DNA, 601 bp, Human
tctcttccccatggggcagcagggcatgcagggtggagaaagccaaggccatttcacctcaagttccagaccgccttggcaggggactgcccacagcagatgagactatatccccctccatcggccccaccactcttttactggttggcccccaaactgattccctgaactgagatccccacatggcagcaccctgccctctcccatacccccagggctctcccgaacaccagtacaccaccccatgggaaaaggaactgggggtaagaggagggggaggggctggggcaaaccaggtgcrcaaacagagagggtgggggttcagcggcgttggctctcacgggggctctcgctcactgaatcaaagtgaaacttggggacccaggagcgaggaggaaccgaaacctgagcccccacccgtgggacaggccctgggcactagggaaaggccccaggagcccctccaattggccacctggcctcagatgccctgcgttaccacagaggcctccagcagttgtctatctgggtctcagctgaggtgcccacagctacaagatcaggacagagatcacaggggagagtggcccgccaggcaggg

SEQ ID NO: 131093 - DNA, 601 bp, Human
acagcaggggcaggggtttgaagccttgtaaattctctgacccacaggctatgcagccagggattaaaccatattcccaagccagagagaaaggactgtgggattctcttccccatggggcagcagggcatgcagggtggagaaagccaaggccatttcacctcaagttccagaccgccttggcaggggactgcccacagcagatgagactatatccccctccatcggccccaccactcttttactggttggcccccaaactgattccctgaactgagatccccacatggcagcaccctgmcctctcccatacccccagggctctcccgaacaccagtacaccaccccatgggaaaaggaactgggggtaagaggagggggaggggctggggcaaaccaggtgcacaaacagagagggtgggggttcagcggcgttggctctcacgggggctctcgctcactgaatcaaagtgaaacttggggacccaggagcgaggaggaaccgaaacctgagcccccacccgtgggacaggccctgggcactagggaaaggccccaggagcccctccaattggccacctggcctcagatgccctgcgtt

SEQ ID NO: 131094 - DNA, 601 bp, Human
ttttgtttcattcccaatcaatagcattgctaggttttcttcccatcaaaaatatgccccagatggggtctccaggtggctgcaggctagtacagagctaagctggatggggagaataggcagggttctgaaacactcactccccaggctctcgggtggcacgagctggctgctgctggcacagaagaaagcctgctggagggaaatcagacctcaagccctaccaacaatctgctgggaaggggagaaggctcggtagctatgtctttccgtgggagctcaacctgggatagaagcaagwagcactacatacatatcccaatcggctagtggaggatttccaaaacccagtgtgtcttgtcactccctcctcagctcaaagacctgccatggctcccactgtcttaaggagctaagaacaggagaaatgactgatgacacctttcttttaactgaaaccacttaattgctcaccttatctatatgagtgataagtaggcaagttcagactttgcagcagcctgaagcagaaattttcaaagtgtagtccagggagccctgccagggttggaagaaggggtccccaagatactttcaggtg

SEQ ID NO: 131095 - DNA, 601 bp, Human
aaatgccaggagtcaagataaataccaaacccacttctttattttattttgtttcattcccaatcaatagcattgctaggttttcttcccatcaaaaatatgccccagatggggtctccaggtggctgcaggctagtacagagctaagctggatggggagaataggcagggttctgaaacactcactccccaggctctcgggtggcacgagctggctgctgctggcacagaagaaagcctgctggagggaaatcagacctcaagccctaccaacaatctgctgggaaggggagaaggctckgtagctatgtctttccgtgggagctcaacctgggatagaagcaagaagcactacatacatatcccaatcggctagtggaggatttccaaaacccagtgtgtcttgtcactccctcctcagctcaaagacctgccatggctcccactgtcttaaggagctaagaacaggagaaatgactgatgacacctttcttttaactgaaaccacttaattgctcaccttatctatatgagtgataagtaggcaagttcagactttgcagcagcctgaagcagaaattttcaaagtgtagtccaggga

SEQ ID NO: 131096 - DNA, 601 bp, Human
cttttatccttcttcctctctcaatttttctcaaattaccttaagacattctcttgttctccctctcccacagtttattctaacacagggataaaatgccccaaggaaggactaacacaaatgttaatttgtactaataaaaatgaaaactagaaatttcaaagtaaaattaaacacatgcgggcacacacacacctcgcccccaccccccaaccctcccacacacacacatgagtcaaccagaaacattccagaaacacccagaagcccctgtggaatcagaacaaaaatctcccctttstcaactgtcttttagacctgcttttcctcaaatgccaggagtcaagataaataccaaacccacttctttattttattttgtttcattcccaatcaatagcattgctaggttttcttcccatcaaaaatatgccccagatggggtctccaggtggctgcaggctagtacagagctaagctggatggggagaataggcagggttctgaaacactcactccccaggctctcgggtggcacgagctggctgctgctggcacagaagaaagcctgctggagggaaatcagacctcaagccctacc

SEQ ID NO: 131097 - DNA, 601 bp, Human
gagagaagtgacttggccaaggtcacacagcaagtaaaggcttagagtagaaccaaggactctactcccagaaaggtttatatcaaggcatttggaccatggaggtgagaaaggaccagattaatccccactagcaatggtccagcctccccctccctgactgaatgctgctgaagaagtgagacttcagctaatggtcagcccacctgggcactgccacctccgacccagttacaagcataccaagctcatgaatggccggtacacactgccctgctaccctacccctcttgttcctaaccctggacagcaactaagctgtcctgggtcgatggtgccacctggtggctggtgctgggaagtgtctgactccctcatcactttcgtcctccactgttcagtccctcaagaggctatgcctttctttctgcctatttcctctcatagatcagttaattttgctacaagcaatgtgtttctcacacataccttctctcacaccttttatccttcttcctctctcaatttttctcaaattaccttaagacattctcttgttctccctctcccacagtttattctaacacagggataaaatgcc

SEQ ID NO: 131098 - DNA, 601 bp, Human
taatttaaattccagagaaggccgggcgcagtggctcacgcctgtaatcccagcactttgggaggccaagacaggtggattgcttgagctcatgagtttgagaccagcctggacaacatggtgaaatcccatctctacaaaaaatacaaaaattaaccaggcatggcggttcatgcctgtagccccagctactccgaggctgagctgggaggatggcttgagcccaggaggcagaggttgcagtgagctgagatcacacctctgcactccagcctgggcggtagagccagaccttgtctcaaaaaaaaaaaaaaaaaattccagcaaaaattataaaatcacaacactctccttttcctaaagcaccaaaaagatttcaaaagcatttttccatcttctattttatgtaagtctaagagaaagatgtgactataatctccacagatgtgagaagtgacctacccaaggtcacatggctgacagaaagatctagaatctaactccagctctagtgctctctggtacaccacagagtgtcagagcccaaaagaacctcaaaaatcgtctgctccaatttccacattttaatatgcggaaaaca

SEQ ID NO: 131099 - DNA, 601 bp, Human
cctggaggatggagactctggggtcaggcaggacttggggaacgtttgacgtgcaaggctctgtgttctgctcagcagcctccactcattccccagatgagcccatggcttctgtgacatccatggcccccattcggtacatatttgctgttgtgaaccaggccctgtgctgggcactaaggtgacattggtgactgctccagacacagttcctgccttcatggagctcacagtcttgctgggaaaacaggcgagtgacaaatgtgatattttgatgaacaggcaggttctgtgtgctggkggggagttgggttggaggggagcatctgagaagccctcacttaggaagtgacacaagctagatcctgaagtttgggatgtcagccaggtaaacagtagggtgagggaggaagacagtttttcaagcagtgggaagagcataataaaaggcactctttattgagcacttattatatatggggtcatcctgagcactttacatgcataatctcattcaattcatataacagtccaatcacaagcacaattgggaaactgaggctcagagattggtccaagattccaggagtagtcattgttg

SEQ ID NO: 131100 - DNA, 601 bp, Human
tgcagttcctctttggtgctgtgatctatacacatctggagcacatgcttaggtatggcaggcagaaagaggaccacaggcaccagtatccatatgtatgcatgtgtgcatgtagatcacgaaagagctccctccccgtctagaatggctgtcacaagatcctggaggatggagactctggggtcaggcaggacttggggaacgtttgacgtgcaaggctctgtgttctgctcagcagcctccactcattccccagatgagcccatggcttctgtgacatccatggcccccattcggtacmtatttgctgttgtgaaccaggccctgtgctgggcactaaggtgacattggtgactgctccagacacagttcctgccttcatggagctcacagtcttgctgggaaaacaggcgagtgacaaatgtgatattttgatgaacaggcaggttctgtgtgctggtggggagttgggttggaggggagcatctgagaagccctcacttaggaagtgacacaagctagatcctgaagtttgggatgtcagccaggtaaacagtagggtgagggaggaagacagtttttcaagcagtgggaagagcat

SEQ ID NO: 131101 - DNA, 601 bp, Human
tggtacagtggttgtgagtattacatgagttaataatttaaaatccagagtcaatactcagtaaatgttagccgttatagttatcccatattgcagttcctctttggtgctgtgatctatacacatctggagcacatgcttaggtatggcaggcagaaagaggaccacaggcaccagtatccatatgtatgcatgtgtgcatgtagatcacgaaagagctccctccccgtctagaatggctgtcacaagatcctggaggatggagactctggggtcaggcaggacttggggaacgtttgaygtgcaaggctctgtgttctgctcagcagcctccactcattccccagatgagcccatggcttctgtgacatccatggcccccattcggtacatatttgctgttgtgaaccaggccctgtgctgggcactaaggtgacattggtgactgctccagacacagttcctgccttcatggagctcacagtcttgctgggaaaacaggcgagtgacaaatgtgatattttgatgaacaggcaggttctgtgtgctggtggggagttgggttggaggggagcatctgagaagccctcacttaggaagt

SEQ ID NO: 131102 - DNA, 601 bp, Human
agctgtgtgaccttgggaaattgtctcactctctctgtatctctataaaatggggataataagagtatccacctggtacagtggttgtgagtattacatgagttaataatttaaaatccagagtcaatactcagtaaatgttagccgttatagttatcccatattgcagttcctctttggtgctgtgatctatacacatctggagcacatgcttaggtatggcaggcagaaagaggaccacaggcaccagtatccatatgtatgcatgtgtgcatgtagatcacgaaagagctccctcccygtctagaatggctgtcacaagatcctggaggatggagactctggggtcaggcaggacttggggaacgtttgacgtgcaaggctctgtgttctgctcagcagcctccactcattccccagatgagcccatggcttctgtgacatccatggcccccattcggtacatatttgctgttgtgaaccaggccctgtgctgggcactaaggtgacattggtgactgctccagacacagttcctgccttcatggagctcacagtcttgctgggaaaacaggcgagtgacaaatgtgatattttgatg

SEQ ID NO: 131103 - DNA, 601 bp, Human
ccacatgtgaccagccggctgcgcttgaaggtgaccaacttgcaggtgtgacagggaagtgtgcgcagcagtgttaggaaagcttcagaaatggcgtacccctgagtgatgcaacagactctgagccaaggtccccctgagctcagccagacaggataatgggggaacaggcagaactgcgaaaaagtagaatcaaagccccatgttggagagagctgaggatattcccctggagaacacagcctcatacggatgtcatcctgttgtgacaccctctgtgagaggcagactgggatggccrgtaagcacctaggtactagtcccaacactgccactattgagctgtgtgaccttgggaaattgtctcactctctctgtatctctataaaatggggataataagagtatccacctggtacagtggttgtgagtattacatgagttaataatttaaaatccagagtcaatactcagtaaatgttagccgttatagttatcccatattgcagttcctctttggtgctgtgatctatacacatctggagcacatgcttaggtatggcaggcagaaagaggaccacaggcaccagtatccatatgt

SEQ ID NO: 131104 - DNA, 601 bp, Human
tagattcagagtaaaaacactttgctctgataatagaaataagaaaataataggtgatatttttgaaacttgccatgtgccagtgctaatcaaaatattataggcaacattttctaattaccagaaaaggcaggaattattatccccctttgacaggtgaggaaattgaagctcaaagaagctaaagccctttgctgtcaaagctcacactgctagtaaaaggaaaggcaaggctcaaaccccagtctactcatggtgccacctgctgtggcttaaaacccacatgtgaccagccggctgygcttgaaggtgaccaacttgcaggtgtgacagggaagtgtgcgcagcagtgttaggaaagcttcagaaatggcgtacccctgagtgatgcaacagactctgagccaaggtccccctgagctcagccagacaggataatgggggaacaggcagaactgcgaaaaagtagaatcaaagccccatgttggagagagctgaggatattcccctggagaacacagcctcatacggatgtcatcctgttgtgacaccctctgtgagaggcagactgggatggccagtaagcacctaggtactagtc

SEQ ID NO: 131105 - DNA, 601 bp, Human
aaatctgggaatttagaacgttctcaacgagatctttttgaggaatctagattcagagtaaaaacactttgctctgataatagaaataagaaaataataggtgatatttttgaaacttgccatgtgccagtgctaatcaaaatattataggcaacattttctaattaccagaaaaggcaggaattattatccccctttgacaggtgaggaaattgaagctcaaagaagctaaagccctttgctgtcaaagctcacactgctagtaaaaggaaaggcaaggctcaaaccccagtctactcayggtgccacctgctgtggcttaaaacccacatgtgaccagccggctgcgcttgaaggtgaccaacttgcaggtgtgacagggaagtgtgcgcagcagtgttaggaaagcttcagaaatggcgtacccctgagtgatgcaacagactctgagccaaggtccccctgagctcagccagacaggataatgggggaacaggcagaactgcgaaaaagtagaatcaaagccccatgttggagagagctgaggatattcccctggagaacacagcctcatacggatgtcatcctgttgtgacaccct

SEQ ID NO: 131106 - DNA, 601 bp, Human
aaaaaatctgggaatttagaacgttctcaacgagatctttttgaggaatctagattcagagtaaaaacactttgctctgataatagaaataagaaaataataggtgatatttttgaaacttgccatgtgccagtgctaatcaaaatattataggcaacattttctaattaccagaaaaggcaggaattattatccccctttgacaggtgaggaaattgaagctcaaagaagctaaagccctttgctgtcaaagctcacactgctagtaaaaggaaaggcaaggctcaaaccccagtctacycatggtgccacctgctgtggcttaaaacccacatgtgaccagccggctgcgcttgaaggtgaccaacttgcaggtgtgacagggaagtgtgcgcagcagtgttaggaaagcttcagaaatggcgtacccctgagtgatgcaacagactctgagccaaggtccccctgagctcagccagacaggataatgggggaacaggcagaactgcgaaaaagtagaatcaaagccccatgttggagagagctgaggatattcccctggagaacacagcctcatacggatgtcatcctgttgtgacac

SEQ ID NO: 131107 - DNA, 601 bp, Human
ctcaggaggctgaagtggaaggatcacttgagcccacgaggtcaaggctgcagtgagctgtgtttgcaccactgcactccagcctgggcaacagagtgagaccctgtctcaaaaaaaaaaaaaaaaaaaaaaagagagagagagagagaaaacaaaaaatctgggaatttagaacgttctcaacgagatctttttgaggaatctagattcagagtaaaaacactttgctctgataatagaaataagaaaataataggtgatatttttgaaacttgccatgtgccagtgctaatcaaaataytataggcaacattttctaattaccagaaaaggcaggaattattatccccctttgacaggtgaggaaattgaagctcaaagaagctaaagccctttgctgtcaaagctcacactgctagtaaaaggaaaggcaaggctcaaaccccagtctactcatggtgccacctgctgtggcttaaaacccacatgtgaccagccggctgcgcttgaaggtgaccaacttgcaggtgtgacagggaagtgtgcgcagcagtgttaggaaagcttcagaaatggcgtacccctgagtgatgcaacagac

SEQ ID NO: 131108 - DNA, 601 bp, Human
aaaaagaaagaaagcctgtaatcctggcattttgggagcctgaggcaggaggattgcttgagcccaagagttcaagaccagcctaggcaacaaagcgagatcttgtcttgacaaaaaaattttaaaaaatagccgggtgtggtggtgcatgcctgcagtcccagctactcaggaggctgaagtggaaggatcacttgagcccacgaggtcaaggctgcagtgagctgtgtttgcaccactgcactccagcctgggcaacagagtgagaccctgtctcaaaaaaaaaaaaaaaaaaaaaaagagagagagagagagaaaacaaaaaatctgggaatttagaacgttctcaacgagatctttttgaggaatctagattcagagtaaaaacactttgctctgataatagaaataagaaaataataggtgatatttttgaaacttgccatgtgccagtgctaatcaaaatattataggcaacattttctaattaccagaaaaggcaggaattattatccccctttgacaggtgaggaaattgaagctcaaagaagctaaagccctttgctgtcaaagctcacactgctagtaaaaggaaaggcaa

SEQ ID NO: 131109 - DNA, 601 bp, Human
atgcctttgtgtttgtgcctttttctaattttccaccggtgcaagagacaaaaaagtttatgtcagggcatcatccagcaagatcagaacccccactcaggctcggggacagagggaagaaagagtggcagtcgcacccaggaggacctgcctgtccaacatcaaggaatgatcaagaactcccatcccggttccacgctgcgcgtccgccatccgaaccggcctcgcccctccaggccgggtcccgacgccagctccgtccgacccccgcccggcacccccgtccggcgccctcgccccrgcgcgcatcatctgctccgctgcccagctcccggctgccgccgcgcccgcgccccccggggccccggaaagctggcatccgttgttagcataacaaactcaattgttctcagcggggccccggcaaataaagtcattcattacgggcctctcctggccgccgcgggccgcgcggcaatcagcgggccgagccacgcgccagcgctgggacctgcagggcgcgccgccgcctccacgctgcgccccgggccccgccgcggccgcgccggcgggggcagcgccggccgccgattagttttat

SEQ ID NO: 131110 - DNA, 601 bp, Human
gttatgggggttatatgctgcctctgccaactagtagagcagttatatgcacaggctctgaaaacagagtgcttgggtttgaatcccagccttgtgacttactggctttgtggccctggattggttattgaacctctcttttttttttttttttttttttgagatggagtttcgctcttgtcacccaggctggagtgcagtggcacaatctcggctcactgcaacctccacctcccaggttcaagcgattctcctgtctcagcctcctgagtagctgggattacaggtgcacacaaccacrccaggctaattttttgtatttttagtagaggttttttgtatttttaggggtttcatcatgttggccaggctgttctcgaactcctgacctcaggtgatctgcccacctcagcctcccaaagtgctgggattataggcatgagccaccgcacccagcctcattttttccaacagccaaaggaaaacagtattggtacatacacactcaccacactcgcctatcacaaagtgagtgcttcactctcaccatcagccttgtacagctgagggtagagggcaattttttcccagtggtcacact

SEQ ID NO: 131111 - DNA, 601 bp, Human
ccaggggacatctgatgctccccttccatgccttgcctaagggaaaacaaaggggtccctagggaaaatccctgagggaaaacagtggggtctcccaggccttacctacctctgagaccacagtgcccgacaccacatcaggagccagtaaatggatgaatgacaccccagggaagaggctctgccttggaagtgtttaagtgacaaaagtggtggagcacagagagcaagctctggctctgccacttgccagctgtgtgatcttacacttctctcaacacatctgtgcaatggggtcaayaaatcatgccaggcctacagcactggtcagagcaaacaagctgctggattccaagtgagagagtgctgtctgcacagtgagcacctcctaagagtcaataaggactgagagtgaggacaagaaaacagaagccatttgctaaattaaaaagaacaagggatggaccctgtggctccccactgtaatcccagcactttgggaggccgaggcagatggatcacctgaggtcaggagttcaagaacagcctggccaacatggcaaaaccccacctctagtaaaaatacaaaaatcagctaggt

SEQ ID NO: 131112 - DNA, 601 bp, Human
tcacagcttactaggctttactggtacttaactgggtacccccccagcaatcccacctttctgacctcgtttcctcccactctttccccgcttattctgctcctgccacactcgcctccatagggttccacagtcatgccaagctcaccggccttggggtctttgcacttgctgttccctctctccggaaacttcctcccccagatatctgcctggctcactcctccctccattaaggcctctgctcaaacgtcagctcatcagtaggaccaccctccaaaaacagcaaagcccccccccyctcagccctgcttcattccctgtctcctcacctagctttgttttcctccagagcatagaacagcatgctgcttattttccttatttagttattgtctttcttccttagaacgtcactcatgtgggcaaacatttttgtctgtcttgttcattgctgtgtccccagcaactaggacaatacctagcacacatagcaggcacacaataaatacttgtagagtgaatttcactgaaactggcaaaaaaaaaaaaacaaaaaacaggtacaaaggagaagggagacagctgctccggtgtgacc

SEQ ID NO: 131113 - DNA, 601 bp, Human
acagcccctcacagcttactaggctttactggtacttaactgggtacccccccagcaatcccacctttctgacctcgtttcctcccactctttccccgcttattctgctcctgccacactcgcctccatagggttccacagtcatgccaagctcaccggccttggggtctttgcacttgctgttccctctctccggaaacttcctcccccagatatctgcctggctcactcctccctccattaaggcctctgctcaaacgtcagctcatcagtaggaccaccctccaaaaacagcaaagccccccccccctcagccctgcttcattccctgtctcctcacctagctttgttttcctccagagcatagaacagcatgctgcttattttccttatttagttattgtctttcttccttagaacgtcactcatgtgggcaaacatttttgtctgtcttgttcattgctgtgtccccagcaactaggacaatacctagcacacatagcaggcacacaataaatacttgtagagtgaatttcactgaaactggcaaaaaaaaaaaaacaaaaaacaggtacaaaggagaagggagacagctgctccg

SEQ ID NO: 131114 - DNA, 601 bp, Human
ggtcatacagtctaatctggccacagtgtagagaccctgttggagggagatgagactgaggcccagggtcgagtgggagccctcagccaggacagagctaacagtgggaatggctatccagagaagggggcaggttcgggaggtgattaggagagaaggtatgctggagtgagtgactcactggaggtaggggagaaaatgcacctctgaagttccctgttggaggttctaggctgctgtctactcccactctgagcaaaacccacagcccctcacagcttactaggctttactggtactkaactgggtacccccccagcaatcccacctttctgacctcgtttcctcccactctttccccgcttattctgctcctgccacactcgcctccatagggttccacagtcatgccaagctcaccggccttggggtctttgcacttgctgttccctctctccggaaacttcctcccccagatatctgcctggctcactcctccctccattaaggcctctgctcaaacgtcagctcatcagtaggaccaccctccaaaaacagcaaagccccccccccctcagccctgcttcattccctgtctcct

SEQ ID NO: 131115 - DNA, 601 bp, Human
gtgcagcttggaaactgaggcccagaaggcaataaactgttgccccaaatcaccaggatactcagcagcctaacagagacttgaacttgggtcccaggttctcaggtcaagactttttccactttctctcaatgcctccctaatttatgtcaaaacaatgaactcctatcgacagagaagacttcattccctactgtcaacatggcccaatgcactgctatggttccttcgtggcatttaatttaattttcccaactccaagccaagactatgcttagggaaatcaggaaagcggcttgcmccggtggctgcctgagggaggtggctcttggaggcacaaggctgagcccagcatgagagtctctggaggaggccagggcaatgacagtctgcaaataagctttgcatctgctcagagctggcagagtctgcaaacacactaatggacttccctctgcctgtggggagttggggagaagccataaataaagcaggtgcctctggggggagccattgccgaagccagagacagggctggggattaggagctggttaagggttgggggaggggctttgggccacccactgcaccgcattgcac

SEQ ID NO: 131116 - DNA, 601 bp, Human
agactggtgaaatgaagctgaaatgaacatcatgctttaactcattgaacctatcaggcctgagttaatctcactgtccactgtctctgatagaattcaattgatcaatcatgtttcggtgatagtaccatttcactggcttattgcttcttcatttcagagcttgacctgttagatgtactcggactggctcgactcctcttggatacacagagatcagcctctgtctgccaacgtgtgtcatctcctgtcccagttgaaaagaactcaagaggcttttgtgtatgtctgtggtgtgttyttccaccaaacacacacacaggaatggtggatttatgagggtgtggaactgaacaagcacaaattataagaagggctcttcattattcatggaagcaccattatttcccttttatgtagttaaattgacgtgtttgggctctgtaccttataggggcatattcttgtattacactggcaagtgtgcatgcctagacatctgaaaaggataacagcgacaaaatgataacaatcgcacccctcaaatacatattcctgtggcatatgaaacattcatcagcttatctgattctcctgataa

SEQ ID NO: 131117 - DNA, 601 bp, Human
tacatcccttttatggccttcatgcacacagcagtctctctcccatcccccactgcacagaaataaataaataaataaataaaagggtttaaaaatcatatttactctgatatctttgcattacccctatttgagtttttaaattactgtctgtattttttcccaaggacgatataactaaaaagaaggttcgtatttgaagtgtatctatctgatcattgcacaaatgttttcaggagaaatcactaaatttctccaagatgggtatgggttttgtcatagatcaaagtgagagggaggraaaaaaagataaatcatcagagatccaaaaatacttttcatttggagaagatatcaggccatttcgatggggctgatggagtccctgttctgtctccattacccgcagcaggcagccccagccaggagccaactaccaagattatattccccataagatggtccccgatatctatatatatatatgatcttcaacctctattgattgaccaatttcacaagcaaagactggtgaaatgaagctgaaatgaacatcatgctttaactcattgaacctatcaggcctgagttaatctcactg

SEQ ID NO: 131118 - DNA, 601 bp, Human
ttctgaagcaaatgaaatattactaggagcaaaagggtgatttgtttctgtgaattgtgcttttaaatgagatcaaagaatgtgaaaggcttcattttaattatacctggaaggacctggaagggatgcatacatcccttttatggccttcatgcacacagcagtctctctcccatcccccactgcacagaaataaataaataaataaataaaagggtttaaaaatcatatttactctgatatctttgcattacccctatttgagtttttaaattactgtctgtattttttcccaaggacratataactaaaaagaaggttcgtatttgaagtgtatctatctgatcattgcacaaatgttttcaggagaaatcactaaatttctccaagatgggtatgggttttgtcatagatcaaagtgagagggaggaaaaaaaagataaatcatcagagatccaaaaatacttttcatttggagaagatatcaggccatttcgatggggctgatggagtccctgttctgtctccattacccgcagcaggcagccccagccaggagccaactaccaagattatattccccataagatggtccccgata

SEQ ID NO: 131119 - DNA, 601 bp, Human
atgcacactaattagaaaggatgttaaccgccatagtgaaaatattctgaagcaaatgaaatattactaggagcaaaagggtgatttgtttctgtgaattgtgcttttaaatgagatcaaagaatgtgaaaggcttcattttaattatacctggaaggacctggaagggatgcatacatcccttttatggccttcatgcacacagcagtctctctcccatcccccactgcacagaaataaataaataaataaataaaagggtttaaaaatcatatttactctgatatctttgcattacccytatttgagtttttaaattactgtctgtattttttcccaaggacgatataactaaaaagaaggttcgtatttgaagtgtatctatctgatcattgcacaaatgttttcaggagaaatcactaaatttctccaagatgggtatgggttttgtcatagatcaaagtgagagggaggaaaaaaaagataaatcatcagagatccaaaaatacttttcatttggagaagatatcaggccatttcgatggggctgatggagtccctgttctgtctccattacccgcagcaggcagccccagccagg

SEQ ID NO: 131120 - DNA, 601 bp, Human
actacaggtatgcaccaccacacccggctaattttttgtattttaagttgagaaggggtttcaccatgttggccaggctggcctcccaaagtgctgggattacaggcatgaaccaccatgtccagccttaccctaagtcttaaggatggagttagccaaagaaatgcccagggaagaggaattgcattccaaccagagggaacagcatctgcaacagcctggaggcacagaaagcatggtgcaggggaacggctataattcagcatgattagaattcaggagttggaggaggggaaagggrgtgaagtgtgagaggctcttccctctctgtcgagctgttcagcatcactatccattatccagaacctaatatacactctgatatacaaacagtgcaaatacattattgaagctctcatggtgttggtatgaagagatgggatttctctgtgctaaaatgaatcaagatgacctgaaacaagaggcagaaaggaagtaatacctggtgcattgccacagggcaagtctgttctctctaatccatactgtccaagtccattacctcatacagtagtccctaattactccaccttacagaggg

SEQ ID NO: 131121 - DNA, 601 bp, Human
ttttgtttgttttttttggggtttttttgttttgttttgtttttgtgagatggagtctcaccctgtcatccaggctggggtgtgcaatggcaccatcttggttcactgcaacctccacctcccaggttcaagcgattctcctgcctcagcctctcaagtagctgggactacaggtatgcaccaccacacccggctaattttttgtattttaagttgagaaggggtttcaccatgttggccaggctggcctcccaaagtgctgggattacaggcatgaaccaccatgtccagccttaccctragtcttaaggatggagttagccaaagaaatgcccagggaagaggaattgcattccaaccagagggaacagcatctgcaacagcctggaggcacagaaagcatggtgcaggggaacggctataattcagcatgattagaattcaggagttggaggaggggaaagggagtgaagtgtgagaggctcttccctctctgtcgagctgttcagcatcactatccattatccagaacctaatatacactctgatatacaaacagtgcaaatacattattgaagctctcatggtgttggtatgaaga

SEQ ID NO: 131122 - DNA, 601 bp, Human
caagtctgttattgcttcctcccattttacagatgaggaaactgaggcagggggttaaataacttgcctagtcacaagatctaaagattgggggggtggggggagggaagaaaaaaaagagtaacttgcccaagatcacacagctaagaagtggagaagctagggtccgaactcaagcagtctggttccagagtctgctcctagccctacactaactcactccacttaatccagactaggggcaagtgtagcccaagaaaggccccctgtagcccgagtctttttttgtttgttttttttkgggtttttttgttttgttttgtttttgtgagatggagtctcaccctgtcatccaggctggggtgtgcaatggcaccatcttggttcactgcaacctccacctcccaggttcaagcgattctcctgcctcagcctctcaagtagctgggactacaggtatgcaccaccacacccggctaattttttgtattttaagttgagaaggggtttcaccatgttggccaggctggcctcccaaagtgctgggattacaggcatgaaccaccatgtccagccttaccctaagtcttaaggatggagt

SEQ ID NO: 131123 - DNA, 601 bp, Human
catgaggcctctgactcctgcctcaagcctcctggatccgttgatccctgagctacatactgggtatctggccctgcccttcccaccagagctagagagagcttcaagtcttagccccgtcccctactggaggatgaagacaagtgaataattgcaatgtagtgcgataagtgctaggagcctgagaagcagacacagccctgggagcctaatgcaagtggccagaccctattcagagctcactctgcgagacactgttctaagcaccttccctattggatcctcacaaaaaccctaagaygtcaagtctgttattgcttcctcccattttacagatgaggaaactgaggcagggggttaaataacttgcctagtcacaagatctaaagattgggggggtggggggagggaagaaaaaaaagagtaacttgcccaagatcacacagctaagaagtggagaagctagggtccgaactcaagcagtctggttccagagtctgctcctagccctacactaactcactccacttaatccagactaggggcaagtgtagcccaagaaaggccccctgtagcccgagtctttttttgtttgtttttt

SEQ ID NO: 131124 - DNA, 601 bp, Human
tgatccagagatgactaacaacagggaggggggtcctggagaagggacgatcagagccaggcctgggaaacaagatgccaaggtaagagatgggattccgggtacaggcaaccaggttaagttggcaaacgcttctaggacatctactatgagccaggccccatgctagggatgagggtggccaggctctaaatgtcccttggtagcctggaacaaaaacaaatgttctgagtcattttctaaatcctgtcctaaactggggctgcagactaagaaaaatcaaggtggcatggaggaaaawttccactgaaactaccattattcagccatttgtttcactcaatctttcttcttggagaaggaaaatgcgaaattgtaaaattgccaaatacgttcaggtttgaccagagtgaatccgattgtgccgggtgttacccaatgagtcacaggctgtcagtgtgggaaaggccccaagggctggtgattccacattcgaggatggcaaacgggaggccagatggcaaagggatctgtcaggggccagacagcagattcaaggtgagcttggacatgaggcctctgactcctgcctcaagcctcc

SEQ ID NO: 131125 - DNA, 601 bp, Human
aaaatgctgttcacagactcaagctcaaactcattacagagcttctattctctgcatggtgctgtttggggtgcttagagtgatccagagatgactaacaacagggaggggggtcctggagaagggacgatcagagccaggcctgggaaacaagatgccaaggtaagagatgggattccgggtacaggcaaccaggttaagttggcaaacgcttctaggacatctactatgagccaggccccatgctagggatgagggtggccaggctctaaatgtcccttggtagcctggaacaaaaacmaatgttctgagtcattttctaaatcctgtcctaaactggggctgcagactaagaaaaatcaaggtggcatggaggaaaatttccactgaaactaccattattcagccatttgtttcactcaatctttcttcttggagaaggaaaatgcgaaattgtaaaattgccaaatacgttcaggtttgaccagagtgaatccgattgtgccgggtgttacccaatgagtcacaggctgtcagtgtgggaaaggccccaagggctggtgattccacattcgaggatggcaaacgggaggccagatgg

SEQ ID NO: 131126 - DNA, 601 bp, Human
accttgggcccccaaagtgctgggattacgggtgtgagccaccacgcccagccttgagcaacttctttaactgctctaatcctcaattttcttatctgtagagtgggataataatagtatctggagttgacaaaataatttaatgagaatacatgtaaaatacttagcataacccctgacacatagtaagtgctcaataaacgttagctgtttccagaattagtatttttttcccctgctaaagtatgagctgagggcagagcccatgtcccatttacctcaagcataggagatgctaatraatgtttgttgactgaattattaagctaggaaggcttgagggcttgcagggctgtatggctcagaagaattcagcactaggacagtcgctggtatcatcagagaactcaggagtggcttctattatatcagtgatctcagaggaggaaaaagtgaaacaactaagagtttatgtctcgcctacttctaagacagatttgaggctgttcatagaattttgaactagagtggatgataaactactaaactcagttgagctctaagctccctggcagcatataccaaaaagaaaatgcagcaa

SEQ ID NO: 131127 - DNA, 601 bp, Human
ttccagaactctgtctctcacaagcccatgatatttgagcaatttctttttttttttttttttgagacggagtcttgctctgttgcccaggctggagtgcagtggtgtgatcttggctcactgcaagctccgcctcccgggttcacgccattctcctgcctcagcatcctcagtagctgggactacaggcgcccgccactattcccagctaattttttgcatttttagtagagacggggttccaccgtgttagccaggatggtcttgatctcctgacctcgtgattcatccaccttgggcycccaaagtgctgggattacgggtgtgagccaccacgcccagccttgagcaacttctttaactgctctaatcctcaattttcttatctgtagagtgggataataatagtatctggagttgacaaaataatttaatgagaatacatgtaaaatacttagcataacccctgacacatagtaagtgctcaataaacgttagctgtttccagaattagtatttttttcccctgctaaagtatgagctgagggcagagcccatgtcccatttacctcaagcataggagatgctaatgaatgtttgt

SEQ ID NO: 131128 - DNA, 601 bp, Human
gggacaaagcctgagcccccgaggcctcgacgacctgcccctctagtcagggtcaccccccacttcaccccgcaatgccatcccagcaggccgtttgtcagccctcatgtgtctcttccccactgctccccagtgcccctggacattctgctccctctgctggcatgcccttctctcctgcccagcaagactcagtctaaaagctgcctcctctctgaagcctgcctccaaatccaaaggctgaattcaccaccctttcttctgggtgtcctcagcacgttgcatgggccaccactatggyctggattctactcttcacaaaccattctgtgaactcagtcctcttggaacctccactttacagttaaggaagctggcacagagagatgaagtaatttgcccaagataacacagcagagcacttgcacagctcctacatgtgctaaagtgaagttgggcactgtggcagacctggtacagaacagtggggaagcctaggcactctgaactcatgggggcccgggttcgaattccagaactctgtctctcacaagcccatgatatttgagcaatttctttttttttttttttttgagacgga

SEQ ID NO: 131129 - DNA, 601 bp, Human
aaatgagataatctccatgacactttaacacggcacctggcagagagtttagtgtccaaataatgctagctgctgtcatcctcattttcatcaagaaaacccttccaaggctccccggggacaaagcctgagcccccgaggcctcgacgacctgcccctctagtcagggtcaccccccacttcaccccgcaatgccatcccagcaggccgtttgtcagccctcatgtgtctcttccccactgctccccagtgcccctggacattctgctccctctgctggcatgcccttctctcctgcccrgcaagactcagtctaaaagctgcctcctctctgaagcctgcctccaaatccaaaggctgaattcaccaccctttcttctgggtgtcctcagcacgttgcatgggccaccactatggcctggattctactcttcacaaaccattctgtgaactcagtcctcttggaacctccactttacagttaaggaagctggcacagagagatgaagtaatttgcccaagataacacagcagagcacttgcacagctcctacatgtgctaaagtgaagttgggcactgtggcagacctggtacagaaca

SEQ ID NO: 131130 - DNA, 601 bp, Human
aatcccagcactttgggaggctgaggtgggaggatcacttgaggccaggagttcaagaccagccttggcaacatggcgagacccccatctctacaaaaaaaaaatttaaaaatggctgggcatggtggctcatgcctgtaatcccagcagtttgggaggccaaggcaggcggatcacctgaggtcaggagttcaagaccagcctggccaatatggtaaaaccccgtctctactaaaaatacaaaaattagccaggtgtggtggcacatgcctgcagctactcgggaggctgaagcaagagratcacttgaacgtaggaggcggaggttgtggtgagccaagatcatgccattgcactccagcctgggcaacagagtaagactctgtctcaaaaataataataataataaaatttaaaagttagctggggtgtggtggtgcaggcctgtagtcccagctacttgagaggttgaggcaagaggattgcttgagcccaggagttcaaggcttcagtgagctacaatggtgccactgcacattagcctgtgtgacagaacaagactctgtctctaaaaaaaaaccaaataattttttaaaaggga

SEQ ID NO: 131131 - DNA, 601 bp, Human
catttttcttggagggttctggtttgtttctttaaaaatcatcatgcgctttatgtctgcagatgctcactaggaggaaaatataaaaacaaacaggaatctctgaaatccctcctagcatcatggcttttgggatgtaaccccatctggaggctgaagagccccaggaaaagaggctagagccgccaggtcagcctccagcctttctcagagtccagtttctctgcagaacccaggccaaagccagagcccttatacagcttccttcatcctcacagctgctccttagcatggcagggcmgtggcagggcccagtgggaaaagggttgggagccagcagtcccgggttctagccccagctctgctgttacttgctgtgtgggcccaggcaagttcctctccctctctgagcctcagagaccccagtagtaagctaaggtagctgagttggtcatttctaacccctttctccaccaaaatccacctagatttttgtgtgctaagtagtattaaatgagcattgacttattttcccattttggttgttgtgcagtctttataggggactccctggctatgatccatcccaccgctaagagac

SEQ ID NO: 131132 - DNA, 601 bp, Human
aaattaatcccaaaactcagcccttgcacaagggcaggtctgaacctccaggcctccagtgtaagcttccgtagcatttctcatctgcaccatgaagatgctgtctgacttaattggagaatgtggtcttggaggcaggctacagaaatgctcagacccattttattccagggagaaaagtctgaactcacaaagtgaatggtatgcttaaatatatggacagacacgggcaaaagtacaaaggtgtacagggggcatggtatctttaaatcttttttttctactccaaatcaaataataygtaatagacccagtgctgggcttagtcaaccatggctcgtagaattaacattctggaagctagcttcaggggagcaaggggcaggaagccccgtctcggggagcaaagaaatgctggctttaaatttcaggttaaaccaatgttattcacaacccagctttgaagctaaaagctttacacaatcgggtctggtcacgcaaaaagggaagaagcaaaatagcctcagattcccatctgtcaagagaaagctgtctcttgtgtgtcttaaaagatcataaacccattgcattttcttcagag

SEQ ID NO: 131133 - DNA, 601 bp, Human
ccctctagggggcgtctcttcagccagccaggccatcctcccagaggagtcctcaggcttgatccctctcccccgggactcatgggccaggctctttccacagctcagagcccaaagttcagagagggtggctccactgagggcccctgggggcaaggtcactgtctggtcacccagtagagcccagcacagagtaaaggctcagggcacacaggccctcaagtgtacacacagggggtgttaggagaccctccccctgaggacaccacacagactcagcacaggcagcctcgctggacaygcgcccctctctgcagtctccccagaagcagactggctgcgtcctgctctggttctttgagagtcagccatagcctctgccagctgagcctgtaaggatatctaggctgccaggcgccgtggctcatgcctgtaattctggcacctgggaggccgaggtgggtggactgccctcgaagggctgcgagctgggcagagcctgcctctccgggcattcaccctgtcccgcgattcccctcaccactctcaccccaccagcacctcgcttgctttctttactagggaaataatggcaatagtg

SEQ ID NO: 131134 - DNA, 601 bp, Human
tccttgtcagaaggggcccatccactttcaagagcttctccctccaccagcttcagttatacttcccagccctgaccctgccagccgggcccaaaactcagtgaaacctccttcctgtcagccatctcctaacaactcccgctgaggcctggctctgtccccagcagggcagtgcccagctcctccggcccacccaggctgctccatcagatcccctcaactctgcccctctagggggcgtctcttcagccagccaggccatcctcccagaggagtcctcaggcttgatccctctcccccrggactcatgggccaggctctttccacagctcagagcccaaagttcagagagggtggctccactgagggcccctgggggcaaggtcactgtctggtcacccagtagagcccagcacagagtaaaggctcagggcacacaggccctcaagtgtacacacagggggtgttaggagaccctccccctgaggacaccacacagactcagcacaggcagcctcgctggacacgcgcccctctctgcagtctccccagaagcagactggctgcgtcctgctctggttctttgagagtcagccatagc

SEQ ID NO: 131135 - DNA, 601 bp, Human
acccaccaaatgatccttttctcaaaggttctatgcacacacacacatgcacacacacatgcacacgcacacgcacaccaggaaagatggctcagtttttcctactcagctgtggctctgcccagtcatcctggtcccagtcactcttgctaaagcatgacgtgggccttggtccccaggacaccaccaagttcctccttgtcagaaggggcccatccactttcaagagcttctccctccaccagcttcagttatacttcccagccctgaccctgccagccgggcccaaaactcagtgaarcctccttcctgtcagccatctcctaacaactcccgctgaggcctggctctgtccccagcagggcagtgcccagctcctccggcccacccaggctgctccatcagatcccctcaactctgcccctctagggggcgtctcttcagccagccaggccatcctcccagaggagtcctcaggcttgatccctctcccccgggactcatgggccaggctctttccacagctcagagcccaaagttcagagagggtggctccactgagggcccctgggggcaaggtcactgtctggtcacccagtag

SEQ ID NO: 131136 - DNA, 601 bp, Human
gtgttcttccattggtcagcacccaccaaatgatccttttctcaaaggttctatgcacacacacacatgcacacacacatgcacacgcacacgcacaccaggaaagatggctcagtttttcctactcagctgtggctctgcccagtcatcctggtcccagtcactcttgctaaagcatgacgtgggccttggtccccaggacaccaccaagttcctccttgtcagaaggggcccatccactttcaagagcttctccctccaccagcttcagttatacttcccagccctgaccctgccagcygggcccaaaactcagtgaaacctccttcctgtcagccatctcctaacaactcccgctgaggcctggctctgtccccagcagggcagtgcccagctcctccggcccacccaggctgctccatcagatcccctcaactctgcccctctagggggcgtctcttcagccagccaggccatcctcccagaggagtcctcaggcttgatccctctcccccgggactcatgggccaggctctttccacagctcagagcccaaagttcagagagggtggctccactgagggcccctgggggcaaggtc

SEQ ID NO: 131137 - DNA, 601 bp, Human
gcccacaggacatcatcctcagagacccttctcccatcatggcccatccccatggggaccattcccacaaggtcacctagactagcaggtatgggagctcacggcccagtctatctgcccagcagtgttcttccattggtcagcacccaccaaatgatccttttctcaaaggttctatgcacacacacacatgcacacacacatgcacacgcacacgcacaccaggaaagatggctcagtttttcctactcagctgtggctctgcccagtcatcctggtcccagtcactcttgctaaagcrtgacgtgggccttggtccccaggacaccaccaagttcctccttgtcagaaggggcccatccactttcaagagcttctccctccaccagcttcagttatacttcccagccctgaccctgccagccgggcccaaaactcagtgaaacctccttcctgtcagccatctcctaacaactcccgctgaggcctggctctgtccccagcagggcagtgcccagctcctccggcccacccaggctgctccatcagatcccctcaactctgcccctctagggggcgtctcttcagccagccaggccat

SEQ ID NO: 131138 - DNA, 601 bp, Human
tgtttttctttggtttggtttggtttcagaagtttgaatgtactgcttattacaaaatgtaaattaactaagtataagattaaattccctctgtgttctgtattgttagctattcacactgtaacagtctctggtgatgatgcttacatgtcaaaagaaatattacgaattatcaataaagaaacaaatgggatgaaatatcttctgttgagtctcaagcttgaactgttcaaaataaaatcaagcacagagggcaaatgtttcccgtgaggaaatggcctcgggggtacatcattccccrgggctctctgggaccatattgctcacgcaaggctgaccagaggcttcttgaaacccaggcccagaggtgaggcatctgcctttgcagtcaggaagccctggggaaaaccagcgtgggtctgctctcatgctgaaaggtgcccttactcaaggccttgtctgacccctgcccccaccagtgcactgctgccctagactagacttcatccgtcacgtcaagctcccacccatgtgaggaatgaggccagactaaagaccatgaagcagtgagatgtggtgtcaccaagactcagtcagaagt

SEQ ID NO: 131139 - DNA, 601 bp, Human
ctctccaaaggatatatgagaaacatttacagtggttgctcattcagggaggtaggaagtgagtgagtggaggtgagggggagagacttttcatggcatgtttttctttggtttggtttggtttcagaagtttgaatgtactgcttattacaaaatgtaaattaactaagtataagattaaattccctctgtgttctgtattgttagctattcacactgtaacagtctctggtgatgatgcttacatgtcaaaagaaatattacgaattatcaataaagaaacaaatgggatgaaatatcwtctgttgagtctcaagcttgaactgttcaaaataaaatcaagcacagagggcaaatgtttcccgtgaggaaatggcctcgggggtacatcattccccggggctctctgggaccatattgctcacgcaaggctgaccagaggcttcttgaaacccaggcccagaggtgaggcatctgcctttgcagtcaggaagccctggggaaaaccagcgtgggtctgctctcatgctgaaaggtgcccttactcaaggccttgtctgacccctgcccccaccagtgcactgctgccctagactagact

SEQ ID NO: 131140 - DNA, 601 bp, Human
gctgaaaaggaatgaggcttccttctgtgaattgatatgaaaagatcttcaagatacattgttatgttaaaaaataaaaaacaaggtacagcacagcatgtataatgtacaaccttttgtgtaaaaaaggaagaaaataagacgatgtgcaatataaatctctccaaaggatatatgagaaacatttacagtggttgctcattcagggaggtaggaagtgagtgagtggaggtgagggggagagacttttcatggcatgtttttctttggtttggtttggtttcagaagtttgaatgtacygcttattacaaaatgtaaattaactaagtataagattaaattccctctgtgttctgtattgttagctattcacactgtaacagtctctggtgatgatgcttacatgtcaaaagaaatattacgaattatcaataaagaaacaaatgggatgaaatatcttctgttgagtctcaagcttgaactgttcaaaataaaatcaagcacagagggcaaatgtttcccgtgaggaaatggcctcgggggtacatcattccccggggctctctgggaccatattgctcacgcaaggctgaccagagg

SEQ ID NO: 131141 - DNA, 601 bp, Human
caaggcgacctggtgagagggcagacagtgggatacccacccgctccgtcattccattgttcacggccggtgagcccccaggccgcgtgctggttacatatttccaccatcaccctgactgacaagatactgacccaagaccaccttacgtggcccgaaagatcattacacccttctgtccaaagagcccttggaaaggacaccagagcagccagagaagtcacccaccccctggctggccagcgacagaggcaccagggcaagaagccactggaggcccagacaagccctcccgaccttrtaggatgtagcgactgcccaagtttggccaagaacactgaagagacctctctgagcagaacctggtgtgccctcacccacaccccgccagatgcctctgccttcaggaacctggctgggccggtgtggcggtggcaggtgtggtgggcgtgcatcacgaggcgtacctgctcgggcttgatgggctctgtggtggtgaagatgtctgagtagtgctgcctctcaaacacgcggtccagcacctccagctgctgctgtgtgaacaagtctccccgcatctgcttccggaggaagtctctgc

SEQ ID NO: 131142 - DNA, 601 bp, Human
tatttgttatgtgaatgcgtcttgcagcgtggccttaggcaagttgctctgcctctctggaccttggttttaccatctgaaaacaaagtggctagaaggtctgtaagagctctcatagaaactgctcagacacagacagactgtcatagatgggtggccccagaggccctgctcttccctcaccacacggttctctccagcacctcgcctctccatgggagctgtgcagggaggctacactgcttggactgactttttggagaagattcagaagcatcctctaattagcatttagaggaarctcagtgcagccagttctcaccactagtaccagcgaggaaagtgccgaggaaagttgttgtctgtagggtctctctggttggcccaccaggtgggagctcttggcagtccagagccatgtctagcctgcaaggttacctgtcaaggccctggcacacactgggtgtcaggaaatagtcttatgaactgaatctgatagtccagagatcttagtcaggcctcaagagcctctcactgggccgagcctcgtgatctcatctctatagccacaggtagtgactactctgcccagggtatagca

SEQ ID NO: 131143 - DNA, 601 bp, Human
ctggatccccgctcttccctgttcacttgctgggtgacctcagacatgccctgtcctctctctgggcctctaaaaaaacaacaggttgaaatcttgcctctgtggctcctgttacccctaaaattacatgatcttgtcagccattagaagataaactttctggccaggtgcagtggctcatgcctgtaatcccagcactttgggaggccgaggcaggcggatcatgaggtcaggagatcaagaccatcccggctaacacggcgaaaccctgcccctactaaaaaatagaaaaaattagccrggcatggtggcgggtgcctgtagtccgtcctactcgggaggctgaggcaggagaaaggcgcgaacccgggaggtggagcttgcagtgagccgagatcgcgccactgcactccagcctgggcgacacaacaagattctgtctcaaaaaaagaaaaaagataaaccttctggctgggcgcagtggctcacacctataatcccagcactttgggaggccaaggagggtggatcacctgaggtccggagtccaagactaagcctggccaacatggtgaaaccccatctctactaaaaatacaaa

SEQ ID NO: 131144 - DNA, 601 bp, Human
aaggagttatggtgcagattctgagtctccatgacggtcatgtgaaacacagagggagtctcacacggagtgtctgtgtgaataaggggttcacagaaacacttgtgctgcagaggccaggtggagtgcagaggcctggatccccgctcttccctgttcacttgctgggtgacctcagacatgccctgtcctctctctgggcctctaaaaaaacaacaggttgaaatcttgcctctgtggctcctgttacccctaaaattacatgatcttgtcagccattagaagataaactttctggccrggtgcagtggctcatgcctgtaatcccagcactttgggaggccgaggcaggcggatcatgaggtcaggagatcaagaccatcccggctaacacggcgaaaccctgcccctactaaaaaatagaaaaaattagccgggcatggtggcgggtgcctgtagtccgtcctactcgggaggctgaggcaggagaaaggcgcgaacccgggaggtggagcttgcagtgagccgagatcgcgccactgcactccagcctgggcgacacaacaagattctgtctcaaaaaaagaaaaaagataaacct

SEQ ID NO: 131145 - DNA, 601 bp, Human
tttcaataaccgttttgaaaaggaagtgtttcattgcccaggcgtggtcaacattaacgccttccacccagggcaaagcgtttactacatttccctacaaaagccagcagcctgggcccacccacccaggtagatcttggcgggaaaagctgcaagtggggcaggctccgagctaacagcagtaactgtcaggacccctgcctggccccaatgaggaatgttcttcccatgggagacagggtgggaggatccgggaggatgtggcctctccaaacctatggcaagttctgagagttctggatgacaggcagactctgactgaaataggccaggtctggaaaccagctagccagaaaactggcccctggaatcgtcctggacctggaggcccatggaaccatcttgcatgagatgaagacagaagaccctgagatgagattccagctctgcggttcaacaatcttggaaactccttgaataaacaatctgtgaaaaaaaatgttctagtctatacaatggggctcccgaatcatgcccagcctgtttggcaggcatttgcctcgggggtccaatgagaggatggatgtgaacggtctttgtg

SEQ ID NO: 131146 - DNA, 601 bp, Human
ccccttcccaggaacaggatgcccacaggagaaggcaatgctgttcggcccaccagcctggagaggtgccaccactgagggggcaaagcagctgatgagagcaggaggcatttctagtggttttctctgttagacaaggggcagatcttctcccagtttaacctcctgtgacctttgaactccctgggaggtcagcagcacatccccttccccagctgtctctctgtctctggcccaatgggagggagggccctggcccgttccattttgcacccgtattgatctattggcagcaatgggmtggataattagccaggaattagggtttctattacagccaggaggctgctccagctgatttatcacctgaataatttactgtgattgaaaggaaattaaaatgaactccatttgacaactgtgagcttttatgggctttagtgaaggctcaaaagccagattaatagcctggtgttggttaatagtctgccgagagtaaatacggcaggctatgctccgtagccttcctgtggccgccggaggagggacccgctcccaacaggagcgctgcgccgacgacaacgtcaacgggagttttact

SEQ ID NO: 131147 - DNA, 601 bp, Human
ggtgaaggggcgtgatggggatgaaggtccggggttgggtttcaatggtgggaaaccatgaggaactcttataggaggtaggcttcaagaagaaagagatccaacggtagtcgcaggaacaggacgagaggcaagaagtcccagtgaaggttgcttccaaggtgagcagaataatccaggccacagatcccgggctctgggacacactgccctcaaagcagtcacacctcatctctgcgttccacccctctgtggttgaggtcccctcctgctcctccaccccattgtacctgacttcctktcactgacccccatttcaaccatccaggcccccttgcagctccctgcccacacctgcattcctctcttcccacagtcctttgcctgtgctgctccttcggcctagaatgccttctccagcccgccatctgctattgccacggggctgcattctgcccttccctcaaggcacctcctccaggaagccttcctctttctcagcctggcccacctgtctccccacctcctcctctcctcctctcctcctcatggtgggacacagatccataatgaaggaaaatgagctctctgaagaaaaaaa

SEQ ID NO: 131148 - DNA, 601 bp, Human
ctggggggtaccccaatggccaccagcctgggctctggaggcaaggacctggcttatgatcttggccccatatttactgtgtgcccttggctaagccactgtactcatctcaccaagcctcagctactctgcctgcacaacggggatgatgggagttgttgtgacttggtaatgaggtggggtaagtaagagtcttttcagaacagagccaggcatgccataagcaatgaatacatagtagctacagcaattactacagcaatcactaaaacccaatatatttatgagctcagataagagmcaagttggtgcaggccgaattggtgcagggccattgaaggcctcacagggcaggcaggactcctcctgggcccggacagggtaggatttagaaacaggctgaaagaatgttccaggcagggaagcagtgagcagcagcttagagagtgagccacaaaattaagaaagtaataactgtagtacctgtcacgaaacacgctcagagcctcacctgggattcacacgttcatgcacatacacacatgcgcacgccagccctgggagaggctgggtcatgggcagcagcccccttggacacagg

SEQ ID NO: 131149 - DNA, 601 bp, Human
gttgcatctccaggaaactatccatctctaagagtcagtgggcagcctgtgctgcaactggggggtaccccaatggccaccagcctgggctctggaggcaaggacctggcttatgatcttggccccatatttactgtgtgcccttggctaagccactgtactcatctcaccaagcctcagctactctgcctgcacaacggggatgatgggagttgttgtgacttggtaatgaggtggggtaagtaagagtcttttcagaacagagccaggcatgccataagcaatgaatacatagtagctmcagcaattactacagcaatcactaaaacccaatatatttatgagctcagataagagacaagttggtgcaggccgaattggtgcagggccattgaaggcctcacagggcaggcaggactcctcctgggcccggacagggtaggatttagaaacaggctgaaagaatgttccaggcagggaagcagtgagcagcagcttagagagtgagccacaaaattaagaaagtaataactgtagtacctgtcacgaaacacgctcagagcctcacctgggattcacacgttcatgcacatacacacat

SEQ ID NO: 131150 - DNA, 601 bp, Human
caaggccctgaccccagcacacaagtcccctcgcacctcaccaacttaccacataccactttctgctaatgtgctgaccagcctactcctcccccatgggacctggccctgaactcctgggcagaggaagccagatactgtctggaggcagcaaggctgacagcagccaccagtatcctggccctggcatcttcaccagaaccccagccctgctccctgcactagaggagctggagtcatccaatggcctcccaagaccctgcagtccccacccctttgctgctcagggccatggctcctrtgatgcagactgaccctctttgtccaccctagtgaggattcctcgggggaactgcccttcagtgccccttccggtgcttcagtgtaaaagatcttctctactccttcccctcttcccaccagacccttctcattcttcttatcttagaatcattctttcaggttggaaaggcattggcatttagataattaagctctctggattcttaaacttctaaaaccacatgtatgaaaatggatagattctacttgcatgcctccagcaatgggaagctcactacttaacaaggaggcccattcc

SEQ ID NO: 131151 - DNA, 601 bp, Human
acaatccaaggccctgaccccagcacacaagtcccctcgcacctcaccaacttaccacataccactttctgctaatgtgctgaccagcctactcctcccccatgggacctggccctgaactcctgggcagaggaagccagatactgtctggaggcagcaaggctgacagcagccaccagtatcctggccctggcatcttcaccagaaccccagccctgctccctgcactagaggagctggagtcatccaatggcctcccaagaccctgcagtccccacccctttgctgctcagggccatgrctcctgtgatgcagactgaccctctttgtccaccctagtgaggattcctcgggggaactgcccttcagtgccccttccggtgcttcagtgtaaaagatcttctctactccttcccctcttcccaccagacccttctcattcttcttatcttagaatcattctttcaggttggaaaggcattggcatttagataattaagctctctggattcttaaacttctaaaaccacatgtatgaaaatggatagattctacttgcatgcctccagcaatgggaagctcactacttaacaaggaggcc

SEQ ID NO: 131152 - DNA, 601 bp, Human
tctaaatgtcaggaaaaaaaaaaatggcttccattaaggaactggactctcctccactggtggacaatgagaagaacacaactgattgcatttcccattttgctttgaccatcaggaagctcagaatcaaattcaagctaactctaggaactacgggggcctggctggagacttggagggttggtggggggaagtgtgaggaggtgggggagcagaagggaaaggagagaagccgtgcatgatggggccacactttttgggcaatactacggactggagagaagctagacccaggcagccrtcttcaggggtacagcaacgtcgcttataccctagcaatcgcctcctggtcccctagctctccgagtctcctcacagctgcaagagtaatcttccactctgtgttggattggatcctgatattccctgatttaaaatctcacagaggcctctctttgctctcaaggtaatacaatccaaggccctgaccccagcacacaagtcccctcgcacctcaccaacttaccacataccactttctgctaatgtgctgaccagcctactcctcccccatgggacctggccctgaactcctgggcag

SEQ ID NO: 131153 - DNA, 601 bp, Human
gggaagtcctgaacaaaagcgcatccagcctaccatctccttctttaatctctaaaacatatgacttctccctccttcaagtccccaagtccctgcctaccaagctcccaccagagaagtcaacgcaaactacgaaattcttattctcatcaagagttgagctgatgcagtcgatggtgaccactggaggcaccttccaatagactgaaacttttccacctaaggaggacattttcccaggggtaccctctgggtggcaggaggtctcaaagccccaaagcgtatcttcccagagcatcargttggaaaatctaagaagagctaccctagagggtctgggattttttcttagttaagttgggctatcagaaaagctgctttcttgagcctcatggtcacagtagccctgcccctgcagaaatgcactgattagcatgtgggcgtcatactcatccataagacaagctctatacaacctactgcagggcctctaaatgtgctgttgaggaccgtgaccattgcctcactggtctacccactgaaaacccatgtgaaaatttccttccactctaaatgtcaggaaaaaaaaaaatggcttcca

SEQ ID NO: 131154 - DNA, 601 bp, Human
gagcccaggacaagcagttagctgtgctcgctggtgggcggcatcgctgtgccttgcggctcagaagcccttctctggaacttcaagcttctacacgcttcaggtttcccataggaaggcccagttaagtccgtctctcagttccatcttcccctcctgcaactgggtgggtaagccagggagggtctgctctacagggcagtcagtttgggaaataacgtgccagaagcttcactttaggtctcctctaaggggtgcttaagttaagcctaagtggtactgcgcaactcaggttttcagrgcccctagaaacggttgggaaggtatggagtgagtatttgggtacttgttcagtacccaaatcaataccttgtccatttttgctaggttggcaaccctacagaggaagaataagaaagaagattcaaagctccaaccaaaccccaactcttcctttccacaaaagcagagccttacaaatagtgtgccaagatatcaaactctgtcagcctttggatgaccaggggacatgtggggaagctaaagcctgtaggccagttgcctccagccacgagcatcctgtttatcccagtgtgttacg

SEQ ID NO: 131155 - DNA, 601 bp, Human
tattcttggcagcaaatcaagtgaggtcccatagagtccatgtaattttcatccttgggtcactttgagatgatgacaatagaataaatagaataagggagagtatggctggtctagaggcacccggcacttctagagatctagggagcaacaattccagaataatccttgtgattatctcattcctaaggcaaaatagcgtccaagttaaatcttaagcagttcagtgaacaggaaggtatttctacctcctctcctcctgctggggacaactgggatgagaagccttgtcccccccacytccaccctcttatagctccctgccatgggaggagtcacttatccgactggtcagagcccaggacaagcagttagctgtgctcgctggtgggcggcatcgctgtgccttgcggctcagaagcccttctctggaacttcaagcttctacacgcttcaggtttcccataggaaggcccagttaagtccgtctctcagttccatcttcccctcctgcaactgggtgggtaagccagggagggtctgctctacagggcagtcagtttgggaaataacgtgccagaagcttcactttaggtctcct

SEQ ID NO: 131156 - DNA, 601 bp, Human
aatattcttggcagcaaatcaagtgaggtcccatagagtccatgtaattttcatccttgggtcactttgagatgatgacaatagaataaatagaataagggagagtatggctggtctagaggcacccggcacttctagagatctagggagcaacaattccagaataatccttgtgattatctcattcctaaggcaaaatagcgtccaagttaaatcttaagcagttcagtgaacaggaaggtatttctacctcctctcctcctgctggggacaactgggatgagaagccttgtcccccccrcttccaccctcttatagctccctgccatgggaggagtcacttatccgactggtcagagcccaggacaagcagttagctgtgctcgctggtgggcggcatcgctgtgccttgcggctcagaagcccttctctggaacttcaagcttctacacgcttcaggtttcccataggaaggcccagttaagtccgtctctcagttccatcttcccctcctgcaactgggtgggtaagccagggagggtctgctctacagggcagtcagtttgggaaataacgtgccagaagcttcactttaggtctc

SEQ ID NO: 131157 - DNA, 601 bp, Human
cccaggcaatattcttggcagcaaatcaagtgaggtcccatagagtccatgtaattttcatccttgggtcactttgagatgatgacaatagaataaatagaataagggagagtatggctggtctagaggcacccggcacttctagagatctagggagcaacaattccagaataatccttgtgattatctcattcctaaggcaaaatagcgtccaagttaaatcttaagcagttcagtgaacaggaaggtatttctacctcctctcctcctgctggggacaactgggatgagaagccttgtcccccccacttccaccctcttatagctccctgccatgggaggagtcacttatccgactggtcagagcccaggacaagcagttagctgtgctcgctggtgggcggcatcgctgtgccttgcggctcagaagcccttctctggaacttcaagcttctacacgcttcaggtttcccataggaaggcccagttaagtccgtctctcagttccatcttcccctcctgcaactgggtgggtaagccagggagggtctgctctacagggcagtcagtttgggaaataacgtgccagaagcttcacttt

SEQ ID NO: 131158 - DNA, 601 bp, Human
gcctaagagccatcactaaagcccagaaccccacgcttttcactatggcaatttgcccagtattccctcaaacatccccctcccttacaaagcaggaacgatttttactggggagctgtccttgtgcttggttcacaggaagacaaagactactcaactgtttagaaaatatttcaaaagctacttagagacaaatggacatccccaggcaatattcttggcagcaaatcaagtgaggtcccatagagtccatgtaattttcatccttgggtcactttgagatgatgacaatagaataaayagaataagggagagtatggctggtctagaggcacccggcacttctagagatctagggagcaacaattccagaataatccttgtgattatctcattcctaaggcaaaatagcgtccaagttaaatcttaagcagttcagtgaacaggaaggtatttctacctcctctcctcctgctggggacaactgggatgagaagccttgtcccccccacttccaccctcttatagctccctgccatgggaggagtcacttatccgactggtcagagcccaggacaagcagttagctgtgctcgctggt

SEQ ID NO: 131159 - DNA, 601 bp, Human
ggtgcaggcagctctttgacaattcacttgtaatctttaaatcccacaaacacagaatttgcctgtcatcaaaaagagtggaacagacaggaggaaaaactgtaaacaagtcaaaataaaaataagtgatggatttcccatttgttttatcactcacagaatgttagagctagaatggatctcaaggatgacccagggcaatctcccaccctaaatgcaaaaaccatgacccagagtgactagcctaagagccatcactaaagcccagaaccccacgcttttcactatggcaatttgcccrgtattccctcaaacatccccctcccttacaaagcaggaacgatttttactggggagctgtccttgtgcttggttcacaggaagacaaagactactcaactgtttagaaaatatttcaaaagctacttagagacaaatggacatccccaggcaatattcttggcagcaaatcaagtgaggtcccatagagtccatgtaattttcatccttgggtcactttgagatgatgacaatagaataaatagaataagggagagtatggctggtctagaggcacccggcacttctagagatctaggga

SEQ ID NO: 131160 - DNA, 601 bp, Human
atatataatgctttattgttatatttgatccaattgtttgcaataggagagcctacaatagctcagatcttgttataagaatcagaaatctacgttcttttttaaaaaataatttacaaaacaataaatgtttatttttattgttttttaagagttttgtaaatagccgacttccttaagtcaaacttccgacacaccctcaaaacaaacaaggtgtaagaccaaaattagctgttcttttgtcttttttttgaattgcaaatattggatagccttgtttgaggggaaatatctctactcraaagtcaattctcacacagtattttggctgcatcaattgctgttactttatgccacacaacacagcacaggtggtcaatgtcactgacatggcatatctgtaaaaatttcttggatgaatgaatgaataaatgaatgaaagaacaaccgagcaaggtgcaggcagctctttgacaattcacttgtaatctttaaatcccacaaacacagaatttgcctgtcatcaaaaagagtggaacagacaggaggaaaaactgtaaacaagtcaaaataaaaataagtgatggatttcccatttgtt

SEQ ID NO: 131161 - DNA, 601 bp, Human
ctttctagtctgttccttcttttgtcatggcattttattcttttataatggtttctagtctttttcatctctttaatcattttctagtctctttcaaattgtctgctatcttggattcttggaatactcattttgcccgttatgtctcctaactttccctcattttcttgggtggtttgacatttttaaattgtgagcttatttagtagttattatttattctgtaggcatgttgtacatactaaattgtggaaggagccagatgaaagtttttttatatgcatctgcgaggcatctcagkgatttcactaatatgcctccagtttttatattatttccatccttgaattttttagaaatattttgtttttgtctgagtcccatgtagaatcaagtttccctactgactccttcagcttgtgggtaaaacttacctagtgcccatttcatggaatgtgcagcccttccaggtttctagttttttgcaggagctttggttcccactcctatatatcacacaattctaagactacatcttttgtctcaacatcagcatcaaaaccccagcccctgttcactagagactatattgagaacccat

SEQ ID NO: 131162 - DNA, 601 bp, Human
tctttagctttctatgctatgttcctgagaatttcctcagctttgtctcctcccaaatcagtaattttctattcagctatgtcttatctggtatttaatccatcagttgaatttttaattaattctcacatcataatttttatttctagaaaatttatttgattctctttctagtctgttccttcttttgtcatggcattttattcttttataatggtttctagtctttttcatctctttaatcattttctagtctctttcaaattgtctgctatcttggattcttggaatactcattttscccgttatgtctcctaactttccctcattttcttgggtggtttgacatttttaaattgtgagcttatttagtagttattatttattctgtaggcatgttgtacatactaaattgtggaaggagccagatgaaagtttttttatatgcatctgcgaggcatctcagtgatttcactaatatgcctccagtttttatattatttccatccttgaattttttagaaatattttgtttttgtctgagtcccatgtagaatcaagtttccctactgactccttcagcttgtgggtaaaacttacc

SEQ ID NO: 131163 - DNA, 601 bp, Human
atcacttgagcctgggaggttgaggttacagtgagctgagatcatgccactgtactccagcttgggtgacagagcaagaccctgtctcaaaagaaaaaaatatatacctatctaataattccaaagtctgagtctgattttgatgcttactttgtctcttcttacttttttttttcttgcctaatattttgttgaaagttgtacatgatacatgaagtaattggactaaagtaaggtttcatgttaatctggcagatctcagctgtaactctgtattcttatgacttaggccaagaaaacstgttgattttccttttgttcagctttacttcttattgtaaagatcagagtaatggtgtcaaaactccacttgtcagagctgaaactgcaagtctctcatatctttcttattgaagtacatgatttagcagttcagcaagagtctgtgagtggtaaactctccctgccattatctgaaaatgtctttatttgccttcactgttaaatgatcatttatctgagtacgaggtaattattactatctcttaacactcgaagatattttctgttgtcttctgacttctaacaatgctgaaaaaag

SEQ ID NO: 131164 - DNA, 601 bp, Human
tactgtgttttttatttttcttttgattctttcttagaattttcatctctctgcttacattactcatccattcatgtatgttgtttactttttccattacagtccttaacatattaattatagtcattttaaattccctatcttggccaggtgcagtagctcacacctgtaattccagtactttggggggccaaggcaggttgattacctgggctcaggagttcaagaccagcctgggcaacatggtgaaacctggtctctacaaaaaatacaaaaattagccaggcgtggtggtgctgcytgtagtcccagctacttggggggctgagaggggagaatcacttgagcctgggaggttgaggttacagtgagctgagatcatgccactgtactccagcttgggtgacagagcaagaccctgtctcaaaagaaaaaaatatatacctatctaataattccaaagtctgagtctgattttgatgcttactttgtctcttcttacttttttttttcttgcctaatattttgttgaaagttgtacatgatacatgaagtaattggactaaagtaaggtttcatgttaatctggcagatctcagct

SEQ ID NO: 131165 - DNA, 601 bp, Human
tttgcttttcagtgtgggaaagtttctattgtcatatcttcaagctcccaaattcttggtttggctgtgtccagtctagtgatgagcccagcaaagaaagtctttatttctgttactgtgttttttatttttcttttgattctttcttagaattttcatctctctgcttacattactcatccattcatgtatgttgtttactttttccattacagtccttaacatattaattatagtcattttaaattccctatcttggccaggtgcagtagctcacacctgtaattccagtactttgggrggccaaggcaggttgattacctgggctcaggagttcaagaccagcctgggcaacatggtgaaacctggtctctacaaaaaatacaaaaattagccaggcgtggtggtgctgcctgtagtcccagctacttggggggctgagaggggagaatcacttgagcctgggaggttgaggttacagtgagctgagatcatgccactgtactccagcttgggtgacagagcaagaccctgtctcaaaagaaaaaaatatatacctatctaataattccaaagtctgagtctgattttgatgcttact

SEQ ID NO: 131166 - DNA, 601 bp, Human
aaattcccagccattgttatttcaaatatttcttcttcttcattctctcttctccttccggcaacctaattataaatatgctatgcctcttaaaattatcccacagttcttaggtgttctgttctggttttgttttttcattcttttttctctttgcttttcagtgtgggaaagtttctattgtcatatcttcaagctcccaaattcttggtttggctgtgtccagtctagtgatgagcccagcaaagaaagtctttatttctgttactgtgttttttatttttcttttgattctttcttmgaattttcatctctctgcttacattactcatccattcatgtatgttgtttactttttccattacagtccttaacatattaattatagtcattttaaattccctatcttggccaggtgcagtagctcacacctgtaattccagtactttggggggccaaggcaggttgattacctgggctcaggagttcaagaccagcctgggcaacatggtgaaacctggtctctacaaaaaatacaaaaattagccaggcgtggtggtgctgcctgtagtcccagctacttggggggctgagaggggag

SEQ ID NO: 131167 - DNA, 601 bp, Human
attttggtgttctctaagttttctgcatttgtggttagcatctgtcactaattttgaaaaattcccagccattgttatttcaaatatttcttcttcttcattctctcttctccttccggcaacctaattataaatatgctatgcctcttaaaattatcccacagttcttaggtgttctgttctggttttgttttttcattcttttttctctttgcttttcagtgtgggaaagtttctattgtcatatcttcaagctcccaaattcttggtttggctgtgtccagtctagtgatgagcccakcaaagaaagtctttatttctgttactgtgttttttatttttcttttgattctttcttagaattttcatctctctgcttacattactcatccattcatgtatgttgtttactttttccattacagtccttaacatattaattatagtcattttaaattccctatcttggccaggtgcagtagctcacacctgtaattccagtactttggggggccaaggcaggttgattacctgggctcaggagttcaagaccagcctgggcaacatggtgaaacctggtctctacaaaaaatacaaaaat

SEQ ID NO: 131168 - DNA, 601 bp, Human
gtagatattttggtgttctctaagttttctgcatttgtggttagcatctgtcactaattttgaaaaattcccagccattgttatttcaaatatttcttcttcttcattctctcttctccttccggcaacctaattataaatatgctatgcctcttaaaattatcccacagttcttaggtgttctgttctggttttgttttttcattcttttttctctttgcttttcagtgtgggaaagtttctattgtcatatcttcaagctcccaaattcttggtttggctgtgtccagtctagtgatgrgcccagcaaagaaagtctttatttctgttactgtgttttttatttttcttttgattctttcttagaattttcatctctctgcttacattactcatccattcatgtatgttgtttactttttccattacagtccttaacatattaattatagtcattttaaattccctatcttggccaggtgcagtagctcacacctgtaattccagtactttggggggccaaggcaggttgattacctgggctcaggagttcaagaccagcctgggcaacatggtgaaacctggtctctacaaaaaatac

SEQ ID NO: 131169 - DNA, 601 bp, Human
aatggtatgtttagaccattcacattcaaagtgattattgatataattggattcatatctactacgtttgtaacttttctacttgttgaacttgttctttgtttctttacgtctcctcttcttccttctctggtttcaactgaacgtgtcatacaattccattttatctcttctgttagcatttcaattatatttctttttttaagtattagtactttccctagagtctgcaatatacgtttatatctaatctaaattcaccttcaaatgatactattcctcttcaatcatgtaccttctratagaatattcccagttcctcattcctgtcccttaggacattgctgccatcatttcacttatccatatgtaataaatcactccatacattgttattattattactttacacaaacagttaccttttagatcaattaagaatagaaaaatcaaaggtcttattttaccttcatttattctttctccaactcccttctttcccttatgtagatctgagtttctgaactacatcattttccttcctctggagaacttcttttaacatttcttctagaccaagtctgctggtgatgaatttcct

SEQ ID NO: 131170 - DNA, 601 bp, Human
cacatgccaccatgcctagctaattttttgcattttagtagagacggggtttcaatatgttcaatggtatgtttagaccattcacattcaaagtgattattgatataattggattcatatctactacgtttgtaacttttctacttgttgaacttgttctttgtttctttacgtctcctcttcttccttctctggtttcaactgaacgtgtcatacaattccattttatctcttctgttagcatttcaattatatttctttttttaagtattagtactttccctagagtctgcaatatacrtttatatctaatctaaattcaccttcaaatgatactattcctcttcaatcatgtaccttctaatagaatattcccagttcctcattcctgtcccttaggacattgctgccatcatttcacttatccatatgtaataaatcactccatacattgttattattattactttacacaaacagttaccttttagatcaattaagaatagaaaaatcaaaggtcttattttaccttcatttattctttctccaactcccttctttcccttatgtagatctgagtttctgaactacatcattttcc

SEQ ID NO: 131171 - DNA, 601 bp, Human
agacagagtcttgctctttcagccaggctggagcacaatggcgagatctcggctcactgcaacctccgcctcccaagttcaagtaattctcctgtctcggcctcccaagtagctgggattacaggcacatgccaccatgcctagctaattttttgcattttagtagagacggggtttcaatatgttcaatggtatgtttagaccattcacattcaaagtgattattgatataattggattcatatctactacgtttgtaacttttctacttgttgaacttgttctttgtttctttacgtcycctcttcttccttctctggtttcaactgaacgtgtcatacaattccattttatctcttctgttagcatttcaattatatttctttttttaagtattagtactttccctagagtctgcaatatacgtttatatctaatctaaattcaccttcaaatgatactattcctcttcaatcatgtaccttctaatagaatattcccagttcctcattcctgtcccttaggacattgctgccatcatttcacttatccatatgtaataaatcactccatacattgttattattattactttacacaa

SEQ ID NO: 131172 - DNA, 601 bp, Human
tatgtatttggttaccatcacttcttaaatcccattctctccttttgtatttcatatccttcttgtaggcaacatatggatgagtccttctgtttttttaatatgctctgacaatctcccttttttttttttttttttttttttgagacagagtcttgctctttcagccaggctggagcacaatggcgagatctcggctcactgcaacctccgcctcccaagttcaagtaattctcctgtctcggcctcccaagtagctgggattacaggcacatgccaccatgcctagctaattttttgyattttagtagagacggggtttcaatatgttcaatggtatgtttagaccattcacattcaaagtgattattgatataattggattcatatctactacgtttgtaacttttctacttgttgaacttgttctttgtttctttacgtctcctcttcttccttctctggtttcaactgaacgtgtcatacaattccattttatctcttctgttagcatttcaattatatttctttttttaagtattagtactttccctagagtctgcaatatacgtttatatctaatctaaattcaccttcaaat

SEQ ID NO: 131173 - DNA, 601 bp, Human
cctatttagattattgttcatttatctatgtatttggttaccatcacttcttaaatcccattctctccttttgtatttcatatccttcttgtaggcaacatatggatgagtccttctgtttttttaatatgctctgacaatctcccttttttttttttttttttttttttgagacagagtcttgctctttcagccaggctggagcacaatggcgagatctcggctcactgcaacctccgcctcccaagttcaagtaattctcctgtctcggcctcccaagtagctgggattacaggcacaygccaccatgcctagctaattttttgcattttagtagagacggggtttcaatatgttcaatggtatgtttagaccattcacattcaaagtgattattgatataattggattcatatctactacgtttgtaacttttctacttgttgaacttgttctttgtttctttacgtctcctcttcttccttctctggtttcaactgaacgtgtcatacaattccattttatctcttctgttagcatttcaattatatttctttttttaagtattagtactttccctagagtctgcaatatacgttta

SEQ ID NO: 131174 - DNA, 601 bp, Human
aggggcattttagtctccccaaaatatcatgggatttgttcatttgttcattgacattttttgctttaaatatttagagactctgttgccaagtgcgtacaggttcaggattgttatattttcctacaaattgttcttgttatcattaagcaataatcctctttgtctttgagcatactttgggccttaaagtttatatcatctgataatgagattactctatcacattttatttggttagtattgccatattttcctctctcagtccttgcaaactttcagtaccattttgttttaggtwaattactaaaaacaccacatttctgggtcttggttattttacacgtcttctatttatcttgcaaatccaatctatttatcgagactactcaaatatttttatttatttctatcctctattgtgtaattttatatttttaatttacctttcttctcccttaccttctattggatccactaagtattctaaatatttctttttgcttattctggtttgcacattatgcattctattaccataatggttaccctttaattgttatccttaatttgctcactggcatccttgacctaacacagc

SEQ ID NO: 131175 - DNA, 601 bp, Human
gggtagggaagtagggtggtagggtggtgtaagtagggggcaggataaatgggcattcatggaagtattccttccaggagttcaaaaagcaaagtattctctaattgttgtcctttcatgtgtctattctattaagcttgttaattatgttgtgcaaaacttacaaatatccctgccaattttttgtcagcttgatttattcattaacaagaggggcattttagtctccccaaaatatcatgggatttgttcatttgttcattgacattttttgctttaaatatttagagactctgttgcyaagtgcgtacaggttcaggattgttatattttcctacaaattgttcttgttatcattaagcaataatcctctttgtctttgagcatactttgggccttaaagtttatatcatctgataatgagattactctatcacattttatttggttagtattgccatattttcctctctcagtccttgcaaactttcagtaccattttgttttaggttaattactaaaaacaccacatttctgggtcttggttattttacacgtcttctatttatcttgcaaatccaatctatttatcgagactact

SEQ ID NO: 131176 - DNA, 601 bp, Human
tctcaaactcctgacctcgtgatccgcccacctcggcctcccaaagtgctgggattgcaggcgtgagccactgcatgaattttcttttctataggccagccagttccacttcctctacaagttccttataagacatatttgggggtagggaagtagggtggtagggtggtgtaagtagggggcaggataaatgggcattcatggaagtattccttccaggagttcaaaaagcaaagtattctctaattgttgtcctttcatgtgtctattctattaagcttgttaattatgttgtgcaaawcttacaaatatccctgccaattttttgtcagcttgatttattcattaacaagaggggcattttagtctccccaaaatatcatgggatttgttcatttgttcattgacattttttgctttaaatatttagagactctgttgccaagtgcgtacaggttcaggattgttatattttcctacaaattgttcttgttatcattaagcaataatcctctttgtctttgagcatactttgggccttaaagtttatatcatctgataatgagattactctatcacattttatttggttagtattgcc

SEQ ID NO: 131177 - DNA, 601 bp, Human
tttttttttttttttttttttgagatggagtcttgccctctcatccaggctggagcgcaatgctgcaatcttggctcactgcaacctccgccttccaggttcaagcgactctcctgcctcagcctcccaagtagctgggattacaggcacacaccaccacgcccagctaattttttgtatctttagtagagacggggtttcaccatctcgagaccaagctggtctcaaactcctgacctcgtgatccgcccacctcggcctcccaaagtgctgggattgcaggcgtgagccactgcatgarttttcttttctataggccagccagttccacttcctctacaagttccttataagacatatttgggggtagggaagtagggtggtagggtggtgtaagtagggggcaggataaatgggcattcatggaagtattccttccaggagttcaaaaagcaaagtattctctaattgttgtcctttcatgtgtctattctattaagcttgttaattatgttgtgcaaaacttacaaatatccctgccaattttttgtcagcttgatttattcattaacaagaggggcattttagtctccccaaaata

SEQ ID NO: 131178 - DNA, 601 bp, Human
cctcttccaagccccaatctgacacttgaaacccctcctcagtcttcctcccaagtggcctcactgcccacaccagacactctcagcgacagaagattcccagcccaatccacatttaggcagctcgcctgcttggaaggtttccttcaactaagatgagagctgcctctctgtaatttccacctaaatcctgggtctgccccttggaactacgaagaagtctgcttctgttccttctccacaggagcccttttgagatcagatcacattcttgcatatccactgagttttcttttttttytttttttttttttgagatggagtcttgccctctcatccaggctggagcgcaatgctgcaatcttggctcactgcaacctccgccttccaggttcaagcgactctcctgcctcagcctcccaagtagctgggattacaggcacacaccaccacgcccagctaattttttgtatctttagtagagacggggtttcaccatctcgagaccaagctggtctcaaactcctgacctcgtgatccgcccacctcggcctcccaaagtgctgggattgcaggcgtgagccactgcatgaattttctt

SEQ ID NO: 131179 - DNA, 601 bp, Human
attaacctgtcatttagaactcatctaagtccctaagctccttctgaaagcttgtttgtcataatcttccttgcatgctctcatcctgatgagccggctcttgccaggaacccttgaactactgtaaccaacaggtagataaagttatctgtcctcttggtgagcctgaaatgaaaacatcaccaattctgttgccctgacccaagaagggtctgcaccttcttaaaagcattgacactgagctggactatgtgatgatcttcaataaaatcatcccatttggtttcatagccaagacatygggaaagaatcaacaaattcatcttttctccaaaatagaagagaggaaatgcaaccacatgcgtcacagaatgccaaagctcagagctggaagggaccctggtggttacctcttccaagccccaatctgacacttgaaacccctcctcagtcttcctcccaagtggcctcactgcccacaccagacactctcagcgacagaagattcccagcccaatccacatttaggcagctcgcctgcttggaaggtttccttcaactaagatgagagctgcctctctgtaatttccacctaaatcct

SEQ ID NO: 131180 - DNA, 601 bp, Human
agcctcatggatggacacagataggaccgttattaacctgtcatttagaactcatctaagtccctaagctccttctgaaagcttgtttgtcataatcttccttgcatgctctcatcctgatgagccggctcttgccaggaacccttgaactactgtaaccaacaggtagataaagttatctgtcctcttggtgagcctgaaatgaaaacatcaccaattctgttgccctgacccaagaagggtctgcaccttcttaaaagcattgacactgagctggactatgtgatgatcttcaataaartcatcccatttggtttcatagccaagacattgggaaagaatcaacaaattcatcttttctccaaaatagaagagaggaaatgcaaccacatgcgtcacagaatgccaaagctcagagctggaagggaccctggtggttacctcttccaagccccaatctgacacttgaaacccctcctcagtcttcctcccaagtggcctcactgcccacaccagacactctcagcgacagaagattcccagcccaatccacatttaggcagctcgcctgcttggaaggtttccttcaactaagatgaga

SEQ ID NO: 131181 - DNA, 601 bp, Human
gcctcagcctcccaagcagctgggaccacaggggcccgccaccacgcctggctaattttttgtatttttagtagagacggggtttcaccatgctagccaggatggcctcgatctcctgacctcatgatccacctgcctcagcctcctaaagtgctgggattacaggcgtgagccaccgtgcccggccaacacaagtattgttattatccccattttacttatgagaaaactgaggataaagcagtggtaaagccaagtagattggaaataataactttgtacacaaaggaagaaaagttcrtatttgtttgagatgtgataataaccagtgttctcaaagctaggaataaaggaagaatcacatagactccagaggtaagcctacattcacttttattaccacaatctcccaagagattacgtgagctcaaaactaacgtaacaggttgcaaagtcacaagcagctgcttccgaagcttgtgctcttaaccatgacactatgctacttccagcagtcctccagacatgggtccctgacgcactccccagtagaaagcacaccaccgtcctctcctcaggcctttctgggccaggcatgggg

SEQ ID NO: 131182 - DNA, 601 bp, Human
gtttgttttgttttgttttgtttttgagacagagtctcgctctgtcgcccaggctggagtgcagtggcacaatctcggctcactgcaacctctgcctccgggttcacgccattctcctgcctcagcctcccaagcagctgggaccacaggggcccgccaccacgcctggctaattttttgtatttttagtagagacggggtttcaccatgctagccaggatggcctcgatctcctgacctcatgatccacctgcctcagcctcctaaagtgctgggattacaggcgtgagccaccgtgccyggccaacacaagtattgttattatccccattttacttatgagaaaactgaggataaagcagtggtaaagccaagtagattggaaataataactttgtacacaaaggaagaaaagttcgtatttgtttgagatgtgataataaccagtgttctcaaagctaggaataaaggaagaatcacatagactccagaggtaagcctacattcacttttattaccacaatctcccaagagattacgtgagctcaaaactaacgtaacaggttgcaaagtcacaagcagctgcttccgaagcttgtgc

SEQ ID NO: 131183 - DNA, 601 bp, Human
aacactccttaataataataacaatgataataaaggaacatttggagtacctactatgggctgaaccctctgtcaaactttgtttaatcagtacaaccacctacaacacaagtattgctgtttttttgtttgttttgttttgttttgtttttgagacagagtctcgctctgtcgcccaggctggagtgcagtggcacaatctcggctcactgcaacctctgcctccgggttcacgccattctcctgcctcagcctcccaagcagctgggaccacaggggcccgccaccacgcctggctaattttttgtatttttagtagagacggggtttcaccatgctagccaggatggcctcgatctcctgacctcatgatccacctgcctcagcctcctaaagtgctgggattacaggcgtgagccaccgtgcccggccaacacaagtattgttattatccccattttacttatgagaaaactgaggataaagcagtggtaaagccaagtagattggaaataataactttgtacacaaaggaagaaaagttcgtatttgtttgagatgtgataataaccagtgttctcaaagctaggaataaaggaag

SEQ ID NO: 131184 - DNA, 601 bp, Human
ctgaaactactctccctttcccagactgaacgcatatgcatatgtctccatgcttttgttctttctcttcttcctctttccacttccctacctggcaccctcttcctcatcctcctccccacacactctctgtgcaccccacccccgttgcccctggtgaaaggcagagccgtgtctatatcactgagacattccctgagaatgcaaataataataaataacatcctctgaacgtctcccacgtgccaggcactgtccaagactttggagacacacgggagcctcacaccagctctgtgckagcatatcggcatggctaccctcctcttgtggatggagaaactgatgctgagtgagggggagcaaactatcccaatcacacagccagcaggtacgcacgccaggttccaggaccagggactccagagctctggctcttaccgccttgccatgtggccagcacaggtgcagcccgaccataagtgggagcggcgagtgtccctgagaacaaggttaccgaggctgacagtccatcccttcctccgagagggacgggacacattctgttaggcagtttccttagaagtatcacagtctgggt

SEQ ID NO: 131185 - DNA, 601 bp, Human
catgaggccctccccactgccagctggagaagggaagctggttcacgacctcacagagtccatgagatgcagaccgcccattactcagaggttttctgactaactctcaaaccaggtggaatttctccccaaaacccccctaaagagcaagctgagaaagtgccgaatgcgcttcagatccaggggtggttttcaaacatgatttcttagggtgtctccatatgggttcagtataactctaaggggaccacactggtggggcagttacccaattgaatggctttatccggtaatgattttaaaataaatgaaagggacataaattaaatgttctccaagcatttttatttctaaccggggaccggagggatgctgctctgtgcctatggttaaacacagaccgagctggaagtggtactgacaccctcatgtgaaagctcagtgacctgacaggaacccaggcctgaagccacgcagagtgagccttgcaactacccacagacagggacaggaatcccctcagaagactgctgtagcaacaatcacagacctccaacgcacagatctatagatgacggagacgccaaagttcctctctgta

SEQ ID NO: 131186 - DNA, 601 bp, Human
gaggcttttaatctcactccaggaaggactgcatgaggccctccccactgccagctggagaagggaagctggttcacgacctcacagagtccatgagatgcagaccgcccattactcagaggttttctgactaactctcaaaccaggtggaatttctccccaaaacccccctaaagagcaagctgagaaagtgccgaatgcgcttcagatccaggggtggttttcaaacatgatttcttagggtgtctccatatgggttcagtataactctaaggggaccacactggtggggcagttaccyaattgaatggctttatccggtaatgattttaaaataaatgaaagggacataaattaaatgttctccaagcatttttatttctaaccggggaccggagggatgctgctctgtgcctatggttaaacacagaccgagctggaagtggtactgacaccctcatgtgaaagctcagtgacctgacaggaacccaggcctgaagccacgcagagtgagccttgcaactacccacagacagggacaggaatcccctcagaagactgctgtagcaacaatcacagacctccaacgcacagatctata

SEQ ID NO: 131187 - DNA, 601 bp, Human
tgggtgcaggccaagggggagcccaggcaaagatggggagtctggcatccccaagtctcctcagtgcctacctgtctggctcctagcatcccataggtggtggctccaatctgtttccccattctttcctattcctcatttcaaatggctatgcttggcctctaggacacgagactggagttttacacaccccacgttactttcgaaaatcagatcttcacagtacaataaagctgatcttacttgctaacttcagctctcctaaagatattgctgagtatttgtggattagttcaacattcacacacacacacacacacacacacacacacacacacacagctacatatttgcaagctacttaataccagaaaagaaggcctaaggatcactgtgtaagaattctgggtaaattaatgttgcaagagaatttttgtaataaaatcagaaaagacacatgaaagactttgagaagaataggcgtaggttccaaagaacctacacctataagccattgttatattaattaactgtattaatcactcattttttcatacctcactactttccagaaaagatataagcagctcacaaggatgta

SEQ ID NO: 131188 - DNA, 601 bp, Human
tccatctcagtcccaccgtcccccatctccatcgcttcacgttcttttcttcccattccctgggatgtggccagaatcaccttgacttacgggtccatcaggtttgcctccccaggcacattgccttgaggtgggtgcaggccaagggggagcccaggcaaagatggggagtctggcatccccaagtctcctcagtgcctacctgtctggctcctagcatcccataggtggtggctccaatctgtttccccattctttcctattcctcatttcaaatggctatgcttggcctctaggacaygagactggagttttacacaccccacgttactttcgaaaatcagatcttcacagtacaataaagctgatcttacttgctaacttcagctctcctaaagatattgctgagtatttgtggattagttcaacattcacacacacacacacacacacacacacacacacacacacagctacatatttgcaagctacttaataccagaaaagaaggcctaaggatcactgtgtaagaattctgggtaaattaatgttgcaagagaatttttgtaataaaatcagaaaagacacatgaaagactttg

SEQ ID NO: 131189 - DNA, 601 bp, Human
cttgatcaaggggacactgttgtaagacaggaggcctcaaatcagagcccaggtctcaggaaaagcaacacttggagttaggaagagcaaagaaaatgcatttccctggcttacacttgcttcacaggcaaaatgggaatcatagcgtctgcttgccttcatatcacagaagcgttcacagtgatcaaacaaggccacagatgtgaaagcagtcaggtaatttcacagcaccttttacacacagagtccccctccatgtgctaggtgggcttgaggaggacccaggggtgggacgtgtgcwagtccctgctctgttgtaagagtcgtgctcagctgctgacacagctttcatactgggcttcgttctgcctctaccagaggggtgtggttctcattcttcttcctttttgcagatgcagaaactgaggcacagagagatgaagtgactttcccatgatcacgccattaataaaattttaacctaggttatgtagctacaagtgctgatgttggaagcagagcttttagcagaggagttgctagaggttgtggggcctggcttttgcctgcaagagagtgagcccaggaggagcagtgccat

SEQ ID NO: 131190 - DNA, 601 bp, Human
acatgagactcacaccaggctcactggatgatgcaggggtgcatagggcatctcccaagacagaccctttccaatcacatagctagtaagaaaaagagcttgtacttgaactcacttctgcttcctgaagaataatagtggtagtaaaaataataatagcagcactcgatcaagtgctagtcactttgcacgtgttatctcattatctcatttaataccctggcagtgtgcccaggcagctgatggctgaaacatgaactcgtgtgcccacctgcgtgtccaggagcctgaccctctcctyggctcagggaaaggacccaggcctcctaggtcaggcctataactctaggcagcgtctgagctgaagggatttggggtatccccattcccatcccctcaattttcagatggaagctgaaggggaaagacttgatcaaggggacactgttgtaagacaggaggcctcaaatcagagcccaggtctcaggaaaagcaacacttggagttaggaagagcaaagaaaatgcatttccctggcttacacttgcttcacaggcaaaatgggaatcatagcgtctgcttgccttcatatcacagaagc

SEQ ID NO: 131191 - DNA, 601 bp, Human
gaaaatatcctaaagaaacgcaatgagaggagaagattacgggtccaggtagagagtggataattagagccctgaaaacaggttaagtgggagagacagaggcccaggcacaaggggtaatgaaggcaggaacaggcccagaagcactagagctgctgctggtgagcaacagagtgaaaatgcccagtaaacgctaaaccatattggaaggcagctgtagggtaagagaaagcacggattagcgtgcaagggcgtggcctgcacagccgctaagccagcaggctcaggaagcagacagagstgggttagaaccccagcaccacccatcacagaccctggctttgcccctgtgtgcctcagctacctatctgtggaacacaactcataatagtttttcccttacagagttgttctgagtattaaatgagatgatgtgtgccaagtgaccagcacttgacagagctttgctatctattctttttactaccgctattattcctcaggaagcagcagaagtgagtccaaatacaagctctgcctcttaccagctgtgtgatttgagagcgtccgtcttgaggggtatcctatgcacccatgcatc

SEQ ID NO: 131192 - DNA, 601 bp, Human
ccaggggaaaacaggccctctagaagtggacaccaggatgtgctgctgtcccaggaacagcaagcaggagaaggcagggctctcagtgcacagcaccagggagaatcgaatttgagtctggagaggcacccaggcatcagggtcagaaatcatctccgtccaggagtctagaagctccacaagggcagtgattttcatctgctttgttctctgctgaatctccaggtacctagagcagtgccaggcacccggcaggtactcggaaaatatcctaaagaaacgcaatgagaggagaagattmcgggtccaggtagagagtggataattagagccctgaaaacaggttaagtgggagagacagaggcccaggcacaaggggtaatgaaggcaggaacaggcccagaagcactagagctgctgctggtgagcaacagagtgaaaatgcccagtaaacgctaaaccatattggaaggcagctgtagggtaagagaaagcacggattagcgtgcaagggcgtggcctgcacagccgctaagccagcaggctcaggaagcagacagagctgggttagaaccccagcaccacccatcacagaccctgg

SEQ ID NO: 131193 - DNA, 601 bp, Human
agggcctttctgacaagcagcggccccttcctgtgtccccttctcagcgggagtatgtacattctgtcaccagaaagggccaactttttaaatttgccctagggcaaagctccaatggtagttgccccaccaccctttctttcttaaaataaatgtggaaggttctaaactggccctttcatgaaatatgtgtgggttttactgctcagtatgggctgtgggtgatcctcagagacccttaaagccctgggggatgccctacgtgtcccccacccccagtcaagcatccttagccgtttgrgcagggctgacccatttttaacccaaaccaccagaccctgggtaggccctgctgagaccacgtgtcttgccattttgttctgaaaccccacgtgctcaaggctgtctctttccagcctcctaaagggaccccaaatccaatctaaatgtcttgaatttacctgtttgtcttttatacatataaatagctgcatttccattccctctttgtttctcattttcatttggttctaatatctgcatgtaaatgtcggaaaatagcatctgtaattggagattatgaagtatggccagctcctga

SEQ ID NO: 131194 - DNA, 601 bp, Human
gggcaacaaggctgttctcccttcaattttatgggaagaacattttcattacaaagcctcctcccagaccctcctctctcagccagattagcctcgagaaggaagcggatgatccatatatcagaactccttctctccccattaattttattatttatatcccattttaaaagtttattggtgcaactccctatgcacctggccagggcctttctgacaagcagcggccccttcctgtgtccccttctcagcgggagtatgtacattctgtcaccagaaagggccaactttttaaatttgmcctagggcaaagctccaatggtagttgccccaccaccctttctttcttaaaataaatgtggaaggttctaaactggccctttcatgaaatatgtgtgggttttactgctcagtatgggctgtgggtgatcctcagagacccttaaagccctgggggatgccctacgtgtcccccacccccagtcaagcatccttagccgtttgggcagggctgacccatttttaacccaaaccaccagaccctgggtaggccctgctgagaccacgtgtcttgccattttgttctgaaaccccacgtgct

SEQ ID NO: 131195 - DNA, 601 bp, Human
tgggagagtttaatccaaagcagtgctaattaatatccccggctttccagaagtcagtgccacatacagctgcgagggcaacaaggctgttctcccttcaattttatgggaagaacattttcattacaaagcctcctcccagaccctcctctctcagccagattagcctcgagaaggaagcggatgatccatatatcagaactccttctctccccattaattttattatttatatcccattttaaaagtttattggtgcaactccctatgcacctggccagggcctttctgacaagcagcrgccccttcctgtgtccccttctcagcgggagtatgtacattctgtcaccagaaagggccaactttttaaatttgccctagggcaaagctccaatggtagttgccccaccaccctttctttcttaaaataaatgtggaaggttctaaactggccctttcatgaaatatgtgtgggttttactgctcagtatgggctgtgggtgatcctcagagacccttaaagccctgggggatgccctacgtgtcccccacccccagtcaagcatccttagccgtttgggcagggctgacccatttttaa

SEQ ID NO: 131196 - DNA, 601 bp, Human
gtcaactcagaggacagcagggctcccatttaatgccaacattagcaattcatcttaacattagtgcaaaacaatagagaaataaacagtaacatgtggcactgttagcaccattaaggaaaaaccaggcatgtgactgtttgcttagttcaagtcctctctgttctttactgaaggtgatattctggcttctagaaagatcagaaactaaaggaaggagacactaggcttaggatttagctatgatgtgtaagcccaaattttagctaatgtcaataatctagacaaaactagcacagcracggtggtgtttctgcttgtatgcctttttatcagggttaactttacttaagagcttctgcttttaattacggaaatatatttgcattttgtggttatgtgttaattccatgaatcttgcatttcatacctagaaacaaagcataataattatttttcgtgctaatacctataatttacttagacaagcaagccatttgccttgaggctagacatgtaaacaaacacacgtctaaaggcttggtctgagttggatttttaataatttcttctcccttacacacacacatatattaattta

SEQ ID NO: 131197 - DNA, 601 bp, Human
tgcaaaggcaaggcctctcatggtgaattcagactccctggtttgccattcagaagactctaccagctccccctacaccctcacatacctttactaagaggcggaataacttgcattgactgggtgcttactgtgtaccaggtactgttctagatgttaaaatgtattactaataattcatttaatccttgcaacaaccctacagggtaagtattactaccctccctttacagatgatgaaaatgagacacaaggtgccaaaataacgtgtccagttcaccccccagcagtgcgactccaragtccaagctctgaaacaccactctacaccccctctgccactgttactaaccccaacaagttgcagatgagaacactgaggttgacagaagttgagtaagttgcagagccgggggttaaacccagcttctgtttgactccaaagcctgtgttctttactctgattgtaaactgctccacgatgtgccggagccctgacggggacaccacctgctaggccaggctcctcttcctgtgtttggtgacctctttagataacccacctgactctgcacctttgacatggccatgctttccccgc

SEQ ID NO: 131198 - DNA, 601 bp, Human
tttctccagaaatgtactcatggcctgggtcaaaatggtttgcagcaggccaggcatggtggctcatgcctgtaatcccagccctttgggaggccgaggcgggcagatcatctgagattgtgagtttgaaaccagcttgaccaacatggagaaacctgtgtctactaaaaatacaaaattagccgggcatggtggtgcatgcctgtaatcccagctacttgggaggctgaggcaggagaattgcttgaacccggggggcggaggttgcagtgagcggagattgtgccattgcactccagcytgggcaacaagagcgaaactccatctccgaagcaaacaaacaaaaaaaaaaatgatttgcagcagaattgaagggcttccaagaagagatctatacagtttcagtgactcatctccccctgttctgtttacagcctgccaggcccccctcaggcacacccccagacaggttcccaagtggtggtgggtaccagcaggggaagcccagggaggccaccaaagtcagacattttaacttctgtccgagagcaacttttcagcaatgactaatcagaaggcccttttcttcccctgtcctctt

SEQ ID NO: 131199 - DNA, 601 bp, Human
aagatgtttttgtggagggaaactcggtaaagggtgtataggagtcctcggtattatttcttacaactgcatatgaatctacagttatctcaaaataaaaagtttaattgaatgatgcttgcagaaatactccataatctacaaagtgctaccattaatattaactagggggaagtactacaaaggatgttgaagggccttcctcttccaggaagccctcatggattcccccttctctgtgttcctaaaatggctgagtgtgcctctctctgccacagcacttattattctgcattatacrtttaactgtttagggacatcatcccccagctagagtgtgagcttcataaggatgagacagtgtctccctcatctttgtggcagcagctcctggcccagtgcccagctctgaacagatgtgacataaatgcctgtggaatcaaatgaacttggacaggtaccatggcctggctcttccaacggtgccagaggtgcttcccagggtcactgagaggataagtgatgtcaaggtgcttttattcatcagaggttgccacggacatgggccaaacacgctctttattcatttgtttctccagaa

SEQ ID NO: 131200 - DNA, 601 bp, Human
caagtctactttgaaagtctccgtaattatggctgggcacggtagctcacacctgtaattccagcactttgggaggctgaggcaggtggagtacctgaggtcaggagttcaagaccagcctggccaatatgatgaaaccccatctctactaaaaatacaaaaatagtcaggctgtggtggtgggcacctactcaggaggctgaagtgggagaattgcttgaaccccagaggcgaactttgcagtgagccaagatcgcaccactgcattccagcctgggtgacagagggagaccctgtctcaaaaaaaaaaaaaaaggaaaaaaaagaaagaaagtctccatagttaaaataaataaagttaaaccacacatatttgactcatggcaccgcctgtcaccgctcatcagccatccaacaaatacctgtgaaataacgagagaacgcaagaagccaaggacagccaggagcttactctctcgcctcctcttcctggtgccctgccctgctccttgaaagccatcatccctgcatcttcagggatgccaaagttccaaacacaagaagtctaagtcctcttgcctgcctagcactttccagtttg

SEQ ID NO: 131201 - DNA, 601 bp, Human
aaccactgcatgtctcttttggctttgactgccaggaaactcggtcaaattcagtgttcaaccaccataagcacatcattgctggctcctgccacaatgatcttccccttttctctatgtaatttctgaactttttttccaaacttaacttagatacacatacttgcttattttgcaggccacctcaagttctttgtgaaagtgaaggctgggaaaggtgaactgacagaaaaagaaagatggaaggaaggaaggaagaaggaaggaaggaggaaggaaggaaggaaggaaggaaggaaggaaggaaggaaggaaggaaggaaggatggatgagagagagagagagagaaagaaagagaagaggaaaggaattcctggtgcctcttttcctggtaacaacggcattctacttccatttctcagttttttcgaagccaaaggctgagtggcggggtgcagaggtacacacgcagtcacagatgtgtaagtgtgttggtgcacctacatacttgggtacattgcccccgccaaccccagcccctaagaatcacaggcaacagctgtgttctacatttcctactttttctgagcccttggggtt

SEQ ID NO: 131202 - DNA, 601 bp, Human
ttggtggagccattcctgaactccacactcctacaaagaaacaatctctcccttgtctatgcttccatacttggtggctttttgcacagacctccattatcaccatgtagagtggctgtttgtctatctccctccaggttgccttgacagtgtggaacatggaacatccttagtgccccctaagtgcttgttgaatgaatgaatgaataatggttcagtagcatgttatgagctacaacactcaaaaattaactgggaagtgtttgaacaagagcactaagtgatacgctaacatcccctkccctccttccacctctaccccacatcgagtcaggtcaccagaaagccacatccctatccaacatattaaagcccctgggtggtgctttcaccagtctctgatggaatatcaggcattcaacacttttacgaggcaaaaaaagaaaacagccataaaaagaagattgtttaaaacctctggggacactgcccactagaatattcaaattccttatcaatccctcctacaattcaacaccagtaaagtgtttcccctggtgagtcattaatctgcctctgactaaacaacaagaacactgga

SEQ ID NO: 131203 - DNA, 601 bp, Human
cctacctccgcctggagggtccctctcactccgtgacttagagaactcttacattatccacaagacccagttcacatgtcacctccttggtggagccattcctgaactccacactcctacaaagaaacaatctctcccttgtctatgcttccatacttggtggctttttgcacagacctccattatcaccatgtagagtggctgtttgtctatctccctccaggttgccttgacagtgtggaacatggaacatccttagtgccccctaagtgcttgttgaatgaatgaatgaataatggtycagtagcatgttatgagctacaacactcaaaaattaactgggaagtgtttgaacaagagcactaagtgatacgctaacatccccttccctccttccacctctaccccacatcgagtcaggtcaccagaaagccacatccctatccaacatattaaagcccctgggtggtgctttcaccagtctctgatggaatatcaggcattcaacacttttacgaggcaaaaaaagaaaacagccataaaaagaagattgtttaaaacctctggggacactgcccactagaatattcaaattccttat

SEQ ID NO: 131204 - DNA, 601 bp, Human
actctgctcctgcatgagccaggggaagctgtcatttagttttggtgtttaattgttccctaagtcctcatcaccgtttgtccttttgaggtgtccgtgatttttaaaggcaactgcattctccccaatctcttgggttccctggaacattgctacaccacagctcctcagccattccagacactgtcctacctccgcctggagggtccctctcactccgtgacttagagaactcttacattatccacaagacccagttcacatgtcacctccttggtggagccattcctgaactccacamtcctacaaagaaacaatctctcccttgtctatgcttccatacttggtggctttttgcacagacctccattatcaccatgtagagtggctgtttgtctatctccctccaggttgccttgacagtgtggaacatggaacatccttagtgccccctaagtgcttgttgaatgaatgaatgaataatggttcagtagcatgttatgagctacaacactcaaaaattaactgggaagtgtttgaacaagagcactaagtgatacgctaacatccccttccctccttccacctctaccccacatcg

SEQ ID NO: 131205 - DNA, 601 bp, Human
cagcgggaggtccgaaaatccaggcatccaaccaccactggctcccagaaagcaaagcaaacctccctataagccaggccctgggggacggcgggacacttggaaacgagtccttagctgcacttcaccatctgtgcctttcctttttctttttcttttttttttttttgagacaaagtcttgctctgtcacccaggctggtgtgcagtggcacgatcttggctcactgcaacctccgccccccgggttcaagcgattctcctgcctcagcctcccaagtggctgggattacagacacatrccaccacacccagttaattttttgtatttttagtagagacagggtttcgccatgttggccaggctggtcttgaacttctggcttcaagtgatccacctgcctcggcctcccaaagtgctgggattacaggcatgagccactgcacccagatatctgggcctttcaccataaccaccttgcagggcttgcccagagcccagcctctcttctttggtgggattccctcagttcttactctgctcctgcatgagccaggggaagctgtcatttagttttggtgtttaattgttccctaagtcc

SEQ ID NO: 131206 - DNA, 601 bp, Human
ggaacaagtctgcccttcatggaaggaagagtgccttttctggcctgggatgctcacgcagagttcctgctcactgtggggttagtggtgggacccagtcatcctgctgccctgtctcagtgcctcctcctccaagaagtctttcataaccaccattccccaggaagtgtgagtcccaccctcattctgctggccccgccaagtggtgccagaacaataacaaccacagtcttcacaattgcatcaaaatctcacactcactgagcattcactctgtaccaggagctttagctgtactatyccatttaatcctcacagtcaccccttgaagcaggctctatgacatccccattttacagatgaagaaactgaggcttttatgatagcgcaggaatgacttgcctaactaagttcatacagcttctaggtgcccaagccaggattcaaacctgggtccttctgactccaaaaccttgacaatgaccctaatgatctttatactctcagtacctgatccattaaaacacagtgaaatcaacttgctggtcccaacatttttataaatgaaactgaaaaaaaaatatccaagggtctcccacat

SEQ ID NO: 131207 - DNA, 601 bp, Human
ggggtcagcaaaggcttactccagatgggctccccggctccctgcccctcgctaacgtctcccacctcaggcctgggtgcactccaggctcttggcccacctcaggtggatgggggacaaagttgctcttgccacctgactggcccttacgtggtgctcagagctgcaaatagggcccctctcttctgcctgagcctcagtgctgacccttcagcccaggtctcggagctgggccctccctgtcttgctgctttggcctaagtgaccccctccactgttctaatccgagtctaacccagcwtccctgatgcacccacagtccacctgcatgtctacgagtcccgtgtcactgtcactattcactgtgccctgcctaccagcccacatgggcatcctgctacctcaaaccagacccatggctctggcccaagtgtggcccgccagccccttgtctatttgtgcagtacccgagcgggcctcctgcctgcccggttggacaaccaagagctggcagctgagtctgtccacatggagtcggctccacgttaccccagcacagctgggccaggggtctccccgtcctggcccacgcatccagccc

SEQ ID NO: 131208 - DNA, 601 bp, Human
gttcacttagcacagtgcctggttctcagtaagtgctcagtgaagtgccagtttctattattgttcgctaatccaggtttctttgcactctgccatgcccacctctataattatttgtagttccttgaaaaagaggaaaaagggcccaggatctaggagccagagggccagctctaactcccccttaccccttatgctgggcaagccaccgcccctccctgagacttggtttctgtgtctgtgaaatgggagtgccttcagaggtcttgtcatggattcttgtgacaccaggggaggggamcccctcggacacctgtggggtcagcaaaggcttactccagatgggctccccggctccctgcccctcgctaacgtctcccacctcaggcctgggtgcactccaggctcttggcccacctcaggtggatgggggacaaagttgctcttgccacctgactggcccttacgtggtgctcagagctgcaaatagggcccctctcttctgcctgagcctcagtgctgacccttcagcccaggtctcggagctgggccctccctgtcttgctgctttggcctaagtgaccccctccactgttctaat

SEQ ID NO: 131209 - DNA, 601 bp, Human
gtcaattgatgcagcaaacttcatcattgtctattttaagaaattgccacagccaccccaatcttcagcaaccaccgtcctgatcagtcatcagccatcaacatcgaggcaagaccctccaccagcaaaaagatgactcactgaaggctcagatgattatgagcattttttagcaacaagtatttttaaattaaggtatgtgtcttttaaaaaacataatgcacacttactagactacagtactggttgagtatcccttatccaaaatgcgtgggaccagaagtgtttcagattttggatygctttggattttggaatattggctttatatttaccagttcaactcctaatctgaaaatccaaaatttgaaatgcctcaatgagcatttcctgtgagcatcatgtcatactcaaaaagtttcagatattggagcatttcagatgctcaacctgtatagtatagacatagctttttttttttttttttttttttttttgagacagagttttgctcttgtggcccaggctggagtgcaatggcatgatcttggctcactgcaacctccgccttccaggttcaagcaattctcctgcctcagcc

SEQ ID NO: 131210 - DNA, 601 bp, Human
agttgcttcttatggataagcaaagaaagtggtttcttaagatgaaatctactcctggtgaagatactgtgaacattgttgaaatgccaacaaaggatttagaatattccataaacttagttggtagggtagtggcaaggtttgagagagctgactccaattttgaaagaaattctatggtggataaaatgctatcaaacagcatcatatgctacagagaaatctttcatgaaaagaagagtcaattgatgcagcaaacttcatcattgtctattttaagaaattgccacagccaccccartcttcagcaaccaccgtcctgatcagtcatcagccatcaacatcgaggcaagaccctccaccagcaaaaagatgactcactgaaggctcagatgattatgagcattttttagcaacaagtatttttaaattaaggtatgtgtcttttaaaaaacataatgcacacttactagactacagtactggttgagtatcccttatccaaaatgcgtgggaccagaagtgtttcagattttggatcgctttggattttggaatattggctttatatttaccagttcaactcctaatctgaaaatcc

SEQ ID NO: 131211 - DNA, 601 bp, Human
gattattttctacctaaagaggcatgtgcataaatggcaggatgcccagcacacctcattttactgtgtttcactttattgtacttcacaaatattgcattttttaacaaatggaaggtttctggcaaccctgtgtcaagcaaatctatcagtgccatttgtccaacagcatgcgctcccttcctgtctctgggtcacattttggtaatttttgcgacatttcacagtttctcattattattatatctgttatggtgatctgtgatcagtgatctttgatattcctattctaattgtttcrgggagccacaaactgtgcccatataagatggaaaacttccaataaatgctgtgtgtgttctgactgctcatcactgattggctgttccctcatctctcttcttctcctagggcctccctattccctgagagacatcaatactgaaattaggccaatcaataaccctacaatggcctctatgtgttcaagtgaaaggaagagtcatgtatctctcactttaaatcaaaagctagaaatgattaagcttagtgaggaaggcatgtcaaaaactgagacaggccaaaagcaaagcctcttgca

SEQ ID NO: 131212 - DNA, 601 bp, Human
ggattattttctacctaaagaggcatgtgcataaatggcaggatgcccagcacacctcattttactgtgtttcactttattgtacttcacaaatattgcattttttaacaaatggaaggtttctggcaaccctgtgtcaagcaaatctatcagtgccatttgtccaacagcatgcgctcccttcctgtctctgggtcacattttggtaatttttgcgacatttcacagtttctcattattattatatctgttatggtgatctgtgatcagtgatctttgatattcctattctaattgtttyagggagccacaaactgtgcccatataagatggaaaacttccaataaatgctgtgtgtgttctgactgctcatcactgattggctgttccctcatctctcttcttctcctagggcctccctattccctgagagacatcaatactgaaattaggccaatcaataaccctacaatggcctctatgtgttcaagtgaaaggaagagtcatgtatctctcactttaaatcaaaagctagaaatgattaagcttagtgaggaaggcatgtcaaaaactgagacaggccaaaagcaaagcctcttgc

SEQ ID NO: 131213 - DNA, 601 bp, Human
agcctcaacttttacaggattattttctacctaaagaggcatgtgcataaatggcaggatgcccagcacacctcattttactgtgtttcactttattgtacttcacaaatattgcattttttaacaaatggaaggtttctggcaaccctgtgtcaagcaaatctatcagtgccatttgtccaacagcatgcgctcccttcctgtctctgggtcacattttggtaatttttgcgacatttcacagtttctcattattattatatctgttatggtgatctgtgatcagtgatctttgatattmctattctaattgtttcagggagccacaaactgtgcccatataagatggaaaacttccaataaatgctgtgtgtgttctgactgctcatcactgattggctgttccctcatctctcttcttctcctagggcctccctattccctgagagacatcaatactgaaattaggccaatcaataaccctacaatggcctctatgtgttcaagtgaaaggaagagtcatgtatctctcactttaaatcaaaagctagaaatgattaagcttagtgaggaaggcatgtcaaaaactgagacaggccaa

SEQ ID NO: 131214 - DNA, 601 bp, Human
tctatgtagccccaactaaacatgtctgtgggctagattagccctttggccagctggccaccagttgaccatttctgtagacaagattctcagaaaggcaaccacagcctcaacttttacaggattattttctacctaaagaggcatgtgcataaatggcaggatgcccagcacacctcattttactgtgtttcactttattgtacttcacaaatattgcattttttaacaaatggaaggtttctggcaaccctgtgtcaagcaaatctatcagtgccatttgtccaacagcatgcgctcmcttcctgtctctgggtcacattttggtaatttttgcgacatttcacagtttctcattattattatatctgttatggtgatctgtgatcagtgatctttgatattcctattctaattgtttcagggagccacaaactgtgcccatataagatggaaaacttccaataaatgctgtgtgtgttctgactgctcatcactgattggctgttccctcatctctcttcttctcctagggcctccctattccctgagagacatcaatactgaaattaggccaatcaataaccctacaatggcctct

SEQ ID NO: 131215 - DNA, 601 bp, Human
acccagtgtggccaaattttccagtttttgtaagggaatccccaaatccagacttttgttttctaaatattgactcaaatttgtaaaaagctctatgtagccccaactaaacatgtctgtgggctagattagccctttggccagctggccaccagttgaccatttctgtagacaagattctcagaaaggcaaccacagcctcaacttttacaggattattttctacctaaagaggcatgtgcataaatggcaggatgcccagcacacctcattttactgtgtttcactttattgtacttcrcaaatattgcattttttaacaaatggaaggtttctggcaaccctgtgtcaagcaaatctatcagtgccatttgtccaacagcatgcgctcccttcctgtctctgggtcacattttggtaatttttgcgacatttcacagtttctcattattattatatctgttatggtgatctgtgatcagtgatctttgatattcctattctaattgtttcagggagccacaaactgtgcccatataagatggaaaacttccaataaatgctgtgtgtgttctgactgctcatcactgattggctgttc

SEQ ID NO: 131216 - DNA, 601 bp, Human
aaggaagcaactgagtggggaccatggggacctgtcttaaggggcagcagctactgctactgaaccccaaccaccacgactatgtgggaatatgacccagtgtggccaaattttccagtttttgtaagggaatccccaaatccagacttttgttttctaaatattgactcaaatttgtaaaaagctctatgtagccccaactaaacatgtctgtgggctagattagccctttggccagctggccaccagttgaccatttctgtagacaagattctcagaaaggcaaccacagcctcaactkttacaggattattttctacctaaagaggcatgtgcataaatggcaggatgcccagcacacctcattttactgtgtttcactttattgtacttcacaaatattgcattttttaacaaatggaaggtttctggcaaccctgtgtcaagcaaatctatcagtgccatttgtccaacagcatgcgctcccttcctgtctctgggtcacattttggtaatttttgcgacatttcacagtttctcattattattatatctgttatggtgatctgtgatcagtgatctttgatattcctattctaat

SEQ ID NO: 131217 - DNA, 601 bp, Human
aaatttcttgccaggcttgtaagataaataaggaagcaactgagtggggaccatggggacctgtcttaaggggcagcagctactgctactgaaccccaaccaccacgactatgtgggaatatgacccagtgtggccaaattttccagtttttgtaagggaatccccaaatccagacttttgttttctaaatattgactcaaatttgtaaaaagctctatgtagccccaactaaacatgtctgtgggctagattagccctttggccagctggccaccagttgaccatttctgtagacaagaktctcagaaaggcaaccacagcctcaacttttacaggattattttctacctaaagaggcatgtgcataaatggcaggatgcccagcacacctcattttactgtgtttcactttattgtacttcacaaatattgcattttttaacaaatggaaggtttctggcaaccctgtgtcaagcaaatctatcagtgccatttgtccaacagcatgcgctcccttcctgtctctgggtcacattttggtaatttttgcgacatttcacagtttctcattattattatatctgttatggtgatctgtga

SEQ ID NO: 131218 - DNA, 601 bp, Human
actcaatgcatgcccagacttcctgcttgggcctaacaaagaagccttctcctgcagaccccaggacagctaagccactgagctggttcttagcaccaatcttctagatcagttcaactcaaatttcttgccaggcttgtaagataaataaggaagcaactgagtggggaccatggggacctgtcttaaggggcagcagctactgctactgaaccccaaccaccacgactatgtgggaatatgacccagtgtggccaaattttccagtttttgtaagggaatccccaaatccagacttttrttttctaaatattgactcaaatttgtaaaaagctctatgtagccccaactaaacatgtctgtgggctagattagccctttggccagctggccaccagttgaccatttctgtagacaagattctcagaaaggcaaccacagcctcaacttttacaggattattttctacctaaagaggcatgtgcataaatggcaggatgcccagcacacctcattttactgtgtttcactttattgtacttcacaaatattgcattttttaacaaatggaaggtttctggcaaccctgtgtcaagcaaat

SEQ ID NO: 131219 - DNA, 601 bp, Human
agggtttactttaaaactcaatgcatgcccagacttcctgcttgggcctaacaaagaagccttctcctgcagaccccaggacagctaagccactgagctggttcttagcaccaatcttctagatcagttcaactcaaatttcttgccaggcttgtaagataaataaggaagcaactgagtggggaccatggggacctgtcttaaggggcagcagctactgctactgaaccccaaccaccacgactatgtgggaatatgacccagtgtggccaaattttccagtttttgtaagggaatcccmaaatccagacttttgttttctaaatattgactcaaatttgtaaaaagctctatgtagccccaactaaacatgtctgtgggctagattagccctttggccagctggccaccagttgaccatttctgtagacaagattctcagaaaggcaaccacagcctcaacttttacaggattattttctacctaaagaggcatgtgcataaatggcaggatgcccagcacacctcattttactgtgtttcactttattgtacttcacaaatattgcattttttaacaaatggaaggtttctggcaacc

SEQ ID NO: 131220 - DNA, 601 bp, Human
gtttacttataagaatatatattatattgataattagaatacttctaatatttttaaattaagcataattttgacttaggcctgggatgtttatatttttttctgctctataatgagactttaaaatggataaatcaaagtataaacaggtctttggtcaagggtttactttaaaactcaatgcatgcccagacttcctgcttgggcctaacaaagaagccttctcctgcagaccccaggacagctaagccactgagctggttcttagcaccaatcttctagatcagttcaactcaaattycttgccaggcttgtaagataaataaggaagcaactgagtggggaccatggggacctgtcttaaggggcagcagctactgctactgaaccccaaccaccacgactatgtgggaatatgacccagtgtggccaaattttccagtttttgtaagggaatccccaaatccagacttttgttttctaaatattgactcaaatttgtaaaaagctctatgtagccccaactaaacatgtctgtgggctagattagccctttggccagctggccaccagttgaccatttctgtagacaagattctca

SEQ ID NO: 131221 - DNA, 601 bp, Human
cttcatttattctattatgacccttaagggagttttaaacttaagtttattcccaggtgagatatatatatatatatttatagttatagttagtggggtcttctcttttattatgttttctctttttttgagacagagtctcattacatcatccaggctggaatgcagtggcgtgatctcggctcattgccatctccatttcctaggttcaagtggttcttgtgcctcagcctccctagtacctgggactacaggtgtgcacaaccatgcctggctaatttttgtatttttggtagagacrgggtttcaccatgttgaccaggctgatctcaaactcctgacctcaaatgatccgcctgccttggtctcccaaaatgctgggattacaggcgcgagccactgcacccagctcttttattatgttttctagctaactattgtttacttataagaatatatattatattgataattagaatacttctaatatttttaaattaagcataattttgacttaggcctgggatgtttatatttttttctgctctataatgagactttaaaatggataaatcaaagtataaacaggtctttggtcaag

SEQ ID NO: 131222 - DNA, 601 bp, Human
aatgtatgctcttataacagtgtgtgaaaagataagtttctcatactatctccaacactgaactttaatctttgttaagatgtttttaagtgtctcatgattgttttaatttacagttttaaagttataagtcaggtgaacacgttttcatatactgctgggcatccgcattttttcccaatgaaaagatgttcaggttgaatgaaacgttaagaaaaaaaagtcagtagaaaaaaatgggcaaaggatttttacttattcatttttaaaagctctttatatattgaggaaattagctttytgtcatctgtcttctacactttttttttcattttgttctttgtcttttggatgttcttccatatacatacaaaagatttaaatgtttaatacttaaatttatttcttttgtcttttgtattcagaatatagtttaaaaaagacttttcccactctaaaattataaaaaaatttccaggccaggcacagttgctcacttctgtaatcccagcactttgggaggccaaggtgagagaatcacttgagcccaagagttcaaaaccagcctgggcaacatagggagaccctgtctctacaaaaa

SEQ ID NO: 131223 - DNA, 601 bp, Human
gacacctgcagataattagtcccaatcaggacaggcccaaactgctgacagtgcagtaacaggctggccatgtcaccagtttgcaaatggtgagcagtttcagaactgtggccctagctggtagagcaggtgtttaacttaatatttaatgcggcatatatatccctctctaatgagatcttccctgagcagcccagagtgtgagggctgagatagagcagcgcagaagccatctgttccccagaccccaggtagagccctgggccgggctcaccatccagctgggcacctacagcactcygggctttgtggggagggaaaaggagagaggtggggccggaaggttctgagtgtcccttgaagagctctgcactatgtcagcacatccgctaacacaggtggagttagatgaatgccgtgtggtgaaacagagccccccaccccccaacagctcctgggggcattccttcaaggtgtttaacagttctcaatggggtgggtaactgcacctccagagggcgttttgaaaatccatgggggcttctccctgcctgaggggtgttactgccctgcagtgcaagaatcccacacagtgaagact

SEQ ID NO: 131224 - DNA, 601 bp, Human
ccgctgtcctctctggcaggtaggcacagtggctcccccatcagcaggcctgtggcccaatgagacacctgcagataattagtcccaatcaggacaggcccaaactgctgacagtgcagtaacaggctggccatgtcaccagtttgcaaatggtgagcagtttcagaactgtggccctagctggtagagcaggtgtttaacttaatatttaatgcggcatatatatccctctctaatgagatcttccctgagcagcccagagtgtgagggctgagatagagcagcgcagaagccatctgtyccccagaccccaggtagagccctgggccgggctcaccatccagctgggcacctacagcactctgggctttgtggggagggaaaaggagagaggtggggccggaaggttctgagtgtcccttgaagagctctgcactatgtcagcacatccgctaacacaggtggagttagatgaatgccgtgtggtgaaacagagccccccaccccccaacagctcctgggggcattccttcaaggtgtttaacagttctcaatggggtgggtaactgcacctccagagggcgttttgaaaatccatggg

SEQ ID NO: 131225 - DNA, 601 bp, Human
ggactttctttggctgccaagttttgggtattgagactccaaacattgaacctgagggatactgcaaatcagagcaggtggactcagggacttggcagccattctgtctgtctttgtgggtatttccgctactaaaaaggggcagtgcccagggggagcctcagtccccagggcccaggtctcctaccaggctagtgtttcccaaacttgctggcccacaggaggcctctctctgtctcctcctcacatgccaacttactgatgcaaagagatgctcctcagggaaaaaggccagcaagayacagtctggccccattcctttgttctctcaggcaaaaggtcaggtggacccagctaagtccttcaccagtagagaggtgagcagaagtggggagcctggtgccccacccgctgtcctctctggcaggtaggcacagtggctcccccatcagcaggcctgtggcccaatgagacacctgcagataattagtcccaatcaggacaggcccaaactgctgacagtgcagtaacaggctggccatgtcaccagtttgcaaatggtgagcagtttcagaactgtggccctagctggtagagcagg

SEQ ID NO: 131226 - DNA, 601 bp, Human
cttctccacaactgcccacatacactcagacaccccttcggtggctcttaatccccctcctcccactggctcattttatccttgaaacagccaagggaggcaggggcagaattaccacccctatttcatagatagggaaatgagcttggagagaagaggatgaccaatgtgtccaaagacaggaccagttaggtgcaaagtccagacagaaacctgttcctctgactcctgttccagtgctctttccctcagcccttggctgttgctcagattaaaagccagaagagggtggactttcttkggctgccaagttttgggtattgagactccaaacattgaacctgagggatactgcaaatcagagcaggtggactcagggacttggcagccattctgtctgtctttgtgggtatttccgctactaaaaaggggcagtgcccagggggagcctcagtccccagggcccaggtctcctaccaggctagtgtttcccaaacttgctggcccacaggaggcctctctctgtctcctcctcacatgccaacttactgatgcaaagagatgctcctcagggaaaaaggccagcaagatacagtctggc

SEQ ID NO: 131227 - DNA, 601 bp, Human
acaggcatgagccacacgcccggcccacagaacaactctgatagccagcccagcatcttccatggaattccgaggacggccccgtggccgacactcagttgcagggtatcatcctgcactgtagctcttgttgtaattttttacagcgccttttggcagcctggatacataaggtgttcttgtatttttgctttcattattcattatgatttcactctgagagaagaggtatttcactgcatctcatgagcctcaaaaaggctcataaaaatgggtcaaaggaggcatgccccatggaaawatgaacaaatcgctgttcagagctgcctggcaccccgccagaggggattgtgacagaggaggcagaacatatttcctgaggaggaaaaccccaaagccactcagcccagcagagggtctccaccacgcagccgaaaccagcctgggctccccagcccttgagacgccccaggtctggagtccgtgggttcacaggctgaaagcaaccccatgcagtgtttactgtttccccaaaatccccaaacacacagtggatgtccctgcttccaatgatagacactgggactctaaacaagtggaa

SEQ ID NO: 131228 - DNA, 601 bp, Human
ggggtctccctatgttgcccaggctagtctcgaactcctgggctcaagtggtcctcccgccttgacctccggaagtgctggaattacaggcatgagccacacgcccggcccacagaacaactctgatagccagcccagcatcttccatggaattccgaggacggccccgtggccgacactcagttgcagggtatcatcctgcactgtagctcttgttgtaattttttacagcgccttttggcagcctggatacataaggtgttcttgtatttttgctttcattattcattatgatttcacyctgagagaagaggtatttcactgcatctcatgagcctcaaaaaggctcataaaaatgggtcaaaggaggcatgccccatggaaaaatgaacaaatcgctgttcagagctgcctggcaccccgccagaggggattgtgacagaggaggcagaacatatttcctgaggaggaaaaccccaaagccactcagcccagcagagggtctccaccacgcagccgaaaccagcctgggctccccagcccttgagacgccccaggtctggagtccgtgggttcacaggctgaaagcaaccccatgcag

SEQ ID NO: 131229 - DNA, 601 bp, Human
cccaataagctgtaactactgatattatctcctttccaatgcacaaaacaactttttttttttttgagatcgggggggtctccctatgttgcccaggctagtctcgaactcctgggctcaagtggtcctcccgccttgacctccggaagtgctggaattacaggcatgagccacacgcccggcccacagaacaactctgatagccagcccagcatcttccatggaattccgaggacggccccgtggccgacactcagttgcagggtatcatcctgcactgtagctcttgttgtaatttttyacagcgccttttggcagcctggatacataaggtgttcttgtatttttgctttcattattcattatgatttcactctgagagaagaggtatttcactgcatctcatgagcctcaaaaaggctcataaaaatgggtcaaaggaggcatgccccatggaaaaatgaacaaatcgctgttcagagctgcctggcaccccgccagaggggattgtgacagaggaggcagaacatatttcctgaggaggaaaaccccaaagccactcagcccagcagagggtctccaccacgcagccgaaaccagc

SEQ ID NO: 131230 - DNA, 601 bp, Human
aaaggcagcatgctgtatacactattctttaccttgcttttttcataaataatatatctcaaagatacattatttacatcccctatgaggatataaagagcttcctcgttctttcccactccattgtgtggatgagctattctgtatataacaaggtctccacggatggacattggggtgtatctcctctggttgttaaaatgttaggactaatttttttttaagtttaaaaaactctatgcaaatcaaagcacctttgggctggacctcgggggcacacgccaggctaaggggtgtgttrggcagtgcctggtctatgagttcaaagcatagatgcccgcctggactttgtagatacctcagcttctggcctgacagtgggaaaggaaatcacttcaactgagaacagctttgggtaaataccgctggaagagacttcgcctttgaggtagtgaaatccccaataccagaggtgaccaagccctgatgtggaactgaccccgcgctgtgtgaagagtcaggccgccggacctctatgctttcctctaactccaagagccctcgaagcctgatttatgggctgagcctggctggcagcaga

SEQ ID NO: 131231 - DNA, 601 bp, Human
tttacgcaaaggcagcatgctgtatacactattctttaccttgcttttttcataaataatatatctcaaagatacattatttacatcccctatgaggatataaagagcttcctcgttctttcccactccattgtgtggatgagctattctgtatataacaaggtctccacggatggacattggggtgtatctcctctggttgttaaaatgttaggactaatttttttttaagtttaaaaaactctatgcaaatcaaagcacctttgggctggacctcgggggcacacgccaggctaagggrtgtgttgggcagtgcctggtctatgagttcaaagcatagatgcccgcctggactttgtagatacctcagcttctggcctgacagtgggaaaggaaatcacttcaactgagaacagctttgggtaaataccgctggaagagacttcgcctttgaggtagtgaaatccccaataccagaggtgaccaagccctgatgtggaactgaccccgcgctgtgtgaagagtcaggccgccggacctctatgctttcctctaactccaagagccctcgaagcctgatttatgggctgagcctggctgg

SEQ ID NO: 131232 - DNA, 601 bp, Human
acgctgtctctacaaaaaatacaaaaattagccagcatagtggcgtgcacctgtagtcccagctacttgaaaggctgaggtgggaggatcccttgaggctgggaggacaagggtacagtgagccatgatcacaccgctgcactccagcctgggccacagggtaagaccctgtttcaaaaaaaaaaaaagaagacttttttttttttaagagaatggtgagagattaaaccaaagagaagccaagagtggatggcttccctggagcagcttagatgttgcttccccataaaaccttccccaraccccacagagagaagcaactgtcccttccttcatgctgtcaaaagcacttggcttctcccacaatatttctctttctttttcatttttgttttgttttgctttgctgcatacatgtatccatgtttgcctcccccatcagactgtgagttggctgagggcaggaattctaaaaccctcaggacttagactaggctgatgtctgacatgaaggaggagttcagttttaatggagagatgagtgaatgggtgatgaatggcagaagctctgcaaattgcccaggtgctatcctttgcactt

SEQ ID NO: 131233 - DNA, 601 bp, Human
tgaatttattttacagtgaacatgtattactttgcaattaaaaaggaattattcactttgggaggtcaaggtgggaggattgctcgagcccaggagtttgagaccagcttgggcaacatggcaaaacgctgtctctacaaaaaatacaaaaattagccagcatagtggcgtgcacctgtagtcccagctacttgaaaggctgaggtgggaggatcccttgaggctgggaggacaagggtacagtgagccatgatcacaccgctgcactccagcctgggccacagggtaagaccctgtttcaaaaaaaaaaaaagaagacttttttttttttaagagaatggtgagagattaaaccaaagagaagccaagagtggatggcttccctggagcagcttagatgttgcttccccataaaaccttccccagaccccacagagagaagcaactgtcccttccttcatgctgtcaaaagcacttggcttctcccacaatatttctctttctttttcatttttgttttgttttgctttgctgcatacatgtatccatgtttgcctcccccatcagactgtgagttggctgagggcaggaattctaaaac

SEQ ID NO: 131234 - DNA, 601 bp, Human
aagccaggcagtctgatccagcatctgcacacaggactgcacgtttgatcagtttcccagaccccagtgggcgccagcctctctgtgctacagtgagcggaaaagggctctgcttgaggggcttggtaccaagggaagcaggaccgtagaggagttaggagaaaaccatacctccagttacaagctgtgtgaactcacaggtttctttaactattacttgggaccaaaatagtgcctgtgttttaaagagtagaagattaaatgaaccaaagtacataacaaatgcttattattaaacatyagctatcattgttattatctcctgaggcagcctattcagctttcagagagttcaaactgctcagaagtgcttcttctcactaaactaaagcttcctccccgtggcttccccttgtcctcctggcagcctccctccccgcatagcatgggggaggccatagccaggctccaagtcagctgtctctatgccaacagccctgggcctcctgtggatgccaaggtgccctgtcctctgcccttcttgggcctgttcacctctgtctgaagccccgtgtatcaaatactgagagagattcgcccc

SEQ ID NO: 131235 - DNA, 601 bp, Human
tttaccccagggcttccagaaggaacacagcccaccactctttgattttaggacttctgacctccagaactttacaataatacatttgcattgttttagcccctgggattggggtaatttgttacagccgcaactggaaactgcaggaggtcaatggaacatccaagacaggcagccgtcaggcctgctccacgctggacagatccccccgcaagctctcccaccagcccctctgctggggacccctaagtctgactccctgactcaggttgttttcccgagctccagattttcaaagccrcatgtaagaagcccaggcagggcttttagtgctttgcaagttatccactcacttcatctacatagtgagttctatccccattttatagatgaggagactgaggtgtgcacacatacatacacacatgttgagaaaccgaggtcaccaattcataagtggcagagctgggattcaaagccaggcagtctgatccagcatctgcacacaggactgcacgtttgatcagtttcccagaccccagtgggcgccagcctctctgtgctacagtgagcggaaaagggctctgcttgaggggcttgg

SEQ ID NO: 131236 - DNA, 601 bp, Human
gagacagagtgagaaccagccagtgctcacagagagagtggagaaagaacaggcagaaacggagcaaaagaggtgcccagtgccctcacagatgatgggtcatccaggggaactacaggacacacggtgctcaaggaggcttttatatttggccctggagatgtggtagacagaagaataatccaccccccaccccaggatgtctacatcctaattcccagaacctgtgactatgtgaccttacatggcaaaagggactttgcagatgtgattaaattgaggtatttgcgatgtggagagmgtgtggatcacccaggtgagcccaatgtaaccacaagagattttagaaacaggggcaagggggtcagagtcacagacagaagatgtggcagcagaagcagaggccaaggaggagagaagatgctactctgctggctttgaagatggaggaaggggccatgagccaaggaatttgtgtgtcctctagaagctggaaaaggcaaggaaacgaattttaccccagggcttccagaaggaacacagcccaccactctttgattttaggacttctgacctccagaactttacaataatacatttg

SEQ ID NO: 131237 - DNA, 601 bp, Human
atgccagaaacaaccttactaaacatttatagatgatctcagggtgggagtagaagttctatggcctcacagataatgaaaataaaagctaatagagataaattagagagagatttttttcctgagctgtgaacttggccaagaaaaaaaaaaggcagcagactagtagaagctaatgcatttgggaagaaataataattatgataatatcttgaattcaaatgtgactttatgctaatcaaagatatgtatgtgagtgtgtgaatcatgtcaataaccttgacaatgacctagaagggtrgagtgctgcgtgattagtaacgaccaatcatagcagacagctcgttggtttattaattcatccattcattcattcaataaacacttcctgagtacatactatattccaagtcccatactaggctgtgctggagaaggcagagacaattcagaatcttgtagactaagaagaaagttaggctggacacaaagaattataaatcaaggcacaatgggctaacaggcataatggtgggctgatcaagggcaatatgacttctgactgtagggtaattgaggagggcttcctagaggaggcagc

SEQ ID NO: 131238 - DNA, 601 bp, Human
gacttcctctggcacacttccaggctgccatgactcaccaggctttatgagaatagtgtggcttagaggtcaagtgtgtggtctgtggagtctgactgccggcatttaaaacctggctacaccacttacaagctgtgtgaccttgagcaagtttctatgcttctctgtgcctcagttactgcaccagtgaaatgaggatgagaagagtgactcccacaaagggttgttatgcagattagacaagctattaataagtcaagggcttagaacaatgcatggtgcagagggagtggatgggagmatcagctatcactcctgctggtgactcttggctcatgggaccctagcttgggcctgcctctctagctgttcaggattgaaaccaactctgggggaagagctccctagtcccctatcctacacaccagccccctaaataggctgctgggccacactatccttaacatgggcatgtgaccccatcttgaacctgggttcacagaggcatacgaaaggaactaatgggtctgaaaaggcaaacacttctctggatgggttcatccagacaggcagcaggtgcccctaagcattcatgccagaa

SEQ ID NO: 131239 - DNA, 601 bp, Human
ggcctgaaatccacctatcagctctgttcttcagataggggtctgtccaactcagacttcctctggcacacttccaggctgccatgactcaccaggctttatgagaatagtgtggcttagaggtcaagtgtgtggtctgtggagtctgactgccggcatttaaaacctggctacaccacttacaagctgtgtgaccttgagcaagtttctatgcttctctgtgcctcagttactgcaccagtgaaatgaggatgagaagagtgactcccacaaagggttgttatgcagattagacaagctrttaataagtcaagggcttagaacaatgcatggtgcagagggagtggatgggagcatcagctatcactcctgctggtgactcttggctcatgggaccctagcttgggcctgcctctctagctgttcaggattgaaaccaactctgggggaagagctccctagtcccctatcctacacaccagccccctaaataggctgctgggccacactatccttaacatgggcatgtgaccccatcttgaacctgggttcacagaggcatacgaaaggaactaatgggtctgaaaaggcaaacacttct

SEQ ID NO: 131240 - DNA, 601 bp, Human
gtggcctgaaatccacctatcagctctgttcttcagataggggtctgtccaactcagacttcctctggcacacttccaggctgccatgactcaccaggctttatgagaatagtgtggcttagaggtcaagtgtgtggtctgtggagtctgactgccggcatttaaaacctggctacaccacttacaagctgtgtgaccttgagcaagtttctatgcttctctgtgcctcagttactgcaccagtgaaatgaggatgagaagagtgactcccacaaagggttgttatgcagattagacaagstattaataagtcaagggcttagaacaatgcatggtgcagagggagtggatgggagcatcagctatcactcctgctggtgactcttggctcatgggaccctagcttgggcctgcctctctagctgttcaggattgaaaccaactctgggggaagagctccctagtcccctatcctacacaccagccccctaaataggctgctgggccacactatccttaacatgggcatgtgaccccatcttgaacctgggttcacagaggcatacgaaaggaactaatgggtctgaaaaggcaaacactt

SEQ ID NO: 131241 - DNA, 601 bp, Human
gctgggaggctgcacagcaggggctgagagccctgaggctgctggggcatgtccaggtggcctggcccaggcaggaacatgaaagaatacacagcatgtttcccaagaaagaaggagcaatcatacctgctgtgtctgcccatccactcaccaaaccttcacccaggacctgctaaggcctggccaggctgcatgaggtctgtctgagcaggaggctgacctaaggggatgccagcttttcaggggtgagtcaacccactacccttcaatcagatatcacccaagaagccccatcagtccyggcccctacacgtggcctgaaatccacctatcagctctgttcttcagataggggtctgtccaactcagacttcctctggcacacttccaggctgccatgactcaccaggctttatgagaatagtgtggcttagaggtcaagtgtgtggtctgtggagtctgactgccggcatttaaaacctggctacaccacttacaagctgtgtgaccttgagcaagtttctatgcttctctgtgcctcagttactgcaccagtgaaatgaggatgagaagagtgactcccacaaagggttgttatgca

SEQ ID NO: 131242 - DNA, 601 bp, Human
tctttcttatgcttttattttttgcttgaaagcaaaagaacagaagaaagctttggtctaggtggggagtttcttgaagcacagggctccccacaatggacaacacacagcctgagggctgggaggctgcacagcaggggctgagagccctgaggctgctggggcatgtccaggtggcctggcccaggcaggaacatgaaagaatacacagcatgtttcccaagaaagaaggagcaatcatacctgctgtgtctgcccatccactcaccaaaccttcacccaggacctgctaaggcctggycaggctgcatgaggtctgtctgagcaggaggctgacctaaggggatgccagcttttcaggggtgagtcaacccactacccttcaatcagatatcacccaagaagccccatcagtcccggcccctacacgtggcctgaaatccacctatcagctctgttcttcagataggggtctgtccaactcagacttcctctggcacacttccaggctgccatgactcaccaggctttatgagaatagtgtggcttagaggtcaagtgtgtggtctgtggagtctgactgccggcatttaaaacctgg

SEQ ID NO: 131243 - DNA, 601 bp, Human
ctctcaggcaggccgggcaatggaggataagaaagcaggaactccatggggtgcaggtgtgaagaactggggacttcacgacttgttcctgaagagaaccagacctaagtggcatgatccttaccctggcacttggccttctctctcccagaccaaggaaggaggaagaaagtctgtttaagaaaagcagttggctgggaagggtggctcacatatgtggtcccggctactcaggaggctgaggtgggagcatcacttgagcccaggaatttgagaccaacctgggcaacagagtgagacyccatctctaaaatatttgtttttaagtaatgacaattatctttcttatgcttttattttttgcttgaaagcaaaagaacagaagaaagctttggtctaggtggggagtttcttgaagcacagggctccccacaatggacaacacacagcctgagggctgggaggctgcacagcaggggctgagagccctgaggctgctggggcatgtccaggtggcctggcccaggcaggaacatgaaagaatacacagcatgtttcccaagaaagaaggagcaatcatacctgctgtgtctgcccatcc

SEQ ID NO: 131244 - DNA, 601 bp, Human
agcaactataacattcggggctgatattagtggttgtgaaagaccccataaggctgccaatccagctagaaaagagtagctgcccagagccctaagtgcagcctctggcttcacccctccccttcccccaaatccagtcacctggatcacacctgctggcctgccccgggacctgggccgaggttccccacccctcaccaccagcacttggcatccttcctcctctcaggcaggccgggcaatggaggataagaaagcaggaactccatggggtgcaggtgtgaagaactggggacttcaygacttgttcctgaagagaaccagacctaagtggcatgatccttaccctggcacttggccttctctctcccagaccaaggaaggaggaagaaagtctgtttaagaaaagcagttggctgggaagggtggctcacatatgtggtcccggctactcaggaggctgaggtgggagcatcacttgagcccaggaatttgagaccaacctgggcaacagagtgagaccccatctctaaaatatttgtttttaagtaatgacaattatctttcttatgcttttattttttgcttgaaagcaaaagaa

SEQ ID NO: 131245 - DNA, 601 bp, Human
cacccacactggcacagacggctatttgtgccaaccatggttttcttttgggcaacaccttttgagcaactataacattcggggctgatattagtggttgtgaaagaccccataaggctgccaatccagctagaaaagagtagctgcccagagccctaagtgcagcctctggcttcacccctccccttcccccaaatccagtcacctggatcacacctgctggcctgccccgggacctgggccgaggttccccacccctcaccaccagcacttggcatccttcctcctctcaggcaggccrggcaatggaggataagaaagcaggaactccatggggtgcaggtgtgaagaactggggacttcacgacttgttcctgaagagaaccagacctaagtggcatgatccttaccctggcacttggccttctctctcccagaccaaggaaggaggaagaaagtctgtttaagaaaagcagttggctgggaagggtggctcacatatgtggtcccggctactcaggaggctgaggtgggagcatcacttgagcccaggaatttgagaccaacctgggcaacagagtgagaccccatctctaaaata

SEQ ID NO: 131246 - DNA, 601 bp, Human
tcctcttccatggtcttcatctcagccactggctccattatctcccgggtcccccagactccaaccaggggagccatcgttgatggccgcccacctgttcctcacaagtgactattgccagttccacccctcaaaatgtttcctccatccccctttccacagcctgggttcaggtcctcatccgttctctcctgggcttttacagccacctgggtcaggtcaggtcttcctgcgagtctcatcctccttacctccaccctctgtcaagaccccacagagattcccctggagagtcgactcycctcagggctcccagcacctgcaaggtctgcccccaggtctttggcagcctcagggacctgggccctccctcatctccagctgctttcttcactcatcctttatcatgctgttccttctgcctggaatgctcttccctcacctgtttccccagcctggttaattcctgctcatttccgtgtgctcaagtgtcacctccctcaggaagccctcccacccagcctcgggaagtggcccccgttgtgcacctgtgacatctgtcacatgcctctccttatcatttcaccttttaaaaacattt

SEQ ID NO: 131247 - DNA, 601 bp, Human
ctccccatcgtccttgtctaaagctctcaactgagtgactcacatcctcccaccacctgtgtccatgcccccagtcctgaccccgcccccactgcctctgcacattccacctgagtgtccctggggtaccccaaagttaaatattcaaaccagctcctcttccatggtcttcatctcagccactggctccattatctcccgggtcccccagactccaaccaggggagccatcgttgatggccgcccacctgttcctcacaagtgactattgccagttccacccctcaaaatgtttcctccwtccccctttccacagcctgggttcaggtcctcatccgttctctcctgggcttttacagccacctgggtcaggtcaggtcttcctgcgagtctcatcctccttacctccaccctctgtcaagaccccacagagattcccctggagagtcgactctcctcagggctcccagcacctgcaaggtctgcccccaggtctttggcagcctcagggacctgggccctccctcatctccagctgctttcttcactcatcctttatcatgctgttccttctgcctggaatgctcttccctcacctgtt

SEQ ID NO: 131248 - DNA, 601 bp, Human
aagccagagagaattctgttgtttacagtgaagtcctgtgactgctacagcctccaagatggagcgcatctgtggcgggagtgtcaatcaccactcactcccccactccgggcttctccatggcgtcctcctccatggcgtcctcctcctcagccaccctggtttcccagagtccctctccagctctgctcctccccatcgtccttgtctaaagctctcaactgagtgactcacatcctcccaccacctgtgtccatgcccccagtcctgaccccgcccccactgcctctgcacattccayctgagtgtccctggggtaccccaaagttaaatattcaaaccagctcctcttccatggtcttcatctcagccactggctccattatctcccgggtcccccagactccaaccaggggagccatcgttgatggccgcccacctgttcctcacaagtgactattgccagttccacccctcaaaatgtttcctccatccccctttccacagcctgggttcaggtcctcatccgttctctcctgggcttttacagccacctgggtcaggtcaggtcttcctgcgagtctcatcctccttacctcca

SEQ ID NO: 131249 - DNA, 601 bp, Human
gaagaaactcctgcaagggcagggtcttgcccagagggctgtgcacagccaggtttgggtcctggacccagcatggatcctgatccaggtttcctttcccaggttttctctgttgctttcctgcccttccctctgtcttcacagaacacctctcaagctcaagaaactgatgctcaattttcttccagtagtccagggcgctcatgtccctgatgaagagaattacaacactttcttttgtgagtagatctaagaatgccagcatcttcttgggctctgcagacttggccaaagtcagccrtgtccctggagcccgggagatagggctgagccatccttgagcctactggtcaggggcaacacacacagaaatccgacttcacagaatttgactctaactttttccttctgtgctaccagcaaatgcctgtgcctcgatgagccttgctttacaatcctgaaaatgggaaccatgccccttgctctgcctcccatggtttgttcctgggtttggaaatggaggatggaaagagggaaggaaagagaatgagaaagaggaacaaggcagtcttctggttaaaacaaaagaaaagaaagaaaa

SEQ ID NO: 131250 - DNA, 601 bp, Human
atacacacacaagcaagaaaaaaacaaaaccttaacagttgctaaaaaaaaaaaatcactaaatgcctattctgcaggtgagaagaagaaactcctgcaagggcagggtcttgcccagagggctgtgcacagccaggtttgggtcctggacccagcatggatcctgatccaggtttcctttcccaggttttctctgttgctttcctgcccttccctctgtcttcacagaacacctctcaagctcaagaaactgatgctcaattttcttccagtagtccagggcgctcatgtccctgatgamgagaattacaacactttcttttgtgagtagatctaagaatgccagcatcttcttgggctctgcagacttggccaaagtcagccgtgtccctggagcccgggagatagggctgagccatccttgagcctactggtcaggggcaacacacacagaaatccgacttcacagaatttgactctaactttttccttctgtgctaccagcaaatgcctgtgcctcgatgagccttgctttacaatcctgaaaatgggaaccatgccccttgctctgcctcccatggtttgttcctgggtttggaaa

SEQ ID NO: 131251 - DNA, 601 bp, Human
gtttcttcaaacacacacacacatacacacacaagcaagaaaaaaacaaaaccttaacagttgctaaaaaaaaaaaatcactaaatgcctattctgcaggtgagaagaagaaactcctgcaagggcagggtcttgcccagagggctgtgcacagccaggtttgggtcctggacccagcatggatcctgatccaggtttcctttcccaggttttctctgttgctttcctgcccttccctctgtcttcacagaacacctctcaagctcaagaaactgatgctcaattttcttccagtagtccmgggcgctcatgtccctgatgaagagaattacaacactttcttttgtgagtagatctaagaatgccagcatcttcttgggctctgcagacttggccaaagtcagccgtgtccctggagcccgggagatagggctgagccatccttgagcctactggtcaggggcaacacacacagaaatccgacttcacagaatttgactctaactttttccttctgtgctaccagcaaatgcctgtgcctcgatgagccttgctttacaatcctgaaaatgggaaccatgccccttgctctgcctcccat

SEQ ID NO: 131252 - DNA, 601 bp, Human
gagacaggaggaatccatagtcatcggcttctctgccctttgtccaggaccggctgacagctcatattattttaagaaaaagtcaataggtaagtatccaagcctctgataggcttctgatttcttgtaaagggactgaggcccatcacgaatcctaaaccagtgcctcagctggtccagggggcaacgggatagtcgatgtcacagtgccaggcttggaaccaagaaagtccaaacagacaacgctgatattttgtaacgccagctcctacacctccaattatttcctcaaaccaagcakcaaggaggcccatacgagacaggcaggctgagcaggtgcactgctcgccaaggaaaaccaagcccatcccacagaggcacctcccagggtgcacagcaaattaatgtgctgcagagaacatgcattaaattgtgctgctaggctggtgctgcaggctaccaaagtgccagcccatccctctccagccctcccttccctgagaagcagatcaggtgccagggccgaactatctcacagaatcaccggctgcttttgctagccaccagcctagctcaggctcttgcttgcaggccactgctg

SEQ ID NO: 131253 - DNA, 601 bp, Human
tgtttgcaatgaaatcaggcatggtgggagggacctactggatctttgaagctaaggggtaagttcagggctgggggaccaagtgcaaagcccatggaggtacagccagccctggactaggagtcagaaaaccccgcacttcctcactgtgccctcgggcaggtcccctctcctctgtaaatgtcctcacctgtgcacctgatgcccaaccccaggccacccaccagagggagatcagctaatgctgcagagacaggaggaatccatagtcatcggcttctctgccctttgtccaggaccrgctgacagctcatattattttaagaaaaagtcaataggtaagtatccaagcctctgataggcttctgatttcttgtaaagggactgaggcccatcacgaatcctaaaccagtgcctcagctggtccagggggcaacgggatagtcgatgtcacagtgccaggcttggaaccaagaaagtccaaacagacaacgctgatattttgtaacgccagctcctacacctccaattatttcctcaaaccaagcagcaaggaggcccatacgagacaggcaggctgagcaggtgcactgctcgccaa

SEQ ID NO: 131254 - DNA, 601 bp, Human
ctcgctgcacctccctaccacacgctttcatttgtgctaaacctctgccagctccggggtccgaataaaacatgtggtctaaatgcggaagacgagaggcgcagagggaagcaggcctgtgcacaaaggtggaggcctctggagcggttcaccccatgcctgtgtgtgccgccgaatccgccgaatgcatgcgaggtacatgaagaatggtggccagcactgggatctttctatttgccagaaactcttctaaatgccttacttgcgtcacctcatttagtcatcagaacaatcgtatgargtagaaatgatcactattattattgtccttgttaagaggctcagcctagcggtgaagggcaaaaggtctggagcagattctttggattaaaattactagttgttctataaccttgggcaagattacacctcagtgttctcatttataaaatggggataatgatacctccttagactgcttaaaaggattcaagactcaatgcatgtaaagcacttaggaagccgcctggcccatgtaagtgctcccaaatgtcagttattacctctgatgcctgttactgccaccaatgtacagaggagg

SEQ ID NO: 131255 - DNA, 601 bp, Human
cgatggctccccactgcttacacacacagctaagagcatgggctctgagggctcaaatcccagctctgccacttaccagccgtgtgaccttgggcaggtgaccccgccttcctttcctcgtctaagggaggaggaaggggaaccccaacagtccttctctgatggagtggtggcgagggccgagtgagtgagacagctctgggaacaaacataggctggtgcccatggcccactcacactcgctgcacctccctaccacacgctttcatttgtgctaaacctctgccagctccggggtccraataaaacatgtggtctaaatgcggaagacgagaggcgcagagggaagcaggcctgtgcacaaaggtggaggcctctggagcggttcaccccatgcctgtgtgtgccgccgaatccgccgaatgcatgcgaggtacatgaagaatggtggccagcactgggatctttctatttgccagaaactcttctaaatgccttacttgcgtcacctcatttagtcatcagaacaatcgtatgaggtagaaatgatcactattattattgtccttgttaagaggctcagcctagcggtgaagggcaa

SEQ ID NO: 131256 - DNA, 601 bp, Human
tggaaagcacagctctgttcacatcgagctgctgtcagaaatcctcgatggctccccactgcttacacacacagctaagagcatgggctctgagggctcaaatcccagctctgccacttaccagccgtgtgaccttgggcaggtgaccccgccttcctttcctcgtctaagggaggaggaaggggaaccccaacagtccttctctgatggagtggtggcgagggccgagtgagtgagacagctctgggaacaaacataggctggtgcccatggcccactcacactcgctgcacctccctaycacacgctttcatttgtgctaaacctctgccagctccggggtccgaataaaacatgtggtctaaatgcggaagacgagaggcgcagagggaagcaggcctgtgcacaaaggtggaggcctctggagcggttcaccccatgcctgtgtgtgccgccgaatccgccgaatgcatgcgaggtacatgaagaatggtggccagcactgggatctttctatttgccagaaactcttctaaatgccttacttgcgtcacctcatttagtcatcagaacaatcgtatgaggtagaaatgatcactat

SEQ ID NO: 131257 - DNA, 601 bp, Human
gtcacatgtattaaattaacaaatacaggtaaggcccctagcacagggcccagcacagagtgaacactcagtaaggccaccattgttaaccgtgcctcctgcgctccacagccaccctcgggccatcccaaaagcaaagccagattgggcttggaaagcacagctctgttcacatcgagctgctgtcagaaatcctcgatggctccccactgcttacacacacagctaagagcatgggctctgagggctcaaatcccagctctgccacttaccagccgtgtgaccttgggcaggtgacccygccttcctttcctcgtctaagggaggaggaaggggaaccccaacagtccttctctgatggagtggtggcgagggccgagtgagtgagacagctctgggaacaaacataggctggtgcccatggcccactcacactcgctgcacctccctaccacacgctttcatttgtgctaaacctctgccagctccggggtccgaataaaacatgtggtctaaatgcggaagacgagaggcgcagagggaagcaggcctgtgcacaaaggtggaggcctctggagcggttcaccccatgcctgtgtgt

SEQ ID NO: 131258 - DNA, 601 bp, Human
gtaaacaagatgatggctaaatgaaaaaatagaataaatacatgaaagcacagaaaggatagcattccccagactggccttctggatttggggatgtgaaatctttgtaaagggggccatgtgggatggtaggcagtgtgcgatgggacaagagccacagggctggtggtctccactcagatcctggctccacactcactggccatgtgatctccagcaagtcatttcgcctctctgtgtgtcaggttttgcatttataaaatgaggacgatcctatcttcctcacagtgctgtcacatgkattaaattaacaaatacaggtaaggcccctagcacagggcccagcacagagtgaacactcagtaaggccaccattgttaaccgtgcctcctgcgctccacagccaccctcgggccatcccaaaagcaaagccagattgggcttggaaagcacagctctgttcacatcgagctgctgtcagaaatcctcgatggctccccactgcttacacacacagctaagagcatgggctctgagggctcaaatcccagctctgccacttaccagccgtgtgaccttgggcaggtgaccccgccttcct

SEQ ID NO: 131259 - DNA, 601 bp, Human
tggcggccaccccatgttctcctgcccagggctggcagtattcccatcacatgtttgcccagcacctcttgcccaccctgggtaggagctgctaattcagaacatacctgtcaaatctaatggttgggaaagtctcccttcctgggagatagattttatgtaaacaagatgatggctaaatgaaaaaatagaataaatacatgaaagcacagaaaggatagcattccccagactggccttctggatttggggatgtgaaatctttgtaaagggggccatgtgggatggtaggcagtgtgcratgggacaagagccacagggctggtggtctccactcagatcctggctccacactcactggccatgtgatctccagcaagtcatttcgcctctctgtgtgtcaggttttgcatttataaaatgaggacgatcctatcttcctcacagtgctgtcacatgtattaaattaacaaatacaggtaaggcccctagcacagggcccagcacagagtgaacactcagtaaggccaccattgttaaccgtgcctcctgcgctccacagccaccctcgggccatcccaaaagcaaagccagattgggc

SEQ ID NO: 131260 - DNA, 601 bp, Human
gggggagaaacagctcaatacccaggacgtggggcggggattcatcctgctacgcacacgtcggtgcgtgtgtacacgtagtgcatacgccgccaggcttattcgttccagctggtgttggaaatgtgtggcagtttgaacagggttgctctggagtctccctttgtccagacctgccactagtggagggtatgctgctgacggtagatgcagagggggaatatttcacccggaggggaagggcagtgggaatggtgatgtaacagcctacctctgcctgcagacaatggatgtgctaatkgcagatgagctgtatccagtcattaaagcggatctggcaggctcctaatgacaggtttattagccattagtttgggtggtgttattgacttaggaatagtaaccctcaatttcttttcccaaaattacctaatccccacttttaactaattctgactgacctccttctaattgccctggctaaagatctaatctggatttgtagagccaggaagacaatctcagaatccactaaccagggagctgtttactttgctaaccctcctcattccttcctctgaattgaccgcacccacctccc

SEQ ID NO: 131261 - DNA, 601 bp, Human
tgttattgatggcctataataagtttgcaaataactaactaaaatgaatcaatttgcattcctaacataattcctcctattaatggcacgtaagtacatcttttctaactcatgcgtggccttctcttaccagggagaataaccaagacttggctttgcttactatcagcaaggagtccaggcagaacagtgaaactcaacacaaaggccactcctccagaagagacacatttggtttgaaataactcactctttgcaatcctgagaggaaggggaagaacagggatctgcccctgttgtrtacatgaggaaactgaggctcagggatgagttttgactggcccaaagtcacagagtaagcggtagaacagggacttcaattcagatctcatgatttctacttaaatgctattattgtaggattattaaaaatgtttcccctcgaggggactagccctcccagatgctaaaacattctatgaagtctttataattaatattgtgataccagcacctgaagaaaaaaccaatggaatagaatgaaaaatttaaacaaaggctcaaaagatccaatccatattggattatggacccaataatc

SEQ ID NO: 131262 - DNA, 601 bp, Human
gtttggggggcatttgctaagcagcaatgtggtggcaattgctgattgacaaagatttaataaatgtcatcactgttctctacttaaaagcttgctgcctggaacctctaagaacacgtatcaaattccaggcagaggctgatccccacgcctggttggggaacccactcttatgaattcaagcctcagatctgctctgaggcccatcagaactctcccggcaccaagctgaggagtctgtgaccttggaggacacaggcagtttcaccttctcagtcccttccctaacatgtcttaggcrtgtcgccagggttggggtttacaacctgtcaacacaaggcagctaaggagatgctactcccccttcttagctctaattcaagcctctggactgggatgggaaaccagatttaatgcttctaaacatgctatgacctcaaagcacacatttctttcatttttttttaaccaaggaagaaattatttgtatcatttgcaatggcactgaatgttattgatggcctataataagtttgcaaataactaactaaaatgaatcaatttgcattcctaacataattcctcctattaatggcacgta

SEQ ID NO: 131263 - DNA, 601 bp, Human
gtaattcttcaccccaccctcaccaccatcagcttgaaaaagaaatagtaatttaacaccaaaaagtaggaaggacatatattaaactggtttttaaaaccaaataaattcagttttatgaaaaaacaaaaggaaccctttgcagctcttcctgttagagcacagtggcctcctctgacccttaaatttaggttcagccgtgtgccttgctctggccaatgggatgggagcactcggcaagcagaagcttgatgtgtgcttgtgtggctgggtgcccttctcccttatcctgagaatatgycctggctagcctgcaggtccaaggagagggggcacatgtggagcagagatggacccaaactgtgactggaacccagcccagcctggtgcagccaatccccagccgaccccaagtgcactagcaagaataaacgattactgtgttaagacctgagtttggggggcatttgctaagcagcaatgtggtggcaattgctgattgacaaagatttaataaatgtcatcactgttctctacttaaaagcttgctgcctggaacctctaagaacacgtatcaaattccaggcagaggctgatcccc

SEQ ID NO: 131264 - DNA, 601 bp, Human
cttacggagagtaaactgtgagtgaggcacacacattctcacttattcctcacaatagccctattagagagctactatgatccctattttactgagggggaaactgaggcacagagcatttaagtgacttgctcacagtcacacagctagaatattaaaaagcaaggtttcaaacccagccagtctggcttgcaagcctgccctctccacccctgccctgtgccatctctgcaaccacacagaagcatgccttcttcataaggctgtggtaaggaggcagagggaagatgtgtgagaagcrcatggcacagtgtggaaggtaattcttcaccccaccctcaccaccatcagcttgaaaaagaaatagtaatttaacaccaaaaagtaggaaggacatatattaaactggtttttaaaaccaaataaattcagttttatgaaaaaacaaaaggaaccctttgcagctcttcctgttagagcacagtggcctcctctgacccttaaatttaggttcagccgtgtgccttgctctggccaatgggatgggagcactcggcaagcagaagcttgatgtgtgcttgtgtggctgggtgcccttctc

SEQ ID NO: 131265 - DNA, 601 bp, Human
attgctccagtgttccaggcactggtatgggctgttgagcagcattattccactgaaacctcatagcttacaaaattcccagcataaacctgatgacactgtgtggggaggtctcggggaggctgcagctcaccagagaaaggaagacagcagagcacagtgacgaagcatgtcaagtctgcccaggctcacacccttgatttgccacttattagctgtgtgaccttgagagagtcccttagtcattctgagcctcgatttccttatctataaaatggggaggataatagccagcgcttayggagagtaaactgtgagtgaggcacacacattctcacttattcctcacaatagccctattagagagctactatgatccctattttactgagggggaaactgaggcacagagcatttaagtgacttgctcacagtcacacagctagaatattaaaaagcaaggtttcaaacccagccagtctggcttgcaagcctgccctctccacccctgccctgtgccatctctgcaaccacacagaagcatgccttcttcataaggctgtggtaaggaggcagagggaagatgtgtgagaagcgcatg

SEQ ID NO: 131266 - DNA, 601 bp, Human
agggagagaagctgacagctttctgtgtcctctcaacctcctgaattgctccagtgttccaggcactggtatgggctgttgagcagcattattccactgaaacctcatagcttacaaaattcccagcataaacctgatgacactgtgtggggaggtctcggggaggctgcagctcaccagagaaaggaagacagcagagcacagtgacgaagcatgtcaagtctgcccaggctcacacccttgatttgccacttattagctgtgtgaccttgagagagtcccttagtcattctgagcctckatttccttatctataaaatggggaggataatagccagcgcttacggagagtaaactgtgagtgaggcacacacattctcacttattcctcacaatagccctattagagagctactatgatccctattttactgagggggaaactgaggcacagagcatttaagtgacttgctcacagtcacacagctagaatattaaaaagcaaggtttcaaacccagccagtctggcttgcaagcctgccctctccacccctgccctgtgccatctctgcaaccacacagaagcatgccttcttcataa

SEQ ID NO: 131267 - DNA, 601 bp, Human
atacttccttgttcttatattgatactaaatctaaagttaataccttaaaaatacttaattggtgagatacttagagaattcctgttaatgtcaagaacatgtcaaggaaacctattatcaatgttatcactgaaaattgttctgaaagttttagccagtacaatacgataagacagagacataagaggaataagcactggggggcagggggaaacccaagattataatcagctggataaatcttaggcttgggaaatcataagaaaattggctcatctcctagaaccaatggaaaatttyggtgaaatagccaggtaatggactgtgtcgactccagccttgtgcaggacttgagcaaccaccatgctggggactcattccattctcaggtccccctctcccagcccaccaggatggcagtatgtgctcagaggagctggcacatggccgcatgcactctacacatcactctgcctccgagttcccatcacagaggggctcctttgccttgtccacggctccagttttacgcaggcacagtccccagaaccagaggcttcacctgtagctgtgcttactctccttggactagccatgaaa

SEQ ID NO: 131268 - DNA, 601 bp, Human
tggtgaaactctgtctttactaaaaaatatatatatataaattagccaggcgtcgtggcacatgcctgtgatcccagctactcgggaggctgaggcaggagaatcgcttgaacctaagtggtgtaggttgcagtgagctgaggtggcaccactgcacttcagcctgagagacagagtgagactccattcacaaaaagaaaagaaaagaatgaattaggaaacagaaaagcagacaacaatacatcagccaataattgttatttgaaaagaacaataaaatagacaaatctatcaagattcaaaaaaaaagcacagataatcaagataaaggatgaggagacattataaccagagatgatatttaaaaacataaagaaacacactccacatgaatgaatgtagaaatctcaacaaaaggtacaattttctaggaaaatatgaattgccaaaagtaattcaagaagagtcagagaataccaacatcccaataatcttagaagaaatagaaaaagtttaaaaaaaaataagtgcctcatccatttagcttcttgggaaagtttttgtttgttattctttttggcaagttctttaaaccttcaag

SEQ ID NO: 131269 - DNA, 601 bp, Human
ggaccacataaggggtgctgccaaacctgcctcctgaaagatggggggcattagcccagtaggaggctgcctggtacaagtgctcacatcctacttggctgcctgggatggataagaggatcgtgagaggggagggaacttgtccaaagatactcggctgacctgaggcaaggctgggactgacagtctgcccccctgccccctgggagtggatcctttcttcaacggtgggttgctctcagggtcatttctgaaccccaacagtttctgctgctgttacacatgctttaaaaccttgaaycctaaagcaaatgttcagaagatcagtgcctcaccaaagcactcaagaagccagataaaaatctataaaatgaacccagggaaagaaggaggaaggaatcaacaaaataaaaacagaaaagaatgaattaggggcaggctgtggttcacgcctgtaatctcagcactttgaaaggctgaggtcaggagttcaagaccagcctggctaacatggtgaaactctgtctttactaaaaaatatatatatataaattagccaggcgtcgtggcacatgcctgtgatcccagctactcgggaggc

SEQ ID NO: 131270 - DNA, 601 bp, Human
ccactgcaggcccagctgcagagagtgcagacctctgcctgatttattcaggtccgcttctcagaagcgtagaggtcacccaggctgtttggggggggatgtccccccaccgaaaccccgtccgctgcctgctgtggagacgccgacagtgcaaactcaccaggcaccatccctgtcagcgtcggtgctgagtagctgccctgtccagcgggggggacgtgtggagggtacccggggagggtcgtgctcgccaagtcacggcctgaggaatcaaagcaacaaatcacagggtgagcatctycgcggccagccgctcatgtccacagctccctggacgcttctgcacatttgtcacgtttggacgctgaacggcaatgtgcccccagctcccccctgtcgctcacacgctctcacaaacacacatacacacacacacacacacacacacacactcatgcacacacatctccagccaccctcgctccactcagcaagaacagagtcagggatgtggcctgttcctgggaaatcagaaccccctgcttggggaggctaggcaatgcaggtgacagcacgccccgactccagccagctctcccta

SEQ ID NO: 131271 - DNA, 601 bp, Human
tctcactacaaagaaatgatgaacatttgaggtgaagggtatgttaattagcctgatttgatcattccacaatgcatacactgtcaaaacaccacactgtaccctatagatacactgaactatttgtctattaaaaattaaattaaataaataaaaacttttagaaataatttttaaaaggagacaatgctaactcataaaagatgtgtaacaacatccagtggaggcccgattttcctcctgatttttaaaaacatctttcaagaaagaatactcgggtatttctgctatgctaatgctsttaacacccagacagccagtaccgcttgtccccacaccaccccacaatgtaaggagacatggcagcctcctctccagatgttttaaactgacaatcaccggcctggggggatcaggttccaacggccacagggtgttcagtttagaatcaaatgacaaacccaccatccaacatcccgtctgtcctgaacacattatcctcaaccccaaggagtgaggccaccgcgagcacctcagcgccttctgcttgttcgtgtcacacgattgtgtgggagagagggcgggggccgggagggaggga

SEQ ID NO: 131272 - DNA, 601 bp, Human
caagtgatctgtctgcctctgcctcccatggtgctgggattacaggcatgagccactgtgcccggcctattctggcttttttaggtgcccagagacagtcaagagtgtgtgttaggaggagataaggcccttagagccccaggcactgaaacaagctgtgttgccccctgtaaatgactctacctaagagacagcatggtgactatagtcagtaataatgcattgcatatttccaacagctaaaagagaggtttttaatggttctcactacaaagaaatgatgaacatttgaggtgaaggrtatgttaattagcctgatttgatcattccacaatgcatacactgtcaaaacaccacactgtaccctatagatacactgaactatttgtctattaaaaattaaattaaataaataaaaacttttagaaataatttttaaaaggagacaatgctaactcataaaagatgtgtaacaacatccagtggaggcccgattttcctcctgatttttaaaaacatctttcaagaaagaatactcgggtatttctgctatgctaatgctcttaacacccagacagccagtaccgcttgtccccacacc

SEQ ID NO: 131273 - DNA, 601 bp, Human
gctcactgtaacctctgctttctgggttcaagcaattctcatgccttagcctcccgaatagctgggattacaggtgcatgccaccacacctggctaagttttgtattttgtttgtttgtttgtttagtagagacagggcttcgccatgttggccaggctggtctcgaactcctggcctcaagtgatctgtctgcctctgcctcccatggtgctgggattacaggcatgagccactgtgcccggcctattctggcttttttaggtgcccagagacagtcaagagtgtgtgttaggaggagayaaggcccttagagccccaggcactgaaacaagctgtgttgccccctgtaaatgactctacctaagagacagcatggtgactatagtcagtaataatgcattgcatatttccaacagctaaaagagaggtttttaatggttctcactacaaagaaatgatgaacatttgaggtgaagggtatgttaattagcctgatttgatcattccacaatgcatacactgtcaaaacaccacactgtaccctatagatacactgaactatttgtctattaaaaattaaattaaataaataaaaacttt

SEQ ID NO: 131274 - DNA, 601 bp, Human
atcctggtggccagagggcaggctctgtttggataaacttggcaaagttcagctgcttctctgaactcagcctctttggggtttccagtggggggctgagaggaccggctgggtggcctcagcttcaccactgacatgctctcagaacaggttccggggctgtccctgtccctctgtcatcacagataagctggagttgactgattcagagagcacacccaggcagcccagggcacaggaagaagtgcctccctgggtgtggggagtgctgggagggaggtagaaggggccaaagactggrgttcaagtcctcctcctgcaagctgcacagccccccagaaattccctggcttctccggggcttctctggcccttttggaaaacagggattactctcctaaccctgccccccttgcaggactgttgcgtcatagcactcaggggaagtccgtgttctataaggcactacataaatgcgacgggccatccatggacgcggcttggggtccatctcccaaggccgcctggacgtgctaaaggttggaaaatgaggagccggtggggcggggcaaggggaagggtggtgtgtgtcccaccacct

SEQ ID NO: 131275 - DNA, 601 bp, Human
tgcattcagccctgaagggtgttgctggattctgacaggtcaaggtgggaagctattcaagaatgatgaaggaactgatgggtgagagtccaaggtgtgctgggcaccagacagcagtcagggttggggaggctgggagaggaggccagaaaggcaagttgaggccaaccacggtgaggcctgacagcccagggcccctgctctgccaaaaggtgggccctctctgttctgtgggacagtgccgggggtagtgtctgcaaaaacaatgtccacaggccacccaagaaacagatttggaaaytttgttggaaacaagagtcccaaagacctgaccctgtttggccattgagaaacaggaactaagggctgtgcggctgagcttggaatcccagccctgacgccaggcatggcactgaataaatgctgggagatgcatgagaagagacagcaaggaggctggggcaagaggagaaagaggaaaagacggaggaagaggagacagagagatgcagaaggaaagaatggagggagagagagaaggaagaagtcatgggctcccaggcagcaggctcctctgccgaagtgcttgtttcctccctcc

SEQ ID NO: 131276 - DNA, 601 bp, Human
cactgcactccagcttgggcgacggccagagtgagaccatgccttcatttaaaaaatgaaaagaaaaaagaagtgaaagtagtggcagctaaatgttttctaaagccgacagtggggaaaaaacaccccgaagattttgggattccctctagattgcaccaccagcccaccagaggccaggagggagtgaaacagatctcacagtgaaacagatcattgcagcatagcaacctcagagagacaaaagcaagagacacaggtgtcccagagccttgcttcacttgtttctccaaacatgccwacaggccctcggggtcaatgcaatggcatcatcatcttcagcaccgtcacaattcagtggatgccttcaggattcagaagcccgagaggtcacaaatcagcatctgaacaaacactgagttgaagttctcaagcgtgttgtggcacatccatgccctactccctggagcctgatatagggaggctccttatatgtaacctgtgaatgtgactccccgtgaaaggaaaaaaggggtctttgcagatgtgattgactaaggatcttgcgatggggagatcatcctggatcctccaggtatga

SEQ ID NO: 131277 - DNA, 601 bp, Human
cctcacctcctacttctttaagaaaataaaagccatcagtttagtgagtgcctcaattgaaaggcatctagaaatgatgtccatcaatccatggcaagtacagtgcccaggcccacagggaccccacctagtgcctttgtgcacattgttctggtgggccatgagggatggggcacccaccggttcctcaaagatagcaacctttttttctcagacttactaaagccaaagggcaatgaactccccttcctttttcctctagcccagaatttgtcagaatttcaaatgccatgtcgatatytgcaaccatgttaagatatttgcaaccatgttaggttgcaaaatatcttcaggcaggaatcaactggttacaccaatcaagacactatgaaatctttggtgcaaaattttcggcattttctgggacttgatggaaataaaatttgaaaactgtttcctttctaagctgatataagatgctatattcgctttcttcaacgtaactgctctgcaaatggtgatgcagagtttactgaatctgcaaaccctagagaagaccagaagctatgttttgcagacatggggatgccctggagccgga

SEQ ID NO: 131278 - DNA, 601 bp, Human
tggcagctcggcctaaagttctccattttaatttcagctactgtgtcctgagtgcgactaggtgctaggcactgtgccgggaactaaggacacaactgtgaacaaaacagacatagccttgattattgtacagctcttacataccatacagacctgaagagaagccggaggggaacgagtaaaccacacactaaatgacttcagctgggcttagtgctgcacatgaaaagagcaggaagctctgggagaggaatgatagggggtcctggttcggagggtatgtggcaggcagaattgtggccccccccaaaaatgtccatatcataagccctagaacccatgattatgtcggattacatggcagaggggaattaggttgcagataaaatgaaattagctgtcctgaacatgggcagattatcctagatatccaggtgggtccaagggaaacacagagctctctaagtgaatgggggaggaaggaggggcagccggataaagactcagcccaacatcgccagtttcgacaaggaaggaaggggccaaaagccaaggaatgccggcagcagcaacaagctaggacaagaaagcaaatcattcc

SEQ ID NO: 131279 - DNA, 601 bp, Human
tgcctatggaactgggcagtatatattttctccctgtttcacatgcttaaccagacccagagagtggaaatgacatgtcagatggcacagaggtcctggctgagctgggccaggatgctgcctggtactgcggcccccacccctaagcctgcatgctttgcacagagcaggcctgtagggcaggcaagacgcagaatcaggggtgggcttgccagaccacaaaagaaaccttctcctccccgctccagaacctcaatacccttcctatctcacacaggcggtgtctccgtaactacacaamcatcgtttcaaacagtagcaaggcaggctccgagaagtcacagagctcctctgtggtcacactgctaataatggtgaagccacattcttgccaaagcacccttcgcttctcttggggcatctgcatatttctgtctggactggccctcgccccatgctcctggggttcatgcacctgtctgcagaaggcctcatctgcatgtctgcttggcctccaaaagttgccaagctcagatcctaaccttgctggccatcagcctccactcaacaggctcccctccctgccaatcctacttgcctg

SEQ ID NO: 131280 - DNA, 601 bp, Human
cttagaaagaaagtcaggggtcaagggaagttagtgttaagaacaaaggctgttctttccctgagcaaacgctccctgagcctgatgcttaggtcacggaggtgcctggagagcactggtcctctctccatctgatgctcaaatccccaccaccaagttctcaccagtgtccgctggaccctcccaagtctgcccattccaatgtcttcagtactaatcataggaaaggttcttgatacaaggctggaaaaggtggccctctgaatcctgttcactactcccggccatgcctatggaactsggcagtatatattttctccctgtttcacatgcttaaccagacccagagagtggaaatgacatgtcagatggcacagaggtcctggctgagctgggccaggatgctgcctggtactgcggcccccacccctaagcctgcatgctttgcacagagcaggcctgtagggcaggcaagacgcagaatcaggggtgggcttgccagaccacaaaagaaaccttctcctccccgctccagaacctcaatacccttcctatctcacacaggcggtgtctccgtaactacacaaccatcgtttcaaac

SEQ ID NO: 131281 - DNA, 601 bp, Human
ctcccactccaccccattgcctcagcagactcagtggtccccctcacctgcatttccccacactttatagattcctaggtcttagctcttaacattagcacatcaggatttttttatatccatctctccaactagactgtgagctccctgagggcaggggctgtgtcggcagctccacccctagcccacaattggcaccaagggtctcttaggaaatgtatggagaatgaatgaatgaacaagtgaatggccacctgcatttcatcgtagctgtgtctaggattccccagggtcaagtctrtgttcctgctgtggcagagtgactggaggccaccagagggcagcaaagagtcaggaacgagcaacaggtgtgcaccccagaggccagggccaggttggcaaaggggtggcgtgcccaggccagagagctaccaggagccccagcaaggagcttagaaagaaagtcaggggtcaagggaagttagtgttaagaacaaaggctgttctttccctgagcaaacgctccctgagcctgatgcttaggtcacggaggtgcctggagagcactggtcctctctccatctgatgctcaaatccccac

SEQ ID NO: 131282 - DNA, 601 bp, Human
atctggcagctagaatcagaacctaggtctcctaaattcaagtaggaccttcatgtccccagagtcctttccatctctgaggcttttgtaattcttttcttcccaaatgcaggcaagagctgagaaagcctacatgtgtgtatcagtttctcctcactcccagcatcacttccgtgcagggttcctggagctttagtcacatagactgtccagaccacctcattctagacccctcgtccccccaccctatgagggcacaggcaacaggcaaccctggctctccacatctgcctgggcagascctgccctctgcaaggctattggatgctcagcctcatgcccagaggtttccagggctgaggtgtgggtgtgactgggacccttcttccctagatccagccttcccttccagctcatctcccaccagccccacaaggctttggtcactcccagctccctccctgatgcccatgttctctggttcccctggggcttctcacgcactggtcccttacccaacaatatccctccagcttcacagactggcaaactcactcttcaaggtccagctcaaatgacctcctttgagaagtcttccctg

SEQ ID NO: 131283 - DNA, 601 bp, Human
caccggctttggacagggcactctcccagctgagactctgcttctcagctgtccttgcaatggggttgtgagaaataagaatgtttcccagcacctgtgagcctaggatattctctctccccatctccatgctcccaaaagggacactttgctttcaaagatggaacaaatgatggtgatctttactacctctctctcaccctaagattgcagattccagtctgggagccctcctcccaggtgcacaagccccaaaagccagccctggcctgccccagcagtttctgggccttcccgatcragacatgggagcagtgtgtaaggttaacaagtcctcaggctcttctccttcagtccagcccttggaagtgattaccagattatacatgacagcccagggccactgtcttattattcacagccccagatctgaagggaacttggaagcactttctgcttacttagaacagaggtggcagggcttagggagccctccagttcggtcaggagctgttatgagcagggataaacatcactgacttagaaaccttgaatggcaggagcagaaaaccccctggggtgcattcagcccagcctcccc

SEQ ID NO: 131284 - DNA, 601 bp, Human
ttcatctcctaaaaagccatcacagcccagtcgttttgtttgttgtttgtttttaagaaacaccattagtagaaggacatcaggaagaaattgtaagtcaggatcccaaacacatgttctcacatactcatgaccaggttggtgcagttggatctggggcctgccaaccaccatcagaaggagctggaaactggggaaatctaacaagtagattcagcccagagcagcaccaaagctgtcctcagcccctggctctgagctcccccagcactgcacacttcccaggcgggccagtgagcaccggctttggacagggcactctcccagctgagactctgcttctcagctgtccttgcaatggggttgtgagaaataagaatgtttcccagcacctgtgagcctaggatattctctctccccatctccatgctcccaaaagggacactttgctttcaaagatggaacaaatgatggtgatctttactacctctctctcaccctaagattgcagattccagtctgggagccctcctcccaggtgcacaagccccaaaagccagccctggcctgccccagcagtttctgggccttcccgatcaag

SEQ ID NO: 131285 - DNA, 601 bp, Human
ttctaaagcaaattctgatagcattccccttcatctcctaaaaagccatcacagcccagtcgttttgtttgttgtttgtttttaagaaacaccattagtagaaggacatcaggaagaaattgtaagtcaggatcccaaacacatgttctcacatactcatgaccaggttggtgcagttggatctggggcctgccaaccaccatcagaaggagctggaaactggggaaatctaacaagtagattcagcccagagcagcaccaaagctgtcctcagcccctggctctgagctcccccagcacygcacacttcccaggcgggccagtgagcaccggctttggacagggcactctcccagctgagactctgcttctcagctgtccttgcaatggggttgtgagaaataagaatgtttcccagcacctgtgagcctaggatattctctctccccatctccatgctcccaaaagggacactttgctttcaaagatggaacaaatgatggtgatctttactacctctctctcaccctaagattgcagattccagtctgggagccctcctcccaggtgcacaagccccaaaagccagccctggcctgcc

SEQ ID NO: 131286 - DNA, 601 bp, Human
ttgttggtagaatgagcttacgggcatgggtggtttggccccatttgagaacactctccttttggaaggcagaagccaagctccactggctctcactgccctgagggcttcggacactgccagaagttctctggatagcagtatcccaggtggagtgaccctcagggttggaggcagcggttggtccagatgaagactgacagctgtcagggtcttggagacaggggctgcagatcccagcaagccgaagggagtcaaactctgacagccccagtagattaaagctgggtttcggaaagaytgcagtaagtacaggagcaaagcacatctcagaacctttgtcttcattgttcctgctctgcctgaaacactcatcttctccctcctcactccacctcccactggctaacatatgtttctctctcaacaataaacctgaaaattgtctcttcctagattcctcccctgccctaagggcagcaccagggatgtcttggaaagctttagctgtgcccctattctttgatgtgttttctcaatcttagcaaaactctctgcaaaagcaccctcagacatgcctcccacccagccctactgtaca

SEQ ID NO: 131287 - DNA, 601 bp, Human
agttactctgtgcaagccgatgcctccacttcctactctgtgaaatgggataacatcaacagcagcctaatgggagcattgcaaaaaacacgcaggtcggggaatgaaaggcaattagtgcaggactggcatatagaagtgcacagtaggggccgggcgcagtggctcacgcctccaatcccagtactttgggaggctaaggtgggcggatcaggaggtcaggagctcaagaccagcctggccaacatggtgaaaccccgtctctactaaaaatacaaaaattagctgggcatggtggcaygtgcctgtagtcccagctactcgggaggctgaggtagaagaattgcttgaacccacgaggcagaggttgcagtgagccgagattgcaccgctacattccagcctgggcatcagagcgagactctgtctccccccgcccccccaataaaagtgcttagtaggtgtcagctactgctacaaagcaagcccttttcctcacaggagccctgggaaaaagaccataaaagtgcaggctgaggtacagagacagaaaggtgacttccctctaaggctggtaaacctacaggcaggactaaggcca

SEQ ID NO: 131288 - DNA, 601 bp, Human
agtgagcctactaggctctatcttggtactatcacttgggcaagttactctgtgcaagccgatgcctccacttcctactctgtgaaatgggataacatcaacagcagcctaatgggagcattgcaaaaaacacgcaggtcggggaatgaaaggcaattagtgcaggactggcatatagaagtgcacagtaggggccgggcgcagtggctcacgcctccaatcccagtactttgggaggctaaggtgggcggatcaggaggtcaggagctcaagaccagcctggccaacatggtgaaacccygtctctactaaaaatacaaaaattagctgggcatggtggcatgtgcctgtagtcccagctactcgggaggctgaggtagaagaattgcttgaacccacgaggcagaggttgcagtgagccgagattgcaccgctacattccagcctgggcatcagagcgagactctgtctccccccgcccccccaataaaagtgcttagtaggtgtcagctactgctacaaagcaagcccttttcctcacaggagccctgggaaaaagaccataaaagtgcaggctgaggtacagagacagaaaggtgac

SEQ ID NO: 131289 - DNA, 601 bp, Human
cagaggcaggctccagctctcaggcccctgtgttttctcttgttaaaagggctctagaaccagtgagcctactaggctctatcttggtactatcacttgggcaagttactctgtgcaagccgatgcctccacttcctactctgtgaaatgggataacatcaacagcagcctaatgggagcattgcaaaaaacacgcaggtcggggaatgaaaggcaattagtgcaggactggcatatagaagtgcacagtaggggccgggcgcagtggctcacgcctccaatcccagtactttgggaggcyaaggtgggcggatcaggaggtcaggagctcaagaccagcctggccaacatggtgaaaccccgtctctactaaaaatacaaaaattagctgggcatggtggcatgtgcctgtagtcccagctactcgggaggctgaggtagaagaattgcttgaacccacgaggcagaggttgcagtgagccgagattgcaccgctacattccagcctgggcatcagagcgagactctgtctccccccgcccccccaataaaagtgcttagtaggtgtcagctactgctacaaagcaagcccttttcctca

SEQ ID NO: 131290 - DNA, 601 bp, Human
aaggtgacttttgaagaaagaatgaaggtagcaagagtttgccatatgaatatctgtgggaagggccctctaagcagaaggaacagcaagtgcaaaggccctggggcaggagtgtgggaggtgtgtggctaggacagccaggaggcctatgtggctggagagaagccagggtggggagaggggagagaaggccagggagggaagtggggagtgggagataggtcaggactttggcctctactctgagtgtgcacaggagggacgtgtcctgactccaattttcacaggctcactgcagccrcgttgttgtgaatagactaaagggtcatgactggcaatggggagaccaggaaagaggctgttgcaaggatttactgtaagactgaccttcccactgagtggacacctctggccctttctatcctaatgccacaagactgggaagggccaggccatgtggctatgcaagcagagggtcagctggccaaagccaagggcactcacggagcggggccaggtgtgtggaggcagctggtagagggaaagcatgctgaattctagtcctggctctgcatgatcttgggcctctctacctctcgct

SEQ ID NO: 131291 - DNA, 601 bp, Human
gcaagtttgagagacagggggcagggactcggtactcagtgtgcagcatgttagaggacaagcctcctgcacccaccctcaactctatgaagcagaatctgctctctgagatgatccctgatgatttgggtgcaataaagcttgagaagcactgatccttgttaaagagtttcgctagcgtcctcagaggcatgctggtgtccagttcccacggcctctgaaatggggcccctaaggagactggcttctaagcaggcagccaccataagctaaccactgagaagggctggcttctatgggrgactccaggcaggccacaaggcagccgccaccatgactcagtgagcttgacagggccattccatggagggagctgaattaggatgaccctcacagctcccaaggctggaccagaaggcaggagccccatgcagtcctgtgctgatgaagacccatttttttctaggagatttacactttcatatgtatcccctgtgaccagcccacacacctggctgagagatggctctgcagggagggagtcagcaggaggggaggggagggaagaggaggggaggaaagatatcttgggaggccaagg

SEQ ID NO: 131292 - DNA, 601 bp, Human
aaagaaaaaaaaatcatctgggaagctttaaaaatccagatgaccaggccatatctcatactagttcacagggagctcggagtaagcggggggaggcagatggtaatatttgtcgaaacttccaaggtgacgccaatgtacagcaagtttgagagacagggggcagggactcggtactcagtgtgcagcatgttagaggacaagcctcctgcacccaccctcaactctatgaagcagaatctgctctctgagatgatccctgatgatttgggtgcaataaagcttgagaagcactgatccwtgttaaagagtttcgctagcgtcctcagaggcatgctggtgtccagttcccacggcctctgaaatggggcccctaaggagactggcttctaagcaggcagccaccataagctaaccactgagaagggctggcttctatgggagactccaggcaggccacaaggcagccgccaccatgactcagtgagcttgacagggccattccatggagggagctgaattaggatgaccctcacagctcccaaggctggaccagaaggcaggagccccatgcagtcctgtgctgatgaagacccatttt

SEQ ID NO: 131293 - DNA, 601 bp, Human
acattaagaatcatctggggctgggtgtagtggttcacacctgtaatcccagcactttgggaggccgaggtaggtggatcacgaggtcaggagatcgagaccatcctggctaacacggtgaaaccccacctctactaaaaatacaaaaaaattagccaggcatggtggtgggcacctgtagtcccagctactcaggaggctgaggcaggagaatggtgtgaacccgggaggtggagcttgcagttagctgagatcacgccactgcactcaagcctgggtgacagagtgaggctctgtctcaaaaaaaaaaaaatcatctgggggccgggcatagtggctcacacctgtaattccagcattctgggaggctgaggcgggtagatcacgaggtcaggagttcgagaccagcctgaccaacatggtgaaatcctatctctactaaaaatagaaaaattagccgggcgtggtggcacatgcctgtaatcccagctactcaggaggctgagggaggagaatcacttgaacccaggaggcagaagttgcagtgagccaagattgcaccactgcactccagcctgggtgacagagcaagactgtctca

SEQ ID NO: 131294 - DNA, 601 bp, Human
ctctcccaaggctgactgagagtgggatgtgccccctcctccctccccggctcctcacccttcctcactgtgtccgcaaattcctgtaagttttactgctctcctacagcaaagctgccctgaggggaggtggaggcgggcaggaataatgcagtgacccaggccagtggctgtcaagccttgctgcacattaagaatcatctggggctgggtgtagtggttcacacctgtaatcccagcactttgggaggccgaggtaggtggatcacgaggtcaggagatcgagaccatcctggctaamacggtgaaaccccacctctactaaaaatacaaaaaaattagccaggcatggtggtgggcacctgtagtcccagctactcaggaggctgaggcaggagaatggtgtgaacccgggaggtggagcttgcagttagctgagatcacgccactgcactcaagcctgggtgacagagtgaggctctgtctcaaaaaaaaaaaaatcatctgggggccgggcatagtggctcacacctgtaattccagcattctgggaggctgaggcgggtagatcacgaggtcaggagttcgagaccagcctgac

SEQ ID NO: 131295 - DNA, 601 bp, Human
ctggggccagtgtgtttgtacaggtatgaaagccgggccgggctgaagtagggaagggagagttatttctcctaacagagtcagggtcaaggaagaagccaaagacccaggctggaccacccagctgcttcggctctcctggtcactcctctggctgaaaaagctcccagggcctctccctccctccccctgccagcctcagggtctcagtggcccctctccttcagcgtctgcacccgacattcattcctttggggttctctctcccaaggctgactgagagtgggatgtgccccctccyccctccccggctcctcacccttcctcactgtgtccgcaaattcctgtaagttttactgctctcctacagcaaagctgccctgaggggaggtggaggcgggcaggaataatgcagtgacccaggccagtggctgtcaagccttgctgcacattaagaatcatctggggctgggtgtagtggttcacacctgtaatcccagcactttgggaggccgaggtaggtggatcacgaggtcaggagatcgagaccatcctggctaacacggtgaaaccccacctctactaaaaatacaaaaaaatt

SEQ ID NO: 131296 - DNA, 601 bp, Human
cacggagagcccacagtctgcgggaggggcaggcgcgcacataaattacttgcaaccctgggaggctggggccagtgtgtttgtacaggtatgaaagccgggccgggctgaagtagggaagggagagttatttctcctaacagagtcagggtcaaggaagaagccaaagacccaggctggaccacccagctgcttcggctctcctggtcactcctctggctgaaaaagctcccagggcctctccctccctccccctgccagcctcagggtctcagtggcccctctccttcagcgtctgcamccgacattcattcctttggggttctctctcccaaggctgactgagagtgggatgtgccccctcctccctccccggctcctcacccttcctcactgtgtccgcaaattcctgtaagttttactgctctcctacagcaaagctgccctgaggggaggtggaggcgggcaggaataatgcagtgacccaggccagtggctgtcaagccttgctgcacattaagaatcatctggggctgggtgtagtggttcacacctgtaatcccagcactttgggaggccgaggtaggtggatcacgaggtc

SEQ ID NO: 131297 - DNA, 601 bp, Human
cctgcaccccgaggagcgcgctcaattctgcacacccttcctgcccccggcaagccaggcctggggctggaagaggcggagatgaatcagacacggtccctgcccacggagagcccacagtctgcgggaggggcaggcgcgcacataaattacttgcaaccctgggaggctggggccagtgtgtttgtacaggtatgaaagccgggccgggctgaagtagggaagggagagttatttctcctaacagagtcagggtcaaggaagaagccaaagacccaggctggaccacccagctgcttcrgctctcctggtcactcctctggctgaaaaagctcccagggcctctccctccctccccctgccagcctcagggtctcagtggcccctctccttcagcgtctgcacccgacattcattcctttggggttctctctcccaaggctgactgagagtgggatgtgccccctcctccctccccggctcctcacccttcctcactgtgtccgcaaattcctgtaagttttactgctctcctacagcaaagctgccctgaggggaggtggaggcgggcaggaataatgcagtgacccaggccagtggc

SEQ ID NO: 131298 - DNA, 601 bp, Human
aaatccatgctggaaagaattagtgaaacaccagtcccgatctttgctagaaacatggagacagcaaggcagagaaagggaataaaacacacaaagagaagtgggctgtgtttactgcagaaaccaccgtgcaggtcccatgagtgaaaagggacactggtgctctcctgagcggcttagctcccacctgcaggcctcagtaggcctcccctgccacataatgacagcactcagttcggctcacttcaaaagagtgcaaaagtacaagctaaaataaagagacacaaattttcgtctttcytttttcctctttttttttttaggcggagtctcgccctgtcgcccaggctggagtgcagtggtgcgatctcggctcactgcaagctctgcctcccaggttcacgccattctcctgcctcagcctcctcagcagctgggactacgggttcacgcctccacacctggctaattttttgtatttttagcagagatggggtttcaccatgttagccaggatggtcttgatctcctgaccttgaaaatacacaaattttctaaagggagaagcaaaaaaagagcagtaccagactgaagctggatt

SEQ ID NO: 131299 - DNA, 601 bp, Human
agccctgggtctatcactgcccatgtcccagggcacacagattcagggctgtctgtgaccctgtcttgtttcccctgctgttgggtctggcttctcctcaatggcaggaaccaaggctgaccatctgtgactgacaggtccctgcagccccacccccagcacagggcttgcccacaataccaatgcagactgagtgagcactaagtgtgcccagcagatgttccttgagccagcccctttcagagtcagaacagaaaaggtcgtgaaatccatgctggaaagaattagtgaaacaccagtyccgatctttgctagaaacatggagacagcaaggcagagaaagggaataaaacacacaaagagaagtgggctgtgtttactgcagaaaccaccgtgcaggtcccatgagtgaaaagggacactggtgctctcctgagcggcttagctcccacctgcaggcctcagtaggcctcccctgccacataatgacagcactcagttcggctcacttcaaaagagtgcaaaagtacaagctaaaataaagagacacaaattttcgtctttcttttttcctctttttttttttaggcggagtctcgcc

SEQ ID NO: 131300 - DNA, 601 bp, Human
tctctcatgctgtttccttcatcccaaacaccaccttccttcccttcctcatgtccaattctcctatttgtcaagacccagctcaaataccacctcctccaggaaggctttctggattaatcatcccagctgagagcagtcccccactggtccctgagtccccagccctgggtctatcactgcccatgtcccagggcacacagattcagggctgtctgtgaccctgtcttgtttcccctgctgttgggtctggcttctcctcaatggcaggaaccaaggctgaccatctgtgactgacagrtccctgcagccccacccccagcacagggcttgcccacaataccaatgcagactgagtgagcactaagtgtgcccagcagatgttccttgagccagcccctttcagagtcagaacagaaaaggtcgtgaaatccatgctggaaagaattagtgaaacaccagtcccgatctttgctagaaacatggagacagcaaggcagagaaagggaataaaacacacaaagagaagtgggctgtgtttactgcagaaaccaccgtgcaggtcccatgagtgaaaagggacactggtgctctcctgagc

SEQ ID NO: 131301 - DNA, 601 bp, Human
tcgagacacatggggccaggaggaaacaattgatcggctcctggtgtttgaaaggggcaagtatcagtagccacaggacttccatctatctagatctgttgtacttgcctccaaggctgacctttctttctgtaacctgcctggcccctgcaggcatttccatttgagatccctggctatgccatggcacattttgaacaacactggtccaagtttaatccattctgctgctgtggtcctattccaaaattctgtcctgtcctgccctcatctaagcaaacaatgggcatgtacaaatgacccccctgaagcctcactagggtgcaagataacacctgatttgtgtgcatgcgtgaggtggggaggggggtactgcagtgccctgtgctgggagtgcccacaggtagcactttgtgaagatcaacaccccagacgccgcctggtggcggtcaaggcccttcaggggctggttcccatggagcttctcagccacacctcccactgcccacatcctccactccacccctacccgccacaagccatattccaggccaaccacaccaccagttgttctgcacacctactccacggggccgtttcc

SEQ ID NO: 131302 - DNA, 601 bp, Human
ggcaagagctgggggcctcgagacacatggggccaggaggaaacaattgatcggctcctggtgtttgaaaggggcaagtatcagtagccacaggacttccatctatctagatctgttgtacttgcctccaaggctgacctttctttctgtaacctgcctggcccctgcaggcatttccatttgagatccctggctatgccatggcacattttgaacaacactggtccaagtttaatccattctgctgctgtggtcctattccaaaattctgtcctgtcctgccctcatctaagcaaacaaygggcatgtacaaatgacccccctgaagcctcactagggtgcaagataacacctgatttgtgtgcatgcgtgaggtggggaggggggtactgcagtgccctgtgctgggagtgcccacaggtagcactttgtgaagatcaacaccccagacgccgcctggtggcggtcaaggcccttcaggggctggttcccatggagcttctcagccacacctcccactgcccacatcctccactccacccctacccgccacaagccatattccaggccaaccacaccaccagttgttctgcacacctac

SEQ ID NO: 131303 - DNA, 601 bp, Human
acactcccgatatacacgtacacatgcatataatgtatctgtgtatgtatacgtaataatatgtataatatttataatatacagatgtatgtatgttggatgtgtacacacacacatacacacacactggattctggagctgtgtcaaagcctcttagagtgaccttggacaagtcatttctcaccaagtctcagttttctcatctgtaaaagtggtgtgcttggaagaaattgaaataagtgacctccaagggctttcagctctcagaagctgtcttcactgcacccacgccaagcctcwccccctcgcaggccaaggcttctcaccgttcctctctccacagcaagaccttcctgggctcccaacagggagatgaaaacctgagctcagtaaaggtcagcctgtcggccccgacagccgtgcatcgatccattgctgggaaaaacctctctcccaccagctcaggccagccacgagggccttcagaaaaacagagggaagagaaaaaccgagagagagggtgagcatgaggggcagaatgcacaatgtgtctcacttctgtttctcccgagagccgcggaccccacagctggacggcag

SEQ ID NO: 131304 - DNA, 601 bp, Human
caaactgttgacgaccagagtgagcgcaggcacggcatcacacgtagccacagccaggctttcataatacacatgtatagacactcccgatatacacgtacacatgcatataatgtatctgtgtatgtatacgtaataatatgtataatatttataatatacagatgtatgtatgttggatgtgtacacacacacatacacacacactggattctggagctgtgtcaaagcctcttagagtgaccttggacaagtcatttctcaccaagtctcagttttctcatctgtaaaagtggtgtgyttggaagaaattgaaataagtgacctccaagggctttcagctctcagaagctgtcttcactgcacccacgccaagcctctccccctcgcaggccaaggcttctcaccgttcctctctccacagcaagaccttcctgggctcccaacagggagatgaaaacctgagctcagtaaaggtcagcctgtcggccccgacagccgtgcatcgatccattgctgggaaaaacctctctcccaccagctcaggccagccacgagggccttcagaaaaacagagggaagagaaaaaccgagagagagg

SEQ ID NO: 131305 - DNA, 601 bp, Human
gctacccgggatgttgcgggaccaaactgttgacgaccagagtgagcgcaggcacggcatcacacgtagccacagccaggctttcataatacacatgtatagacactcccgatatacacgtacacatgcatataatgtatctgtgtatgtatacgtaataatatgtataatatttataatatacagatgtatgtatgttggatgtgtacacacacacatacacacacactggattctggagctgtgtcaaagcctcttagagtgaccttggacaagtcatttctcaccaagtctcagtttyctcatctgtaaaagtggtgtgcttggaagaaattgaaataagtgacctccaagggctttcagctctcagaagctgtcttcactgcacccacgccaagcctctccccctcgcaggccaaggcttctcaccgttcctctctccacagcaagaccttcctgggctcccaacagggagatgaaaacctgagctcagtaaaggtcagcctgtcggccccgacagccgtgcatcgatccattgctgggaaaaacctctctcccaccagctcaggccagccacgagggccttcagaaaaacagaggg

SEQ ID NO: 131306 - DNA, 601 bp, Human
gaggaaggagccagcgggattgagatgaaagaaagtggctgaagaatgtcccgagaagcctgagcctgaggtgagcatgggaaagtgagcctccacctggaaatggggcagaaatcttaaggagaacataggattttcccactaggtggcaaatgagggtttgaatcaattttaccttgatttcaaagtgccaggtgatgctggccagctgttgggattattggaatcagagaaaggcatggtggggccagaggaggcaactgcatgagcaaaggcagggaggaggggcaggcagatggcycacgatgggattccagggcatccgggctgatcccccttctctgatcccccttctctagctgctgttgacagaattaagaacagagggctggtccccttctaggccatgctccaggccacacccaaggtgtgctctgctctctgctgttgcccagagctgcccacattggaggagaagacagaaaatggcctttgaagtcacacagacccaagctccaggccggctcttcctcttccaagctgtgtggctttgggtacatgcattcacctgttgagtctcagtttcttcatctataaaatg

SEQ ID NO: 131307 - DNA, 601 bp, Human
ggagaaaacaggactggacccaaagcctcatgggactgggcctgcagttggcactgtaaactgggccccaaaatggtgctgtgggggcagaaggcaggtgggcatgtggtggacacaggcattcctgcggcggggctgaaagcacgctctgccatcaggccatctgctcactggttttgtggccttgggcaagcgattgaaccttccaggcagagcctcctcatcttgaatatgggcaaaataaaagcacctacatcataggattggcaagaagtaagtgaaagaatgttactggaagaamaaaactaccttttccccaggccaaggggactggggatgttgggtggagatggaagaagaaagagcctcctctgaaaactaactgaggccctaaacgtaatttgatagctttcggtggggctgggggtagaagaacattgaagaagtggggtgcccaagttcccattttcagttgcctgttgggtgtttaatctacctctgccatttctgctcactcacactcaaatgccttggatggccgggttggtgttttctccccacatggaaatcagaggaaggagccagcgggattgagatgaaa

SEQ ID NO: 131308 - DNA, 601 bp, Human
cgttattagcacccacagccaggggtgtgttggacacctgctatgtgccaggatccaaaccaatttctcctattccattgcccaccacaccatcctgccccttggtgggagaaatgagcctaccagggactggcttgcctggtgtgctaagagtggtagtgtggtgggcacccccaacatggggcccctgccctatgagagcaatacgctctgggtaaggggcgtttgaccatgtacgggtcgtgaggctgacctagaggctggttcagccacctgctggggactctgggatggtgtctgrttatctgaagtgccacacaagaagctgtctgagtgtagggagccctcaccccatgagatccggagaagctaggtccttagtcaacagtccagagaaggcctgggaacactttctgggagtggaagcgaccacgtgaaccaggacttgaagggtgggtaggactttgatggcagagagaggcgggcattccaggcacaagcaaaggcccggcagtggggctgggcagaacgtggcccctgcatggccaggtcttccgtgaggccccgcagaggcagctgcagggcagagcaggcgtggggc

SEQ ID NO: 131309 - DNA, 601 bp, Human
gcaagagagaagtggtttccatactgtgtgtctgtcctagccaccaaatcaggtttgggaaggggtcaaggctgagattacatggcctttttcacagacctatggtttggcaacttgagtttgaagacaccaggttatggcttttctgatgaagcctgtttctcagtcccaaaataattaaggatccaaggaattaaaaggttcttccttaaggaggccttgttaagctgggcagataaacctgggtggtctcagagggcccttccatgtctgaccttttactgctcgaagtagaaaattmttagctgactgctgggggagggctccatgttgctatctgcaggctgattggctggctccacctcccagatggtgagtgacatctttgagcccatgcctctacttcatgtcccagaacctttagctccaactggcactcactagctggtttcatgtaaggtcagtccaacaaaacagagggctccccttggccttttgaaagctgagttagacttgcatggtctttgcggtggcccaaatcttgatgatgttcacagatcagactgccaccagtcacggacaatctgccaatccaaggctt

SEQ ID NO: 131310 - DNA, 601 bp, Human
gacctccggacaggtttccatgccctggcgccctccccagatgtcacgaataacccatctaggtctacctgccctggggtattctctcaggccacgctgaagacaccgtggggcagggcgggccgggagaggtgaacgggcctggagctatttgcaaggctgtgggttggggaggcagcaatctcacccatcttcaggaaggtgggatcactgcttcctctgccctgcacatctcaagagagcatgcatgcagctcctgttggaatgaggctgcagggatgactatcctcaatttacatcygaggcaactgaggcccagacctgcctaggctcctccaggttatagacttgggcagtgcagggaccatttctcatgtttgtttctggccaatatcgtttgtgctcttcctgtgtttgtagagattctgcagtaggaggcctgcttctttgagccagaagtcagaactcatcctcccagcttcccttgctgctagggcacaggtgtgtttcatgggctctgccaattagactttcttgtatatgaccttgattgagaaggtagccccttgaagcagtgggctgggggactccatctgttggg

SEQ ID NO: 131311 - DNA, 601 bp, Human
tgaaaacatcacctcacaaagcactctgtcttcctggcgcccattaaacctccatctagaataaacttgtcctttcttctgtcatttttcctctctaattcacattatggtcaatttactgcttgacacagtcattcccggttctgctttctctctaatcccttcacatcggccacaggcactcctattctaatcctaattgaccgcagccggcctttcttcctgccgggaccgcagcccccttgccaccctggggccctggtgggatgctgagtcacagttgccctggctgagggacatyctcccgagaagtcaaagtgccccagtccttctgcttcatctcctggcatcgctgatcctcaccttggccattcctgggaaggaggcttcagccaggttggacgaggtgtgggcagcacatgcgagggtgtgtgcgagtgggagtggggatgtgagcatgtgtctgtgtgtgtatgtgcgtgtatgtgtgcatgtgtgtgtgagtgtatcagtgtgtgagcgtgtgtgtgcctgtgtgtgtgtgcgtgtgtgtgtgtgagtgtatgagtgtgagcgtgcgtctgtgtgtgtgtgcatgtgt

SEQ ID NO: 131312 - DNA, 601 bp, Human
ccatcgggagaagctcatagattggcttttagaaatagacaagcatccagaagtccaacggccccaccaaagggccccagagtccctggaggaagagaggaagaggggagcttcaggcaagtgggggatgctgggggacggtctcatgggctctctggctatcttcaggagggctgggtggctgtcaccctcaataggtgccatcagtgtttggtgcccgcctggctccaagggtcagtgacggtcataggcagtggcggctgcaggtggggcggctcctcgggcggcagcgctataatartagggggagcctggaagagacgggagagagcaccgaggtcagatccggggtcccctttccaccagtctcctccacttctgtcctttcctcccctcactcagtccgggccaccatcctctctcaccaagatctctgtcccagtctgttccccagatggcaagtcccatcagggccacaacctgctcataagatttcgaggctcttcgccatctagagctggggtccggagcctggggcccttgggtccaatcctcccagctgcccgttttagtgaataacattttactggaacacagtctt

SEQ ID NO: 131313 - DNA, 601 bp, Human
cctacctcttgctctctgaagctgttggcaaatagaaaatactgaaattcatttattcaatcaaggcaggggtagccctgctcccagggactggtgggtatggatgatgcccaatctcccctctcctccctctcacaggtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccrcgcctgccggagcgcatgaccacactcaccttcctgggcaacttcccggacacagcccagctgctcatgccggtgtgggcggagcgggcagggcggtgtgacttgggaggggatgggcaggaggcaactcccagcctgggctgcggcagggaacctgggagtacttgagcctccagatggaggaggctccaacttatcttacctcccccatcccacccccagcaactgaatgccatcattgcagcctcaatgtccatcaagtcctctgacaaactccgccagatcctggaggtgaggggc

SEQ ID NO: 131314 - DNA, 601 bp, Human
tgctgagtctgaggtagtctgattttcgtagccagcttgttattcgcagtattggtggcagtgcagatataaaggtataaagaccaaggactgcgtagaagagatggtcccacaagattatagtacatatttttattgtatcctttctatgtttaggtatgcttagatacacaaatacttaccattgtattatagttgcctgcagtactcagtaacatgcagcagcctattgctcctaggctacaaacctgtatagcatgttactgtaatgtacaccatatagcctaggcatttagtaggytataccatctagatttgtgtaagtacaccctataatgttggcaaggcaaaaatcacctaaccatgcatttcccagcacatatgcctgacgttcagtgaagcatgactgtatttaagtggtttataatctgcttgtggtaaatcttaggttaaaagatctagcttttatgttcttcagccggcattaaaaatcacaggaagggccgggcatggtggctcatgcctgtaatcccagtactttgggaggcagatcacgaggtcaggagatcgagaccatcctggctaacactgtgaaatccca

SEQ ID NO: 131315 - DNA, 601 bp, Human
tatagtgaggcttgagatttgcatctccactggtctctttgacatctcagaggatccattctgaacttgctaggtttctttcccctgctgaattgagttctgcatcttgagtctgcagcagtgtgaatcctatctttggctccatttaacagcctatggacgttcccaaacttgggacccagtttgtctcttcatgatagacaaatattattttcagaagtcattctaatcgcaccactgcactccagcctggcaacagtgagactccatctcaaaaaaaaaaaaaaaagtcattctagtrggtgagatttctgccagcattgagccactgctcaacatattcttgataatggtctctgaacagcatttgattttaccttggagttgcaaagtcaaagtctaactcgccaaacaaactcagtgtggaatatacacatttgtctcattccggttttaaggagtttagtataccagagcttttgtgacctctaaaaagcagttatcgtccatgacaagaattggctcgttcaccctcagtactctggcttactatcccagggagggccgagggtggcagcaaaagtggtcttttgtaatccct

SEQ ID NO: 131316 - DNA, 601 bp, Human
atttctgccagcattgagccactgctcaacatattcttgataatggtctctgaacagcatttgattttaccttggagttgcaaagtcaaagtctaactcgccaaacaaactcagtgtggaatatacacatttgtctcattccggttttaaggagtttagtataccagagcttttgtgacctctaaaaagcagttatcgtccatgacaagaattggctcgttcaccctcagtactctggcttactatcccagggagggccgagggtggcagcaaaagtggtcttttgtaatccctttttatracctgctgttctcttcacagacctcccagggtacctttttttgtgtgtgtgtgtgtgagatggagtctcactctcacccaggctggagtgcagtggcgtaatctcggctcactgcaacctctgcctcctgggttcaaactattctcttgcctcagcctctcaagtagctgggattacaggcacccgccaccatgcctagctaatttttattttttatttttgagacagagtctcgctctgtcacccaggctggagtacagtggcgcggtcttggctcactgcaagctgcgtctcccgggc

SEQ ID NO: 131317 - DNA, 601 bp, Human
tctcttgcctcagcctctcaagtagctgggattacaggcacccgccaccatgcctagctaatttttattttttatttttgagacagagtctcgctctgtcacccaggctggagtacagtggcgcggtcttggctcactgcaagctgcgtctcccgggctcacgccattctcctgcctcagcctcctgggtagctgggactgtagtcgcccgtcaccacgcccggctaattttttgtatttttagtagagacggggtttcaccgtattagccaggatggtctcgatctcctgacctcatgaaccgcccacctcggcctccctaagagctggaattacaggcgtgagccaccgcgcctggccaatttttgtaatttttagtagagaagggttttgctatgttggccaggcttgtctcgagctccagaccttaggtgatctgcccgccttggcctcccaaagtgctgggattacaggcatgagccactgtgcccagccccagggtaccttgatggcagtactaaagtgtttttatttttcccatcatttgggattcacaagcagtttttgatataactaattggtgggaatgtgcggagttggg

SEQ ID NO: 131318 - DNA, 412 bp, Human
cccaccttggtctcccaaagtgctgggattacaggtgtgagccaccgcacctggcctatttttttttttgagatggagtctctctctcttgcccaggctggagtgcagtggygcgatctcagctcactgcaagctccgcctcccgggttcacgccattctcctgcctcagcctcccgagtagctgggactacaggcgcccgccacgatgcctgcctaattttttgcgtttttagtagagacggggtttcaccatgttagccaggatggtctcgatctcctgacgtcgtgatccacccgcctcggcctcccaaagtgctgggattacaggcgtgagccaccgcgcctggcctattttttttaataaaaaaagaaagttgataatttaaaatcccaatcagtagctcaagagca

SEQ ID NO: 131319 - DNA, 601 bp, Human
agccaccgcacctggcctatttttttttttgagatggagtctctctctcttgcccaggctggagtgcagtggcgcgatctcagctcactgcaagctccgcctcccgggttcacgccattctcctgcctcagcctcccgagtagctgggactacaggcgcccgccacgatgcctgcctaattttttgcgtttttagtagagacggggtttcaccatgttagccaggatggtctcgatctcctgacgtcgtgatccacccgcctcggcctcccaaagtgctgggattacaggcgtgagccacygcgcctggcctattttttttaataaaaaaagaaagttgataatttaaaatcccaatcagtagctcaagagcacagcatttccattgctctcatagaatattaacacagctgtcctgtgcaaacagaactgaagatgttttgctgaccctcttttgggctctagcttttcaaggtcttattttagtctattatgcctgtaaagcatcagtcaagcatataattgttgaactgttaactgtgtgctcagcacaactagaggcgctgtgggaagcagctgtataagatgtagtctggccgggc

SEQ ID NO: 131320 - DNA, 601 bp, Human
ggaaatggccccaagccaagtctttagagattgatggctcctccctagatgctagttggttggttgataaccaatttgcctcacatctctgggccttagtttcctcatctgtaaacaacaagttaagccagatggttctgagattccagtgttggaagctcagcttcccctcccctacgatagagctttttcttcccaggcatgcagttttgagcggattgcatcatccagtaagactgagaggaggcccacatatggaccctcgctgctcctgttgtctagaagttcctcttctcctgcygttcatctgccagcttacccttacctcccacccgctcacatacccagcattgcgctctatttctagaaataagtactgaagttagttttccatctcctccccaaggtctgaatttatacaggagcatccttaggatgtcttacatctttgaacttgtaacattttggtcttcattaaaagatgactttttttttttttttttgagacagagtctcgctcagtcgcccaggccggagtgcagtggctggttctctgctcactgcaagctccgcctcctgggttcacgccattctcctgcct

SEQ ID NO: 131321 - DNA, 601 bp, Human
atttgcctcacatctctgggccttagtttcctcatctgtaaacaacaagttaagccagatggttctgagattccagtgttggaagctcagcttcccctcccctacgatagagctttttcttcccaggcatgcagttttgagcggattgcatcatccagtaagactgagaggaggcccacatatggaccctcgctgctcctgttgtctagaagttcctcttctcctgccgttcatctgccagcttacccttacctcccacccgctcacatacccagcattgcgctctatttctagaaataaktactgaagttagttttccatctcctccccaaggtctgaatttatacaggagcatccttaggatgtcttacatctttgaacttgtaacattttggtcttcattaaaagatgactttttttttttttttttgagacagagtctcgctcagtcgcccaggccggagtgcagtggctggttctctgctcactgcaagctccgcctcctgggttcacgccattctcctgcctcagcctcccgagtagctgggactacaggcgcccaccaccacgcccagctaatttttttgtattgttttttagt

SEQ ID NO: 131322 - DNA, 601 bp, Human
atgcagttttgagcggattgcatcatccagtaagactgagaggaggcccacatatggaccctcgctgctcctgttgtctagaagttcctcttctcctgccgttcatctgccagcttacccttacctcccacccgctcacatacccagcattgcgctctatttctagaaataagtactgaagttagttttccatctcctccccaaggtctgaatttatacaggagcatccttaggatgtcttacatctttgaacttgtaacattttggtcttcattaaaagatgactttttttttttttttytgagacagagtctcgctcagtcgcccaggccggagtgcagtggctggttctctgctcactgcaagctccgcctcctgggttcacgccattctcctgcctcagcctcccgagtagctgggactacaggcgcccaccaccacgcccagctaatttttttgtattgttttttagtagagacggggtttcaccatgttagccaggatggtcgcgatctcctgacctcgtgatctgcccacctcggcctcccaaagtgctggtattacaggcgtgagccatcgtgcccggccgagatgacatttc

SEQ ID NO: 131323 - DNA, 601 bp, Human
agtttgagcccagcctaaaattagccaggcatggtggtgcacacctgtagccccaattactcaggatgctgaagcaggaggattgtttgagccaggagttggaggcaggagctggaggctgcagtgagccatgatcgtgccactgcactccagcctgggtgacagagcaagaccctgtctcaaaaatgaacaaacagccaggtgcggtggctcacgcctgtaatcctagcatgttgggaggctgaggtgagtggatcacttgaggtcaggagtccaagaccagactggccaacatggtgaraccccgtctctactaaaaatataaaaattagctgggcctgatggtgggcgcctgtaatcccagctactcaggaggccgaggtgtgaggatttgcttgaacctgggaggtggaggttgcagtgagccgagatcacaccactgcactagaggctgggcaacagagcgagactcttgtcttaaaaaaaaaaaaatggctgggcgtggtggctcacgcctgtaatcccagcactttgggaggccaaggctggcagatcatgaggtcaggagttcaagaccagcctggccaacatggtgaaaccc

SEQ ID NO: 131324 - DNA, 601 bp, Human
tgcggtggctcacgcctgtaatcctagcatgttgggaggctgaggtgagtggatcacttgaggtcaggagtccaagaccagactggccaacatggtgagaccccgtctctactaaaaatataaaaattagctgggcctgatggtgggcgcctgtaatcccagctactcaggaggccgaggtgtgaggatttgcttgaacctgggaggtggaggttgcagtgagccgagatcacaccactgcactagaggctgggcaacagagcgagactcttgtcttaaaaaaaaaaaaatggctgggcgyggtggctcacgcctgtaatcccagcactttgggaggccaaggctggcagatcatgaggtcaggagttcaagaccagcctggccaacatggtgaaaccccgtctctactaaaagtatgaaaaattagccgggcatggtggtagtcccagctactcaggaggctgaggcaggagaatcgctgaacccaggaggcggaggttgcagtgagctgagaacacggcactgcactccaggctggcaacagagcaagactccgtctcaaaacaaaacaaaaaaagaggccaggcacggcggcttacgc

SEQ ID NO: 131325 - DNA, 601 bp, Human
gctgggcctgatggtgggcgcctgtaatcccagctactcaggaggccgaggtgtgaggatttgcttgaacctgggaggtggaggttgcagtgagccgagatcacaccactgcactagaggctgggcaacagagcgagactcttgtcttaaaaaaaaaaaaatggctgggcgtggtggctcacgcctgtaatcccagcactttgggaggccaaggctggcagatcatgaggtcaggagttcaagaccagcctggccaacatggtgaaaccccgtctctactaaaagtatgaaaaattagccrggcatggtggtagtcccagctactcaggaggctgaggcaggagaatcgctgaacccaggaggcggaggttgcagtgagctgagaacacggcactgcactccaggctggcaacagagcaagactccgtctcaaaacaaaacaaaaaaagaggccaggcacggcggcttacgcctgtaatcctagcactttgagcggctgaggcaggcagatcacctgaagtcaggagttcaagaccagcctgaccaacatggcgagacctcatctctactaaaaatacacagattagctgggtatggtggt

SEQ ID NO: 131326 - DNA, 601 bp, Human
gaacacggcactgcactccaggctggcaacagagcaagactccgtctcaaaacaaaacaaaaaaagaggccaggcacggcggcttacgcctgtaatcctagcactttgagcggctgaggcaggcagatcacctgaagtcaggagttcaagaccagcctgaccaacatggcgagacctcatctctactaaaaatacacagattagctgggtatggtggtatgtgcctgtattcccagctacccaggaggctgaggcagaagaatcactggaacctgtgatgaggaggctgcagtgagccaarattgtgccattgtactccagcctgggtgacagagcgagactccatctcaaaaacaaaaaacatgaatcaagaaacaaacaaaaaatgatgccagattcctggagaaggattagcctggcttctgtggggtcctctagttttgttttcccttagtccaaattgaggccattcttctgtgaagtggcgttggcttgctaggatgctttttgaagttctactctcaaggcctctgagcttggttccctatgaataattaaaattattataattaccatgaaagctaactggagtgggctcctt

SEQ ID NO: 131327 - DNA, 601 bp, Human
tttttgtatttttagtagagacggtgttttaccatttagccagaatggtctcaatctcctgacctagtgatccgcccgcctcggcctcccaaaatactgggattacaggcgtgagccactgcgcccggccacatgtttcttgtaatctctccatggcaggagtaactgggtgctattgttgttttagtttcccaagattcctaatgctgggttttgccagtggtgatccctcagtctgagcttgccgacagttgtcctcaatcctgcagatctggtttaggcatttcttttttttttcccttttttttttgagacggagtttcgctcttgtttcccaggctggagtgccgtggcgcgatcttggctcacaacaacctctgcctcctgggttcaagcgattctcctgccttagcctcccgagtagctgggattacaggcatgcgccaccatgcccggcttattttgtatttttagtagagacaggctttctccatgttggtcaggctggtctcgaactctgcacctcaggtgatccgcctgccttggcctcccaaagtgctgagattacaggtgtgagccaccacacccagccttttccttt

SEQ ID NO: 131328 - DNA, 601 bp, Human
ccttttttttttgagacggagtttcgctcttgtttcccaggctggagtgccgtggcgcgatcttggctcacaacaacctctgcctcctgggttcaagcgattctcctgccttagcctcccgagtagctgggattacaggcatgcgccaccatgcccggcttattttgtatttttagtagagacaggctttctccatgttggtcaggctggtctcgaactctgcacctcaggtgatccgcctgccttggcctcccaaagtgctgagattacaggtgtgagccaccacacccagccttttccttttttttttttttttttttgagacagagtctcgctttgtcacccaggctgaaatgcagtggcatgatctcggctcactgcaagctctacctcccaggttcacaccattctcctgcctcagcctcccgagtagctgggactacaggcgcccgccaccgtgcccggctaatttttttgtatttttagtagagatggggtttcaacatgttagccaggatggtcttgatctcctgacctcatgatctgcccgcctcggcctcccaaagtgctgagattacaggtgtgagccaccgcgcattgc

SEQ ID NO: 131329 - DNA, 601 bp, Human
cacaacaacctctgcctcctgggttcaagcgattctcctgccttagcctcccgagtagctgggattacaggcatgcgccaccatgcccggcttattttgtatttttagtagagacaggctttctccatgttggtcaggctggtctcgaactctgcacctcaggtgatccgcctgccttggcctcccaaagtgctgagattacaggtgtgagccaccacacccagccttttccttttttttttttttttttttgagacagagtctcgctttgtcacccaggctgaaatgcagtggcatgatstcggctcactgcaagctctacctcccaggttcacaccattctcctgcctcagcctcccgagtagctgggactacaggcgcccgccaccgtgcccggctaatttttttgtatttttagtagagatggggtttcaacatgttagccaggatggtcttgatctcctgacctcatgatctgcccgcctcggcctcccaaagtgctgagattacaggtgtgagccaccgcgcattgctgccttttcctttttttgagacgaggtctgtctctgtcatacaggctggagtgcaatgacgtgatctc

SEQ ID NO: 131330 - DNA, 601 bp, Human
accatgcccggcttattttgtatttttagtagagacaggctttctccatgttggtcaggctggtctcgaactctgcacctcaggtgatccgcctgccttggcctcccaaagtgctgagattacaggtgtgagccaccacacccagccttttccttttttttttttttttttttgagacagagtctcgctttgtcacccaggctgaaatgcagtggcatgatctcggctcactgcaagctctacctcccaggttcacaccattctcctgcctcagcctcccgagtagctgggactacaggcrcccgccaccgtgcccggctaatttttttgtatttttagtagagatggggtttcaacatgttagccaggatggtcttgatctcctgacctcatgatctgcccgcctcggcctcccaaagtgctgagattacaggtgtgagccaccgcgcattgctgccttttcctttttttgagacgaggtctgtctctgtcatacaggctggagtgcaatgacgtgatctcaactcactgcaacctccacctcccgggttcaagcagttctcctgcctcgtcctcctgagtagctgggactacaggcatg

SEQ ID NO: 131331 - DNA, 601 bp, Human; identical to SEQ ID NO: 39842

SEQ ID NO: 131332 - DNA, 601 bp, Human; identical to SEQ ID NO: 39843

SEQ ID NO: 131333 - DNA, 601 bp, Human; identical to SEQ ID NO: 39844

SEQ ID NO: 131334 - DNA, 601 bp, Human; identical to SEQ ID NO: 39845

SEQ ID NO: 131335 - DNA, 601 bp, Human; identical to SEQ ID NO: 39846

SEQ ID NO: 131336 - DNA, 601 bp, Human; identical to SEQ ID NO: 39847

SEQ ID NO: 131337 - DNA, 601 bp, Human; identical to SEQ ID NO: 39848

SEQ ID NO: 131338 - DNA, 601 bp, Human; identical to SEQ ID NO: 39849

SEQ ID NO: 131339 - DNA, 601 bp, Human; identical to SEQ ID NO: 39850

SEQ ID NO: 131340 - DNA, 601 bp, Human; identical to SEQ ID NO: 39851

SEQ ID NO: 131341 - DNA, 601 bp, Human; identical to SEQ ID NO: 39852

SEQ ID NO: 131342 - DNA, 601 bp, Human; identical to SEQ ID NO: 39853

SEQ ID NO: 131343 - DNA, 601 bp, Human; identical to SEQ ID NO: 39854

SEQ ID NO: 131344 - DNA, 601 bp, Human; identical to SEQ ID NO: 39855

SEQ ID NO: 131345 - DNA, 601 bp, Human; identical to SEQ ID NO: 39856

SEQ ID NO: 131346 - DNA, 601 bp, Human; identical to SEQ ID NO: 39857

SEQ ID NO: 131347 - DNA, 601 bp, Human; identical to SEQ ID NO: 39858

SEQ ID NO: 131348 - DNA, 601 bp, Human; identical to SEQ ID NO: 39859

SEQ ID NO: 131349 - DNA, 601 bp, Human; identical to SEQ ID NO: 39860

SEQ ID NO: 131350 - DNA, 601 bp, Human; identical to SEQ ID NO: 39861

SEQ ID NO: 131351 - DNA, 601 bp, Human; identical to SEQ ID NO: 39862

SEQ ID NO: 131352 - DNA, 601 bp, Human; identical to SEQ ID NO: 39863

SEQ ID NO: 131353 - DNA, 601 bp, Human; identical to SEQ ID NO: 39864

SEQ ID NO: 131354 - DNA, 601 bp, Human; identical to SEQ ID NO: 39865

SEQ ID NO: 131355 - DNA, 601 bp, Human; identical to SEQ ID NO: 39866

SEQ ID NO: 131356 - DNA, 601 bp, Human; identical to SEQ ID NO: 39867

SEQ ID NO: 131357 - DNA, 601 bp, Human; identical to SEQ ID NO: 39868

SEQ ID NO: 131358 - DNA, 601 bp, Human; identical to SEQ ID NO: 39869

SEQ ID NO: 131359 - DNA, 601 bp, Human; identical to SEQ ID NO: 39870

SEQ ID NO: 131360 - DNA, 601 bp, Human
cactcagcctatgtgacataggtagaaggcagtatccaaacctgaactacagatcacaaatacatttatcattgccatcagtctctccccttcggtttgaaaacattctaattttaataacgaaaatcgaattgatattggagatgaatttgggaaaattcactaaacttcatggatatagggcatattaatataatttgatttgagtatacataagtatctgctatattttctaggtgtttgaactattttattaaatattcaaaaaacaaatccaatgaaataactgagttgaatacartttgttttatagctctcaacaaccaatattttgagaatttaataatattctttaagaatgtgtaacacaagttgctaaaaattaaaagattttaggtggcttcagtatttatgtggaaattgtttaaataatgttgacttctccaataatatgtacttcaaataattatcatgattccatttttgattttttttttctgagtgccattatttaccagtgacatgaaatctggaacttactctataccagggattatagtgatgtgaagcccaggtgtctatagtttctctgaggtacttt

SEQ ID NO: 131361 - DNA, 601 bp, Human
aatgaaataactgagttgaatacaatttgttttatagctctcaacaaccaatattttgagaatttaataatattctttaagaatgtgtaacacaagttgctaaaaattaaaagattttaggtggcttcagtatttatgtggaaattgtttaaataatgttgacttctccaataatatgtacttcaaataattatcatgattccatttttgattttttttttctgagtgccattatttaccagtgacatgaaatctggaacttactctataccagggattatagtgatgtgaagcccaggtktctatagtttctctgaggtactttgtaggttaatacacacacaactgttttcattcactttttttactcctaaagcaactgtgttatagcactttgcaatacaggcttagaagaattgtcataaaatcaaacaaaaaggtatgtagccaaaatagttgttccatgtctagaccttagatccctggaaaaaacagcactgcctttaaaagggagaggaccaaggagaggaagtaggtcatgttcttgttaggaagggtgacactagcaaggttagtttctgaggtaagtctgttgtcttga

SEQ ID NO: 131362 - DNA, 601 bp, Human
tgtgaagcccaggtgtctatagtttctctgaggtactttgtaggttaatacacacacaactgttttcattcactttttttactcctaaagcaactgtgttatagcactttgcaatacaggcttagaagaattgtcataaaatcaaacaaaaaggtatgtagccaaaatagttgttccatgtctagaccttagatccctggaaaaaacagcactgcctttaaaagggagaggaccaaggagaggaagtaggtcatgttcttgttaggaagggtgacactagcaaggttagtttctgaggtargtctgttgtcttgatcgtagcttgcattcctagtctaagcctccatgagcatgactgctcaaagcttgataattgcaacaagaatccagctagatcatgtccacagccataggagcccgttcctctagtcaaactcctggtagactatagcagtggagcaaggggcttatggcttaaaggtttatctctctagtccagtgggttgtttcttgtttcttttttctgaacccacagactgaaaaaaaaaaaagccacttttttttagtgaaggtggctctggatgacagagttgtttaccca

SEQ ID NO: 131363 - DNA, 601 bp, Human
gtttatctctctagtccagtgggttgtttcttgtttcttttttctgaacccacagactgaaaaaaaaaaaagccacttttttttagtgaaggtggctctggatgacagagttgtttacccataagagggctggaggggatgtgtagctctcagaagctccttacaaatactcctagattctgttgctttccttttctgaattgagaatcattgctaacttcagctttcaaacaggttctattatattagcttttccctactcttctatcctcataaaaccaggctgttctctttaaaaagytgtatatgtagaaaactaacaaaaaaatcactgtgatttatcatagtatcttctacgtgatcaacaatgatctaataggaagtctctagtctcatgctttcatacctctttactgtgtcacttgactttttttttttttttttgagatggagtctcgctctgtcacccagactagaatgtagtagagtgatctcagatcactgcaacctccgcctcccaggttcacgtgattctgtgcctcagcctctcgagtagctgggactacaggcgtgcgccaccatgcctggctaatttgttgta

SEQ ID NO: 131364 - DNA, 601 bp, Human
ttatctctctagtccagtgggttgtttcttgtttcttttttctgaacccacagactgaaaaaaaaaaaagccacttttttttagtgaaggtggctctggatgacagagttgtttacccataagagggctggaggggatgtgtagctctcagaagctccttacaaatactcctagattctgttgctttccttttctgaattgagaatcattgctaacttcagctttcaaacaggttctattatattagcttttccctactcttctatcctcataaaaccaggctgttctctttaaaaagctrtatatgtagaaaactaacaaaaaaatcactgtgatttatcatagtatcttctacgtgatcaacaatgatctaataggaagtctctagtctcatgctttcatacctctttactgtgtcacttgactttttttttttttttttgagatggagtctcgctctgtcacccagactagaatgtagtagagtgatctcagatcactgcaacctccgcctcccaggttcacgtgattctgtgcctcagcctctcgagtagctgggactacaggcgtgcgccaccatgcctggctaatttgttgtatt

SEQ ID NO: 131365 - DNA, 601 bp, Human
gggcatggtggcatgtgcctgtaatcccagctactcggaaggttgaggcaggaaaatctcttaaaccagggaggcagaggttgcagtgagccgagattatgccactgcactcgagcctgcatgacagagtgagactccgtctcaaaaaaaaataaaaaaaaatttaatattaggttggtgaaaagtagtggtaaaaactgcagttacttttgcaccaatctgataatcaattttatatatcttgtaaatgatattcactctcatcttaaaagtttagcttatattaaatgtttgatgtaartaaagttgaaagaaagtttcttctgttaggtgtgaaacataaaagatatactcataaaagtggttctaaccagggccttacttaagatgaggtattgtatgattgttgaatattacctataacatagtcgtattttctattcaatagatatttattgagttactgtgtgccaatcattcattcattcattcactcatctatcctttcaataaacaaagacttattgagggtttcctttgagccatgtactgtcctggaaactaggaatataaataaggataaataattttttccctttgc

SEQ ID NO: 131366 - DNA, 601 bp, Human
ggttgcagtgagccgagattatgccactgcactcgagcctgcatgacagagtgagactccgtctcaaaaaaaaataaaaaaaaatttaatattaggttggtgaaaagtagtggtaaaaactgcagttacttttgcaccaatctgataatcaattttatatatcttgtaaatgatattcactctcatcttaaaagtttagcttatattaaatgtttgatgtaaataaagttgaaagaaagtttcttctgttaggtgtgaaacataaaagatatactcataaaagtggttctaaccagggccwtacttaagatgaggtattgtatgattgttgaatattacctataacatagtcgtattttctattcaatagatatttattgagttactgtgtgccaatcattcattcattcattcactcatctatcctttcaataaacaaagacttattgagggtttcctttgagccatgtactgtcctggaaactaggaatataaataaggataaataattttttccctttgctaagctcacattttagtgggaaaaatgaatataggcggatgaattgtaaaatgttgtgataaatgatttaatagagat

SEQ ID NO: 131367 - DNA, 601 bp, Human
tttaggaggtgaaactgcaggagttagtgattggttgtatatggaaggttgagagggagggaggagaataagtcattgctccagcattctgatttggataatggtggtgccattcagtgtgctgaatggaggtgggctgggataaggcaaataattattttgttcatgttgattttgaggctacatgtaaaggaagtttttttttttgagactgagtcttgctgtgtcgcccaggctggagtgcagtggcacgatcttggctcgctgcaagctccacctccccggttcaagtgattctccyacctcagcctcctgaataactgggattataggcacctgccaccacacccggctaatttttgtacttttagtagagacggggcttcaccacgttggccatgtcttgaactcctgacctcatgatccacctgccttggcctcccaaagtgctgggattacaggcgtgagccaccgcacctggccataaaggaagatatttatcaaaatttggctgcccacatctgaagctcagaggaaggggattgggcaagagattgagatgtagaaatctttggtatatggtaagtgaagccacgggcat

SEQ ID NO: 131368 - DNA, 601 bp, Human
cacctgccttggcctcccaaagtgctgggattacaggcgtgagccaccgcacctggccataaaggaagatatttatcaaaatttggctgcccacatctgaagctcagaggaaggggattgggcaagagattgagatgtagaaatctttggtatatggtaagtgaagccacgggcatggctatatttcaagattgaaatgaaggaacgagaaagagcagatacccaaaaatttgatgaagaagaaacaggtaaggagctgacaggagaagcaaaaccaatgacattcctatcctgggacttyagagaattgctgctgtagcagccatggaaagaaatttttttttttttttttttgagtcggagtctcgctcagtcccccaggctggagtgcagtggtgcgatctcggctcactgcaagctccgcttcccaggttcacaccattctcctgcctcagcctcccgagtagctgggactacaggcgcctgccaccacgcccagctaatttttttttttaatttttagtagagacgtggtttcactgtgttagccaggatggtctcgatctcctgacctagtgatccgcctgcctcggcctcccaa

SEQ ID NO: 131369 - DNA, 601 bp, Human
ttattttacagagagccagctgcaccggcagcatcaccaaaccagagctggaagagagcagctggcttcactcctggctttcaggaaagggaatgtctaaagttgcctcccttatttttggaattttgaactgataaccctattcttacccatctggccagacgattccttaactcgtgttacacctgcagaatgagttttagatctagctgtgacctcttcccccagccccacccccattgtccccttgtgtgccttcaggaatctgatcattcttctctcctgctccttcccaaaggckgcaggagcaggtgtgaagacgtggatgtgccagatgcagagtcctgacacttttcaacacatctgcatattagaggaagtacatacccattgcttggtggtttcatgtctaatgtggtatgagtgtgacaaagagagggagaaaatttggactagccaaagaagccagtcaggcgtggggtttgaagggcatcgtgggcggctgtcatttgctctctgcttgtcacagccccttgcccagggcttgaccagtgaggtgtatgtgctggtcacacccatctcagcagatctgtcagctttc

SEQ ID NO: 131370 - DNA, 601 bp, Human
ctgtggtcccagcaacccgggaggctgagatagatggatcgctttagcctgggggttttaggctgcatgaatgtcgtgatcatgccgctgcattccagcctgagtgacatagtgagacctcatcttaacaacaacaaaccggaaaatggcggccatccattattttggatgcctaacatttcaaactttcaagaactgccgtgctttccctctaggtgattctgatgggtctgccaatcactggtcacagaatgtcccagccaactaacaacagcagttggttcaaacagaagatgcacarcccaacagggccagttagactctttccctgggaatttatgagcactttgaaagcaaaagcctctctttcttcatagaggacactgtatccctggagctaccaacttcgctgaccacttgaaggaagctagtctttagtacgagagaatgaggccaataacaaaagatggaccaagacaggcactctgatagcatttgagacgtgggtccaaggattttcaaacacgcagccctgcctctttcagttctgtgagctagtttcttttatttgtttaagctattttgagttagcttctatccc

SEQ ID NO: 131371 - DNA, 601 bp, Human
gtccaataccccttgcatctggaaaggatgttctaatcttctggggttgatttaaacatccatctattttattaatcattgctaccacttcagaatcgaagaagacggtggtggcagtggtgattgcttgtggtcagcagcttttcaggagacagtctttgcctgcctcaccagcctctcgtggttctcagtcccacatactatgatggaagtgtactcaagtcataccagactctttgcagtttccaaacattcatgttcaagcatttatgcctttgtgtatgctggtttctctttctakcatgcccttgtcacctcttcttcacctgctttacttatttatgattagaggtttagctcatgtgttatatcttctaagaagtcttctttaacctcctcgcatggattagggccctgccttagcctgaggcgaaaacatggcctgaaggccaaggcatatgtgcaggtggattatgtgggataatgatcccaggaagcaagagtgagggactagtggaatgaaactctacaaggatgcattgtcaagctggctgcagcgacagaagcctggtgctccagactttctgaggagccttatgaa

SEQ ID NO: 131372 - DNA, 601 bp, Human
acaagagagctaagtagaaacaagtaaacaagtggggcttcttaaggccttggctcagaactagcatgttgtcacacccaaagtgatgtgcccaaagtcaagggacgggaaatacactctgcccacaacgaggccaaagcagaaatgtggaagcaaggaaggatggagagttggggccaataattcaacctattataacaactactagctttgcactgtggtgcaactcactcggcttcatctgtaaaatatgcagcatgatagtacctacctcatgggttttttttggagggaggagcamgtaattcaggtagttcttataaaccatttagaacaatgcttaaatttagaaaacacaaagaaaattagtgacagtactaatatttaatccatctaaccatcaacacctgtgcatatgaggtctatcccaccagagtggctataggagggttagggttgacttcgcagattggcctagtgtcagctgattctcttccagcagaagggcttgaaggagtgaccttcggaacagtccccagtcgctcatttataagtcccctttttcctctctcataactgcatcatagccacaaactcaaga

SEQ ID NO: 131373 - DNA, 601 bp, Human
tagttcttataaaccatttagaacaatgcttaaatttagaaaacacaaagaaaattagtgacagtactaatatttaatccatctaaccatcaacacctgtgcatatgaggtctatcccaccagagtggctataggagggttagggttgacttcgcagattggcctagtgtcagctgattctcttccagcagaagggcttgaaggagtgaccttcggaacagtccccagtcgctcatttataagtcccctttttcctctctcataactgcatcatagccacaaactcaagacccaaccagcrtgggcttgcattgtgttgcctggtctccccacccgcctcggccctgtgtatctcacacccagagtcagcagtgcttttcacacaaaccatctgccaagagatgtggagctggagccagaaacacacaacagctgcagaagctcagccacattcagaagcctgtagtaatcgcctaacaggcttggatacagctctgactgctgagtaactctagagtatggaagcccatcagtaaattatgattgcagcatgagtaatacatgagttctgccagctgcttctggaatcaaacaaaagaca

SEQ ID NO: 131374 - DNA, 601 bp, Human
gatgggcttttgggttggttccaagtctttgctatcgtgaatagtgccacaataaacgtgtgtgcatgagtctttatagtagaatgacttataatcctttgggtgtatacccagtaatgggatggctgggtcaaatggtatttggtatttctagttctagatccttgaggaattgccatattgtcttccacaatggttgaactaatttaaactcccaccaacagtgtaaaaacgttcctatttctccatatcctccagcatctgttgtttcctgactttttaatgattgccattctaactsatgagagatggtatctcattgtggttttgatttgcatttctctaatgaccagtgatgatgagcattttttcatgtttgttggctgcataaatgtcttcttttgagaagtgtctgtttatatcctttacccaattttgatggggttgtttgattttttcttgtaaatttgttgaagttctttgtagattctggatattaaccccttgtcagaaggatagattgcaaaattttactcccattctgtaggttgcctgtccactctgatggtagtttcttttgctgtgcagaagctctttagtt

SEQ ID NO: 131375 - DNA, 601 bp, Human
ttctctaatgaccagtgatgatgagcattttttcatgtttgttggctgcataaatgtcttcttttgagaagtgtctgtttatatcctttacccaattttgatggggttgtttgattttttcttgtaaatttgttgaagttctttgtagattctggatattaaccccttgtcagaaggatagattgcaaaattttactcccattctgtaggttgcctgtccactctgatggtagtttcttttgctgtgcagaagctctttagtttaattagatcccatttgtcaattttggcttctgttgcsattgcttttggtgttttagacatgaagtccttgcccatgcctatgtcctgaatggtattgcctaggttttcttctagggtttttatggttttaggtctaacttgtaagtctttaatccatcttgaattaatttttgtataaggtgtaaggaagggatccagtttcagctttctgcatatggctagccagttttcccaacaccatttattaaatagggaatcctttccccatttcttgtttttgtcaggtttgttaaagataagatggttgtagatgtgtggtgttatttctgaggcctct

SEQ ID NO: 131376 - DNA, 601 bp, Human
ggggcttatgcaaatattcacccaataaaatatttccttcatattttggcacaagcaataaagaagtacaaggtcccagatcagttgcccctccctatcattgcctctgcctgttattcctgacagaataagcatttttctcatcttaaacgcatgatccatggtttctgcaatttctaaagaccctagaccaggctctggccacactggatattcaataaatgaatagatttccactaaactgatggctttggggaaagagatattgtataatattttcttccataaaactcataggtargtttaagtattgttttcttatatatttcacagcaaagtttcataattcgtatcacataagttctaagcattgccttctaataactcttatccaatcacctaaagatattggttttgaaatttaacaaaataattatacactttgtcttgaagaataagcaggaagaatagctgaaaaaattctgaaaaagaaaagtaatgtcttgagaatagttttactggatcttaggtggaatatgctactgtaataacagtgttacagttccaggaatttggatgcacagatcaacagatgaaaggc

SEQ ID NO: 131377 - DNA, 601 bp, Human
gaatatatattgaattttcatatgggaaggactttttaagtttaaaacacaatagaagaaaccacaaaactaaaaatcagcacacttggctatgtaaatatttaaagtgtcaattcaagaataataaaaggcaaagaacaaaaagagaaaaatacttggaacaaatatggtaaataaaagattaaagtacttttttttttttttttttttgctcactgcaacctccgcttcctgggttcaagcgattctcctgcctcagcctcctgagtagctgggattacaggtgtgcaccaccacgccyggctaatttttgtatttttagtagagatgggatttcaacatgttgatcaggctggtctgacctcgtgattcacatgccttggcctcccagagtgttgggattacaggcgtgagccaccgcgcccggccaaagtactttaaaaaacaaaacaaaacaaaacctcattgaaagtgatagaaaaaaataaaaacatcaatagaaaaagagaggaacaagtaattcacaaaaggaggaaatacaaatggcttataagcatgcgaaaagtttaccctctaaaacaaatttaaatcaaatcaaaac

SEQ ID NO: 131378 - DNA, 601 bp, Human
aatatatattgaattttcatatgggaaggactttttaagtttaaaacacaatagaagaaaccacaaaactaaaaatcagcacacttggctatgtaaatatttaaagtgtcaattcaagaataataaaaggcaaagaacaaaaagagaaaaatacttggaacaaatatggtaaataaaagattaaagtacttttttttttttttttttttgctcactgcaacctccgcttcctgggttcaagcgattctcctgcctcagcctcctgagtagctgggattacaggtgtgcaccaccacgcccrgctaatttttgtatttttagtagagatgggatttcaacatgttgatcaggctggtctgacctcgtgattcacatgccttggcctcccagagtgttgggattacaggcgtgagccaccgcgcccggccaaagtactttaaaaaacaaaacaaaacaaaacctcattgaaagtgatagaaaaaaataaaaacatcaatagaaaaagagaggaacaagtaattcacaaaaggaggaaatacaaatggcttataagcatgcgaaaagtttaccctctaaaacaaatttaaatcaaatcaaaaca

SEQ ID NO: 131379 - DNA, 601 bp, Human
gacatacagaaaaatgtttttaaatgtatggtcaccagagttaacaaatgtgcttctttaatgatacaagaaatctatatctatagcaatcaagagggaggtagaaagagagagagacagagaaatagagagatgacagagagagagacaggtttggctgtttggtttaaacatttggtaattattacctttaaacataaacacaattgtacatgttctgttgtatgatggtaggggtagctaaaaaagaggaaaacagtttcaaccataggatcattgactataaaccagagagatctcrtggaaagtaaagtcacagaactaatccaggtcttccgaagctgccatattgttactgagtaatgcctgaaataaatacttccttcttttctccggacctcctctcatcacttagacttaaccctgaaggatggagtgaggaatggcagaagtgtgagggtaaataacagaaatgggattagaatgtcatatatacaatatttgttaatgaaaaaaatctggacaagtcatggcttatttttaggatcattaaatagttggaaaggtctaagaatttctggcatcaaaagggcatctttca

SEQ ID NO: 131380 - DNA, 601 bp, Human
ttccgaagctgccatattgttactgagtaatgcctgaaataaatacttccttcttttctccggacctcctctcatcacttagacttaaccctgaaggatggagtgaggaatggcagaagtgtgagggtaaataacagaaatgggattagaatgtcatatatacaatatttgttaatgaaaaaaatctggacaagtcatggcttatttttaggatcattaaatagttggaaaggtctaagaatttctggcatcaaaagggcatctttcaaaatgtcgtgtacttctgagtctgtcttttgcycttcactttaccattttccttatgagccttaagagccacagtcggctgagtttgagtcaggtgaagcctacagccttttgatgccctctacaatcttccaacatagcctcctttgttatgtcagtgaccatatgatgcatccaacctgaaagccagtgtcctccacttattgctattttttagtatctgtatccaaatcaattgctagtgcatgcctcatctttccgtaaatctcctattagattgcaggctagtggctttcatacttgctttatggagctcgaggggttccaaaggaga

SEQ ID NO: 131381 - DNA, 601 bp, Human
aaatgggattagaatgtcatatatacaatatttgttaatgaaaaaaatctggacaagtcatggcttatttttaggatcattaaatagttggaaaggtctaagaatttctggcatcaaaagggcatctttcaaaatgtcgtgtacttctgagtctgtcttttgcccttcactttaccattttccttatgagccttaagagccacagtcggctgagtttgagtcaggtgaagcctacagccttttgatgccctctacaatcttccaacatagcctcctttgttatgtcagtgaccatatgatrcatccaacctgaaagccagtgtcctccacttattgctattttttagtatctgtatccaaatcaattgctagtgcatgcctcatctttccgtaaatctcctattagattgcaggctagtggctttcatacttgctttatggagctcgaggggttccaaaggagatgcctgtgggactgtcatggatggtgagggtgagacccatgcctggacgtctctgggatctttacccctattttaccccaatttcaaccagagtaattatacttttctttaggtgtaacatattgtcttttacataa

SEQ ID NO: 131382 - DNA, 601 bp, Human
gaaaaaaatctggacaagtcatggcttatttttaggatcattaaatagttggaaaggtctaagaatttctggcatcaaaagggcatctttcaaaatgtcgtgtacttctgagtctgtcttttgcccttcactttaccattttccttatgagccttaagagccacagtcggctgagtttgagtcaggtgaagcctacagccttttgatgccctctacaatcttccaacatagcctcctttgttatgtcagtgaccatatgatgcatccaacctgaaagccagtgtcctccacttattgctaytttttagtatctgtatccaaatcaattgctagtgcatgcctcatctttccgtaaatctcctattagattgcaggctagtggctttcatacttgctttatggagctcgaggggttccaaaggagatgcctgtgggactgtcatggatggtgagggtgagacccatgcctggacgtctctgggatctttacccctattttaccccaatttcaaccagagtaattatacttttctttaggtgtaacatattgtcttttacataatatttaatttggtaaaacgatgcctctgcttaaataaaa

SEQ ID NO: 131383 - DNA, 601 bp, Human
ggaaaggtctaagaatttctggcatcaaaagggcatctttcaaaatgtcgtgtacttctgagtctgtcttttgcccttcactttaccattttccttatgagccttaagagccacagtcggctgagtttgagtcaggtgaagcctacagccttttgatgccctctacaatcttccaacatagcctcctttgttatgtcagtgaccatatgatgcatccaacctgaaagccagtgtcctccacttattgctattttttagtatctgtatccaaatcaattgctagtgcatgcctcatctttcygtaaatctcctattagattgcaggctagtggctttcatacttgctttatggagctcgaggggttccaaaggagatgcctgtgggactgtcatggatggtgagggtgagacccatgcctggacgtctctgggatctttacccctattttaccccaatttcaaccagagtaattatacttttctttaggtgtaacatattgtcttttacataatatttaatttggtaaaacgatgcctctgcttaaataaaaacacattggggaacccctaacataagttgcaggatttgctcagacaaaga

SEQ ID NO: 131384 - DNA, 601 bp, Human
gaactaaaatcaatttaacctagtttctatctcttttatgagccaaaattaggagtatcaaaaatatgatttgaagcctagggctcttgctgactagtcatattttaaaattctgaatctagagatcttagacttcagttcctagagtacatggcaaacttcattttccagtgtaaccctagatgatacatgtatgccatccttagaaggagtcagatatcatcattaaataatccataaactaaaacttgttttcatgatcccctactagaagtcaagtccatttaaagatctaataaaragaagagaaaccttagcaatgtgctcagaataccagaacataggaggaatataggtctgagttttcagaaatacgtatgctgctgtggctcatttcttgcccatgtttgtattgcttctctgggctgttactagatttaaaagaaacaaaaagggtgcgtaataaattgttataatcccagcactttcggaggccgaggcaggtggatcacctgacgtcaagcgttgaagaccagcctgcccaacatggagaagtcctgtctctactaaaaatacaaaaattagctgggcatggtggtgc

SEQ ID NO: 131385 - DNA, 601 bp, Human
gcctagggctcttgctgactagtcatattttaaaattctgaatctagagatcttagacttcagttcctagagtacatggcaaacttcattttccagtgtaaccctagatgatacatgtatgccatccttagaaggagtcagatatcatcattaaataatccataaactaaaacttgttttcatgatcccctactagaagtcaagtccatttaaagatctaataaagagaagagaaaccttagcaatgtgctcagaataccagaacataggaggaatataggtctgagttttcagaaatacrtatgctgctgtggctcatttcttgcccatgtttgtattgcttctctgggctgttactagatttaaaagaaacaaaaagggtgcgtaataaattgttataatcccagcactttcggaggccgaggcaggtggatcacctgacgtcaagcgttgaagaccagcctgcccaacatggagaagtcctgtctctactaaaaatacaaaaattagctgggcatggtggtgcatgcctgtaatcccagctacttgggaggctgaggcaggagaatcgcttgaacccaggaggtggaggttgcagtga

SEQ ID NO: 131386 - DNA, 601 bp, Human
cttcattttccagtgtaaccctagatgatacatgtatgccatccttagaaggagtcagatatcatcattaaataatccataaactaaaacttgttttcatgatcccctactagaagtcaagtccatttaaagatctaataaagagaagagaaaccttagcaatgtgctcagaataccagaacataggaggaatataggtctgagttttcagaaatacgtatgctgctgtggctcatttcttgcccatgtttgtattgcttctctgggctgttactagatttaaaagaaacaaaaagggtgygtaataaattgttataatcccagcactttcggaggccgaggcaggtggatcacctgacgtcaagcgttgaagaccagcctgcccaacatggagaagtcctgtctctactaaaaatacaaaaattagctgggcatggtggtgcatgcctgtaatcccagctacttgggaggctgaggcaggagaatcgcttgaacccaggaggtggaggttgcagtgagccgagatcgtgccactgcactccagccttggtgacagagtgagacttttttttttttttttgagacaaaggattcttgtctt

SEQ ID NO: 131387 - DNA, 601 bp, Human
gccatccttagaaggagtcagatatcatcattaaataatccataaactaaaacttgttttcatgatcccctactagaagtcaagtccatttaaagatctaataaagagaagagaaaccttagcaatgtgctcagaataccagaacataggaggaatataggtctgagttttcagaaatacgtatgctgctgtggctcatttcttgcccatgtttgtattgcttctctgggctgttactagatttaaaagaaacaaaaagggtgcgtaataaattgttataatcccagcactttcggaggcygaggcaggtggatcacctgacgtcaagcgttgaagaccagcctgcccaacatggagaagtcctgtctctactaaaaatacaaaaattagctgggcatggtggtgcatgcctgtaatcccagctacttgggaggctgaggcaggagaatcgcttgaacccaggaggtggaggttgcagtgagccgagatcgtgccactgcactccagccttggtgacagagtgagacttttttttttttttttgagacaaaggattcttgtcttagtgtactatttttgagctggttggcattcattagcc

SEQ ID NO: 131388 - DNA, 601 bp, Human
agcaatgtgctcagaataccagaacataggaggaatataggtctgagttttcagaaatacgtatgctgctgtggctcatttcttgcccatgtttgtattgcttctctgggctgttactagatttaaaagaaacaaaaagggtgcgtaataaattgttataatcccagcactttcggaggccgaggcaggtggatcacctgacgtcaagcgttgaagaccagcctgcccaacatggagaagtcctgtctctactaaaaatacaaaaattagctgggcatggtggtgcatgcctgtaatcccagctacttgggaggctgaggcaggagaatcgcttgaacccaggaggtggaggttgcagtgagccgagatcgtgccactgcactccagccttggtgacagagtgagacttttttttttttttttgagacaaaggattcttgtcttagtgtactatttttgagctggttggcattcattagcccacccttagacctcattttctctccatataagataaaaaatgccaccacaaacattagcttttccttgtgatgggctctgtagggtaggttgccaccttaggagggtctagttgtgactg

SEQ ID NO: 131389 - DNA, 601 bp, Human
catgtttgtattgcttctctgggctgttactagatttaaaagaaacaaaaagggtgcgtaataaattgttataatcccagcactttcggaggccgaggcaggtggatcacctgacgtcaagcgttgaagaccagcctgcccaacatggagaagtcctgtctctactaaaaatacaaaaattagctgggcatggtggtgcatgcctgtaatcccagctacttgggaggctgaggcaggagaatcgcttgaacccaggaggtggaggttgcagtgagccgagatcgtgccactgcactccagscttggtgacagagtgagacttttttttttttttttgagacaaaggattcttgtcttagtgtactatttttgagctggttggcattcattagcccacccttagacctcattttctctccatataagataaaaaatgccaccacaaacattagcttttccttgtgatgggctctgtagggtaggttgccaccttaggagggtctagttgtgactgttttgcaggggaaaaaaatcctgtttctcttcattagtctcaaaattttagggaatcacaaatcatcatcacctttatcatcatgtc

SEQ ID NO: 131390 - DNA, 601 bp, Human
ctttcggaggccgaggcaggtggatcacctgacgtcaagcgttgaagaccagcctgcccaacatggagaagtcctgtctctactaaaaatacaaaaattagctgggcatggtggtgcatgcctgtaatcccagctacttgggaggctgaggcaggagaatcgcttgaacccaggaggtggaggttgcagtgagccgagatcgtgccactgcactccagccttggtgacagagtgagacttttttttttttttttgagacaaaggattcttgtcttagtgtactatttttgagctggttggyattcattagcccacccttagacctcattttctctccatataagataaaaaatgccaccacaaacattagcttttccttgtgatgggctctgtagggtaggttgccaccttaggagggtctagttgtgactgttttgcaggggaaaaaaatcctgtttctcttcattagtctcaaaattttagggaatcacaaatcatcatcacctttatcatcatgtctttgtaatcatttattgaatattccactatttgccacatactgttaatacagcctccataaaatttacgaaaattttttttc

SEQ ID NO: 131391 - DNA, 601 bp, Human
acatggagaagtcctgtctctactaaaaatacaaaaattagctgggcatggtggtgcatgcctgtaatcccagctacttgggaggctgaggcaggagaatcgcttgaacccaggaggtggaggttgcagtgagccgagatcgtgccactgcactccagccttggtgacagagtgagacttttttttttttttttgagacaaaggattcttgtcttagtgtactatttttgagctggttggcattcattagcccacccttagacctcattttctctccatataagataaaaaatgccaccamaaacattagcttttccttgtgatgggctctgtagggtaggttgccaccttaggagggtctagttgtgactgttttgcaggggaaaaaaatcctgtttctcttcattagtctcaaaattttagggaatcacaaatcatcatcacctttatcatcatgtctttgtaatcatttattgaatattccactatttgccacatactgttaatacagcctccataaaatttacgaaaattttttttcgtatgtatgtatacattgatacatcctcagggaaatgcttagaaataagtaccaccagct

SEQ ID NO: 131392 - DNA, 601 bp, Human
gcacagaggctaaataacttaacttgtaagtggcagatctagaattcaaacccaggatggcttgaatccctggactctgaccatgaagcttcctggtctatctcagagcagaccttaatctgatctgagataggcatagcactgcacaggcacttagaagcagagaggacgcctttaaaacatcaccatgatgaaggtgctaatataaattccaagactaaatgtgcagagcccaagtcacttgcattcctgccaaaagattcaattttaaaaatgtttatctttttgttctgtgtgtacygtaccgtcattctgagatagccactgttaatattttctagataagattgaattttatatccttttctgcggaattcaaatgccctctacgaggtttcctctgtgaattcccagggcagttattttttttttttttgagatggagtctcgctctgtcactcaggttggagtgcagtggcacgatcttggctcactgcaacctccccatcccaggttcaggcaattcttctgcctcagcctcccgagtagctgggactataggtgcatgccaccacgcccagctgatgtttgtatttataat

SEQ ID NO: 131393 - DNA, 601 bp, Human
tgctgattggtgcatttacagtcctctagctagacagaaaagttctccaagtccccacttgacccaggaagtccagctggcttcacctctcacttttaaaactgttgagcagagttcttgatttatttatattcaatagtaagcaaagtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgygttactagagtggagtacaggaattgagtatgtgtgaatttggttgtacacaagtggtcctggaaccaatcccctgtgtgtaccaaggaacagctatgtaatgttttagattcactgtagcagttttgaaagtaggattcttagatgggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtct

SEQ ID NO: 131394 - DNA, 601 bp, Human
tcacttttaaaactgttgagcagagttcttgatttatttatattcaatagtaagcaaagtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgtgttactagagtggagtacaggaattgagtatgtgtgaatttggttgtacacaagtggtcctggaaccaatcccctgtgtgtaccaaggracagctatgtaatgttttagattcactgtagcagttttgaaagtaggattcttagatgggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtctgtagtcccagctactccggagggaggctgaggcaggagaatggcgtgaacctgggaggcggagcttgcagtgagccgagatcacgccac

SEQ ID NO: 131395 - DNA, 601 bp, Human
tcttgatttatttatattcaatagtaagcaaagtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgtgttactagagtggagtacaggaattgagtatgtgtgaatttggttgtacacaagtggtcctggaaccaatcccctgtgtgtaccaaggaacagctatgtaatgttttagattcaytgtagcagttttgaaagtaggattcttagatgggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtctgtagtcccagctactccggagggaggctgaggcaggagaatggcgtgaacctgggaggcggagcttgcagtgagccgagatcacgccactgcactccagcctgggcgacagagcg

SEQ ID NO: 131396 - DNA, 601 bp, Human
caaagtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgtgttactagagtggagtacaggaattgagtatgtgtgaatttggttgtacacaagtggtcctggaaccaatcccctgtgtgtaccaaggaacagctatgtaatgttttagattcactgtagcagttttgaaagtaggattcttrgatgggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtctgtagtcccagctactccggagggaggctgaggcaggagaatggcgtgaacctgggaggcggagcttgcagtgagccgagatcacgccactgcactccagcctgggcgacagagcgagactctgtctcaaaaaaaaaaaaacag

SEQ ID NO: 131397 - DNA, 601 bp, Human
agtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgtgttactagagtggagtacaggaattgagtatgtgtgaatttggttgtacacaagtggtcctggaaccaatcccctgtgtgtaccaaggaacagctatgtaatgttttagattcactgtagcagttttgaaagtaggattcttagaygggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtctgtagtcccagctactccggagggaggctgaggcaggagaatggcgtgaacctgggaggcggagcttgcagtgagccgagatcacgccactgcactccagcctgggcgacagagcgagactctgtctcaaaaaaaaaaaaacagtag

SEQ ID NO: 131398 - DNA, 601 bp, Human
tatgttccccctgtcctgccaccttggcttccccagtcccgctaccttagactctctagacttcccagtaatttagcaatgaaagggttaatgctagcccattagggtttttcagatccatttcctggtgctcagatcagtgtccattttaatcggttggtccaggttgaatttcacctttgagcaacaccaaacttatttaagttaggcaaattcaactatataattcttgatcgaaaacatgtagaaaataagtataatataaacaatgcaggtgatttcacttgccctttcacttcayatgccccacactgagcttagtcccaattcttgtggtctctcatacgctcaccatgtttgaaggcatacatactttttatgctgtctggttcctgaacaccactttatctggttctcacccaaagaaacagggatctgtttgtgaaacttacattagcaaaaaagaaaaaaaaaaaaaaaaaagaaacattaatctcttccaatgctggaggaaaacctacctgtttcattggtgaataaatgatatatgtccacatttccctttatgggttattttaaggattgccaagagtccttttgt

SEQ ID NO: 131399 - DNA, 601 bp, Human
cccctgtcctgccaccttggcttccccagtcccgctaccttagactctctagacttcccagtaatttagcaatgaaagggttaatgctagcccattagggtttttcagatccatttcctggtgctcagatcagtgtccattttaatcggttggtccaggttgaatttcacctttgagcaacaccaaacttatttaagttaggcaaattcaactatataattcttgatcgaaaacatgtagaaaataagtataatataaacaatgcaggtgatttcacttgccctttcacttcatatgccccacactgagcttagtcccaattcttgtggtctctcatacgctcaccatgtttgaaggcatacatactttttatgctgtctggttcctgaacaccactttatctggttctcacccaaagaaacagggatctgtttgtgaaacttacattagcaaaaaagaaaaaaaaaaaaaaaaaagaaacattaatctcttccaatgctggaggaaaacctacctgtttcattggtgaataaatgatatatgtccacatttccctttatgggttattttaaggattgccaagagtccttttgtctatata

SEQ ID NO: 131400 - DNA, 601 bp, Human
gaatttcacctttgagcaacaccaaacttatttaagttaggcaaattcaactatataattcttgatcgaaaacatgtagaaaataagtataatataaacaatgcaggtgatttcacttgccctttcacttcatatgccccacactgagcttagtcccaattcttgtggtctctcatacgctcaccatgtttgaaggcatacatactttttatgctgtctggttcctgaacaccactttatctggttctcacccaaagaaacagggatctgtttgtgaaacttacattagcaaaaaagaaamaaaaaaaaaaaaaagaaacattaatctcttccaatgctggaggaaaacctacctgtttcattggtgaataaatgatatatgtccacatttccctttatgggttattttaaggattgccaagagtccttttgtctatatacgattgcactgatctttgtaacctcgactcctatagaatgtgttgctccactggctatatatgtaattataaagacatatatcttatatatgtcttacataaagatatacatatctttataattatttaaatgttatatttgatttttagtctactttatc

SEQ ID NO: 131401 - DNA, 601 bp, Human
ttcacctttgagcaacaccaaacttatttaagttaggcaaattcaactatataattcttgatcgaaaacatgtagaaaataagtataatataaacaatgcaggtgatttcacttgccctttcacttcatatgccccacactgagcttagtcccaattcttgtggtctctcatacgctcaccatgtttgaaggcatacatactttttatgctgtctggttcctgaacaccactttatctggttctcacccaaagaaacagggatctgtttgtgaaacttacattagcaaaaaagaaaaaaamaaaaaaaaaagaaacattaatctcttccaatgctggaggaaaacctacctgtttcattggtgaataaatgatatatgtccacatttccctttatgggttattttaaggattgccaagagtccttttgtctatatacgattgcactgatctttgtaacctcgactcctatagaatgtgttgctccactggctatatatgtaattataaagacatatatcttatatatgtcttacataaagatatacatatctttataattatttaaatgttatatttgatttttagtctactttatctgtc

SEQ ID NO: 131402 - DNA, 601 bp, Human
aatgctggaggaaaacctacctgtttcattggtgaataaatgatatatgtccacatttccctttatgggttattttaaggattgccaagagtccttttgtctatatacgattgcactgatctttgtaacctcgactcctatagaatgtgttgctccactggctatatatgtaattataaagacatatatcttatatatgtcttacataaagatatacatatctttataattatttaaatgttatatttgatttttagtctactttatctgtcaaaatgggagtggtgtggtgctatcttcyaaaactattatgttttccttacatttttttgcttttaacagtttatcctttatatatttgatcctatatgatttggagaacaaagatacatagctgttatgcctctactgtggattttactttctagcaacataatatgagagactatgttctactttatgccttcaatcttgagttttaccttgtctgaaactagtattatttttgctttcttttctttcttcattcttttattggtccttttttcttttaatttattcgttaagttctctgcctatctctgtttttaagattttatga

SEQ ID NO: 131403 - DNA, 601 bp, Human
ttttagattcatagtcttacatgtggtccagagagtactcgtgtttctactgggatgatcaaagtactaaggcaaaggggttcccagtcaaacaatggatatggagaagctactgtgcccaactttgttaggaaaaaggaagagttatgaattctatcactgttccggatgttttacatttgagatctcctttagtcatcgctgttgcttattttgtctaagccagtttcctcatccgtggtatggaggtataatgtctaattcatatggtggttgtgagaactcattaaaaacaatgcaygttaaagtaactagactgtggaagttacttaataagttaaagctattgttaatgatttttgtaactattcgtgtgtcattgaaacactgctattgtgaaacacaactagcaaacacttgatagtagtgatttgcacactgctctttaaagagccgctctagggaggtacccaaagggagtgcttcaagattgagggagcatgtacaaagctgggcttctgtttctttatcaacccacaggaagcatggtgttatctgtgtgcgttgcttgaaatgagcgtaggtagacctaaaagcacca

SEQ ID NO: 131404 - DNA, 601 bp, Human
attcatagtcttacatgtggtccagagagtactcgtgtttctactgggatgatcaaagtactaaggcaaaggggttcccagtcaaacaatggatatggagaagctactgtgcccaactttgttaggaaaaaggaagagttatgaattctatcactgttccggatgttttacatttgagatctcctttagtcatcgctgttgcttattttgtctaagccagtttcctcatccgtggtatggaggtataatgtctaattcatatggtggttgtgagaactcattaaaaacaatgcatgttaargtaactagactgtggaagttacttaataagttaaagctattgttaatgatttttgtaactattcgtgtgtcattgaaacactgctattgtgaaacacaactagcaaacacttgatagtagtgatttgcacactgctctttaaagagccgctctagggaggtacccaaagggagtgcttcaagattgagggagcatgtacaaagctgggcttctgtttctttatcaacccacaggaagcatggtgttatctgtgtgcgttgcttgaaatgagcgtaggtagacctaaaagcaccaggggag

SEQ ID NO: 131405 - DNA, 601 bp, Human
gcctggagacagagcaagactccgtctcaaaaaaaaaaggaaaaggagaatatgtaaagagcgtagctcatgcgaagatgctatggatgattcataaagaagagctcccagtgtgtttggaatgatgttactgccatcggaatgaatatggggactggtaggggcccatggggattacacttaatacatttatacctaaagtttctcaagaactctctcttaacgaatgcgcataggcctccgactcttgagatatttaggcctgcagtttgatagaggaaaaacagacataaaatccagytggaatttcacctggcaaatgtttatctgtcgtttggaagcacacaggattttttttttaattgaggcgagggaatgtgatcagacaagctacttcccaaataggtggcacacaatcacagaaataattcacatatggcctggaagacaatagattccaaaattgtagtaaagcaattcctaaactaaatggtacaaggctggagggcctctgagccctcttccagtactgagctaagaatatgtcccctctagtgagctggagaactgtgcttcagaacctagagctcctgtcctgttc

SEQ ID NO: 131406 - DNA, 601 bp, Human
tggaatttcacctggcaaatgtttatctgtcgtttggaagcacacaggattttttttttaattgaggcgagggaatgtgatcagacaagctacttcccaaataggtggcacacaatcacagaaataattcacatatggcctggaagacaatagattccaaaattgtagtaaagcaattcctaaactaaatggtacaaggctggagggcctctgagccctcttccagtactgagctaagaatatgtcccctctagtgagctggagaactgtgcttcagaacctagagctcctgtcctgttcragagggaagaaaagcaacatatagggagggaaaagagaattcttggagcaaaatattgggagagtatatttcattgtcaggttgaacaaacagaattccacaagacagtgttgccaggaatagaatatcgactgtgcacacacttctaaagatgaagaaaatgtaagtgggggttcttgggcttagagacacatatgtgggctctttgggttaggttaggtgagtggtctccctgaggttcagctggcaaagacccaagaagcaacttcttaagctcatctccaaatagccccctgatct

SEQ ID NO: 131407 - DNA, 601 bp, Human
ctggcaaatgtttatctgtcgtttggaagcacacaggattttttttttaattgaggcgagggaatgtgatcagacaagctacttcccaaataggtggcacacaatcacagaaataattcacatatggcctggaagacaatagattccaaaattgtagtaaagcaattcctaaactaaatggtacaaggctggagggcctctgagccctcttccagtactgagctaagaatatgtcccctctagtgagctggagaactgtgcttcagaacctagagctcctgtcctgttcgagagggaagaraagcaacatatagggagggaaaagagaattcttggagcaaaatattgggagagtatatttcattgtcaggttgaacaaacagaattccacaagacagtgttgccaggaatagaatatcgactgtgcacacacttctaaagatgaagaaaatgtaagtgggggttcttgggcttagagacacatatgtgggctctttgggttaggttaggtgagtggtctccctgaggttcagctggcaaagacccaagaagcaacttcttaagctcatctccaaatagccccctgatctccccaaggctg

SEQ ID NO: 131408 - DNA, 601 bp, Human
cccagccctaatccttggcagccactcatctggtctcatccctacaggcctgcctttcttagaatgtcatataaatgcagtcggacagtaggtagaagatgattttagcttcttcactcagcataatgccatgttgctgcaagtagcaataggttttttcttttcattgttgagtagcatggatatactatagcttgtttatgtatttatccactgaaggatatttgggtgcttccagtttggggtgattatgaataaatagagctgctataaacattctattttttttttttttttttttggcgggggggacggagtcttgctctgtctcccaggctggagtgcagtggcgtgacctcggctcactgcaagctccgcctcccgggttcacgccattctcctgcctcagcctctcgagtagctgggactacaggtgcccaccaccacgcccggctaattttttgtatttttagtagagacggggtttcaccgtgttagccaggatggtcttgatctcctgaccttgtgatctgcccgcctcggcctcccaaagtgctgggattacaggcgtgagacactgcgcccggccaacattcattgt

SEQ ID NO: 131409 - DNA, 601 bp, Human
taattacactgcccatcaacaatatagatgtttctattcaacagccagcaccagatattatgaccctctccattctttgacaatttgataggcaaataatgagatgtctttttagtttgtattttgagatctgtggtcaggttaaacatcttttcaacttttcacatgttgtgagtatatcagcttttgatgagtaacaaggcatccaaaacataatggtaaaacagcaaacatttattatgacttatgcttctgtatgtcatctgggaaactctttggcttaagctggattggtctctcrtcctctagcgggttagtcttggcgtctcctcatgatggcctcagggttccatagagcagcagcaagagtgcaagcccagtgggagagcccagtgggcaagcacttttcaagcctctgcttatgccacattggctaatcctccattgatcaaaagaagtcccatggccaagcctagattcaagagatggagaaagaaactccacttcttgatggaatgaaatgcaaaatattgtgaccactttttcatgaatctactgcgactggctgtttgtgtttccttctctgtgaattgctattggt

SEQ ID NO: 131410 - DNA, 601 bp, Human
ggtagttcttagggcccaacagaaagaaattaatagcaactttaagatagagaaagaacattctagaattgagtcctactaaaaactcatttttgaaaaatgagtaactactgctcagtagttaccattttggggaagatttttctgattatcttctcatctctctcttgctttgcctggctaaccccaactttcctttagactaaaagtccacaaaccctccttcaaaacagtcaagtctgataaagtttaccattatggtgtctcataagcatcttgtaattctctctcttagtacctrtctgtatttatgtgtttatgtgattagttttccatgtctgtctcctacatttgcctataagctacgagacggttgtatattcactgctgtgtctccagggccaagtgcagtactgggcacaggggaagcatgcaataagtctgcgtggtaagtgaatgaatggacacataaacaacttaatgagtgctttttgaactgaagataatttttctttttcaggacagcaaaaacaaaaaacctaaactaaaatccaaacaatttcgcaaaatatcctggatagtttgggagttgtctttgctt

SEQ ID NO: 131411 - DNA, 601 bp, Human
tagagaaagaacattctagaattgagtcctactaaaaactcatttttgaaaaatgagtaactactgctcagtagttaccattttggggaagatttttctgattatcttctcatctctctcttgctttgcctggctaaccccaactttcctttagactaaaagtccacaaaccctccttcaaaacagtcaagtctgataaagtttaccattatggtgtctcataagcatcttgtaattctctctcttagtacctgtctgtatttatgtgtttatgtgattagttttccatgtctgtctcctrcatttgcctataagctacgagacggttgtatattcactgctgtgtctccagggccaagtgcagtactgggcacaggggaagcatgcaataagtctgcgtggtaagtgaatgaatggacacataaacaacttaatgagtgctttttgaactgaagataatttttctttttcaggacagcaaaaacaaaaaacctaaactaaaatccaaacaatttcgcaaaatatcctggatagtttgggagttgtctttgcttctttggctcattgccacggccttaattccagaaatgcttttgactca

SEQ ID NO: 131412 - DNA, 601 bp, Human
tctagaattgagtcctactaaaaactcatttttgaaaaatgagtaactactgctcagtagttaccattttggggaagatttttctgattatcttctcatctctctcttgctttgcctggctaaccccaactttcctttagactaaaagtccacaaaccctccttcaaaacagtcaagtctgataaagtttaccattatggtgtctcataagcatcttgtaattctctctcttagtacctgtctgtatttatgtgtttatgtgattagttttccatgtctgtctcctacatttgcctataarctacgagacggttgtatattcactgctgtgtctccagggccaagtgcagtactgggcacaggggaagcatgcaataagtctgcgtggtaagtgaatgaatggacacataaacaacttaatgagtgctttttgaactgaagataatttttctttttcaggacagcaaaaacaaaaaacctaaactaaaatccaaacaatttcgcaaaatatcctggatagtttgggagttgtctttgcttctttggctcattgccacggccttaattccagaaatgcttttgactcagaccttttcagttc

SEQ ID NO: 131413 - DNA, 601 bp, Human
ggagttcaagaccagcctggccaacatggtgaaaccccgcctctactaaaaatagaaaaaaaattagctgggcgtggtcgcgggcacttgtaatcccagctactcgagaggctgaggcaggagattcttttgaacccgggaggcggaagttgcagtgagcccagatcgcaccattgtactccagcctgggcgacagggcgagactccgtctcaaaaaaagaaaaagtatttgagagatctttgttaaggaaaaatagcattaatctctaaaacttataagatgtatgatattaaatatgcrtcttgtttcagcaaattattagccttcatgatagaagtatgaattaaactattaatgaatttgatcagagccttttagatatggttgtgatgaaacaactcactatccgtccccaacatgatttggagaggatagcgctataatgtaagaaagggtattaagcagagagattgatattggtatgagcccagataggatctgtcttctggcaatgattctcaggaaatgtctctattagaaaatgtcttgagtggcaccagatatgcagtggcagccatgcctttcatggtgtcagcagca

SEQ ID NO: 131414 - DNA, 601 bp, Human
gatagaagtatgaattaaactattaatgaatttgatcagagccttttagatatggttgtgatgaaacaactcactatccgtccccaacatgatttggagaggatagcgctataatgtaagaaagggtattaagcagagagattgatattggtatgagcccagataggatctgtcttctggcaatgattctcaggaaatgtctctattagaaaatgtcttgagtggcaccagatatgcagtggcagccatgcctttcatggtgtcagcagcagaactctttcaagaagccacggaccacagytgtactcgttgtcgtggagcctctgctctattctttctgaaaggctgtttggctactttttttttcagcattaagttttaactcctttatttttcagcattgtgagataacatcacatttcctattattagttcaaagaagagagaaagagaaaaatgcattatttggatgtaatttgaaatttggagtagatatagggctgaaggatgagacataaagggacatgtatgtccatggctcttgattcttttccagctgccatttttttctctctctctttctgtctctcttttatttatt

SEQ ID NO: 131415 - DNA, 601 bp, Human
ggagcctctgctctattctttctgaaaggctgtttggctactttttttttcagcattaagttttaactcctttatttttcagcattgtgagataacatcacatttcctattattagttcaaagaagagagaaagagaaaaatgcattatttggatgtaatttgaaatttggagtagatatagggctgaaggatgagacataaagggacatgtatgtccatggctcttgattcttttccagctgccatttttttctctctctctttctgtctctcttttatttatttatttatttttattayactttaagttcttggatacatgtgcagaacgtgcaggtctgttacataggtatacacatgccatggtggcttgctgcacccatcaacctgtcatctacattaggtatttctcctaaggctatccctccctgacctcaggtgatccgcctgcctcaatctcccaaagtgctggaattacaggcatgagccaccgcgcccagcctccagctgcccctttttaagaaatgggccataacacttttttttacgtttaatttttatgtgtgaataatagtcaaattgttcaaaagccagtacaca

SEQ ID NO: 131416 - DNA, 601 bp, Human
cagctgccatttttttctctctctctttctgtctctcttttatttatttatttatttttattacactttaagttcttggatacatgtgcagaacgtgcaggtctgttacataggtatacacatgccatggtggcttgctgcacccatcaacctgtcatctacattaggtatttctcctaaggctatccctccctgacctcaggtgatccgcctgcctcaatctcccaaagtgctggaattacaggcatgagccaccgcgcccagcctccagctgcccctttttaagaaatgggccataacrcttttttttacgtttaatttttatgtgtgaataatagtcaaattgttcaaaagccagtacacacaagcatatagggaaaagtcttccttttaccattgtgccccaactacccagttcccccgaataggtcatcgttgttcttctttttatgtgtcaccttctagaaattctttaggcagatactagcaaatacaactatagattctcattttaagaaaactaagcaggtgattttcaagactcatcctaggaagctggtaggtatgtcttcttatacccaaagctcacatagaagatcct

SEQ ID NO: 131417 - DNA, 601 bp, Human
tgtaattccactgttaggctttgtagctcgtcgtctctttcaatgtttttactatcctaacttgtattctctgtcctgagatcttaaaagttaccaatgaggctagaagtaaaatggatgcttcaaggccaggcttgggaactcattctagtggagattttctccctcaatctcatgtaatgagttaatattacaataaaatgcaggtgtaactcctgcttacacgaagacttgactttgaaatttttctttctaatcattcagataaaggtttaatttgtaccaagattatcctcaaaayatcactgaatacagtaaacactggcaattgccattaaaaacaaattatatgaggactttatatcaggtacaatgcttgacataagtaggtgctcaaaaattctggtaaatgaatattagccttaaacgctcagcagtcattggtcacttttctttggcattttgtaaaaattgtaatgtttttttccccaaaacattgggaataatgtttttttgccccaaaacagttaaatatgggcaaggaggtcagttcagactcgggggagcacttttgtttttttttttttttgagacagaattt

SEQ ID NO: 131418 - DNA, 601 bp, Human
caccatgttgaccaggctggtctcaaactcctgacctcaggtgatccccctgcctcggcctcccaaagtgctgggattgcaggcatgagccactgtgcctggcccgcactttcatttttaaccttattattctagaattggaagccgagcaaatggatggacttcagtcaggcagatctgaaataaaatttgcccatccatccatcccattcatccatacactcatccaacaaatacttaagtcctctatatgttgagattacggagaatattccattgtaaaccaattcctaaattcctsttcctatacagaacatttggagtttatcatttagagggagagtaaataaaataatcacaaattatggtaatctgtatgaataaaacaggaggccaaattagaggtcaatgggatgagagtgtataggtattatagataaggcaggtagagaagccttctatgagaaagtggcacttaagctgagacccaaaggacaagcagaaggtggccatgccaagagtggagaaaaacattccaggcagaaggaacagcaaaggctttgaggtaggaaagagtatcttgtatccaaggaatcaaaga

SEQ ID NO: 131419 - DNA, 601 bp, Human
tgagataatggtgcatacctcacagagttgctgaatttaatgggtattcaataagataacatgtagcttatttgaatcacttctacacaaaggtctctgagactctagttgggccctcatcactcaattgatttttctagtctcctgattgttttatgcacatttgagagccaaccatcactggagctagagaacattttccatccctgatatttccacatttaaagaggagagaatagacacagactctatctgctcatgttagaacctttagaaatcaaaaaagggaggggtggggagsggagagagagaaagaaagagaaatagtgagaaaataacatgagaggattttctttttaaaagtgtacttcctcatttacagaacaaattcataaaatttaaagtttgggtaaggttttgtttttgtttttacatttggggagagggtaaggtttggggctaagtgttcaggaaacagaataaagagaaatgaaataataatcactgagtatgcaatatataacagacagagtggttggcaagttatgtattttatcttatttaatctttacaagaatcctgatggagtaaatgaggccct

SEQ ID NO: 131420 - DNA, 601 bp, Human
cagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaaggtaacatgcccctaagttttgggcaggtgaggcccactgaggaacacacacaccttttgtcttggcagctgctccctcaggggcagggcatgcactacctgaatgtagagcttgacgatcttgcctgtctctttscatgcatcaccgtgtctggtacatggaatgttagagataaaggagactacccagtccaaccccttaactagatactgtgcctactttgtgagatgaaatatttcatatgttctaagggcatcatggtacttatggatagttgactgttacatgtatgtaatatgaaaatcatagcaatgaaaacaagtgttcattgccaaactactattttgagctttcttatttgatttttcatgtgatacattgctttgcttgtccctaaatacccttaatggaagttaatattttcaggagaaaatt

SEQ ID NO: 131421 - DNA, 601 bp, Human
tgttttataaagtacaatgatcctacctgaagtcctaaaaagcaacccagggcacagagtagaggtatgagagtggaagtcagacagatatgggttcgagtctacctctgcaactgagtggtgtggctcaggacaagttacttaattgaagtcatattttttcctcatgtgaaaagaaataaggatagagattttatcacacatatttggaaattaaatgaggcacttaactattaccaattacattatctgcttcacagtaaatgtttaacaactgattattgtaatttctttgagtaayaggtgagataattttccgactcaattgtagaaatttttactatgcattcacatattatggagttttacacaaaatggaaaaataggtatgttctctcctgtattttaacaataacagcatctcaggctgatgaacaggttctgtttttcttgctgaccatccagtgggggaaatctggtttgaggaaagtgaaatcctttatgatgaatcaggaaaaacctccaaaactatgttttcatgtcactattaattcgttattaaaacatcatggaaactcagaaatgcctgcctagggacaca

SEQ ID NO: 131422 - DNA, 601 bp, Human
tccagaccttatggaataaggaattatatttttagttaagttctgcccatgaattagcccatccaaatgatcttaagcaagttatcttccaacctaggcctcagcagtatcaaatttaaaatgaggtggttggaccttaaagccttctgagtgctaacattacataatctatgaaagcatccagagcgagattccttggttcaaatcctggctctcccatgtatatgctgtgtgatcttggacaggttacctagcttctctgtaccttaatttcctcatctgtaaaattaggataattgtrgtacctatctcatagggatattataaaaagtaatttttatttagttggagtctcgctctgttgcccaggctggagtgcagtagctcattacagtcttgattttttttttttttttgagatggagtctcactctgtcactgaggctggagtgcagtggcgcaatctcagctcactgcaagctccgcctcctgggttcacgccattctcctgcctaagcctcctgagtagctgggactacaggcgcccgctaccacgcccggctaattttttgtatttttagtagagatggagtttcaatgt

SEQ ID NO: 131423 - DNA, 601 bp, Human
ccatgtatatgctgtgtgatcttggacaggttacctagcttctctgtaccttaatttcctcatctgtaaaattaggataattgtagtacctatctcatagggatattataaaaagtaatttttatttagttggagtctcgctctgttgcccaggctggagtgcagtagctcattacagtcttgattttttttttttttttgagatggagtctcactctgtcactgaggctggagtgcagtggcgcaatctcagctcactgcaagctccgcctcctgggttcacgccattctcctgcctaarcctcctgagtagctgggactacaggcgcccgctaccacgcccggctaattttttgtatttttagtagagatggagtttcaatgtgttagccaggatgatgtcgatctcctgaccttgtgatctgcccaccttggcctcacaaagtgctgggattacaggcgtgagcaactacgcctggcctacagtcttgatttcttaagctcaagtgatcctcctgaacagctgggactacaagcatgtgctaccatacctagctaatttttaaatattttttttgtatggagcgggggtctcactgtg

SEQ ID NO: 131424 - DNA, 601 bp, Human
aagtgatcctcctgaacagctgggactacaagcatgtgctaccatacctagctaatttttaaatattttttttgtatggagcgggggtctcactgtgttgcctaggctggtctcaaactcctggccttaagagatcctcccaccttggcctcccaaaattttgggattagaagcatgagccaccgcccccaggttgacaattaaatttgtgtaaagtgcttataacagcacttggtccatagtaggtgctattaaaaggtatttatcgtttttatggcctagtcaagtcacataacatcartatatgtgtactgaatacaagccaggctcctgtgtcatcagaaagcccaaagtagaacatgaatgttggatttccttcgttagtactcagcagagagcaatcagcctagagacattcatgcagaggtaaactctggacagcagtgaaactctggtgtgataatgcccctaagaaaacgggagcttaaaaagcacagtcctaaataataaagagccacagagtggtggggggaaagctacttggaattgagcctactggggaaccttggttcctttcagaacacaatactgagtgagaagt

SEQ ID NO: 131425 - DNA, 601 bp, Human
ttctcacacaaaggagcagaaaatataaacaaaccatatagacaggaacaacagcatgaaatggtcagaaaaaaattctcgtaggagtccaggagcatgccacagagagcaagagctgcatgcatttggaggtctaaatgaagcacttggcaacgtgagcagaagccccacaaagacagcccccctcaccatccagtcccctgtctgctcttcctttatggctggctcattttagtgctctggagaaaagtgtccctcatgctcatatcacaaatgtcagcacagcagtgttgctgtttayattagaaggataccgacctcttctaggcacctcagggcttagcctacatcacttaatattactaacaacctttgaaggtaggtatcattacttttcaattacacatgagaaaactgagatttgcagaggtgaagcagctttcaaaaagggtggcagagggtggatccaagcccaggaatgtgtctgattccagcgctcgcactgctggaatgatctaccccgtgctctctctgggtttgcccccaggtcatcatctgcaccaaaggcattcacatacctgaccaccaggggagtctgtgc

SEQ ID NO: 131426 - DNA, 601 bp, Human
agtcccctgtctgctcttcctttatggctggctcattttagtgctctggagaaaagtgtccctcatgctcatatcacaaatgtcagcacagcagtgttgctgtttatattagaaggataccgacctcttctaggcacctcagggcttagcctacatcacttaatattactaacaacctttgaaggtaggtatcattacttttcaattacacatgagaaaactgagatttgcagaggtgaagcagctttcaaaaagggtggcagagggtggatccaagcccaggaatgtgtctgattccagygctcgcactgctggaatgatctaccccgtgctctctctgggtttgcccccaggtcatcatctgcaccaaaggcattcacatacctgaccaccaggggagtctgtgcaaggcacccatgctaggatccgcaggcacagcccacagccgatgaaagcaagcaggcaaacctaaagcccaggtccttctgagcatggttcggaggcatcttttgccctcacagggtagttgtctcagccagtggcgcgcacagcgcttgattagtctttctcaaaccaccatctgaaagccacggatgagatg

SEQ ID NO: 131427 - DNA, 601 bp, Human
gcaaggcacccatgctaggatccgcaggcacagcccacagccgatgaaagcaagcaggcaaacctaaagcccaggtccttctgagcatggttcggaggcatcttttgccctcacagggtagttgtctcagccagtggcgcgcacagcgcttgattagtctttctcaaaccaccatctgaaagccacggatgagatgagaatgagggcacagcgaccagctggttcatcacaaggtcctcagcaggatccctatgatcccaaggcttggtcctggtctgaatctttataggaattcttactytgggggacaggatgttttgctattaatttctaatttaggtgcattctggtcagagaattttgttattaacagagatgtgctttgtggataaacaggcaatgttctggtaaataatgtgtatttcaataactgagcaaggggttaatgaatattcaacagatctctaatagtgttattaaaatcttctaaatatttccttagtaattttcagtctttttgattaatttctgaaagtttccaccgtgttcacggatttgtcagtttctttaattctgacactttttgtttcatgagctttga

SEQ ID NO: 131428 - DNA, 601 bp, Human
taacaaggttttatcagttagtagatggttctgttttatcattacataatgaccatctatatccctaatttttagctttataataattttttctgtataaatgttgcaatactagctttatttagtattagtttgctatatatttttatatccctttattcacaatcttatgtgccattatgtcgaatgtatacttcatgaaagagcacacagttttatgtgtgtgtgtgttttagaattgagattctagaatctaagattttctgatctgaatttgatgtgagctcctgtcttttaacayacatttggcataatgtctgccaccttatcctatcttttccacaccatgattttctctggtcctttttttctcattttatgtcttttgtttccttatcttctctcttgccctcttgttgaggaaagttagatagactgtttctcttcctttagtggtgatccttatattgttaacattggcttaacttaaagcctaaagctaatgcctccttatgtcacagagtttggctttctgcagattatgatataagttaagggaattcagaaactcttgttgctggaagaaagttagaagatttta

SEQ ID NO: 131429 - DNA, 601 bp, Human
aaaataaaatctgaaacacttctggtcctaagtatctgagataagggatattcattctgaactaatcaacacaaagtcctcatctccccaaccactgaatagaaaaattgtgtataggcatattgtttgtatatatttacactcttataaaggaagtgaccatccctttcatcagattcttaaaaaggtacataatgttaagaaaggttaaaacgcattagccaccactgtttttcaccttccaaaaaccatctgacacctagcaagtgccagccctcattttctgagtctcaaagctcarttgctcctggagaaaatgtgtgatcccatttttggtatttgttttctctcttttaaaagcttccttcctaccagctactttaactatgactgtggacaagggagataacgtgaacatatctttcaaaaaggtattgattaaagaagaagatgcagtgatttacaaaaatggtgagtatgtgtttcattgctttccccagtatgatgtgagatatcagataacatacaacatattgaatcattttcctattgtggtcttgtgggcagatgtttgaattaaagctgctatgatgcaagcttt

SEQ ID NO: 131430 - DNA, 601 bp, Human; identical to SEQ ID NO: 19195

SEQ ID NO: 131431 - DNA, 601 bp, Human; identical to SEQ ID NO: 19196

SEQ ID NO: 131432 - DNA, 601 bp, Human; identical to SEQ ID NO: 19197

SEQ ID NO: 131433 - DNA, 601 bp, Human; identical to SEQ ID NO: 19198

SEQ ID NO: 131434 - DNA, 601 bp, Human; identical to SEQ ID NO: 19199

SEQ ID NO: 131435 - DNA, 601 bp, Human; identical to SEQ ID NO: 19200

SEQ ID NO: 131436 - DNA, 601 bp, Human; identical to SEQ ID NO: 19201

SEQ ID NO: 131437 - DNA, 601 bp, Human; identical to SEQ ID NO: 19202

SEQ ID NO: 131438 - DNA, 601 bp, Human; identical to SEQ ID NO: 19203

SEQ ID NO: 131439 - DNA, 601 bp, Human; identical to SEQ ID NO: 19204

SEQ ID NO: 131440 - DNA, 601 bp, Human; identical to SEQ ID NO: 19205

SEQ ID NO: 131441 - DNA, 601 bp, Human; identical to SEQ ID NO: 19206

SEQ ID NO: 131442 - DNA, 601 bp, Human; identical to SEQ ID NO: 19207

SEQ ID NO: 131443 - DNA, 601 bp, Human; identical to SEQ ID NO: 19208

SEQ ID NO: 131444 - DNA, 601 bp, Human; identical to SEQ ID NO: 19209

SEQ ID NO: 131445 - DNA, 601 bp, Human; identical to SEQ ID NO: 19210

SEQ ID NO: 131446 - DNA, 601 bp, Human; identical to SEQ ID NO: 19211

SEQ ID NO: 131447 - DNA, 601 bp, Human; identical to SEQ ID NO: 19212

SEQ ID NO: 131448 - DNA, 601 bp, Human; identical to SEQ ID NO: 19213

SEQ ID NO: 131449 - DNA, 601 bp, Human; identical to SEQ ID NO: 19214

SEQ ID NO: 131450 - DNA, 601 bp, Human; identical to SEQ ID NO: 19215

SEQ ID NO: 131451 - DNA, 601 bp, Human; identical to SEQ ID NO: 19216

SEQ ID NO: 131452 - DNA, 601 bp, Human; identical to SEQ ID NO: 19217

SEQ ID NO: 131453 - DNA, 601 bp, Human; identical to SEQ ID NO: 19218

SEQ ID NO: 131454 - DNA, 601 bp, Human; identical to SEQ ID NO: 19219

SEQ ID NO: 131455 - DNA, 601 bp, Human; identical to SEQ ID NO: 19220

SEQ ID NO: 131456 - DNA, 601 bp, Human; identical to SEQ ID NO: 19221

SEQ ID NO: 131457 - DNA, 601 bp, Human; identical to SEQ ID NO: 19222

SEQ ID NO: 131458 - DNA, 601 bp, Human; identical to SEQ ID NO: 19223

SEQ ID NO: 131459 - DNA, 601 bp, Human; identical to SEQ ID NO: 19224

SEQ ID NO: 131460 - DNA, 601 bp, Human; identical to SEQ ID NO: 19225

SEQ ID NO: 131461 - DNA, 601 bp, Human; identical to SEQ ID NO: 19226

SEQ ID NO: 131462 - DNA, 601 bp, Human; identical to SEQ ID NO: 19227

SEQ ID NO: 131463 - DNA, 601 bp, Human; identical to SEQ ID NO: 19228

SEQ ID NO: 131464 - DNA, 601 bp, Human; identical to SEQ ID NO: 19229

SEQ ID NO: 131465 - DNA, 601 bp, Human; identical to SEQ ID NO: 19230

SEQ ID NO: 131466 - DNA, 601 bp, Human; identical to SEQ ID NO: 19231

SEQ ID NO: 131467 - DNA, 601 bp, Human; identical to SEQ ID NO: 19232

SEQ ID NO: 131468 - DNA, 601 bp, Human; identical to SEQ ID NO: 19233

SEQ ID NO: 131469 - DNA, 601 bp, Human; identical to SEQ ID NO: 19234

SEQ ID NO: 131470 - DNA, 601 bp, Human; identical to SEQ ID NO: 19235

SEQ ID NO: 131471 - DNA, 601 bp, Human; identical to SEQ ID NO: 19236

SEQ ID NO: 131472 - DNA, 601 bp, Human; identical to SEQ ID NO: 19237

SEQ ID NO: 131473 - DNA, 601 bp, Human; identical to SEQ ID NO: 19238

SEQ ID NO: 131474 - DNA, 601 bp, Human; identical to SEQ ID NO: 19239

SEQ ID NO: 131475 - DNA, 601 bp, Human; identical to SEQ ID NO: 19240

SEQ ID NO: 131476 - DNA, 601 bp, Human; identical to SEQ ID NO: 19241

SEQ ID NO: 131477 - DNA, 601 bp, Human; identical to SEQ ID NO: 19242

SEQ ID NO: 131478 - DNA, 601 bp, Human; identical to SEQ ID NO: 19243

SEQ ID NO: 131479 - DNA, 601 bp, Human; identical to SEQ ID NO: 19244

SEQ ID NO: 131480 - DNA, 601 bp, Human; identical to SEQ ID NO: 19245

SEQ ID NO: 131481 - DNA, 601 bp, Human; identical to SEQ ID NO: 19246

SEQ ID NO: 131482 - DNA, 601 bp, Human; identical to SEQ ID NO: 19247

SEQ ID NO: 131483 - DNA, 601 bp, Human; identical to SEQ ID NO: 19248

SEQ ID NO: 131484 - DNA, 601 bp, Human; identical to SEQ ID NO: 19249

SEQ ID NO: 131485 - DNA, 601 bp, Human; identical to SEQ ID NO: 19250

SEQ ID NO: 131486 - DNA, 601 bp, Human; identical to SEQ ID NO: 19251

SEQ ID NO: 131487 - DNA, 601 bp, Human; identical to SEQ ID NO: 19252

SEQ ID NO: 131488 - DNA, 601 bp, Human; identical to SEQ ID NO: 19253

SEQ ID NO: 131489 - DNA, 601 bp, Human; identical to SEQ ID NO: 19254

SEQ ID NO: 131490 - DNA, 601 bp, Human; identical to SEQ ID NO: 19255

SEQ ID NO: 131491 - DNA, 601 bp, Human; identical to SEQ ID NO: 19256

SEQ ID NO: 131492 - DNA, 601 bp, Human; identical to SEQ ID NO: 19257

SEQ ID NO: 131493 - DNA, 601 bp, Human; identical to SEQ ID NO: 19258

SEQ ID NO: 131494 - DNA, 601 bp, Human; identical to SEQ ID NO: 19259

SEQ ID NO: 131495 - DNA, 601 bp, Human; identical to SEQ ID NO: 19260

SEQ ID NO: 131496 - DNA, 601 bp, Human; identical to SEQ ID NO: 19261

SEQ ID NO: 131497 - DNA, 601 bp, Human; identical to SEQ ID NO: 19262

SEQ ID NO: 131498 - DNA, 601 bp, Human; identical to SEQ ID NO: 19263

SEQ ID NO: 131499 - DNA, 601 bp, Human; identical to SEQ ID NO: 19264

SEQ ID NO: 131500 - DNA, 601 bp, Human; identical to SEQ ID NO: 19265

SEQ ID NO: 131501 - DNA, 601 bp, Human; identical to SEQ ID NO: 19266

SEQ ID NO: 131502 - DNA, 601 bp, Human; identical to SEQ ID NO: 19267

SEQ ID NO: 131503 - DNA, 601 bp, Human; identical to SEQ ID NO: 19268

SEQ ID NO: 131504 - DNA, 601 bp, Human; identical to SEQ ID NO: 19269

SEQ ID NO: 131505 - DNA, 601 bp, Human; identical to SEQ ID NO: 19270

SEQ ID NO: 131506 - DNA, 601 bp, Human; identical to SEQ ID NO: 19271

SEQ ID NO: 131507 - DNA, 601 bp, Human; identical to SEQ ID NO: 19272

SEQ ID NO: 131508 - DNA, 601 bp, Human; identical to SEQ ID NO: 19273

SEQ ID NO: 131509 - DNA, 601 bp, Human; identical to SEQ ID NO: 19274

SEQ ID NO: 131510 - DNA, 601 bp, Human; identical to SEQ ID NO: 19275

SEQ ID NO: 131511 - DNA, 601 bp, Human; identical to SEQ ID NO: 19276

SEQ ID NO: 131512 - DNA, 601 bp, Human; identical to SEQ ID NO: 19277

SEQ ID NO: 131513 - DNA, 601 bp, Human; identical to SEQ ID NO: 19278

SEQ ID NO: 131514 - DNA, 601 bp, Human; identical to SEQ ID NO: 19279

SEQ ID NO: 131515 - DNA, 601 bp, Human; identical to SEQ ID NO: 19280

SEQ ID NO: 131516 - DNA, 601 bp, Human; identical to SEQ ID NO: 19281

SEQ ID NO: 131517 - DNA, 601 bp, Human; identical to SEQ ID NO: 19282

SEQ ID NO: 131518 - DNA, 601 bp, Human; identical to SEQ ID NO: 19283

SEQ ID NO: 131519 - DNA, 601 bp, Human; identical to SEQ ID NO: 19284

SEQ ID NO: 131520 - DNA, 601 bp, Human; identical to SEQ ID NO: 19285

SEQ ID NO: 131521 - DNA, 601 bp, Human; identical to SEQ ID NO: 19286

SEQ ID NO: 131522 - DNA, 601 bp, Human; identical to SEQ ID NO: 19287

SEQ ID NO: 131523 - DNA, 601 bp, Human; identical to SEQ ID NO: 19288

SEQ ID NO: 131524 - DNA, 601 bp, Human; identical to SEQ ID NO: 19289

SEQ ID NO: 131525 - DNA, 601 bp, Human; identical to SEQ ID NO: 19290

SEQ ID NO: 131526 - DNA, 601 bp, Human; identical to SEQ ID NO: 19291

SEQ ID NO: 131527 - DNA, 601 bp, Human; identical to SEQ ID NO: 19292

SEQ ID NO: 131528 - DNA, 601 bp, Human; identical to SEQ ID NO: 19293

SEQ ID NO: 131529 - DNA, 601 bp, Human; identical to SEQ ID NO: 19294

SEQ ID NO: 131530 - DNA, 601 bp, Human; identical to SEQ ID NO: 19295

SEQ ID NO: 131531 - DNA, 601 bp, Human; identical to SEQ ID NO: 19296

SEQ ID NO: 131532 - DNA, 601 bp, Human; identical to SEQ ID NO: 19297

SEQ ID NO: 131533 - DNA, 601 bp, Human; identical to SEQ ID NO: 19298

SEQ ID NO: 131534 - DNA, 601 bp, Human; identical to SEQ ID NO: 19299

SEQ ID NO: 131535 - DNA, 601 bp, Human; identical to SEQ ID NO: 19300

SEQ ID NO: 131536 - DNA, 601 bp, Human; identical to SEQ ID NO: 19301

SEQ ID NO: 131537 - DNA, 601 bp, Human; identical to SEQ ID NO: 19302

SEQ ID NO: 131538 - DNA, 601 bp, Human; identical to SEQ ID NO: 19303

SEQ ID NO: 131539 - DNA, 601 bp, Human; identical to SEQ ID NO: 19304

SEQ ID NO: 131540 - DNA, 601 bp, Human; identical to SEQ ID NO: 19305

SEQ ID NO: 131541 - DNA, 601 bp, Human; identical to SEQ ID NO: 19306

SEQ ID NO: 131542 - DNA, 601 bp, Human; identical to SEQ ID NO: 19307

SEQ ID NO: 131543 - DNA, 601 bp, Human; identical to SEQ ID NO: 19308

SEQ ID NO: 131544 - DNA, 601 bp, Human; identical to SEQ ID NO: 19309

SEQ ID NO: 131545 - DNA, 601 bp, Human; identical to SEQ ID NO: 19310

SEQ ID NO: 131546 - DNA, 601 bp, Human; identical to SEQ ID NO: 19311

SEQ ID NO: 131547 - DNA, 601 bp, Human
acttcaaacaatataaaaatttaaaaagaaaaagatacttccaaagtactagccgaagataatcattttaacgctgtgttaaaccatgcttccagatatctttctgaacatatttttgatatactgtgcaattcaatatcaatttataattttgtgtagctatagaatcagaaattttatacagtaacctattatatctcgttggcggtcttgttttctatgtgccattatttaaactgacttttactgctatataaaaaagactttacaactactatataaaaaatactaaatatgttgygaagtattaccacataggactgagcaatgaggatttgatgtacaaatgtacttgccctttgggtagtaatgcttatactctttaaagggacagtcatatagttatcattttcttcataaatgtaaacattttcttgttctctcttgtagatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatc

SEQ ID NO: 131548 - DNA, 601 bp, Human
gaagaagcctattctaaggaaaagtcttcaaagaaagggaaggggaaaaagaagcagtatctatgcccatcgtatgttcttcatgtcttatattcttatatggagaaatgttattgcgtgttttataaaagtaaggtggtttatgaagacacacatcaacaaaacttttcatatcggaatgtatatccatctgttacagagacagaaaatgatagggtgaggagaggtttagaatgtaagaattaattcccaatgttcaaggtggttttatagttttctttttttaaatcatgccatgggyttatataatttttatacactgtttacaaaagtagaaaaagtcactatttttttcttatgctaaatgtgctgtgcaactttaattggatactgatatactgtgttttgagcaaataccagttcaaaaagtttttttttaaaaaaaccctaaaatatttaataatattttatttaaaagtcagataggtaactgtgatcttaaggtcagttcatatgtatgcatggcaaaaggaaattcatatgatagatcaattttctaatttagtaattgtaaataggttatattaggagattaggatat

SEQ ID NO: 131549 - DNA, 601 bp, Human
tactcctcaggatggtaaaattcttgcccagtgatgttttcatttgtttatacttttttttttttgagtagagtggatgaagcaatgtgggtgcatagacataagcagttcatgtgcagcaatccagagtgaaatcttccagttttactgttataacaacatttcccctcaagactgtaaatagaggaaacatgttttaaaatgtaggagaaataaaggacttgagttccttgatattctaggatttaatattgatgctgagcttgagtcagatcataaacttttcttggcctctttgctstttcttttttctaacctgttgtcttttgatatgtaagtgaagcactagtaccagattgacaaagtatctgataaatttgcttccaaaaacttagaaatttaatatgtgttaacaaataagaaatacactttaaattaataaaaatattttaggtaagtccttggacagttacctttttattttacagcttacatttgacattgcctttaatcttttggtctttcctctgatttttcattctacctgagtgattttgtagaaatccatggttgtagttaccatctactcactgttaactcc

SEQ ID NO: 131550 - DNA, 601 bp, Human
tctgatacctccagcagtatcttccccatcccgacccctgcctctgcctaagcctcacacgcatcaactctcatatacccgtgctctttcacatctctgcaagtgttcttccctttccctgaaatgccaatgtttttcttctttttagttagcctgtgtccatgggtctcatccaaattcatggctgtaactaccacttactgttgatttctatgtctgtatatacagcccgtacctctttgaagagcaccacacccatacatccaacattttaatctgattgtttcataatgacctcaarcttaactcagactcaaaccctattgtcttctttgggaaacctttcctaatcctgaggatttagataatcacattctgtgcccccacagttccccaattgccactcatacataatacagtatgataattatctattgtaattgtctgctttccccactagattgtaagctccatgagagcagtgtcttcattaccttaatcaccagcaagcaacatagctcctggcacaaaatatacatataataaaaatttatttaatgaagtgaataaaaacctaaagatctttgactatctcttatta

SEQ ID NO: 131551 - DNA, 601 bp, Human
ccgtgcctggcctgtattttcatgttgttattcttatgtttaaaaacttacaatatcgtactaccagatggttcttgaactccagtacatacttcttaccttgattttcaaggggctccctaacttatatttctaaatttatgtgaaacaactctcttatattatgtgtgtaggtatgtatatatgaatgtatgtttttagagacaggatcttactctgttgcccaggctggagttcagtggtgtgatcatagctcattgcaacctcaaactcctggtgtcaagtggtcctcccgccttgktctcccaaagacttcgcgttacaggtatcagccatacccaagcctactcgcctattttgggaaggcttatctgccgttgttcctaatcttcccttgctattatgtatgcttggacatgtttatgtttggaatgacaacttcttgcttaatatatctaggctttactagtccctcagagctcatcttagatattactttgctttataaaacatttaaaataagttttagttgagaatatgattaatctgaattaatagtggtgtggcttactaatgctttgatgtcttggatattgataga

SEQ ID NO: 131552 - DNA, 601 bp, Human
gaactccagtacatacttcttaccttgattttcaaggggctccctaacttatatttctaaatttatgtgaaacaactctcttatattatgtgtgtaggtatgtatatatgaatgtatgtttttagagacaggatcttactctgttgcccaggctggagttcagtggtgtgatcatagctcattgcaacctcaaactcctggtgtcaagtggtcctcccgccttgttctcccaaagacttcgcgttacaggtatcagccatacccaagcctactcgcctattttgggaaggcttatctgccrttgttcctaatcttcccttgctattatgtatgcttggacatgtttatgtttggaatgacaacttcttgcttaatatatctaggctttactagtccctcagagctcatcttagatattactttgctttataaaacatttaaaataagttttagttgagaatatgattaatctgaattaatagtggtgtggcttactaatgctttgatgtcttggatattgatagaaatacaatgtttagaaataaaaaagtattaatctcatggtgagtatattacctgaagcattatgttgaattctggt

SEQ ID NO: 131553 - DNA, 601 bp, Human
gccatatcttttatgatacaatgcggttttgtttacgattgctttggtaactttataatcagggttaactattttagtgttttgttggtgctttttgttccccaatttttaaccattcaagcctgaccagtggaaaaagaatacacaaaattctatttcttggggaagttaactccaaaggaaatctaattccagagttgatttatcaaaacataggtatttaactgaactccaaagtagaagagtaaggtatgaggaaggtgaattgtctgcattcttagcctaccaaattttcacagawtaaggaattcgacttactgaaatgtatccttttttttttcttgtggaggcaaataatttctgtaatacagtaaaaaaaggtatatttgcaaaagtctcctatattttccttatgcttctacctgaaatagacatatcattgctctgctaaagagagctgaggtccctttataaatgaattcctttaccatgggtattttatggaagtttacacttagaattcatgaagccaattattcaaatttatgtacatacaaatggttcctctgagaaatgatgtaaatatgaaataatattttta

SEQ ID NO: 131554 - DNA, 601 bp, Human
tccagtatcttctcctgccatgctgcacttcttggtgttcctgggcagcctgatctcttcgtgacactattctgttgtctattctttaacttcttcctagggtttgtcctgtcctttcccccttaatctgttacatccctccttatccttctagtcccagctaagtcaactactctatgaactccctgccattaacactatacaaaatcaaatgctacaaaaaatcaatgatgataaatttaaggtgaaattggttgaattaatatggaggagaaaatattggactgaaaattcaggagayttgtgttctagctgactgttactgaccaatagtgcatcctcagataattctttttgggataagtgtcctgatctttaagataaaatcattaacaatgtgatttcttagggtaattgagataaaagtttattctggggtttttaatagatggaaatggtatttttgagtaaaaagagataggttctactttagaatagatcacttaatacatttgtgacctagaataagcaatcagtttgcttctctaagactttatctgtaaaacagaaataagaatctgtacctattcacacagcttct

SEQ ID NO: 131555 - DNA, 601 bp, Human
ccatgctgcacttcttggtgttcctgggcagcctgatctcttcgtgacactattctgttgtctattctttaacttcttcctagggtttgtcctgtcctttcccccttaatctgttacatccctccttatccttctagtcccagctaagtcaactactctatgaactccctgccattaacactatacaaaatcaaatgctacaaaaaatcaatgatgataaatttaaggtgaaattggttgaattaatatggaggagaaaatattggactgaaaattcaggagatttgtgttctagctgaccgttactgaccaatagtgcatcctcagataattctttttgggataagtgtcctgatctttaagataaaatcattaacaatgtgatttcttagggtaattgagataaaagtttattctggggtttttaatagatggaaatggtatttttgagtaaaaagagataggttctactttagaatagatcacttaatacatttgtgacctagaataagcaatcagtttgcttctctaagactttatctgtaaaacagaaataagaatctgtacctattcacacagcttctctgatagtataatttgg

SEQ ID NO: 131556 - DNA, 601 bp, Human
aaatttaaggtgaaattggttgaattaatatggaggagaaaatattggactgaaaattcaggagatttgtgttctagctgactgttactgaccaatagtgcatcctcagataattctttttgggataagtgtcctgatctttaagataaaatcattaacaatgtgatttcttagggtaattgagataaaagtttattctggggtttttaatagatggaaatggtatttttgagtaaaaagagataggttctactttagaatagatcacttaatacatttgtgacctagaataagcaatcastttgcttctctaagactttatctgtaaaacagaaataagaatctgtacctattcacacagcttctctgatagtataatttggaattatatgtaaaattattttctaactgtaatattctacaagttggattacctatgtttgtgatagtagaacctctttaaagagttcaaagtggttttgcatgtttactattactcttggtctcgtttttatttttttgaccattagttaagctaatagttaaatatagaacacctaattatggggaaaatatctgggtcaccttattacacatagct

SEQ ID NO: 131557 - DNA, 601 bp, Human
aagcgaagtataaaatatatagttctggccaggcgcagtgactcacacctgtaatcccagcactttgggaggctgaggtgggctgatcacgagatcaagagatcacgaggtcaagagatcgagaccatcctggccaacatgctgaaaccctgtctctactaaaaatacaaaaatcagctaggcgtggtggcacatgcctttagtcccagctacttgggaggctgaggcagaagaatcgcttgaacccgggaggcggaggttgcagtgagctgagatcgtgccactgcactccaggctgggygacagagcgagactccatctcaaaaaaaaaaaaaaaaaaaaaaatacatggttccccttggctctgctttcaagggataaaaagcaatagagtagttcttcagagagagaaaagtgagttatcttttaaaccaccgtgaaaaatttagatacaggcatttactttctcatatagaatattacatagagacttagttttaactgatcaaagattataatatcatattttaattgctttatgcaatctctctctgtctttctgcctcaatctgtctatgcatgtgtttgctctctgtatatg

SEQ ID NO: 131558 - DNA, 601 bp, Human
tctggccaggcgcagtgactcacacctgtaatcccagcactttgggaggctgaggtgggctgatcacgagatcaagagatcacgaggtcaagagatcgagaccatcctggccaacatgctgaaaccctgtctctactaaaaatacaaaaatcagctaggcgtggtggcacatgcctttagtcccagctacttgggaggctgaggcagaagaatcgcttgaacccgggaggcggaggttgcagtgagctgagatcgtgccactgcactccaggctgggcgacagagcgagactccatctcaraaaaaaaaaaaaaaaaaaaaatacatggttccccttggctctgctttcaagggataaaaagcaatagagtagttcttcagagagagaaaagtgagttatcttttaaaccaccgtgaaaaatttagatacaggcatttactttctcatatagaatattacatagagacttagttttaactgatcaaagattataatatcatattttaattgctttatgcaatctctctctgtctttctgcctcaatctgtctatgcatgtgtttgctctctgtatatgtgacacacaaataattaagcaca

SEQ ID NO: 131559 - DNA, 601 bp, Human
acacctgtaatcccagcactttgggaggctgaggtgggctgatcacgagatcaagagatcacgaggtcaagagatcgagaccatcctggccaacatgctgaaaccctgtctctactaaaaatacaaaaatcagctaggcgtggtggcacatgcctttagtcccagctacttgggaggctgaggcagaagaatcgcttgaacccgggaggcggaggttgcagtgagctgagatcgtgccactgcactccaggctgggcgacagagcgagactccatctcaaaaaaaaaaaaaaaaaaaaaawtacatggttccccttggctctgctttcaagggataaaaagcaatagagtagttcttcagagagagaaaagtgagttatcttttaaaccaccgtgaaaaatttagatacaggcatttactttctcatatagaatattacatagagacttagttttaactgatcaaagattataatatcatattttaattgctttatgcaatctctctctgtctttctgcctcaatctgtctatgcatgtgtttgctctctgtatatgtgacacacaaataattaagcacaagtttttttgggcatttattt

SEQ ID NO: 131560 - DNA, 601 bp, Human
gatcaagagatcacgaggtcaagagatcgagaccatcctggccaacatgctgaaaccctgtctctactaaaaatacaaaaatcagctaggcgtggtggcacatgcctttagtcccagctacttgggaggctgaggcagaagaatcgcttgaacccgggaggcggaggttgcagtgagctgagatcgtgccactgcactccaggctgggcgacagagcgagactccatctcaaaaaaaaaaaaaaaaaaaaaaatacatggttccccttggctctgctttcaagggataaaaagcaatagastagttcttcagagagagaaaagtgagttatcttttaaaccaccgtgaaaaatttagatacaggcatttactttctcatatagaatattacatagagacttagttttaactgatcaaagattataatatcatattttaattgctttatgcaatctctctctgtctttctgcctcaatctgtctatgcatgtgtttgctctctgtatatgtgacacacaaataattaagcacaagtttttttgggcatttatttttaaacctttttgaagtatgtataatatgcatatagaaaagtgcacca

SEQ ID NO: 131561 - DNA, 601 bp, Human
atcagctaggcgtggtggcacatgcctttagtcccagctacttgggaggctgaggcagaagaatcgcttgaacccgggaggcggaggttgcagtgagctgagatcgtgccactgcactccaggctgggcgacagagcgagactccatctcaaaaaaaaaaaaaaaaaaaaaaatacatggttccccttggctctgctttcaagggataaaaagcaatagagtagttcttcagagagagaaaagtgagttatcttttaaaccaccgtgaaaaatttagatacaggcatttactttctcatayagaatattacatagagacttagttttaactgatcaaagattataatatcatattttaattgctttatgcaatctctctctgtctttctgcctcaatctgtctatgcatgtgtttgctctctgtatatgtgacacacaaataattaagcacaagtttttttgggcatttatttttaaacctttttgaagtatgtataatatgcatatagaaaagtgcaccaatcataagctttaataaatgttcaccttggtaaccagcacacggatctagaaacagaacatgtccaaaacattagacatc

SEQ ID NO: 131562 - DNA, 601 bp, Human
ctctatgtcaaaaggtgaagtaggggctgggggcagtggctcatgcctgtaatcccagcactttgggaggccaaggcgggtggatcacaaggtcaggagtttgagaccagcctggccaacatagtgaaaccccgtctctactaacttgtgcatggggatgcacgcctgtagtcccggctactcaggaggctgatacaggagaatcccttgaacccgggaggcaaggttgtggtaagctgagatcacgccactgcactccagtctgggcaaaagagagagactccgtctcaaaaaaacaaamaaaaaaaaaaaagaaagtgaagtagggacaatagggacacaaaggcactcaaatgctcagcctctgtgaaactgcccaaaaccagtccatggccagtggtcttcttatcaggagaaagttgctgaaatcagtctctcgtccaatcacagctgtagttatggcttgtggaacagggggtcagttagtcaatgtctggtggtgagctgcagttctttaattgtgcttaccttgaggccagtgcttgtttagctgctaaagaaaagttaaaatcttatggcagttagaacatagtttatactt

SEQ ID NO: 131563 - DNA, 601 bp, Human
acttactatactatccactccaatctagcctctttctcaactgaaaaaaagttctttcttttgctgaatcccatggaaagctttcagtcctcatctcaacctctcagcaacttttggccctgttagccaactctttcatgaaatattcttttttttccttgagttctgttggtgccacacactgctggatttaccccttcttcctgggctatttattctttgaattattggcttatcttttcctatctgcttattaaatattgcaattcctcacatttcaattccatgtctttttttttttaaccataaactctcttttcaaacaagtgattcttctgataattaaaatcatctgaagagctttttaaaaaccctgatgcccgggccacatccaaaactaattaaatctagatatgggtgatgggatgaggtatcagtaatttctagaattcctcagctgaatccaatctgtttccaaccttgagaatccataaacaaatttatctaaactcacagctttaaataccattttttttatatcagaataaagatcatgtatgtttgattctcaagtgcataacctgtacatagcaagtgcatg

SEQ ID NO: 131564 - DNA, 601 bp, Human
atattcttttttttccttgagttctgttggtgccacacactgctggatttaccccttcttcctgggctatttattctttgaattattggcttatcttttcctatctgcttattaaatattgcaattcctcacatttcaattccatgtctttttttttttaaccataaactctcttttcaaacaagtgattcttctgataattaaaatcatctgaagagctttttaaaaaccctgatgcccgggccacatccaaaactaattaaatctagatatgggtgatgggatgaggtatcagtaattkctagaattcctcagctgaatccaatctgtttccaaccttgagaatccataaacaaatttatctaaactcacagctttaaataccattttttttatatcagaataaagatcatgtatgtttgattctcaagtgcataacctgtacatagcaagtgcatggcacataggaaattctctgaaactgttaaatgaattaaggaatgactaaagtgagagagaaatttagcatattggtggttgcataactggtaaagctccttaaggaaacttagtatttagttgatgttgtaggttgaattct

SEQ ID NO: 131565 - DNA, 601 bp, Human
ggtgccacacactgctggatttaccccttcttcctgggctatttattctttgaattattggcttatcttttcctatctgcttattaaatattgcaattcctcacatttcaattccatgtctttttttttttaaccataaactctcttttcaaacaagtgattcttctgataattaaaatcatctgaagagctttttaaaaaccctgatgcccgggccacatccaaaactaattaaatctagatatgggtgatgggatgaggtatcagtaatttctagaattcctcagctgaatccaatctrtttccaaccttgagaatccataaacaaatttatctaaactcacagctttaaataccattttttttatatcagaataaagatcatgtatgtttgattctcaagtgcataacctgtacatagcaagtgcatggcacataggaaattctctgaaactgttaaatgaattaaggaatgactaaagtgagagagaaatttagcatattggtggttgcataactggtaaagctccttaaggaaacttagtatttagttgatgttgtaggttgaattctcttagagacagagacattgagatgaaaa

SEQ ID NO: 131566 - DNA, 601 bp, Human
gtacttgctgggccaggatgtaattctattctgtagagtatggaaagtaatggcacagtaaacattgtgtttggattgaggtttaactctttatgtcaaagaggtttggagatcattagcaaacccattagaattagtgagaatgtataatgttttacagttgagcaatatacggtataaatagaagatacttctacatggttgtcatagaatgagtaatctcacatgagatatgaagttaaaagtgaccaacagatagccttcaatgagatttgcaaattgctggtattaaaaatctagyatctctccagatagttgcttctactttatgcaaaatattttttctttgagccatggatgatgtaattgtataattggagctagagaagatttgaaaatgtttccacaggctacaacagttcctgaaacccaggtgaggggataaataacatgaatgttgtggaacactcttcttaattatgactcttggcccataataacatgacagactttgccacacacatacacacactcataaacacattcttttcaaataagtttaaactaaactaatcatgtaaaaggtatcactcactgtctg

SEQ ID NO: 131567 - DNA, 601 bp, Human
ttattttagaatagctttatagagttatagaaaaatttccaaggtagtacagagagttcccaaataccctgcacctaattttctctatttttatttttctttagtatggtgcttttatttattttttacaattaaagagctaatattaatagaatattaataagtcaaggccattctttattcagacctctttggtctttaccttaagtcgttttctgtcacaggatcccttccaggatactatgttacatagttgtcatgccttcttgtgcttctcttggccgtgacagtcactcacacrttacttacttttgatgactgtgagagtttagtaaagtatctgtcaaatattttgtggatgtccttcagatgggatttatcggatgtgtttcccatgactagactaggttatgtggtttttgagaggaagacccgcgggttaaaatgtgattcttatcacatcatatcaagggtccatattatcaacatgacttatcacggttgaggttaacttgatcacctgctgaggagagtgcccgtggagtttctctgccataaagttactctttccgcacccccctttgcagactgaactctttgg

SEQ ID NO: 131568 - DNA, 601 bp, Human
cttctcttggccgtgacagtcactcacacgttacttacttttgatgactgtgagagtttagtaaagtatctgtcaaatattttgtggatgtccttcagatgggatttatcggatgtgtttcccatgactagactaggttatgtggtttttgagaggaagacccgcgggttaaaatgtgattcttatcacatcatatcaagggtccatattatcaacatgacttatcacggttgaggttaacttgatcacctgctgaggagagtgcccgtggagtttctctgccataaagttactctttccrcacccccctttgcagactgaactctttggaagggagtcactatgcacagctcacactaaggagtggggagttattttccaccaattagaaagcagaagatctacaccaattatttggaattcttcatgagtgatttgtctatatttccccatttattcaattcttatttttatctgtatggactctggaatttttattttgtactataatacaatactactttattttgttgctcaaatcattgcagctttggccattgggaaccctctcagtttgttccggtgtccttccattgacata

SEQ ID NO: 131569 - DNA, 601 bp, Human
actcacacgttacttacttttgatgactgtgagagtttagtaaagtatctgtcaaatattttgtggatgtccttcagatgggatttatcggatgtgtttcccatgactagactaggttatgtggtttttgagaggaagacccgcgggttaaaatgtgattcttatcacatcatatcaagggtccatattatcaacatgacttatcacggttgaggttaacttgatcacctgctgaggagagtgcccgtggagtttctctgccataaagttactctttccgcacccccctttgcagactgarctctttggaagggagtcactatgcacagctcacactaaggagtggggagttattttccaccaattagaaagcagaagatctacaccaattatttggaattcttcatgagtgatttgtctatatttccccatttattcaattcttatttttatctgtatggactctggaatttttattttgtactataatacaatactactttattttgttgctcaaatcattgcagctttggccattgggaaccctctcagtttgttccggtgtccttccattgacatatttccattatggtgttttttt

SEQ ID NO: 131570 - DNA, 601 bp, Human
gccataaagttactctttccgcacccccctttgcagactgaactctttggaagggagtcactatgcacagctcacactaaggagtggggagttattttccaccaattagaaagcagaagatctacaccaattatttggaattcttcatgagtgatttgtctatatttccccatttattcaattcttatttttatctgtatggactctggaatttttattttgtactataatacaatactactttattttgttgctcaaatcattgcagctttggccattgggaaccctctcagtttgttcyggtgtccttccattgacatatttccattatggtgttttttttttttttttttcctgaacacttctttaatttctgttactgtaagatacctgctctttaaaaaaaaattgtcttctcatttcactttatatgaggttaccagctttaaaataatgactaataacatcacggttgccactatttatagttatattgttttctttgatataattcctttctgagtccttttagtgtagtattcagaaagggaatcttccatctaaaacctccaccaacaataataccttatgttttcttgta

SEQ ID NO: 131571 - DNA, 601 bp, Human
catctctgtatttctaatacaaataaatgtgaattgttgattaaacatttatgccaagttacctgcagctgagacatgaaaatatatattgacacaaataagaatagaagaaaaggggccatatgatatttggtatattccctgggttgtttttttgttgttgtttgtttgcttgtttgattttcaaaagatttttgtcaaacaatgttgagtttttgttgctaacgaacaaaaatttgtttttaacagtggagagttgaaaaacatttggagatggtagaagagtgaactgatagaaagrgccaatttatattttcagtactaatgatttttaacaatgcttagtaaaatgaatagaactcaaggtaaaatacatatgccctaaagcaatatgtgtatggatggtaataagaagatagataatatttcacttacactatggcaggcttaccatggagcaggtttcattcttggctctaccaccttagaaaaatctcttaaccctgctgtcttagtttcttcatacaccatgtactctacaggttcatttacttacctcttactcttctaccaatgtttttctaccattatctccctcaaa

SEQ ID NO: 131572 - DNA, 601 bp, Human
gctagtagttcagcaatggtcaatgctgggaagattctgagggtgggggaagtcattactcctaagagagtgccacaggacaaaatgttcttcttcctctggaaataacgagtggaactgcttaccccttacagcacaggcaacatgaggctgaaatatacctagaagagatggcagattggaagtacttgaaccaatgtgtatttaatactataaaaacagtagggaactacagatatatagaagccatgaatccctcaataatcatactgttttcattttgtctagttggtaatatacycgtagataagaaaagaaaagctacaaaatcattgccaaacaatatatttattagttcatgtttattagagtaaggttgcatggttgatgcaagattttacaaagaagatgaggtttaaaaggacaggtttggtttagattagtacaataaagaatggaagttacaatattccaggaagagagactgattctgtggaagaaggacaaaatttggtagtgagataaagggctaaaaatgagtttgactgacacagcctacagctagaagcagaaaaatcagctggaaagttctaaactacaa

SEQ ID NO: 131573 - DNA, 601 bp, Human
taaaaacagtagggaactacagatatatagaagccatgaatccctcaataatcatactgttttcattttgtctagttggtaatatactcgtagataagaaaagaaaagctacaaaatcattgccaaacaatatatttattagttcatgtttattagagtaaggttgcatggttgatgcaagattttacaaagaagatgaggtttaaaaggacaggtttggtttagattagtacaataaagaatggaagttacaatattccaggaagagagactgattctgtggaagaaggacaaaatttgktagtgagataaagggctaaaaatgagtttgactgacacagcctacagctagaagcagaaaaatcagctggaaagttctaaactacaaaatttagtgttaattgtcttcatgttgtcttttcattgtttagaaggaatgtacttgtaaaagattttatatgaagagacacaataacagcagtcctgaattgatccaatacaagtgtattttgtaatcaatcaattcttttacttcctttgaatgagaaaacttgtagataggtttgaacgctaatttgcatcctaatatccaattttccca

SEQ ID NO: 131574 - DNA, 601 bp, Human
aaccaaacactgcgtgttctcattcataggtgggaattgaacaatgagaacatatggacacaggaaggggaacatcacattctggggactgttgtggggtggggggaggggggtgggatagctttaggagatatacctaatgctaaatgacaagttaatgggtgcagcacaccagcatggcacatgtatacatatgtaactaacctgcacattgtgcacacataccctaaaacttaaaatataataataataaaataaaataaaataataaaataaaataaataaaaaaaagaagaaaaarccatactatagttgtggatttgtctcaaaaaggcagtctttcctcccaatgagaattacccatttctgttgtttgctatttataactacttatcaggatttttctctctcttatagtcagcagtcagcagaggaccttgcccgagtacctgccaactccactagcaatatcttgaacaggttattggtcagttatgatcccaggataagaccaaacttcaaaggtttgtctcccccatataaatgttcatttttattgtttaaaaattaattttatatgtttagagatttgtgatatttt

SEQ ID NO: 131575 - DNA, 601 bp, Human
actatagttgtggatttgtctcaaaaaggcagtctttcctcccaatgagaattacccatttctgttgtttgctatttataactacttatcaggatttttctctctcttatagtcagcagtcagcagaggaccttgcccgagtacctgccaactccactagcaatatcttgaacaggttattggtcagttatgatcccaggataagaccaaacttcaaaggtttgtctcccccatataaatgttcatttttattgtttaaaaattaattttatatgtttagagatttgtgatattttatatrtatatgctttgtgatattcaaaacagtaagatttcaaagtgatatataacaaaaatgtccttaagttcagaacaattcaatgcctaaaatattcagatgagtaaaatatgaattctaattgttttataggttacctgtttttaaaaattcaaaaaaggatatactgtgaattaataggccaacatccgcaatgggttttctaagtactattcttaaccttagtggtttaaaatttaggctctggaaatagacctggctttcattcacagacaccagagttataatttgcagaatgatgat

SEQ ID NO: 131576 - DNA, 601 bp, Human
catttctgttgtttgctatttataactacttatcaggatttttctctctcttatagtcagcagtcagcagaggaccttgcccgagtacctgccaactccactagcaatatcttgaacaggttattggtcagttatgatcccaggataagaccaaacttcaaaggtttgtctcccccatataaatgttcatttttattgtttaaaaattaattttatatgtttagagatttgtgatattttatatgtatatgctttgtgatattcaaaacagtaagatttcaaagtgatatataacaaaaaygtccttaagttcagaacaattcaatgcctaaaatattcagatgagtaaaatatgaattctaattgttttataggttacctgtttttaaaaattcaaaaaaggatatactgtgaattaataggccaacatccgcaatgggttttctaagtactattcttaaccttagtggtttaaaatttaggctctggaaatagacctggctttcattcacagacaccagagttataatttgcagaatgatgattttctcatttagggaaagagaacagttctgatgtatatttagagtctttcttactt

SEQ ID NO: 131577 - DNA, 601 bp, Human
tatttataactacttatcaggatttttctctctcttatagtcagcagtcagcagaggaccttgcccgagtacctgccaactccactagcaatatcttgaacaggttattggtcagttatgatcccaggataagaccaaacttcaaaggtttgtctcccccatataaatgttcatttttattgtttaaaaattaattttatatgtttagagatttgtgatattttatatgtatatgctttgtgatattcaaaacagtaagatttcaaagtgatatataacaaaaatgtccttaagttcagarcaattcaatgcctaaaatattcagatgagtaaaatatgaattctaattgttttataggttacctgtttttaaaaattcaaaaaaggatatactgtgaattaataggccaacatccgcaatgggttttctaagtactattcttaaccttagtggtttaaaatttaggctctggaaatagacctggctttcattcacagacaccagagttataatttgcagaatgatgattttctcatttagggaaagagaacagttctgatgtatatttagagtctttcttactttttgttattatttcac

SEQ ID NO: 131578 - DNA, 601 bp, Human
tgttttataggttacctgtttttaaaaattcaaaaaaggatatactgtgaattaataggccaacatccgcaatgggttttctaagtactattcttaaccttagtggtttaaaatttaggctctggaaatagacctggctttcattcacagacaccagagttataatttgcagaatgatgattttctcatttagggaaagagaacagttctgatgtatatttagagtctttcttactttttgttattatttcacattaatagaaaattctctctattcttttgctgaaaaaacaattggccrtatgatttttaaaagcatgttagctttgtgaataaaagtgattacgtagtccacaacatagattatttttattccaattagatattaccatttatcacaccttttaaaaaccaaaactatgcttacaataaaataagccatgagcagattgtgcagttgtagagaccttttttgtacttttgatgaattagaaaaaagctgtatgaaaaacatctcctctggaaaactataatccttgttgctggttaaggacaggtattaatgtagatcagattaacattataaggcttgatttttttt

SEQ ID NO: 131579 - DNA, 601 bp, Human
tttttaaaagcatgttagctttgtgaataaaagtgattacgtagtccacaacatagattatttttattccaattagatattaccatttatcacaccttttaaaaaccaaaactatgcttacaataaaataagccatgagcagattgtgcagttgtagagaccttttttgtacttttgatgaattagaaaaaagctgtatgaaaaacatctcctctggaaaactataatccttgttgctggttaaggacaggtattaatgtagatcagattaacattataaggcttgattttttttttttttgcctttagaaaaaaaaaataggtctgcagctgcttctagtcaactgaagttatacaactatgttgtaaaaatgggtttttgttcattaccaggacctattcagttactttcaacaacagccatggtctgggttgtcacatgtctaccatatattgattcaccacctgtttttcatcagttagtggttatgtggctaaaaggctaaattcacattttccctttgttagcacaacgagcagccacaatgagatgaaaaaaaatagaaagaaatttgcaacattataccttagttctcactcc

SEQ ID NO: 131580 - DNA, 584 bp, Human
attgatgtattcccccctgaaaaactgtgaattggatacaaacttggaagaaagcgcttatgccatgaagacttcttgggcaacagtttttgttttctaatatgcttatatgttggaacattccaaaatgttttaagtattcaagtttttttcttccaatttcctgaggagaatccttgttttacctgttatgttcattttgtgatatgtagagcagggaattgtaagaagcaaataagaaaattgattttcataagatagggcaatgtgaacgccttgaaaasatggtgcagcaagatgaaagggccgggaaaggcaggtgaagactgggaaggagtgacaagcagattcgtgtcttgaaaggaataggaaagaggttcaagagaggtttggctgttgtccatgataagttggactttagggacaaagttttcagtaaagtaatattagtagatttcctaagcctcttgaaagccattcgataaagtctatttgcttactaaggttttagaatattaaatttgtgctctttttgacaaaccacatggtgaaataatacttcaggtggaagaaagaagacctaa

SEQ ID NO: 131581 - DNA, 601 bp, Human
gaaggagtgacaagcagattcgtgtcttgaaaggaataggaaagaggttcaagagaggtttggctgttgtccatgataagttggactttagggacaaagttttcagtaaagtaatattagtagatttcctaagcctcttgaaagccattcgataaagtctatttgcttactaaggttttagaatattaaatttgtgctctttttgacaaaccacatggtgaaataatacttcaggtggaagaaagaagacctaagatttattttcctgtatttttgggagacacttttattttattaaatrtaagattttgattgcaagcctagtaagaatggcaagagtacagtctaattttcctgagaatatctcagactagtgaaataattacttaaaatatttactccattattcctagtagcagcagcatagtacattataaaagcaattgtacattgcatttaattaatgacacctatttttaaattttaattgtgatgagagtgttatttatttgtagaagtatatatttaagctgggtaatggacaaagtgtagatattttagagaattacttaaaagatttggggattatgtccaaaattca

SEQ ID NO: 131582 - DNA, 601 bp, Human
cacagacccatcccagtagttagccaagaataacttatcctcggtaccagattcaataaattctcaccatggagtctttacccttgctttttattcttgatcttcttctcttctaaacagaaattttcatggctattctcactcactttgtgcactcttttcaatctaggtttttcatctctattatttgtctgttactttaatagcttctatactgtaattaaattatttttgtgtgtattccttttattctctaatggactataaactcataaaattagcaataatgtattctacttaytcatttttccataaaatacagaagacattaggcactcaatggtgaacacataaataaatatttttatattagccaatagtgagtgaataaatgaacaaataaaattgctatttgcttagttaagtaaaatggttggtggaacaaatttaaacagtagattaatgttgagcatttagatggcttaataacagactgaataatgtcgttactacagagtgtaattttgaaaactttgaaaacctttatctaaaggagtcaaattatttatattcattatttctttgatcatatagcctggat

SEQ ID NO: 131583 - DNA, 601 bp, Human
tttaacactgaataatattccattgtctgaatgtaccacagtttacttacccatttatctaccgaatgacattttcatcaattatgaataaaactacaataaacatccaagtgaagggttttatgctgacatgttttcagctcctttgggcaaataccaaggagtgtggttgctggatcatatggtaaaagtatgtttcgttttgtaagaaaccactgtctccaaagtggctgaacagtttttgatttttatcaacaatgaatgagttttttccactttttccacatccttgcgttcgttwttgtcagtgttctggattttggccattcaaataggtgtgtagtggtatctgattgttgttttaatttgcatttccctgatgtcaaaggatgttgaacatcttttcatatgcttatttgtcatctgtatatattcttgtggggtagtatctgttcagatcttttggacattttttaattgagttgtttgttttctgatggttgagtttcaagagttctttgtatatatcttggccttgattttaactcctacctttccactgtctcttgcttgacccctgaattatttgggccattttctc

SEQ ID NO: 131584 - DNA, 601 bp, Human
tgtaccacagtttacttacccatttatctaccgaatgacattttcatcaattatgaataaaactacaataaacatccaagtgaagggttttatgctgacatgttttcagctcctttgggcaaataccaaggagtgtggttgctggatcatatggtaaaagtatgtttcgttttgtaagaaaccactgtctccaaagtggctgaacagtttttgatttttatcaacaatgaatgagttttttccactttttccacatccttgcgttcgtttttgtcagtgttctggattttggccattcaartaggtgtgtagtggtatctgattgttgttttaatttgcatttccctgatgtcaaaggatgttgaacatcttttcatatgcttatttgtcatctgtatatattcttgtggggtagtatctgttcagatcttttggacattttttaattgagttgtttgttttctgatggttgagtttcaagagttctttgtatatatcttggccttgattttaactcctacctttccactgtctcttgcttgacccctgaattatttgggccattttctctatcttgatatttaatcattcttattatgat

SEQ ID NO: 131585 - DNA, 601 bp, Human
tcacttggggccaggtttcatgctttcagtagagtatctcctttaattcttagagtaactgtggactaattttattgacaaggaatttgaggctcagagaagttaaataacttgacttaaacccatatagcaaattatttagcacagaatttagacccagatttctctaactacaggtctcagtataggtatcaattcattagttagcttaaactgatcttcagagtcaaaattagatgtccattgtgaactggtttttgttttatgtttacatagcctttttcaagttatgtttgactgrtgttcaatatcccttatagttatttttttaaaagcaaggggagctcacagctttatccttgctaactagaccatgaaaattaatatgtcattaataaataatttttgaatgaatgaactaactagtaaattacctagggatttagatggaatttaaataaatgttttctgaaagtctatgatctaatctgtagctggattcccaaggatgcaaaatgggaagaaaatgaaggaaagctgcttctgctgattaaaatgcttagacttaatatactgataaaaaatacaaatgtattcttgg

SEQ ID NO: 131586 - DNA, 601 bp, Human
actgtggactaattttattgacaaggaatttgaggctcagagaagttaaataacttgacttaaacccatatagcaaattatttagcacagaatttagacccagatttctctaactacaggtctcagtataggtatcaattcattagttagcttaaactgatcttcagagtcaaaattagatgtccattgtgaactggtttttgttttatgtttacatagcctttttcaagttatgtttgactgatgttcaatatcccttatagttatttttttaaaagcaaggggagctcacagctttatmcttgctaactagaccatgaaaattaatatgtcattaataaataatttttgaatgaatgaactaactagtaaattacctagggatttagatggaatttaaataaatgttttctgaaagtctatgatctaatctgtagctggattcccaaggatgcaaaatgggaagaaaatgaaggaaagctgcttctgctgattaaaatgcttagacttaatatactgataaaaaatacaaatgtattcttgggttgtgtagaaacattcataagatttcaagaaggatttaggatagtaaacttcacat

SEQ ID NO: 131587 - DNA, 601 bp, Human
ctcacatgtggtgggagggacctggtgggagataattgaatcaagaggggaggtcatttccctgttgttcttatgacagtgaataagcctcatgagatctcatggttttataaaggagagttcccctgtacgtgctgtcttgcctgccaccatgtaaatcatgcctttgctcctccttcaccttctgtcatgactgtgaggcctcccatgccatttgaactgtgagtcaattaaacccctttcctttataaattacccattcttaggtatgtctttattggcagcgtgagaacagactaawacagaatgtaatagaataattttcagtgtgtatatttcaaggaagatttttagcaaataatttgaaatgaattatattgagtgttcaaaataacgttaagtggctatcagccacatgctttggctaaggtagtataattcatattttattagaaaatgcttgaaactaatgtgtgttccctctaaagtagagggccatgcatgtcttcctgcaatggataaaaacgtttgccacgttgtatctgttgaaagccttcactccatgagatagataggttttagtcttagacattcttgaatt

SEQ ID NO: 131588 - DNA, 601 bp, Human
aaaacattcctgttaatattaagaggtggagagaacatttacatatttacaatgctgtgataaagacaatgctaggcagcttggggatacagttaaacatctattgttgacttcaaaatacattagcaaatgatataactttaatatgtaagcattccttcttaaagcttatagtacattaggaaaacagagataatagtcgaatatattgctaaataattatggaggtttttaaaagtaaaaaatggagagctattaaaaatttgaccatcaaagtattcaatgaagaagtcatagatartaagatatggaagtgatctaattgataattctgagccactcctttatttaacacataaaataactgaagagcagagtgaatacattacttattaaattacttattactggtgacttattacttattaaatgtcaccaggcaaattactgtcagccttgggaccaagagtagtattccatctcccatttgtacttcaaattaagaagattatagttcttagagatttttgagactgtcatataagaacacgtacttagtagataggtttttgatctctcgctatactaggcattgttttta

SEQ ID NO: 131589 - DNA, 601 bp, Human
gagctattaaaaatttgaccatcaaagtattcaatgaagaagtcatagataataagatatggaagtgatctaattgataattctgagccactcctttatttaacacataaaataactgaagagcagagtgaatacattacttattaaattacttattactggtgacttattacttattaaatgtcaccaggcaaattactgtcagccttgggaccaagagtagtattccatctcccatttgtacttcaaattaagaagattatagttcttagagatttttgagactgtcatataagaacaygtacttagtagataggtttttgatctctcgctatactaggcattgtttttagttctttgcaggaattatttaacttaatcatcccaacaattctatgaattaagtacttttattatcctcattgtacacattaggctaatgaaatagacccttgcccaaggtcatacagttacagtgatgctgtgggagagggagtctgatactgttatacgattaatacctgtggagtcctattatagtttgaaaattgttacccacatccagattatatgcttaacatttcaaaaagagtagtgtcta

SEQ ID NO: 131590 - DNA, 601 bp, Human
aaaaatactcaaattggaagcctgagtgaataatgggataaaacttcacaggaaatagaaagtaaattgaatttgcccaatgaacatttatatcaattagctgcccacctgcctctcataaatgttaataatactaggaaaagatcaaaaaaagatcaagaaatgtttctcataaaattttatggagcaaatcactataatatccaagcatgtattttactgctaaatgcatccaagtcttgtgaagctcccctagtgggtaccttcataaaagggacacgatggaaacttgctccaaatygcaggactcatgtgaatggactatcatttaaacatagtgggatggaatggaaaattttattttaaactatgctactttgtagtaaatcgttataatatttgtgacaactgagactacctaaaaatatataatttgttgagaaacatttcatatgcactaggtgaacagaaaactaatttgacttagtgatactattacaaagtcgtgtacttcagaatcagttttaggaaatattttgagccttctcaattgtagcaattgtacttatgaaagattctatttttgaaatattgcacatga

SEQ ID NO: 131591 - DNA, 601 bp, Human
atatcaattagctgcccacctgcctctcataaatgttaataatactaggaaaagatcaaaaaaagatcaagaaatgtttctcataaaattttatggagcaaatcactataatatccaagcatgtattttactgctaaatgcatccaagtcttgtgaagctcccctagtgggtaccttcataaaagggacacgatggaaacttgctccaaattgcaggactcatgtgaatggactatcatttaaacatagtgggatggaatggaaaattttattttaaactatgctactttgtagtaaatcrttataatatttgtgacaactgagactacctaaaaatatataatttgttgagaaacatttcatatgcactaggtgaacagaaaactaatttgacttagtgatactattacaaagtcgtgtacttcagaatcagttttaggaaatattttgagccttctcaattgtagcaattgtacttatgaaagattctatttttgaaatattgcacatgattgttagttagaaacatatgttcttatttgtccaggcagagagttaaggggaatggtgggaaaagaaaagaaagggagatttttcattg

SEQ ID NO: 131592 - DNA, 601 bp, Human
aagcatgtattttactgctaaatgcatccaagtcttgtgaagctcccctagtgggtaccttcataaaagggacacgatggaaacttgctccaaattgcaggactcatgtgaatggactatcatttaaacatagtgggatggaatggaaaattttattttaaactatgctactttgtagtaaatcgttataatatttgtgacaactgagactacctaaaaatatataatttgttgagaaacatttcatatgcactaggtgaacagaaaactaatttgacttagtgatactattacaaagtcrtgtacttcagaatcagttttaggaaatattttgagccttctcaattgtagcaattgtacttatgaaagattctatttttgaaatattgcacatgattgttagttagaaacatatgttcttatttgtccaggcagagagttaaggggaatggtgggaaaagaaaagaaagggagatttttcattgttatgttttttacatcctttgaaaacctgtgaatgacttgatatattgcctaattttaattaaattcaactgtaaaaaagaaacacttgcatttcttgtctttaatataatatgga

SEQ ID NO: 131593 - DNA, 601 bp, Human
ctgccatccatcctagataagaagtggtacatatggctgaaaaattatactgataatgtgtagtcccggagtgtttctttttaagatttgttctactttgatttactactgcctgtatgactcctttagatcattgccctgagaggacccacgggtaaagaaaagttcaactctattgccaattctctgaacaatgacctaaaaggctagacactgacacagtagagcagcatgtgggatctatttctcaatgtcataatgaagttgcgaaaggtcagctgaaactggttccataatgtcrcccttttagatcacataaattatatatctgcaaagaaaaacttttttttgaggcatttcctctgtgaaattgcctcagatggaagtgacttaccgtttccaggtctgtcattgatgtttgccattctgtgtgggtgaaaacctcatgccttgaatgtgtttgcttctgaaaggctactacacatgcgtggaagtcatcttcaccctgaggaggcaggtcggcttttacatgatgggggtctacgccccaaccctgctcattgttgttctctcctggctttccttctggatcaacccggac

SEQ ID NO: 131594 - DNA, 601 bp, Human
ttagaattgttagccaccaatttcggtgtttaaagactttcttcaaaacttgatattgaactagattttctcaatgtttatgcactctataattaagctaagtttctcttttcatgtccttggagtattataagcagttaatctatttttctgtcatgaaataattatttataagtgattttcacggataactatgtctaaaaccttcggtagtgccaaacttaaaaatgaataactatttcgaaggaagtctttctgaaaaatagtatgtattatcacatactcttagggaatagtaatmtaatttactttttaaaaattacgaaaaattatgtagccatcattttcccaaccattggttattgtgtgctatatcagggctggttgcctgtcccttgagggccattgctctccagtttatttttaatgctttgtgacatagaaataccaccagccagtcttttgaaaattgtgtctgtataatggctaaaaagcctttgcttaaggaaataagcaagcgcccttcctatggataaattgaataaacttcaaaatatgtacattgcatcaacaaattttggttggttggagtgtttcaaaa

SEQ ID NO: 131595 - DNA, 601 bp, Human
tgcctcagcctcccgaatagctgggattacaggcacccaccaccatgcccagctaatttttgtatttttagtagagacagggtttcaccatgtcagccaggctgatatcgaactgctgaccccgtgatctgcccgcctcgacctcccaaagtgctgggattacaggcgtgagccactgcaccgggccgattttagtttttattcagcatgaaatacaaagtcgctaaaggcttttacacatgatctgacttaaattttaaccagatctctttgcttactttgttgagaacagaatgacctygggcaagagcagaagcaaggaaagcagttaggagacaattgcaataattcaggtaaatatttggtctagtgagtagtagtgcaggtgctgataaatatttgatgatggggctgagagcagtggctcacccctgtaatcccagcactttgggaggcaaaggtgggcaaatcacctgaggtcaggagttggagaccagccttgccaacatggtaaaaccccgtctctaccaaaaatgcaaaaaattagccaggcatggtggtggacacctgtaaccccagttactcgggaggctgaggactg

SEQ ID NO: 131596 - DNA, 601 bp, Human
gttgagacaggagttggcatgtgtgcacttgcaattgctccttgacctgctctgttgattcatggcattggttattaatagcaaatgccatactgtctctgccttccatttcttttcttttcctttctttcttcctctcttttctttccttattttttcttctcttttctttttctagttttcaatttttctcttttcaccaatacattcctagtatatatgctgttagggaattattttgcggattcttcctctgtgattggatggacaagaaatctgtggacattccatagacaatcayagaggttactgtatatatcttgaaaaattgagatgattttgtcattatacaattctgtctccatgttgatgagctaaataacttcaaccctgacttgtttatggaagattttgctcacttcaacctccttatatagcttatttgatatatgctatataaggctatattatgataatgctaaagtatttttacaaagtagcattatttgctcagatttcttatttttagctagaaaatgctaataggtgttttctattataatacgattttccaaagataaggcacatagtgtgtgttcac

SEQ ID NO: 131597 - DNA, 601 bp, Human
ggaattattttgcggattcttcctctgtgattggatggacaagaaatctgtggacattccatagacaatcatagaggttactgtatatatcttgaaaaattgagatgattttgtcattatacaattctgtctccatgttgatgagctaaataacttcaaccctgacttgtttatggaagattttgctcacttcaacctccttatatagcttatttgatatatgctatataaggctatattatgataatgctaaagtatttttacaaagtagcattatttgctcagatttcttatttttagmtagaaaatgctaataggtgttttctattataatacgattttccaaagataaggcacatagtgtgtgttcactttcttcttcttaacttcttcaactttccttcttatatctgatatgataaaagtcttgaattcactaccattgtttctaaccgaatgtgtggaattatgaatactccccttttccctccaaaatctataaatattctgtcacaccttttaaagacaatcctttcatctgtttcttcaatcagtcccccttttctgacaccaaaacatctttacctcacaaagtcctctc

SEQ ID NO: 131598 - DNA, 601 bp, Human
gccagaattgctaaggctgagcaagcagatggaaaaggtggaaatgtggctaaaaagaatactgtgaatggaacagggactcctgttcatattagcactttgcaggtaaggataaaattatgccatgaaatcatttcccccaaccacttcatagtgtcaagagagagacacctttgtgtatgtgacaagttttgatggaattggcatttgcttgtttttctctcacagatgaaaacaaactgagcacaacacaatttttgggaaacgtgctttttagaaaacattcagaacgtttaggtcraataccacttaaggaaaaaagtaatgccttattaaattttttgaggactttgcactgagtttaaggattcaactctgctttgatggtcaccattgaatttggagaccttgctggatggagcacagaccttcctattgtttctcattcaatgtatcttaatgaaaggcccgaggactgtggggcatcactgatcatctgccttacataaaaaggcttggagaagcccatgctcatgattaaatcacccaccattccccattacattagagagcttcacatggagcatgtcaggcaggctac

SEQ ID NO: 131599 - DNA, 601 bp, Human
aatgaaaggcccgaggactgtggggcatcactgatcatctgccttacataaaaaggcttggagaagcccatgctcatgattaaatcacccaccattccccattacattagagagcttcacatggagcatgtcaggcaggctacttgtttattggatgtctggctcagggaaacgatgcctgcagttaggaatctgtccctcccagcagtgagtggcaggagaaggaatatttaagattttaccccataaccctgccttgtcaattaattatgggtttaagaatagtgggcaatggtaaatytcaacgtgccaggctgtgtaaaggattgaggttagctgtccatttaccccaatgtgcccctcattgatgccttctggatgggtggaccagtcaaccagaagaccatttccattgagctaagagcagtaaattccacagaagaccaataggtccattccatcctacaaccttgaaaatcttaccttccgtgcttttcctctggtcccacaattgctctatcagtttgttaatcaccactagtcccctcacctagaatgctagactagtataccgcatgcggttcttagatgcagaagcaaa

SEQ ID NO: 131600 - DNA, 601 bp, Human
ttgtttccattctccccgttactttcaggtacaccagtcagacgtagatttggtcttttcacatagtcccatatttcttggaggctttgttcatttgtttttactcttttttatctaaacttctcttctcgcttcatttcattcatttgatcttcaatcactgataccctttcttccagttgatcaaatcggcgactgaagcttgtgaatgcatcacgtagttctcgtgccatggttttcagctccatcaggtcatttaaggatttctctacactgtttatttcagttaaccattcatctmgtcttttttcaaggtttttagtttctttgcaatgggtttgaacatcctcctttagctcagagaagtttattaccaccaatcatctgaagccttcttctctcaactcgtcaaagtcattctccatccagctttgttccgttgctggcgaggagctgcatttctttggaggagaagaggagctctgatttttagaattttcagcttttctactctggtttctccctatctttgtggttttatctacctttgttctttgatgatggtgacatacaggtgcggttttggtgtgtatgtcctttc

SEQ ID NO: 131601 - DNA, 601 bp, Human
tttatataaattagaaaataaaagctgctgtttatatgtaaaggagatcttttaatggtaatgatttaatggacttaaatttagcaaaatatatacaaattattccctctgaacatattttattgtctgtagaggatgccattattgacatgaaatcgtgcctaattattctggtcaagaaatactgcataaagttatttgcttttaaatttgtgtggaatgaaacttaaaagaaccacaaagaaaatcttagaggctaaagttggaggcattagaaagttattaatagcatcgtttttttattcttgacagtttcattatcacactacctcatttttgttgccaataattttcagaagtgacagaagtttatatgatgaaagtaaatgagacacatatttgtaataaggaacaactgagaaattattaattgtaggttaatatagccaaattcgcttttaagaatgtgtgttaagtagggttaatgtcttgtttataagcagtttatttcatctcttttcatgtgatgttataactgtttaaaatagtatttatagtgtaaactcttttgtactttcatgtatatatttgatatgataat

SEQ ID NO: 131602 - DNA, 601 bp, Human
aagtagggttaatgtcttgtttataagcagtttatttcatctcttttcatgtgatgttataactgtttaaaatagtatttatagtgtaaactcttttgtactttcatgtatatatttgatatgataataaggtgtaacagaaaattttctttgtgtaaaatctgtgatgaatggggcaaggagactagccaactacttaatgaaccatgacctatttaagaagccctgagtacttctcattagggaaactaatcttattctttattcagtatgtcattatcattaaaaattacttctgtartagaggttccgtccaccccacatgtgcacctctacttattcttgaatacaagaatcttcaaatatatctccgagagacgttttaaagacttaaatggctagaaacttaatataaccaatttgcagcttttttggaatgctttgtaatgttatggcttcaacactgaaaaaattattctcttactgacatgtttactataagtaatctctgtgaataaacataatattctatatctatagtttgaataaactggatcaaatcctaatattatttaaattgctggcagaatttatatggtta

SEQ ID NO: 131603 - DNA, 601 bp, Human
ggaaggttacagttatggtggaaggtgcaggaaagctggcatgtcagatggcaagagtgggagtgagagggagggcaggtgctaggctctttttaacagtcaattttcacttgaactaacagagggacaactcattcattaccccagggaggacaccaagccagtcatgagggatctggccccgtgacccaaacacctcccactaggccccacctccaacaccgggagtcacatttcaacatgaaatttggaggagacaaatatccaaaccacatcaaccagttcctatttttttttttttgtcagacattttgctagatacagagtataaattgatagggactaaagcctgtccgtacttcttgatgccatgcagatgtaggcactgctctttcacactcagttgagctctcacaattggtaaattgtaactgcacattaaaaaagtggagtgagggggtgcagacaagaagccacttttttcacattggcctacttcttgacacacattcttagaagcgaatttggctatattaacctacaattaataatttctcaattgttccttatgaatatgtgtctcatttactttcatcatata

SEQ ID NO: 131604 - DNA, 601 bp, Human; identical to SEQ ID NO: 22182

SEQ ID NO: 131605 - DNA, 601 bp, Human; identical to SEQ ID NO: 22181

SEQ ID NO: 131606 - DNA, 601 bp, Human; identical to SEQ ID NO: 22180

SEQ ID NO: 131607 - DNA, 601 bp, Human
agttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagkttttaaaatcagtactttttaatggaaacaacttgaccaaaaatttgtcacagaagtttgagacccattaaaaaagttaaatgagaaaaaataataataataataataataataataatattttgagaaactgccatactgtttccacagtggctgcaccattttacattcctctttttatgttttacacatctgctgtttggtgaaattttctacagagtagcttttaactctgagcgctgtacttcctttgaccctggacttcacgcccaaacatcagtaaactgtcacagaaggtag

SEQ ID NO: 131608 - DNA, 601 bp, Human; identical to SEQ ID NO: 22182

SEQ ID NO: 131609 - DNA, 601 bp, Human; identical to SEQ ID NO: 22181

SEQ ID NO: 131610 - DNA, 601 bp, Human; identical to SEQ ID NO: 22180

SEQ ID NO: 131611 - DNA, 601 bp, Human; identical to SEQ ID NO: 131607

SEQ ID NO: 131612 - DNA, 601 bp, Human; identical to SEQ ID NO: 29225

SEQ ID NO: 131613 - DNA, 601 bp, Human; identical to SEQ ID NO: 29224

SEQ ID NO: 131614 - DNA, 601 bp, Human; identical to SEQ ID NO: 29223

SEQ ID NO: 131615 - DNA, 601 bp, Human; identical to SEQ ID NO: 29222

SEQ ID NO: 131616 - DNA, 601 bp, Human; identical to SEQ ID NO: 29221

SEQ ID NO: 131617 - DNA, 601 bp, Human; identical to SEQ ID NO: 29220

SEQ ID NO: 131618 - DNA, 601 bp, Human; identical to SEQ ID NO: 29219

SEQ ID NO: 131619 - DNA, 601 bp, Human; identical to SEQ ID NO: 29218

SEQ ID NO: 131620 - DNA, 601 bp, Human; identical to SEQ ID NO: 29217

SEQ ID NO: 131621 - DNA, 601 bp, Human; identical to SEQ ID NO: 29216

SEQ ID NO: 131622 - DNA, 601 bp, Human; identical to SEQ ID NO: 29215

SEQ ID NO: 131623 - DNA, 601 bp, Human
tgagcagcaggtacaacaaaacaccttttcttcctagtgtatcagacttctttacactgactttgtaaacaagctctgcctgcggccacatttgagtttctgcagatagaacctgagagatctcagttgatccctctttattttcctttttctcttatggggtagtaaggagaaaagattgctgtgaatttacccagccttgcagaactagtgttttaaatgagaaagacccagaattctatgttccttagcactgtactgccagaggtacttaataatattctgttctttccacatctcygcttgcaaaagcattggcagtatatgcagtttatccagtgttaaaaatagcctgagagtaccttggagttagcaataaaggactgtagaatacccatgcctcttgactttatggaatttgttaaagacaaattaaagggaaaacgctccatattccttgggatagtgagggggaaacggatacccttaggattagggaaggcggctgctcagctgtatgtctgataggctttggctagggagactctggtctgactgagctttctaaaaaagggaataattttctgattataaaatatgt

SEQ ID NO: 131624 - DNA, 601 bp, Human
ctttttctcttatggggtagtaaggagaaaagattgctgtgaatttacccagccttgcagaactagtgttttaaatgagaaagacccagaattctatgttccttagcactgtactgccagaggtacttaataatattctgttctttccacatctctgcttgcaaaagcattggcagtatatgcagtttatccagtgttaaaaatagcctgagagtaccttggagttagcaataaaggactgtagaatacccatgcctcttgactttatggaatttgttaaagacaaattaaagggaaaacsctccatattccttgggatagtgagggggaaacggatacccttaggattagggaaggcggctgctcagctgtatgtctgataggctttggctagggagactctggtctgactgagctttctaaaaaagggaataattttctgattataaaatatgtttattaggccaggcatggtggctgacgcctgtaatcccagcactttgggaggctgaggtaggaggattgcttgagctcaggaatttgagaccaacctgggcaacatggtgagaccctgtctctacaaaaaatcaaattagctggg

SEQ ID NO: 131625 - DNA, 601 bp, Human
gcccaggctagagtgcaatggcattatctcagctcatcgcaacctcggcctcctgggttcaagcgattctcctgactcagcctcccgaatagctgggatttcaggcatgtgccaccacacctggctaattttgtatttttagtagagacagggtttctccatgttggtcaggctggtcttgaactcctgacctcaggtgatctgcccacccggcctcccaaagtgctgggattataggtgtgagcccccatgcctggcctattattattattattattattatttttcttttttgagacckagtcttgctctgtcgcctaggctggagtacagtggctcgatctctgctcactgcaacctctggctcactgcatcctccacctcccgggttcaagagattctcctgcctcagcctcccgagtagctgggaatataggtgcgcaccaccatgcccagctaatttttgtatttttagtacagacggggtttcaccatgttggtcaggatggtcttgatctcttgacctcgtgatccgcctgctttggcctcccaaagtgctgggattacaggcatgagccaccatgcccagccataaatacct

SEQ ID NO: 131626 - DNA, 601 bp, Human
gaagaatttttcttagtacagaacaaaatggagtctcctatgtctacttctttctacacagacatagcaacaatctgatttcgctatcttttccccacatttcccccttttctattcgacaaaaccgccatcgtcatcatggcccgctctcaatgagctgttgggtacacctcccagacggggtggcggccgggcagaggggctcctcacttcccagaaggggcggccgggcagaggcgccccccacctcccggacagggcggctgccgggcggaggcgccccccacctccctcccggacrgggcggctggccgggcaggggctgccccccacctccctcctggatggggcggctgactgctttataaaattaaaaaaaaaattaatattggctgggcatggtagctcatggcttttgtaattccagcactttgggaggctgaggagggaggatcacttgagcacaggagtttgagaccagcctgggcaacaaagcaagaccccacctctaaaaaaaaaaaaaattaggcatggtggcagtggcagtggtgtgcatctgtaatcctagctactcgggagcctgaggagggaggatcccttg

SEQ ID NO: 131627 - DNA, 601 bp, Human
ctgcctaaacaagttatagccacgccattctagacacttccatcctagaagggagggcccaggaagtctgtatataaccaactctagggcagaggctgccagctggtggcccgtgagccagacttgggccccagagatagatttgtttggtttgtggtgttgtaaataattttgaattagttgccaacatttgaaaatcaggacttgccttttctcttgaaaaatcaaaagttcaggcatcattggacccaaattcctgcccgataaaataagctggatttcagtagtcgtagcttctttaaaaaaaaaaaaatttcttttttgtttatttaaaaggagtatccctatgttgcccaggctggtctcaaactcctggctcaagtgatgctcctgcctcagcctctccaagtgttgggattacaggcatgagcctctgtggagggctctggctccttttttttttttgagacagagtcttgctctgtcacccaggctggagtgcagtggcgcgatctcggctcactgcaagctccgcctcccaggttcacgccattctcctgcgtcagcctcctgagtgctgggacaacaggtgcctgccacc

SEQ ID NO: 131628 - DNA, 601 bp, Human
gaggtcttatatgaaatatttgcatacatcccgggagaaaacctggttgcacagccgtacctacctgcaggagaggctgggcaatgtcagctttattttggacagccatgccttcagctaaaatttctattacgaatgaaaaagggaaatgaaaaagggaaaaagatagaggaagataactagccatgtctgccacagagactttggggatttgtttctgctttggctttcagtttggatctgccatttgagtactcctttctcagcaataagctcccagagagccttgaagaccctcacrtgggtcccacgctccttggtgcaggcttgtccagcaaggaaatgagatcaggagaagagggaaggcttggatgttttaattgtggtagctgaatcttagcatctggctttaaggcccagttgttgactttgtttgaactctgatagtttatggtaagctaggggggctgggagttctgggaagcaatagaggagtaaggatcagatggtgaaattttgtttcttaattagaatcaggagaacagtcaagggacttggcttctgcttgacagactgttctaggagctctctgttctctggc

SEQ ID NO: 131629 - DNA, 601 bp, Human
atatttacctgtgcacagagaggaccaaacctgtaggacatttatggcaggatagaaggaaggagaaggatcagaagtgagacccagtgccagttagtgggtctgaggagtgtatcagcttctcttccccttggagctgcaaaccagaagcacagttagcactgccaggatattgtcagacagtctctttctccatgtttatttccacctttttgtgtttctctccttttatcctcttctgtctctgcctccttgtctcttatctctcacccctctgtctcttctgtgtattttctcgtcyttttttttttttttttttttttttagagacaagttctcactctgttgccctggctggagtgcagtgactattcacagatgctattacagtgcactataggcccggactcctgggttcggcagttctcccacctcagcctcccacacagttgggactccaggtgtgcaccgctgccccggccccctgtctgtctttttgtctaagctgcatgccctcccacttctgcttctttttgtgttctgcttccttcctctatttacttatggtttctgtccctttgttactaagggcttgtatgtg

SEQ ID NO: 131630 - DNA, 601 bp, Human
aggaggggaggacatttctttttatgtgtgtgtacggtacgagtaagagagagagtctggctgaaggagagagtgcaaagtgggtaggagtaagtggagttggcctagaggatgggcccaaaagattttgtagtaagatttgaggtgcacataaaagttctgtttttgtatgctagaggcagtactcacagatgtcactgcgttccttcctgctggatattgctcttatgtcgtccccatggatcagtcattgtttagcaggagcaaagtgccggggctctcagcacagggcccagatgtyactgaagtgtgtgaggagctagaacttaaagccacgtgagcctagggagtactcgagtgggtgcgcttctccatggacttcattgagaattgggaggtatgggtaggaatgagggtggaagcgatcagtgggcttgggaatgtgaacttagaaatggtagttagcttctctcacctcagtttcctcatccataaaatgggaataggaatatctgtattttggagtcgtgagaattgatggagaggtgtatgtgaaattgtcaggcatataacagacttttctttttctcctttttttttt

SEQ ID NO: 131631 - DNA, 601 bp, Human; identical to SEQ ID NO: 29214

SEQ ID NO: 131632 - DNA, 601 bp, Human; identical to SEQ ID NO: 29213

SEQ ID NO: 131633 - DNA, 601 bp, Human; identical to SEQ ID NO: 29212

SEQ ID NO: 131634 - DNA, 601 bp, Human; identical to SEQ ID NO: 29211

SEQ ID NO: 131635 - DNA, 601 bp, Human; identical to SEQ ID NO: 29210

SEQ ID NO: 131636 - DNA, 601 bp, Human; identical to SEQ ID NO: 29209

SEQ ID NO: 131637 - DNA, 601 bp, Human; identical to SEQ ID NO: 29208

SEQ ID NO: 131638 - DNA, 601 bp, Human; identical to SEQ ID NO: 29207

SEQ ID NO: 131639 - DNA, 601 bp, Human; identical to SEQ ID NO: 29206

SEQ ID NO: 131640 - DNA, 601 bp, Human; identical to SEQ ID NO: 29205

SEQ ID NO: 131641 - DNA, 601 bp, Human; identical to SEQ ID NO: 29204

SEQ ID NO: 131642 - DNA, 601 bp, Human
gagtatgtagtttgaaggaacaaagtggattcactgaaatgattttaggataatatatgcagtaaagtggaaaataagaataaaatggttagtagaattcagatccttgctgggttatatcagtgtgtttgccgaacttatttttggattctcttcctcactggaatggaagttccttgaggtcggggatagtgtctgtatctttttcagttatattatcagtgcctagctagcacagtgcctttacatagtaggcactatatatataatatataacatatattatatataaaatacatayatatttacatatataatgtatatttcatatataatatataatgtattatatacattatatactcatatactatataatatataaaatgcatataattatatataatatatgtagtgtatataatatatattttatatattatatataatgtttattatatattttatatatattttttcttttttgaggcagggtctcgccctgtcgcccaggctgggatgcagtggcgtgatttcagcttactgcagcctcgacctctggggttcaagcgattgtcccgcctctgcctcctgagtagtt

SEQ ID NO: 131643 - DNA, 601 bp, Human
tatataatgtattatatacattatatactcatatactatataatatataaaatgcatataattatatataatatatgtagtgtatataatatatattttatatattatatataatgtttattatatattttatatatattttttcttttttgaggcagggtctcgccctgtcgcccaggctgggatgcagtggcgtgatttcagcttactgcagcctcgacctctggggttcaagcgattgtcccgcctctgcctcctgagtagttgggattacagtggtgtgctgccacagctggctacsttttgtgtttttagtagagacagagtttcaccatgttggccaggctggtctggaactcctgacctcaagggatcctcctgcctcagcctcccaaagtggtgggattacaggcatgggccactgcaccctgcccaatatatatatttttaaatagagatggaagtctcactatgttgcccaggctagtctggaactcctgggctctcctgttctggcttcccaaaatgctgggattacaggtgtgagccactgcacatagcccctatattttgttaaataagtgaataaataacacctaag

SEQ ID NO: 131644 - DNA, 601 bp, Human
atatattttatatatattttttcttttttgaggcagggtctcgccctgtcgcccaggctgggatgcagtggcgtgatttcagcttactgcagcctcgacctctggggttcaagcgattgtcccgcctctgcctcctgagtagttgggattacagtggtgtgctgccacagctggctacgttttgtgtttttagtagagacagagtttcaccatgttggccaggctggtctggaactcctgacctcaagggatcctcctgcctcagcctcccaaagtggtgggattacaggcatgggccacygcaccctgcccaatatatatatttttaaatagagatggaagtctcactatgttgcccaggctagtctggaactcctgggctctcctgttctggcttcccaaaatgctgggattacaggtgtgagccactgcacatagcccctatattttgttaaataagtgaataaataacacctaagttttgaatcattgctcactgctctttcgtggtagaggaaattgacgagaattgtttcagttctttggcttttattgatgagttccataaattagatcttggtaatttggggctgcagtggtt

SEQ ID NO: 131645 - DNA, 601 bp, Human
gtgtaaagctgtcctggtgggtcaggggagtagacacagcagacttggcagtaggcctggcttctaaaacaatatccaagtcatcaaatttgcccaggcatgccatatgaggttcaagtaacagtggaatttaagaggagtgagtttgttcagggaggcttgggagagtcacaagcaagagcaagcttttttaagagccatcatttaaactcaaacataatgtgggtctgcatatattttggcatgtctagtaatgtttacgtaattatattgtatgactttcacctgttggcaattgggrctctaagatttaagtaacagcctatgaattgctagtttaccaacagctgaaatttaatctttgggacagttctagttaatattagttaatattcatgtgtgaggctgggcgcggtggctctcacctgtgtaatcccagcactttgggaggctgaggcgggtggatcacctgaggtcaggagttcgagactagcctggccaacatgatgaaaccctgtctttactaaaaatacaaaaaattagctggatgtggtggcgggcgctgtaatcccggctacttgggaggctgaggcagaattgc

SEQ ID NO: 131646 - DNA, 601 bp, Human
catatggaatcaaacatatatgagtcatgtcttacaaattacatgtgttcctgtgactagattttctgctttgggctcaaaatagctacttgagggatgcttcttattcctgcctgctctaggaaattttaaagggtagcagtgatacagttagaccaatagagggtactgtatcgctatatcgctaactgtgctagacccaaatttagctcttttgggccttttctctttgctgctttgtggatctggaggtcaagaggtgatatcattttaggttttaaggcagtttactctaaggagraattggcctttgtctttggcagcccccctctccgcccatgttgtcttgattagggtctgatttgtcatcttgcaggctgttttgcttttaaagtttaaagcgtttagatctgtcgtcaaaattgccctaaacctgaatgaggaaaaattcagaattttaaaaatgctcaatagtcagggtagtttcatttttcaaggttaacattttgctttcacatgttcaaaaaaaaaaaaatgagtactatttatttgattgaatttaggatgcaaggagaactaccttctatagccactaggactg

SEQ ID NO: 131647 - DNA, 601 bp, Human
aaaacacaaggctgcatgggagaggagtggatagaaggatagaaaatctgttagggaggaagaaagagaaaatggatgctgggagggggtcaaccaaaagaattgtctgtgcttactatccacagtattctagcaactgagggacttaaaaaaaattttttttttttgagagagaatctcactctatttcccaggctggagtgcaacctctgcctcctgggttcaggtgattgtgatgcctcagcctctcaagtagctgaagtagctgggattacaggtgtgcaccacatgcccagctaatttttttttttttttttttttttgagacagagtctcactctgtcacctaggctggagcacagtggcacaatctctgctcactgcaacttccacctcccaggttcaagtgattttcctgcctcatgcctcccaagtagctgggattacagatgtgtgtcaccgtgcctggctaatttttgtattcttagtagagacagggtttcaccatgttggacacgctggtcttgaactccctacctcaggtgatccgcctgcctcggcctcccaaagtgctgggattataggcatgagcccctgtgcc

SEQ ID NO: 131648 - DNA, 601 bp, Human
gtcagagtccttggggatgggcatgggagttgatagaggtgccaagaaagagaagtatggctattgatcctggattaataacagtggggttggtgtcttgatgggtgggagatctgggacacaaaattcatttttgttgtgtggttcaggtggaacctgatgattatgcagacatacagaagcataaagacagtgtcaaatctgatttgtcaaaattgagatagtaaagtgttttttaaatgcttattttattttatttcttaaaatttattttgagacagggtctcactttgttgcccakgctggagttcagtggctcaatcatagatcactgcagtcttaactcagcctcccaagtagctcaaaccacaggtgcttgccaccatgcccagctaatttttaaaaattgtttttgatagagacggagtctttctgtgttgcccaggccagtctcaaactcctgggcctgagcagtcctcccaccttggcctcccaatgtactgggattacaggtgtgagccaccatgcccacgctaaaaattctttttaaagtgctttgtttcattctttcgaaggctcatctgaaagaaactagctgttg

SEQ ID NO: 131649 - DNA, 601 bp, Human
ccgctgaactcactagaacatttatataagtggaattgtaaagcatgtaccctttttttgcgggggttgggtgctgacttcttgtcattgctattttgagatatgtccatgttattgagtgtatcagtaggtcattaatttttattggggagtagttgccattatgtatgtatagtacaatttattttatccattcacctgttgatggacttttggattgtttccaggttttggctgttacaaataaagcagcgatgaatattcatgtattgtctttgtatggacacatctttccctttcycttgggtaaatacctaagaatgtaatggttgggtaatttggtagatgtacatttaactttttgtctattattattattattattattattattttttttttttttttttttttagatggagtctcactctgtcgccaggctggagtgctgtgatgcatatctcggctcactgcaacctcccaactccctcgttcaagttgttctcctgcctcagcctcccgagtagctgggattgcaggcacacgccaccatgcccggctaatttttgtatttttagtagagacagagtttcaccatgtt

SEQ ID NO: 131650 - DNA, 601 bp, Human
ttgagatatgtccatgttattgagtgtatcagtaggtcattaatttttattggggagtagttgccattatgtatgtatagtacaatttattttatccattcacctgttgatggacttttggattgtttccaggttttggctgttacaaataaagcagcgatgaatattcatgtattgtctttgtatggacacatctttccctttctcttgggtaaatacctaagaatgtaatggttgggtaatttggtagatgtacatttaactttttgtctattattattattattattattattatttwttttttttttttttttttagatggagtctcactctgtcgccaggctggagtgctgtgatgcatatctcggctcactgcaacctcccaactccctcgttcaagttgttctcctgcctcagcctcccgagtagctgggattgcaggcacacgccaccatgcccggctaatttttgtatttttagtagagacagagtttcaccatgttgaccaggatggtcacaatctcctgagctcgtgatccacccgcctcagcgtcccaaagtgttgggattacaggtgtgaaccactgtgcccagcaca

SEQ ID NO: 131651 - DNA, 601 bp, Human
agatatgtccatgttattgagtgtatcagtaggtcattaatttttattggggagtagttgccattatgtatgtatagtacaatttattttatccattcacctgttgatggacttttggattgtttccaggttttggctgttacaaataaagcagcgatgaatattcatgtattgtctttgtatggacacatctttccctttctcttgggtaaatacctaagaatgtaatggttgggtaatttggtagatgtacatttaactttttgtctattattattattattattattattattttttwtttttttttttttttagatggagtctcactctgtcgccaggctggagtgctgtgatgcatatctcggctcactgcaacctcccaactccctcgttcaagttgttctcctgcctcagcctcccgagtagctgggattgcaggcacacgccaccatgcccggctaatttttgtatttttagtagagacagagtttcaccatgttgaccaggatggtcacaatctcctgagctcgtgatccacccgcctcagcgtcccaaagtgttgggattacaggtgtgaaccactgtgcccagcacattt

SEQ ID NO: 131652 - DNA, 601 bp, Human
tatgtccatgttattgagtgtatcagtaggtcattaatttttattggggagtagttgccattatgtatgtatagtacaatttattttatccattcacctgttgatggacttttggattgtttccaggttttggctgttacaaataaagcagcgatgaatattcatgtattgtctttgtatggacacatctttccctttctcttgggtaaatacctaagaatgtaatggttgggtaatttggtagatgtacatttaactttttgtctattattattattattattattattatttttttttwttttttttttttagatggagtctcactctgtcgccaggctggagtgctgtgatgcatatctcggctcactgcaacctcccaactccctcgttcaagttgttctcctgcctcagcctcccgagtagctgggattgcaggcacacgccaccatgcccggctaatttttgtatttttagtagagacagagtttcaccatgttgaccaggatggtcacaatctcctgagctcgtgatccacccgcctcagcgtcccaaagtgttgggattacaggtgtgaaccactgtgcccagcacatttaac

SEQ ID NO: 131653 - DNA, 601 bp, Human
gtccatgttattgagtgtatcagtaggtcattaatttttattggggagtagttgccattatgtatgtatagtacaatttattttatccattcacctgttgatggacttttggattgtttccaggttttggctgttacaaataaagcagcgatgaatattcatgtattgtctttgtatggacacatctttccctttctcttgggtaaatacctaagaatgtaatggttgggtaatttggtagatgtacatttaactttttgtctattattattattattattattattattttttttttttwtttttttttagatggagtctcactctgtcgccaggctggagtgctgtgatgcatatctcggctcactgcaacctcccaactccctcgttcaagttgttctcctgcctcagcctcccgagtagctgggattgcaggcacacgccaccatgcccggctaatttttgtatttttagtagagacagagtttcaccatgttgaccaggatggtcacaatctcctgagctcgtgatccacccgcctcagcgtcccaaagtgttgggattacaggtgtgaaccactgtgcccagcacatttaacttt

SEQ ID NO: 131654 - DNA, 601 bp, Human
cactgatttgtgtgtgtttatgtgtgtagttctctgcagttttatcatatgtagattagtgtaactactaccatgatcaagatacagaactgggccaggcgtggtggctcacgcctgtagtcccagcactttgggaggctgaggccggtggatcacctgaggtcaggagtttgagaccagcctggccaacctggtgaaaccctgtctctactaaaaatacaaaaaattagccggctgtggtgatgggcgcctgtagtcccagctactcgggaggctgaggcaggagaatggcgtgaacccrggaggcggagcttgcattgagtggagattgcgccactgcattccagcctgggcgacagagcgagaccccacctcaaaaaaaaaaaaatatattagccgggcatggtggtgggtgcctgtaatctcagctactgggaaggctgagacaggcgaatcgcttgaacctgggaggcgagggttgcagtgagctgagattgggccatttcactccagcccaggtgacagagtgagactctgtctcaaaataaaataataataataataataataataaaaaatatagaactgtttcatctcacta

SEQ ID NO: 131655 - DNA, 601 bp, Human
acctgccaaatgttttcattcccaccagcaggtgtatgagttactcagtttctctgcatcttgggcagcatttggtattaacaccttttttttttaatcattctgatgggtgtgtagtgatacctcattgtggttttaattatattcttctcatgactaatactgttgaccattgttttatgtgatttttgccatccgtatattatttttggtctagtgtctaagtctttgcccctttttagattgggttgttttcttattgttgaattttgagagttctgtgtgtgtgtgtgtgtggggggtgtgtgtgtgtgtgtgtgtgtgaaacaagtctatcaaatatatgctttgcagagagtttctctcaatctgtgatttgttttttaattctattaatagtatcttttgtagaagttttacattttgatgaagtttgccttaccaattttttctttcatggattgcacttttggtgttacagctaagaaatctttgcctaacccatgctcacaaagattttctcctcggttttcttttcttttcttttttttgagacacagtcttgctcgtgttgcccaggatggagtgcagtggcatgatt

SEQ ID NO: 131656 - DNA, 601 bp, Human
tgtgcaccatcacgcctggctaatttttgtatgtttagtagagacggggtttctccctgttgtccaggctggtctcaaactcctgaccttgtgatctgcccgcctcggcctcccaaagtgcagggattacaggcatgagccaccacacccagcctcttttttgtatttttagtagagatggggtttcaccatgttggctgggctggtcttgaacttctgacctcaggtgatctgtccacctcagcctcccaaagagctgggattacagacgtgagccaccgtacccggacgcctttttttkttgttgttttttttttaatttaatttaattttaagttcttggatacatgtgcaggatatggaagtttgttacatagcaaaatgtgtgccatggtagtttgccacacctgtcaagccattacctaagtgttaagcccagcatgcattaggtatttttcctgatgctctccctctctcgtgacccccacccccagacaggccccagtgtgtgttgttcccctccctgtgtccatgtgttctcattgttcacctactgtttataagtgagaacatgtggtgtttggttttctgttcctgcatt

SEQ ID NO: 131657 - DNA, 601 bp, Human
tagtttgctgaggataatggcttccagctccatccatgatctcattctttttatggctgcacagtattccatggtgtatgtgtactacattttctttatcttgtctgtcattggtgggcatttgggttgattctatgtctttgctattgtgaatagtgctgcagtaaacatacacatgcatgtatctttataatagaatgatttatattcctttgggtatatacccagtaatgggattgctaggtaaaatgatatttttggttctaggtctttgggagaataattgctacactgtcttccwcaatgtttgaactaatttacatccctaccaagagtataaaagcctttctatctcagcctcgccaacatctgttgtttcttgactttttaatgactgccattctgggccgggtgtggtggcttacgcctgtaatcccagcactttgaggggccggggcgggcggatcagttgaggtcaggagttcaagaccagcctggccaacatgatgaaacgtcatctctactaaaaataataaaattagctgggcattgtggtgcatgcctgtagtcccagctacttgggaggctgagacaggagaat

SEQ ID NO: 131658 - DNA, 601 bp, Human
tgttcatgtcctttgcctactttttaatggggtggtttattttttttttttttgtaaatttatttaagtttcttgtagactctggatattagaccttagtcagatggataaattgcaaaagttttctcccattctgtaggctgcctgttcactgtgatgatagtttcttttgctgtgcagaagctctttagtttaattagatcccatttgtcagtttttgcttttgttggcaattgcttttgccattttcatcaagaaatctttgcccatgcctatgtcctgaatggtatttattgcctargttttcttctagggtttttatagtttggggttttacattgaagtctttaatccatctcgagttaatttttgtataaggtgtaaggaagggatccagtttcagttttctgcatatggctagccagttctcccaatactacttattaaatagagaatcctttccccattgcttgtttttgtcaggtttgtcaaagatcagatggttgtacatgtgtggtcttatttctgagttctctgttctgtttcattggtctttgtgtctgtttttgtaccagtaccatgctgttttggttactgtagc

SEQ ID NO: 131659 - DNA, 601 bp, Human
gttctcattggtttcaaataacttcttgatttctgccttaatttcattttttacccagaagtcattcaggggcaggttgttcaatttccatgtagttgtgtgggtttgagtgagtttcttaatgttgagttctaatttgattgcgctgtggtctgagagacagttatgatttcatttcttttgcatttgctgaggagtgttttacttccaagtatgtgatcgaatctagagtaagtgccatgtggcactgagaagaatgtatattctgtttttgggtaagtctacttgatcacagctgaaytcaagtcctgaatatctttgttaattttttgtctcgatgatctgtctgatattgacagtggggtgttaagtctcccactattgttgtgtgggagtctaagtctctttgtaggtttctaaaaacttgttttatgaaactgagtgtgcctgtattgggtgcatatatatttaggatagttagctcttcttgttgaattgaaccctttaccatgctgtatgcccttctttgtctttttttgatcttgttggtttaaaatctgttttgtcagaaactaggattgcaacccctgcttttttcctg

SEQ ID NO: 131660 - DNA, 601 bp, Human
cttaatttgtccggatatgacatttgggttggaaattcttttctaagaatgttgaatattggcatccaatctcttctggcttgtagggtttctgctgagaggtccactgttagtttgatgggcttacctttgtggtgatctgtcctctctccctgcgcttaacattttttccttcatttcaaccttggagaatctgatgataatgtgttttgggattgatcttctcatggagtatcttactgggtttctctgaatttcctgaatttgaatggtggcctatcttgctaggttggggaagttytcatggatgataccgtgaagtatgttttccgacttggatgcgatctccccgtctctttcaggtaccccagttgtaggttcagtctttttttttttttttttttttttttttgagatggagtcttgctgtgttgcccaggctggagtgcagtggcgtgatcttggcttactgcaacctccacctcctgggttcaagcgatccttctgcctcagccgcccgagtagctgggactacaggcacacaccaccacgcctggctgatttttgtatttttagtagagatggggtttcaccatcttga

SEQ ID NO: 131661 - DNA, 601 bp, Human
cagacttggcacatggactgtattttgccaacctctgcttcatactatacataaaaacattcataagacaacttgggttgtccagattactgtatgcttgcatgagtccctctggtggttgaaggaacatggaacaagtaattcttgagatggtgaaatttctgaagcaccttgaatttgagaattctagacttggaaatctggacttaggactgttcgtcatagttagattgtagtagctgcttatatcatttccagaggttggacacttgggaaaaagataaagcagcattcccacaarttttgtgtgcaggtctctgcagcactttaagacatcattctgacgtagaagatgtttgcttcatctacagtttatttgggagaagggtgtggttttcagcattagtcaacaactgaaatgggctggtacaataatttcatttgaataaactgtaaaatcttctatgggtgactttctgtccttttttttttttctcaaagggttgggatttaattaatttttcctatttaatcaagtacattcttaagtaaaggaaaaaggcagtttgaaaataagcagtacgattagatgaaattagta

SEQ ID NO: 131662 - DNA, 601 bp, Human
aaatgatttattatagacctaataaatgtcagggacttacttggtaggtactggagatacagcagttgaagttgttctcatatataatagaaatcatgtcattcccctttttaaaactcttacatggtttccattattctttgaataaaatccaaagcccttactacagttcttctatgtcttggcttcttctagctctaccctttcagttgttaactctagccatcttgggcgtttcttaaagaaaccaaggcgttatttgactcagactgtttatgcctattctcctgtgttgcaactrtcaccttctctccccagccccgctgactctctttctttgcttgctggttcctatttatctttcaggttttagcttacatgctaccctctcaaaaaggccatctctgtaatctctgtaaaacaagttccttgtctgattctctcttctaccacttagtagcacttaccatttttaatttgtgtttttgtcagtctctcctgagactgactgcttaatgagggcgggggaccatatgtgtgttatttactttttatgtacctaccatctataacagtttctataaaatattaatcacatcat

SEQ ID NO: 131663 - DNA, 601 bp, Human
catggtttccattattctttgaataaaatccaaagcccttactacagttcttctatgtcttggcttcttctagctctaccctttcagttgttaactctagccatcttgggcgtttcttaaagaaaccaaggcgttatttgactcagactgtttatgcctattctcctgtgttgcaactatcaccttctctccccagccccgctgactctctttctttgcttgctggttcctatttatctttcaggttttagcttacatgctaccctctcaaaaaggccatctctgtaatctctgtaaaacragttccttgtctgattctctcttctaccacttagtagcacttaccatttttaatttgtgtttttgtcagtctctcctgagactgactgcttaatgagggcgggggaccatatgtgtgttatttactttttatgtacctaccatctataacagtttctataaaatattaatcacatcattaatagttggtgaatgaatgagcaccttcttcacttggcttctgggatgctgcattcttttggttattgttccatttcactgatgtctcttctaacctcttaactcattcttctttttctcc

SEQ ID NO: 131664 - DNA, 601 bp, Human
ccacgcccggctaattttttgtattttcagtagagatggggtttcaccgtgttagccagcatggtcgtgatctcctgatctcgtgatccacccgcctcggcctctcaaagtgctgggattaaaggtgtgagccactgcgcccgaccaatactgtgtttttaataatagttcaaggctttaaaccttggtgtcacccttgactgttctttcacatccagtcaacaagttccgtcagcactactttaatccaaaatctgacttcttaatgctgcttctgcttttacagctcactaccacttargtcctgtattccatcttttctcacctggatgattacagtagcctcctaaatttatatcagttcatatatatcaaatgatgatacttttctgtttagaatgctccagtggtttcccatctcgtaaggccttacttgactagcctctccctgaccacccgtagctctcattattctgcctccttactcagttcaagtcccactggccttgttttttctcatacagtacacttcaacaatgctgtacctcaggtctttgcacttactattatcctctgcctgcattatgcccctaaatttctg

SEQ ID NO: 131665 - DNA, 601 bp, Human
gaattgcttgaatccaggaggcaagattgcgccacagcactccagcctgggcgacagagcaagactccatctcaaacaaacaaacaaacaaacaaaagaaaaacccacttttggaactctcctacctttgactacttgttatgttggataatatatacaggttgataatgcaggttgttatgttggataatatatacaggtcatattcaaaatctggaatgttccaatatcctatactttttagctctgacatgatgccacaagtggagaattcttaacacagactttttttcattcaccraattattaaaaaatattgtccaaaattacctttcaggctatgtgaataaggtatatatgaaacataagtgtatttcatgtttagacttgggtcccatatcaagatatctcattgtgtatttgtaaatgggccaaaaaaaaaaaatccaaaatcccaagcacttctggcctcaagcattttggataagggatattcagcctgtgtcccctccccctttttcagctacattgagttggattttctgttctttgcagcctaggaatatctcatttcttttcttttcttttttttttttttttt

SEQ ID NO: 131666 - DNA, 601 bp, Human
agcctgggcgacagagcaagactccatctcaaacaaacaaacaaacaaacaaaagaaaaacccacttttggaactctcctacctttgactacttgttatgttggataatatatacaggttgataatgcaggttgttatgttggataatatatacaggtcatattcaaaatctggaatgttccaatatcctatactttttagctctgacatgatgccacaagtggagaattcttaacacagactttttttcattcaccgaattattaaaaaatattgtccaaaattacctttcaggctatgkgaataaggtatatatgaaacataagtgtatttcatgtttagacttgggtcccatatcaagatatctcattgtgtatttgtaaatgggccaaaaaaaaaaaatccaaaatcccaagcacttctggcctcaagcattttggataagggatattcagcctgtgtcccctccccctttttcagctacattgagttggattttctgttctttgcagcctaggaatatctcatttcttttcttttcttttttttttttttttttttttgagacggagtcttgctgtgtcacccaggctggagtaca

SEQ ID NO: 131667 - DNA, 601 bp, Human
gctagcaaggctggtctcgaactcctgacctcaggtaatctgcccacctcggcctcccaaagtgctaggattacaggcatgagccaccgcacctggcctttatttttattttctaaaatttatttatctttaagcatgtaccacctttgggaaataaaatagattttattctaaagatgaaataattatttattaagcactcaccataaccagaattgtaacttactaaatgaagttttattttgtaatacattgtttcaaagatcaaaggaagaaatgttggtgctggcaaagaagccakttgaatcattgcttggcaataatagcatggtgacatgcatctttgtgtgttttgtttgtagcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaaggtatgagacttttggggcttgttttgcagataccatacacctagtgatgattagacaagtctattcagttaggtac

SEQ ID NO: 131668 - DNA, 601 bp, Human
tcccagccagaattttcctttttttgcattttgataagtagccatgctaaccggagtgatattatatctcattgtggttttgatttgcatttccctgatgattagtgatgttgagcatttttttatatacctgtttgccatttgtatgtctccttttgagaaatgtcattttagatcctttgcccactttttagattatttggggtttttttggctgttgagttgtttgagtaccttgtacattcttagtattaatcctttgttggatgaatagtttgaagatattttctcccattctacrggttgtctcctcattctgttatttcctttgctgtacagaagctatttagttgatagagttctatttctctgtttttattggctgtgattttgtagaattactcataaaatctttgcttagatcagcgttatggagctttccccctgtgttttcttctagtagttttttagttttggatcttaaatttaagtctttaatccattttgagttgatttttttgtatatgatgaaagatgggtttctaatttcattcttctgcgtgtggatatccagtgttcccagcatagttattgaagagga

SEQ ID NO: 131669 - DNA, 601 bp, Human
ataaatgataaatgtttgaggtgatatcttaacctgatttgattattatacattatatacatgtatcaaaatatcactatttactccgcaaatatgtataattattacatgtcaactaaaaagaggaacaaatatatcaataaagtatacaaaccttaagttgtacaacgcaatgaatatttaacacgcaagtataaatactcataaaaataccacacaggttaacatgtagaatattttaagcacttcatgagtctcccttgtaccccttcccagtttatacccccaaccgaagataatmatgcttctcaattctcatcatcatatattagttttcttatttctgcattttatataaatggatgtcctgctttgtatctaacatcatgtattcaacattatgattgtgggattcatcaaatttttgttgtttatttttttcattgctttgtgttattctagtgtatgaatttgcaagtgtttctttatctgttatcttttcatggacatttgatttgtgtccagtgttggacaatatgtataaagctgctttgtgcccttttttttaaaaaaaaaaaaaatgactttcgatggacaaagc

SEQ ID NO: 131670 - DNA, 601 bp, Human
cccttcccagtttatacccccaaccgaagataatcatgcttctcaattctcatcatcatatattagttttcttatttctgcattttatataaatggatgtcctgctttgtatctaacatcatgtattcaacattatgattgtgggattcatcaaatttttgttgtttatttttttcattgctttgtgttattctagtgtatgaatttgcaagtgtttctttatctgttatcttttcatggacatttgatttgtgtccagtgttggacaatatgtataaagctgctttgtgccctttttttwaaaaaaaaaaaaaatgactttcgatggacaaagcattcacttacttgggtatatgtctgggagtgtagttactgattttccaaagtggctgtgccaatttatactcccaatcagccatatataaaagttcttattcctccacattgtcaccaagtgttacacttgttagtcttttaattttaactattattgtaaagatataatggtatctggctgtggttttaatttgtgatttcttgattaccaatgatattgaacatcttaacatatttattggacatttggatatctttcatgaag

SEQ ID NO: 131671 - DNA, 601 bp, Human
ccttcccagtttatacccccaaccgaagataatcatgcttctcaattctcatcatcatatattagttttcttatttctgcattttatataaatggatgtcctgctttgtatctaacatcatgtattcaacattatgattgtgggattcatcaaatttttgttgtttatttttttcattgctttgtgttattctagtgtatgaatttgcaagtgtttctttatctgttatcttttcatggacatttgatttgtgtccagtgttggacaatatgtataaagctgctttgtgcccttttttttwaaaaaaaaaaaaatgactttcgatggacaaagcattcacttacttgggtatatgtctgggagtgtagttactgattttccaaagtggctgtgccaatttatactcccaatcagccatatataaaagttcttattcctccacattgtcaccaagtgttacacttgttagtcttttaattttaactattattgtaaagatataatggtatctggctgtggttttaatttgtgatttcttgattaccaatgatattgaacatcttaacatatttattggacatttggatatctttcatgaagt

SEQ ID NO: 131672 - DNA, 601 bp, Human
tatttttagtagagatggggtttcgtcatgttggccaggctagtctcgaactcctgacctcaagtaatgcaccacctcagcctcccaaagtgctgggattacaggtgtaagccaccgtgcctggcccctgataaaaatcttaatgcttgtttactattattatagttcaagctctccttccttggattaatcatggtagcctaactactgtaactaataatccccaattctcagtggtttaagaccaaaaaaattttttaaaagtttattttgcattttctttcaaattgttgctcaggawtccaagatacgttcatcttttgatgtcgtctttgatgcacagcttctactgtccatgggaaagaagaaggtgtatggaaagcactcaagatacttaactacattaacctggaaattactatcaatcatcaccacttacaattttttggctacaagtagtcacatggccctacttacatgcagaagtactgggaaaagtagtccctggctgggcagcctttcctcatcaaaactctgtattctgtagtataatatagaactctatacttaaatctttggtggttagtgtgccttctatgcc

SEQ ID NO: 131673 - DNA, 601 bp, Human
ctctccttccttggattaatcatggtagcctaactactgtaactaataatccccaattctcagtggtttaagaccaaaaaaattttttaaaagtttattttgcattttctttcaaattgttgctcaggaatccaagatacgttcatcttttgatgtcgtctttgatgcacagcttctactgtccatgggaaagaagaaggtgtatggaaagcactcaagatacttaactacattaacctggaaattactatcaatcatcaccacttacaattttttggctacaagtagtcacatggccctrcttacatgcagaagtactgggaaaagtagtccctggctgggcagcctttcctcatcaaaactctgtattctgtagtataatatagaactctatacttaaatctttggtggttagtgtgccttctatgccacatgctccacacaggaataaatcatggctaagtcactaatacgggctctagagccagactgttttggttgaatcctggattttactgtatccttgaccaagtaacttaacctttctttctagaccttttatttaatcattcattgcttaatttattcacctatctatcca

SEQ ID NO: 131674 - DNA, 601 bp, Human
ggttggttccatgtctttgcagttgttaattgtgctgtgaataatgtatgtatgcaggtgtctttttgacataatgacttcttttcctttgtatagatacctggtagtgggatggtcggattgaatggtagatctacttttagttttttgagaaatctccatactgttttccataattgttttaatttataatttacattcccatcagcagtggacaagtgttcccttttcatcacatcgatgccaacatctattgttttcttggctttttaataacggccattctggctggaggaaggcrgtatctcattgtggttttaatttgcatttacctgatggttagtgatgttgagcatttttttcatacgtttgtgggccatttgtatttcttcttttgagaagtgtctgttcatgtcatttgcctactttttgatgggattatttgtttttttcttgctgatttgagttccttgtagattctgggtattagtcctttattggatgtatagtttgctaatattttctcccattctgtgggttgtctgtttattgcgatgattatttcttccacagtgcagaatctttttagtttaattaggcc

SEQ ID NO: 131675 - DNA, 601 bp, Human
atggagtcttgctctgtcacctagcctggagtgcagagactccatctcagctcactgccacctccgcctcccaggttcaagagattctcctgcctcagtcttacgagtagctgggattacaggtgcctgccaccacgcccagctgatttttacatttttagtagaaacagagtttcaacatgttggccaggctggtccggaactcttgacctcaggtgatccactggcctcagcctcccaaagtgctgggattacaggtatgagccaccgcacatggctgcctcaacctgatttttaaaawtttttttcgtagagatggcaatctcactatgttgcccaggctggtctacaactcctagcctcaagtgatcctcccaccttggcctccctgccgtgggatcacaagcttgacccactatgcctggcctaacaaccaacttttctttctctctctctttttttttttttttttgtgatagggtctggctctgcagattgcacatcacccaggctggagtgcagtgatgcgatctcagctcactgcaacctcagactcacaggcccaagccgtcctccaatctcagtcttcctagtatatggg

SEQ ID NO: 131676 - DNA, 601 bp, Human
agatggcaatctcactatgttgcccaggctggtctacaactcctagcctcaagtgatcctcccaccttggcctccctgccgtgggatcacaagcttgacccactatgcctggcctaacaaccaacttttctttctctctctctttttttttttttttttgtgatagggtctggctctgcagattgcacatcacccaggctggagtgcagtgatgcgatctcagctcactgcaacctcagactcacaggcccaagccgtcctccaatctcagtcttcctagtatatgggactacaggtgtgygccaccatgcccagctatttttatgttttttgtagagatggggtttcaccatcttgtccaggcaggctggttttgaactcctgagctcaagcgattcatccacttcagccttccaaagtgctaggattacaggcatgagcctccacgccctgctgcactttatttttaatagcccaaggttataaacaaaccaaatacacgaataaactctggtgtatccatacaatgtactaccactcagcaatataaaagaataaactgttgatacatgcaacaacttggacagttctccatagactt

SEQ ID NO: 131677 - DNA, 601 bp, Human
tagccgggcatggtggctcatgcctgtagttccagctactcaggaggctgaggcagaagaattgcttgaacctgggaggtggaggttgcagcaccactgcactccagcctgggcaacacagcgagactccatcttaaaagaaaaaaaaattaaattgaatttaaaaaggacttaaatttcccagatgtttctttcctgtgtggtacagcctagtgataatgcctgtcttaccctgagagaatctggtgattctatagagagaatgaagtggaggttctagattctaggagagctaaaggcwaggcttaatgatctgttcttaaaatggggtgggggcggaagggaaggcataatggaagtctgcatactgaagagtgagacctctgaccattttattagttcccacaatgcttgcaataggtttactatgctccctaggcagaagactgcaggatgtgttttaggcaaactcactggtccagtagaagagacctgtagattctaagaaataaactttacttttaacatgtttaaattactgttactttggatttttgtttatgcagccaaacttaatcctaatataaaaggcaattattaa

SEQ ID NO: 131678 - DNA, 601 bp, Human
taaaaaaaaaaaagtttcaaagtgaaaagccttgataatgactatagaagacacagtgaagtagttggacgcttacacatgcttgataatgactatagaagacacagtgaagtagttggacacttaacacctgcactatcagtgtgagtgttgccaggtacaaaggcaggcgtgttgatcatcaccctaaattccctgagtggcattactgacaatgacatgattttttgaaatgatgaactctttacatggtaagttgtactcatgaaaaattcatgtatcttaaaattgcatcttttgrgggtattaatatatactaaggagttctaagtttataaacattttccttatacatgaatgtctgatgggatattctcaaattctgtgagatgtagactattcactttgaagaactatagttatcccatgtattgagataaagttgaatctctggccctttctccttaagtatctgtagtgcaccccacttatcatgttgacaactaaacgcatcttcacaacatttaaaaaatgcctctgctccaccaccaccctcccctgcagagggtgatactgtccaagttaagaaataccattctaa

SEQ ID NO: 131679 - DNA, 601 bp, Human
tgaattagttctaaatgtggagggaagccattagagagttctgagcaggggagccaaagttatccaattcatgttaacaagtttattctgactcttggatagagaatggactatagggcaacaagagggaagacagagagcagttataaggctattgcaatagtccaggctttaattgcttctttataaatgttacaggactgaaaactatcctgggtaaaattgtattacctaataataggcaaaagtcttaatgtcttcttctgggtacagggaggataaccaataaattatgaagttygctggttacaagttccactgtaaagccaaggctggacaagtaggcgggaataaaactcacctgtaagactccaccaaatacaaggaggctactataccaaggaagaggaggcatggcaggagaactgagacccccctcacttcatagttttacctactgaaggcagaaacccttaggcacttaggctgtcatttacaaagactgaagtattatcaggagagctgaaagaagtctctccaagccaatctcaaaagacccaagatctagtaacatagctgaagagatgccctgaggctcaga

SEQ ID NO: 131680 - DNA, 601 bp, Human
tataaaattgtaagtttataatatatggaataggggttttcagactctttctactaaaagtgtctccgatttaacagtctgttagaggaccttcctatatacccaaatctttaggtctggtctgaatggttaatgttgcccagagtacagaatcagtatttcttttgtgttttctacagcagagtcagaaagctttgtacagttttggtcgatctagatatttatcttaaaaaaacaaaaccaaacccacattcctttatgtaacgtattccagtgttttatttcttaaactaatttggawatttggagggctgctcactggttacttttggttgtattttttgaaataacattttgtgtgtcaatagtatatgatagagatataatagacttactattgttggcatattgtaaaatgcatggataatgaattgtgcttttctgtgtttctttttcctgattagctcctgggctataacgaaaagccaataaatctacaaatgtttattgggacagcagatgatcgatatttacgacctcatgcattttaccaggtgcatcgaatcactgggaagacagtcgctactgcaagccaagagat

SEQ ID NO: 131681 - DNA, 601 bp, Human
tggccaacttctgaatgagaatgcaatagagttttgtacaaaaggattatatatagttgcctgtaatagaaacctgatatgcagtggcttgaacagttaggggtttagtgttttatcacataaacgaaatatacagatagatattttagggctagcacagtagctgcataagtcattagggccccaagcaagttttttcttctttgccgtctttagcatgtggtttccatcctaaagattgtcttatgatctaaaatggctgctggagctctagccatgacatccttattaccagaggggaaataaggagaaaggtgtggaggaagggtaaaagggaacttccattggagtcaaatcctcttttaagaaccttttcctaaaacctacttaacaactctacatctcattgatcatgcttatatgtaaggaacacatggttatgtttaccagaacacattgtcacctcaaataatttagggaggccgagcaccatggctcatgcctgtaatcccagtattttgggaggccaaggcaggcggatcacctgagctcaggaatttcagaccagcctgagcaacatggcgaaaccttgtctctacta

SEQ ID NO: 131682 - DNA, 601 bp, Human
ggcagaggttgtagtgaccccagattgcgccattgcactccagcctgggcgacagagtgagacttagtctcaaaacaaaaaacaaaaaaccttattctgttaattactaccagaaaagaaaagttaatataaatttaaataaaatctttaaataaatataaatttaaataaaatttttgcctgctttggttcagatggacagtactcaagaacctaacccagcaaatcattgcataggggctatgacagagttttttcacagcaaaggcagacagctagctgataatctctactcttaaattttttttttttagactgtctaaatttgttgcccaggctggagtgcagtgtcaccatcttagctcactacaacctctgcctcccaggctcaagtgattctcgtgcttcagccacccaagtagctgagattgcacacgtgcaccaccactcctggctaatttttgtatttttagtagagacagggttttgccatgttgaccaggctggtctcgacctcctggcctcaagcagtccacccgctttagcctcccaaagtgctgggattacatctagatgtgagccactgcaacggccttaaaca

SEQ ID NO: 131683 - DNA, 601 bp, Human
gacagagtgagacttagtctcaaaacaaaaaacaaaaaaccttattctgttaattactaccagaaaagaaaagttaatataaatttaaataaaatctttaaataaatataaatttaaataaaatttttgcctgctttggttcagatggacagtactcaagaacctaacccagcaaatcattgcataggggctatgacagagttttttcacagcaaaggcagacagctagctgataatctctactcttaaattttttttttttagactgtctaaatttgttgcccaggctggagtgcagtgkcaccatcttagctcactacaacctctgcctcccaggctcaagtgattctcgtgcttcagccacccaagtagctgagattgcacacgtgcaccaccactcctggctaatttttgtatttttagtagagacagggttttgccatgttgaccaggctggtctcgacctcctggcctcaagcagtccacccgctttagcctcccaaagtgctgggattacatctagatgtgagccactgcaacggccttaaacatttgtgttctataatgtagaaagaactttggaatctcagcctgtatttat

SEQ ID NO: 131684 - DNA, 601 bp, Human
aatttgttgcccaggctggagtgcagtgtcaccatcttagctcactacaacctctgcctcccaggctcaagtgattctcgtgcttcagccacccaagtagctgagattgcacacgtgcaccaccactcctggctaatttttgtatttttagtagagacagggttttgccatgttgaccaggctggtctcgacctcctggcctcaagcagtccacccgctttagcctcccaaagtgctgggattacatctagatgtgagccactgcaacggccttaaacatttgtgttctataatgtagaargaactttggaatctcagcctgtatttattcagatactcgagcaaaactttcttgaggaaaaatattgacaccaggcatcctattggacacattttcaaataaggttaacatgcccaacctctgaatgagaatacaagtaggcttcttcccttttgttctgggatcttacttttttatatagcatcagaagcatgtgatatgtgattagtcagctgtagagggaaatttaaaaatcacctttgaactgtctttttccaaaaactcaggaaattgatccctagacgatagtttgcaggccat

SEQ ID NO: 131685 - DNA, 601 bp, Human
tgagcctgtttactcagtagctaattgctaggataaactagtatcctagtagcttgttgaatgtaactatattattcagtacagtggttgaatataatatagttccagataatggtaggtttaaaattcccaggtgatagataagaccatggttcaaaataatttatgcataagtgaaccttaagtatgtattaagtgtctttactgttctcttaaggcaataaggtgtggaaaaattcatagatactcccttggttttgcctactaagccatgggcttggttatttcaagcctaaactcttttttttttttttttaaacatctcaattggctttattggtgattctggaattgggcaacacttcattccataaaatacataagtgttccgacaaggttgactttatagacagagaagggctgaagaaagacaagcaaagatcaaagaacatgttgatcatttttttttttttaattgatcattcttgggtgtttctcgcagagggggatttggcagggtcataggacaatagtggagggaaggtcagcagataaacaagtgaacaaaggtctctggttttcctaggcagaggaccctgcc

SEQ ID NO: 131686 - DNA, 601 bp, Human
gcggccgggcgaagacgctcctcactttccagactgggcagccaggcagaggggctcttcacgtcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctaggcaccattgagcactgagtgaaccagactccgtctgcaatcccagcacctcgggaggccgaggctggcggatcactcgyggttaggagctggagaccagcccggccaacacagcgaaaccccgtctccaccaaaaaaatacgaaaaccagtcaggtgtggcggcgtgcgcctgcaatcgcaggctgaggcaggagaatcaggcagggaggttgcagtgagccgagatggcagcagtacagtccagcttcggctcggtatcagagggagaccgtggaaagagagggagagggagaccgtggggagagggagagggagagggagagcgcctaatctcttttctaagaccattacactaacgcataagtcacagagctaccc

SEQ ID NO: 131687 - DNA, 601 bp, Human
gggaggtggaggttgtagcgagccgagatcacgccactgcactccagcctaggcaccattgagcactgagtgaaccagactccgtctgcaatcccagcacctcgggaggccgaggctggcggatcactcgtggttaggagctggagaccagcccggccaacacagcgaaaccccgtctccaccaaaaaaatacgaaaaccagtcaggtgtggcggcgtgcgcctgcaatcgcaggctgaggcaggagaatcaggcagggaggttgcagtgagccgagatggcagcagtacagtccagcttyggctcggtatcagagggagaccgtggaaagagagggagagggagaccgtggggagagggagagggagagggagagcgcctaatctcttttctaagaccattacactaacgcataagtcacagagctaccctacaagatgctttaaatataggatgccagtatttattgccttagctctttgcagctcctctgtttttttaacattggattaatattgatgtagcagtgctacaccttgatttaaaatggcatggtggctcatgcctgtaatcccagctctttgggaggctgaggtgggcg

SEQ ID NO: 131688 - DNA, 601 bp, Human
cgagatcacgccactgcactccagcctaggcaccattgagcactgagtgaaccagactccgtctgcaatcccagcacctcgggaggccgaggctggcggatcactcgtggttaggagctggagaccagcccggccaacacagcgaaaccccgtctccaccaaaaaaatacgaaaaccagtcaggtgtggcggcgtgcgcctgcaatcgcaggctgaggcaggagaatcaggcagggaggttgcagtgagccgagatggcagcagtacagtccagcttcggctcggtatcagagggagaccrtggaaagagagggagagggagaccgtggggagagggagagggagagggagagcgcctaatctcttttctaagaccattacactaacgcataagtcacagagctaccctacaagatgctttaaatataggatgccagtatttattgccttagctctttgcagctcctctgtttttttaacattggattaatattgatgtagcagtgctacaccttgatttaaaatggcatggtggctcatgcctgtaatcccagctctttgggaggctgaggtgggcggatcacgagatcaggagatcgag

SEQ ID NO: 131689 - DNA, 601 bp, Human
ctgctatttcccctgaagacccatgttggcatgttaacatgaataatcactaatttgatataacttgataatactgctttgagctaaagtgcagttgttcagtatcagttatataatttgttatctataaatggcaaatgcttttttagttttcaaaattgttgcatttaaaaaaaattcttctcctgtgtctttcttaagatgaaaaattttgagtggcttaattccttttgggattctgccttctgttttattggttgtctttttttttttctttttcttttttttttttttttttggkggagatggagtcttgctctgttgcccaggctggagtgcagtggcgtgatctcagctcattgcaacctctgcctcctgggctcaagcagttttcctgcctcagcctcccaagtagctgagactacaggcacacgccaccatgcctggctaatttttgtattttagcagagacagggtttcactgtgttggctaggctggtctcgaaatactgacctcaggtgatccactcaccttggcctcccaaagtgctgggattacaggcatgagctactgcacccggccggttcttgtcttgctatc

SEQ ID NO: 131690 - DNA, 601 bp, Human
aacagaggcacaagtatctctagtactcattcaaggttatttgctttttagtgatagagctgtgctgcctagaaaacaggttttcttatactctgttgattatataatgttttatatctgttaaccgtatgtgttctttttttttttttttttttttttttttttttttttttttgagacggagatttactcttcttgcccaggttggagtgcagtgttgtgatcttggctcactgcaacctccacctcctaggttcaaacgattctcctgcctcagcctcccaagtagctgggattacargcacccgccaccatatctggctaagtttttgtatttttagtagagacagggtttcatcatgttggccaggctgccctcgaaatcctgacctcaggtgatccacccgcgttggcctcccaagtgcagggattacaggtgtgagccactgcgcccggccaaacacatgtattctttttttcaggtgagggggttgggtgttttttgagacggagtctcactctcttgcccaggctggaatgtggtggcgcaatctcaactcactgcatcctccacctccagagtttaagcgattttctcctg

SEQ ID NO: 131691 - DNA, 601 bp, Human
ggttcaagtaattattgtgcctcagcctcccaagtagctgggattacaggtgcccaccaccacacacagctgatttttgtatttttagtagagatggggttttaccatgttggtcacagtggtcttgaactcctgacttcaagtaatctgcccacctcagcctcccaaagtgctgggattacaggcgtaagccactgcgcccggcctcgattttcttttattgtatttgtatgtctttttgtaaacacacatacacacacaatgttttttaattgggcttatctgatacagttttatatctttttgcagttttcacttatactatcatagatgttttcttctgttattaaatattcttcaaaaatattattttcatcacgcaagtagttttttggcatgtttatgccatctgttgaacacatttttattttatttttttgagatggagtcttgctctgtcgcccaggctggagtacagtggcacgatctcagctcactgcaacctctgcctcctgggttcaaacaattcccccggctcagcctcccgaatagctgtgattacaggtgcctaccaccacgcctggctaatttttgtattttt

SEQ ID NO: 131692 - DNA, 601 bp, Human
ttttttaattgggcttatctgatacagttttatatcgttttgcagttttcacttatactatcatagatgttttcttctgttattaaatattcttcaaaaatattattttcatcacgcaagtagttttttggcatgtttatgccatctgttgaacacatttttattttatttttttgagatggagtcttgctctgtcgcccaggctggagtacagtggcacgatctcagctcactgcaacctctgcctcctgggttcaaacaattcccccggctcagcctcccgaatagctgtgattacagrtgcctaccaccacgcctggctaatttttgtatttttcaatagagatggggtttcaccatgttggccaggttgatcttgaactcctgacctcagatgatctgccggccttggtctcctaaagtgctgggattataggtgtgagccaacgcacccagcctgtgcacactttgctgttacttagaatgtacctgtaatcagtgtttgttttccggacccttctctatgtcctatttagaacagtagagacatgagtattttctgagatctaggttggtgcttggtacatcccaagtaataact

SEQ ID NO: 131693 - DNA, 601 bp, Human
ttattttatttttttgagatggagtcttgctctgtcgcccaggctggagtacagtggcacgatctcagctcactgcaacctctgcctcctgggttcaaacaattcccccggctcagcctcccgaatagctgtgattacaggtgcctaccaccacgcctggctaatttttgtatttttcaatagagatggggtttcaccatgttggccaggttgatcttgaactcctgacctcagatgatctgccggccttggtctcctaaagtgctgggattataggtgtgagccaacgcacccagcctgwgcacactttgctgttacttagaatgtacctgtaatcagtgtttgttttccggacccttctctatgtcctatttagaacagtagagacatgagtattttctgagatctaggttggtgcttggtacatcccaagtaataactgatcctaaatcccatacctatctttttttttttttttcttgagacagagtctcactctgttgcccaggctggagtgcaatggcatgatcttggctagctgcaatcttcgcctcccaggttcaagagattctcctgcttcagcctcccaaatagctgagat

SEQ ID NO: 131694 - DNA, 601 bp, Human
tttaaaaatgtttaaaacttatgaaagactttttttttttgagacagtgacttgttctgttggctaggctggagtgcaatggcacaatcttggctcactgcaacctccgcctcctaggttaaagcgattctcctgcctcagcctcccgagtagctgggattaccggcacacgccaccacacctggctaatttttgtatttttggtagacacgggattttgccaccttggctaggctggttcttaaactcttgacctcaagtgatctgcccacctcagcctcccaaagtgctaggatctacrcgccagtcatgaaagactgtttttataagaataatataatataacaaatacttaaacctactaccaagtttaagaaatacatttacctttgaaagcccctgggtcccccttctcaaatggaaccatcatctgaattgacccttgcttttcttttttttgagacggagcctcgctctgttaccccggctggagtgcggtggcactatctcagctcactgcaacctccacctccgtgttcaagcaattctcctgcctcagcctcccgagtagctgggattacaggcgcccaccaccatgccc

SEQ ID NO: 131695 - DNA, 601 bp, Human
gaaattagtgactctgaggagtgagatttacatgagataagtccaagaaggtgattcaaacaccaagagtgttttgaatatacagacagaacatcagtgatgataaagaatatcaggttttggggacagatgagaggggataggatttaaaatgggccttagaggggagaaggaacagaagggaaagaagataaagaagatggattaagatggatgtagatgaaaaaagtttgtagatttagtaatggagagtttaaggagcttccatatgatagctttaggttttttccgcaaaaaatgrcatgaagtgtcctgttgtggagcagagggaagtttgggtgatttcacagttggacaatcatggagaatgtttgaaatagtttctgtaggccgggcgctgtggctcacactttgtaatcccagcactttgggaggttgaggtgggtggatcacgaggtcaggagatcgagaccatcctggctaacatggtgaaaccccgtctctactaaaaaatacaaaaaattagccgggcgtggtggcgggcgcctgtagtcccagctactcaggaggctgaggcaggagaatggcgtgaacccaggag

SEQ ID NO: 131696 - DNA, 601 bp, Human
acactttgtaatcccagcactttgggaggttgaggtgggtggatcacgaggtcaggagatcgagaccatcctggctaacatggtgaaaccccgtctctactaaaaaatacaaaaaattagccgggcgtggtggcgggcgcctgtagtcccagctactcaggaggctgaggcaggagaatggcgtgaacccaggaggcagagcttgcagtgagccaagatcgcgccactgcactccagcctgggcaacagagcgagactctgtctcaaaaaacaaacaaacaaacaaacaaacaaacaaaamacacacaaatagtttttgtaaagagagagaaagttctctacagaaacctagtagcattgtagacttgattgaagggcaccattgatgttgatcatcaatttacagatactattataattaattctataattaggggtttatttatttattttttttttttgagagagagtcttaccctgttgctcaggcttgagtacagtggtgtgatcttggctcactgcaacctccgcctccagggttcaagttcatatgattttcctgcctcagcctcccaagtagctgggattacaggtaccctgg

SEQ ID NO: 131697 - DNA, 601 bp, Human
ctactcaggaggctgaggcaggagaatggcgtgaacccaggaggcagagcttgcagtgagccaagatcgcgccactgcactccagcctgggcaacagagcgagactctgtctcaaaaaacaaacaaacaaacaaacaaacaaacaaaaaacacacaaatagtttttgtaaagagagagaaagttctctacagaaacctagtagcattgtagacttgattgaagggcaccattgatgttgatcatcaatttacagatactattataattaattctataattaggggtttatttatttatttwttttttttgagagagagtcttaccctgttgctcaggcttgagtacagtggtgtgatcttggctcactgcaacctccgcctccagggttcaagttcatatgattttcctgcctcagcctcccaagtagctgggattacaggtaccctggctaatttttgtatttttagtggagacggggtttcaccacgttggccaggctggtctcgaactcctgacctcaggcaatccgcttgccttggccttccaaagcgctgggattgcaggtgtgagccaccgcgcctggcccaggggtttaatttt

SEQ ID NO: 131698 - DNA, 601 bp, Human
ggcaggagaatggcatgaacccgggaggtggagctttcagtgagccgagatcgcaccaccgcactccagcctgggcgacagagcgagactccgtctcaaaaaaaaaaaaaaaaaaaaaaggcaaaccaggagaatttgccgcctttcagcccatgaattgggaggacaataaaaaggcagaatcctagaggatattacatttgggaatggaaatcagtagagctctggaatggaaagaaaacattgggttgcactgtaactcatcactggccttatggttgatagatgacaaatcaggtgrcatacactaacagaagaatagacacacaggaatgcttgtgtagtacttgttctggttggttactatctctgtagcatttagcttttttcatttttttctaaaatgacattttgaataaaatttttacaaaagtcagtacattactgtaattaaaaaaaaaaaaagacaggtggaaagactatattaaaacattcaaattcttggccaggcgctgtagctcacgcctgtaatcccagcactttgggtggatcacgaggtcaggagatcaagatcatcctggctaacatggggtgaaaccct

SEQ ID NO: 131699 - DNA, 601 bp, Human
gcactttgggaggttgaggtgggaggattgcttgagtgtggaagtccgagaccagcctgggcaacacagtaagactttgtctccacaaaaaataaacatgagcatggtggcgcacgcctgtattccagctactcaggaggctgaggtgggaggatcccttgttgcagtacgccgagattgcacgatggcactccagcctggccgacagagtgagaccctgtttcccaaaaacaaaaaaaagaaattgttttctgaatttttattcagatgtttattgctagtttatagaaatataacttaytatttttgtatgttgattttgtatcctgcaactttgcagaatgtatttgttagtttttttgtggattttagtacttgttttgatccccacatgatggcagaggatcaagtgagatgcatgtgagaaccattgtaaagcagaagttctatgaatgtcagagtcatgatttctggtatatgatgcaacatgtaaaaccagatgacttggtaggcttcggatcagggatccccaagtcaatacttaattaggccctagggctttgttttttgttttagttacttaattttgaataggtaataa

SEQ ID NO: 131700 - DNA, 601 bp, Human
aatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacrggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggtaagttcatctctgatatgttcttgaagtagtgaagattcagggactttattctcccaagtgtcatgaaaaagtttctatggattgcttattggcatatggttgggcttttaaataagttgttattagaaatatat

SEQ ID NO: 131701 - DNA, 601 bp, Human
gtttcacagtcaccctgtggaacccacatgtaagaaaagcagctgtggtctcagtgctttgggaggccaaggtaggaggattacttgagactaggagtttgagaccagcctgggcaacataatgagacctcatttctaccaaaaaaccctacaaaaattagctgggtgtggtggtgtgtgcctgtagtcctagctactaggaagactgaagtgggaggatcgcttgagtccaggagttctaggctgcagtgagctgatcgcatactattgcactccagcctgggtagcaggaaagtgagamcctgtctctaaaaaaaattaaaaagccctccacatatgcagatttcacattcgagaatattcttttttagatccatgtttggttgaaaaaagctgtgtataagtggacccagacagctcaaagctgtgttgttcaagggccacctgagtatgttttcagtaaatgaacatcagaggcaagtcagataacacagcagaaatagagaagaagggtatgtttgtcagggaaggatatgtctgtggtggggtgaggtatggggtccggggtgggggatgggggtgattggtatggtacaggatg

SEQ ID NO: 131702 - DNA, 601 bp, Human
tatggggtccggggtgggggatgggggtgattggtatggtacaggatggttttaaagccatgaggggacatgccaggtcatttgtgtgtaaacagaaggtatatgtgtaaactagagcaacacctaaaattgcatagcatttttctatttattatctaatctaatcgttaccattcctcaaactctgaggtagatagtgacatttatagagttggacttttgaaaaatcacacaactagtaagcagcagaactgagactggttcaatccagtctttttcttgtggcactacagctgcctcycagaaacagcaggccatggtggttagaacagaactctctactaaacggaatccctcaaggtttttctaattcctggagaatattctccagaaatgcatgtgcacaatttcactgcgttaacccatgttcacaactgcatctgatctgttacactgtttggtgtacttgagcactctggtatttaagcattttgctgctgttctctgtgcacagctggcataagtgtcactccctactaaatgatgaaaccaaaaggtagagagcaggctgctacttttatgcaaaacagatttgaaataa

SEQ ID NO: 131703 - DNA, 601 bp, Human
aaaaccctgtctggaaaaattacaaaagttacctgggcagggtagcacgtgcctgtaataccagctacttgggaggctgaagtgggaagattgcttgagcccaggaggtcgaggcttcagtgagtggtgatcatgctactacactccagcccaggtgacagaatgagacccttgtctcaaaaataaagtagttatagagctggaaaatattctaatatagctctcattttatggataaaacatctgaattttacacagagcctaaggtgttcatccaggataagacacttgaattatggcrgaataaagactaaaacctgttttctgactctaggagtttttctagaatctgtaatcaagtttctagtcagtgtgttgaggttttagaactggtgtcaaacaaagaatacatgaaagaaaatgccattttctccatagagccttgattgtgagaggaaccagggtaatcttaagattatagattctggccaggtgcagtggttcatgccttgtaatcccagcacttcgtgaggccaagatgggaggatcgcttgagcccaggagttctagaccagcctgggcaatataccctgtctctacc

SEQ ID NO: 131704 - DNA, 601 bp, Human
gctagccaacatggtgaaaccccgtctctactgaaaatacaaaaataagccgggtgtggtggcacacatctgtaatctcagctacttgggaggctaaggcaggagaatcgtttgaacctgggaggcagaggttgcagtgagctgagatggtgccactgcactccagcctgggcgacagagcaagactccatctccaaaaaaaaaagaaaatagtgaaaattagccacgcatggtggtgaacgcctgtaatttcagctactcatgaggctgaggcaggagaatcacttgaacctgggagacrgaggttgcagtgagctgagatcaggccactgcactccagcctgggcagcagagtgatactctgtctcaaaaatacaaaaaatggtaatgaattatggttactgtttcttgataaactcatattttttttgaacactgtgctaggcactttgctagtggctcattaattctttgcaatcatgtgtgaaatgtgaattattagtcttaattttgtatagatgtggctcagagaccttaagcacatcccagcgttatatggccacaaataattggggcagacatttgaatccagatttgtctg

SEQ ID NO: 131705 - DNA, 601 bp, Human
gggggaacggagacaggagtttgctctgttgatcaggctggagtgcagtgggaccatcatggctcactgcagcctcgacctcccaggctccagcatttctctcccacctcagcctcccgagtagctggggctacaggtgcctgccaccacatccggctaatttttaaatttttttgtagaggcaggcttttactacgttgctcaggttggtctcggcctcccaaagtgctaggattacaggcgtgagccaccatgcctggcctgtgtttcttaatataatcattttttgaacaagtaataygttcatgtggtttaaaatgctaaagttacaacattatacatagttaaaaaaaatctgtcttctaagtagatactccattgtcctctgtagggagaattggagttactagtttcttggctgtcattctatgcatttataaacagttgcatttttttccccttatttttactagcatattatgtatactagtttatactttgcatttcccatgtaatatagaatcttgagagattattctatactgtaacataaaagagcttccttgaaaagatattcttaaaatagaatattccataaaat

SEQ ID NO: 131706 - DNA, 601 bp, Human
gattgggcacagcggctcacacttgtaatcccagcactttgggaggctgaggcaggctgatcacctgagttcaggagttcaagaccaacctggctaacgtgggcccacctggccaacatggggaaactctgtctctactaaaaatacaaaaattagctgggtgtggtggcatatgcctgtaatcccagctatttgtgggactgaggcaggagaatcgcttgaacctgggagacagaagttggagtgaaccaagattatgccactgcactccagcctgagactccgtctcaaaaacaaaccaaaaaaaaaaaccccaaaacaagaattgttttcttaattttttttggacctttcattccaagtatatagaagtacaactgaatattgtgtgttgattctatattctgccactttggtgactttatttgttagtgctaacatttttttgtctgtgtggattctttagagttttatgtttatactatcatgccattcgtgaatagagataattttctctcttcctttttaatttggatgggctttatgtatttatttatttttctaacctaattgctctggctagaacttctagtggtaggct

SEQ ID NO: 131707 - DNA, 601 bp, Human
tttgtttgtgatcttagggggaaagcttttgttctttgttgataatgataggaactaacagtttttcatatatggcctttttcatattgaggaaattccttctattctttgtttattgaatgttttcatcttgaaagagcattgaattttgataaatgagttgggcacggtggctcacgcctgtgataccagcactttgggaggctgaggcgggcagatagctagaacccaggaggtggaggctgcagtgagccgtgattgggatgctactgcactccagcctgggcaacagagtgagacygtctcaaagaaaaagagttctttccctgccactgctgagttgagtggaggcagaggcttgggtgcattcaagattcagcttcacccgtagaccaccaccatggccacggaaggtgttgctgctggaggtgtggtggctgttaatactgctttacaagaggtgttgaagactgtcctcacccatgatggcctagcacgtggaatttgcaaagctgctgaagggtcaggcccatcttttgtgtgtttgcatccaactgtgatgagcctatgtcaagttcatagaggttctttgtgctgaaca

SEQ ID NO: 131708 - DNA, 601 bp, Human
agttaggaagtgtttccttttctttaatctttttaagagtttcaaaagaatcgaaactcttttttctttgttttgttttgagatggagtctcgctctgtcgccaggctggagtgcagtggcgcgatctcagctcactgcaacctccacctcccgggttcacgccattctcctgcctcagcctctcgagtagctgggattacaggcactcaccactatgcccagctaatttttgtatttttagtagagacggggtttcaccatgttggccaggatggtttctatctcctgaccttgtgatcytcccgcctcggcctcccaaagtgctgggattacaggcgtgagccactgtgcccggctgaaactcttcttctgtaaatgttttttgttgttgttgttgttgttgttgttgtttgagtcggagtctcaccctgttgcccagtctggagtgcaatggcatgatctcagctcactgcaacttccgcctcccaggttcaagcaattctcctgcctcagcttcctgagtagctgggattacaggcatctaccacacgcccagctaatttttgtgtttttagtagagacggggtttcaccatgctgg

SEQ ID NO: 131709 - DNA, 601 bp, Human
aactcttttttctttgttttgttttgagatggagtctcgctctgtcgccaggctggagtgcagtggcgcgatctcagctcactgcaacctccacctcccgggttcacgccattctcctgcctcagcctctcgagtagctgggattacaggcactcaccactatgcccagctaatttttgtatttttagtagagacggggtttcaccatgttggccaggatggtttctatctcctgaccttgtgatcctcccgcctcggcctcccaaagtgctgggattacaggcgtgagccactgtgcccrgctgaaactcttcttctgtaaatgttttttgttgttgttgttgttgttgttgttgtttgagtcggagtctcaccctgttgcccagtctggagtgcaatggcatgatctcagctcactgcaacttccgcctcccaggttcaagcaattctcctgcctcagcttcctgagtagctgggattacaggcatctaccacacgcccagctaatttttgtgtttttagtagagacggggtttcaccatgctggccaggctggtctcgaactcctgacctcaggtgatctacccgccttggcctccca

SEQ ID NO: 131710 - DNA, 601 bp, Human
tctcgctctgtcgccaggctggagtgcagtggcgcgatctcagctcactgcaacctccacctcccgggttcacgccattctcctgcctcagcctctcgagtagctgggattacaggcactcaccactatgcccagctaatttttgtatttttagtagagacggggtttcaccatgttggccaggatggtttctatctcctgaccttgtgatcctcccgcctcggcctcccaaagtgctgggattacaggcgtgagccactgtgcccggctgaaactcttcttctgtaaatgttttttgttgttgttgttgttgttgttgttgtttgagtcggagtctcaccctgttgcccagtctggagtgcaatggcatgatctcagctcactgcaacttccgcctcccaggttcaagcaattctcctgcctcagcttcctgagtagctgggattacaggcatctaccacacgcccagctaatttttgtgtttttagtagagacggggtttcaccatgctggccaggctggtctcgaactcctgacctcaggtgatctacccgccttggcctcccaaagtgctgggattacaggcatgaggcaccgtgcc

SEQ ID NO: 131711 - DNA, 601 bp, Human
gtcacatcacagccaaaccaaggctaaagcttacttcttccagtgttaagcccagtgtgcttcccatgtgtgaagcaacaagttggtcactaatgatcttggtaagaaggaagtattatgtggagtgaagggatcgatggatgactgagtaaataagaggtgagaacatagaagaaacagcagtgtagacaactcctttaagatgttaagccatgaaagaaagaattagatacagaggggaacatggggttgagtgtttttatttgcttgcttgcttctttgagatagagagatttgcactttttttttttttttttttttttgagatggagtcttgctctgccacccaggctggagtgcagtggtgcgatctccgctcactgcacgctccgcctcccaggttgacgccattctcctgccttagcctcccgagtagctgggactacaaggcgcctgccaccacgcccggctaattttttgtatttttagtagagatggggtttcactgtgttagccaggatggtctcgatgtcctgacctcgtgatccgcccaccttggcctcccaaagtgctgggatgacaggcatgagccaccgcgctg

SEQ ID NO: 131712 - DNA, 601 bp, Human
gttaatagtattagctaagtgagtataatggagatcccagagacatttccacataggaaatttctctcacacctcatgataattcagagatcaagattcctttcaatttgttgttcctctttctccttaggttttgtcaaagcagagaaaccacttagtcatgactgagtcttagcccgaggaagggatgggaaaaagggaggaagaaggaggccaagcaagtgatgaggaagatacgtacatcgcttttgctcacatttcattgaagaaaacgaattgcatgggccatacctagctacastggggaagccaggaaatatactctgtagctgggtgtcagtgtgactaactaaacctcgattactgtggaagaatgaattaagataattagcagcctaccatagataccttctaaattttcaggaacttatttctgtctgtagcttgaaaaatcaaatgaatattttttggtttttcccttttttttgttttatttggagacagggtctcacactgttgcctaggctggagtgcagtggtgcacgatcatagcttactgcatcctggaactccctgggctcaagtgatcctcttgtctcaa

SEQ ID NO: 131713 - DNA, 601 bp, Human
ctacactggggaagccaggaaatatactctgtagctgggtgtcagtgtgactaactaaacctcgattactgtggaagaatgaattaagataattagcagcctaccatagataccttctaaattttcaggaacttatttctgtctgtagcttgaaaaatcaaatgaatattttttggtttttcccttttttttgttttatttggagacagggtctcacactgttgcctaggctggagtgcagtggtgcacgatcatagcttactgcatcctggaactccctgggctcaagtgatcctcttgyctcaacctcccaaagtgctgggattacaagcatgacccaccacacctggccaaattaatcagattttgataaatccaaattaatttctcaactcatgccataaataggtgaattcaggccaggcatggtggctcatgcctgttatcccagcactttggaaggccgaggcagacagatcacttgagttcaggagtttgagaccagcctgggcaacatggcaaaccctgtttctaccaaaaatttaagaaaaaattggccaggtttggtgctgtgcaggttgcagtgagccaagatcgtgcc

SEQ ID NO: 131714 - DNA, 601 bp, Human
cacgcctgtaatcccagcactttgggaggctgaagcgggcagatcacaaggtcaggagtttgagaccagcctgaacatggtgaaaccccgcctctactaaaatacaaaaaaaattagctgggcatggtggcaggtacctgtaatcccagctacttgggaggctggggcaggagaattgcttgaacccgggaggcggaggttgcggtgagctgagatcatgccactgcactccagcctaggtgacagagcaagactctgtctcaaaaaaaataaataaaaataaaaaaataaattagctggkcttggtggcacatgcctgtagtcccagctacttggggcagggctctgaagcgggaggatcgcttgagcctaggagttcacggctgtagtgagctatgatcacaccacttcactccagcctgggtggcagactaagacactgtctcctaaaataataatagtaataataataataataacaccttcataaaattgtttacccaggggatgaatacctttaatcttcaggttcaggaaaagaataacatgaccaaactttggtgaatgttcattgcagcttcaagaggaaataacatataaa

SEQ ID NO: 131715 - DNA, 601 bp, Human
cgcctgtaatcccagcactttgggaggctgaagcgggcagatcacaaggtcaggagtttgagaccagcctgaacatggtgaaaccccgcctctactaaaatacaaaaaaaattagctgggcatggtggcaggtacctgtaatcccagctacttgggaggctggggcaggagaattgcttgaacccgggaggcggaggttgcggtgagctgagatcatgccactgcactccagcctaggtgacagagcaagactctgtctcaaaaaaaataaataaaaataaaaaaataaattagctggtcwtggtggcacatgcctgtagtcccagctacttggggcagggctctgaagcgggaggatcgcttgagcctaggagttcacggctgtagtgagctatgatcacaccacttcactccagcctgggtggcagactaagacactgtctcctaaaataataatagtaataataataataataacaccttcataaaattgtttacccaggggatgaatacctttaatcttcaggttcaggaaaagaataacatgaccaaactttggtgaatgttcattgcagcttcaagaggaaataacatataaatg

SEQ ID NO: 131716 - DNA, 601 bp, Human
ggcttttaattcactttgctctttaaagggaggaaaatgagggctgggtgcggtgactcacgcctgtaatcccagcattttgagaggccgaggtggccagatcatgtgaggtcaggagtttgagaccaacctggccaacatggcagaaacctcgtttctaccaaaaatacaaaaattagctgggtgggaggcagcagttgcagtgagccaagaccacaccactgcactctagcctgggtgacagagtaagactctatctcaaaaaaattggggggaagaaaaatgataaaattgtacattmggggcataaacaattccttatactcttatcttaaattggtgaaaaaaataggaaaccacctcacatacttagtggactagagtttatttttccttttttttttttttaagagacaaattgtcccggccgggcagggtggctcacgcctgtaatcccggcactttgggaggtcgaggcaggtggatcacgaggtcaggagatcgacaccatcctggctaacacggtgaaaccccgtctctactaaaaaaaaaaatacaaaaaaaaaaaaatagccaggcattgtggcgggcgcctatagtc

SEQ ID NO: 131717 - DNA, 601 bp, Human
taaaagtgtttttcatagcagcctggaacatctttgaaattattgcctttggaagtgataaatgataagaaaagatgatttgattgtgagccaggtgcttgcttatatatttggctttttgccactgctgtaacgcctgcctaaaatacacactgtgaaaatcaaataacatgcattagtcttaacatactctggtccccttcctacctaccacctaatgaactttcactgtgcttgttctaaatagcttccaagtgattgtattgaattagggtccatttatttagtcatcaggaatggrtgtttcctcagtggcaaggttcttgccttttgggagttcatagcctatttgggagacataatgatgatgcctgatgataatctaatatgaagaggaggcatgttagaagtcacgcacagagatttgtgggccatccttgtgctccctcttagcacaagactagctcgtagaacccccagaacctgcacagaaaacactcttccttatattttttgtgacttgaaataacaggtgccaagggctgccttgcgttcttatgcccactttatattccctctctatgtactgtataagaggtat

SEQ ID NO: 131718 - DNA, 601 bp, Human
cttttttttttttttttttttgagacagagtctcactctgttgcccaggctggagtgcagtggcacgatcttggctcactgcaacctccacccgccgggttcaagcaattctcctgcctcagcctcctgagtagctgggattaccgttgcctgccaccgtgcctggctaatttttgtatttttagtagagacaggttttcaccatcttggccaggctggtcttgaactcctgaccttgtgatccacccgccttggcctcccagagtgctgggtttataggcatgagccaccgcgcctggcttttttttttttttttttttttgagatggagtcttgctctgtctccctggctgggctgcagtggcacaatctcggctcactgcaacctccacattccaggttcaagcaactgaattagtaaatattagttccttctccttatagccatatgagtttgagaaatttttgttccgaactgtgtaaaccagaaaaagattagatgttaatacttggaagatttttaaaatctttttgttttggtctgtttttgtttataacagctgtaatgagatataattcacataccataaaatttatcctt

SEQ ID NO: 131719 - DNA, 601 bp, Human
tctcactctgttgcccaggctggagtgcagtggcacgatcttggctcactgcaacctccacccgccgggttcaagcaattctcctgcctcagcctcctgagtagctgggattaccgttgcctgccaccgtgcctggctaatttttgtatttttagtagagacaggttttcaccatcttggccaggctggtcttgaactcctgaccttgtgatccacccgccttggcctcccagagtgctgggtttataggcatgagccaccgcgcctggcttttttttttttttttttttttgagatggartcttgctctgtctccctggctgggctgcagtggcacaatctcggctcactgcaacctccacattccaggttcaagcaactgaattagtaaatattagttccttctccttatagccatatgagtttgagaaatttttgttccgaactgtgtaaaccagaaaaagattagatgttaatacttggaagatttttaaaatctttttgttttggtctgtttttgtttataacagctgtaatgagatataattcacataccataaaatttatccttaaaagtatacaactcagtggtttttagtat

SEQ ID NO: 131720 - DNA, 601 bp, Human
attgccaaagtccaaggtgggaacagataggtctgggggcatgggggctgggcctaataggggccgggcatggatgggcctctcctgctcaccgatcctgggctgggcatcttgtccttggtgggtgggggccaaggaaggagtggtggggcttggcccagagtctggtgtggctgtgactgaccacagcttgtgatgccccagccaagacctcaggcacaccccgtcccccactccgccccccctgggttagacaactgagagtcacagtgtggtgggagaagggacgtcattcctctamgggacaagcttttggcccctccccacaccagggcaggtacttatgtcggggcttatgcagggcagaagggctttggccaggtcagctgccaggggctggggcccaggctccccagggtctggcgtggtgcatcaggggcctggtgggggcttaccgaggatgacgggccgtgtgtggttactgagctcagccttgggcgtggtgtgcggggggaagagcacattgaggagccagaagggggcggcaggagggagcagcagccccagcagcagcgtcacccactgccatggggagccgggc

SEQ ID NO: 131721 - DNA, 601 bp, Human
cacacttaccctcccctgcttacaccccctctccctgctgtccccccagtagccaaagcccaggcttccctgaggaagggaaggcgctgaggtgctgaggccaaggccgctgacccctgcctctgcagagcaaacacccagtctggcgctcctttattgccaaagtccaaggtgggaacagataggtctgggggcatgggggctgggcctaataggggccgggcatggatgggcctctcctgctcaccgatcctgggctgggcatcttgtccttggtgggtgggggccaaggaaggagtgstggggcttggcccagagtctggtgtggctgtgactgaccacagcttgtgatgccccagccaagacctcaggcacaccccgtcccccactccgccccccctgggttagacaactgagagtcacagtgtggtgggagaagggacgtcattcctctaagggacaagcttttggcccctccccacaccagggcaggtacttatgtcggggcttatgcagggcagaagggctttggccaggtcagctgccaggggctggggcccaggctccccagggtctggcgtggtgcatcaggggcctggtg

SEQ ID NO: 131722 - DNA, 601 bp, Human
ttggcttctagctgattccccaggcagccgggcactgtgagcagcagccctcactctggactctggattccccccgtgacccttacccccgtcaccccagatgctgcagtgaccagacccaccccccacctcccataccctcaacccccaggtacaaagcacacttaccctcccctgcttacaccccctctccctgctgtccccccagtagccaaagcccaggcttccctgaggaagggaaggcgctgaggtgctgaggccaaggccgctgacccctgcctctgcagagcaaacacccagyctggcgctcctttattgccaaagtccaaggtgggaacagataggtctgggggcatgggggctgggcctaataggggccgggcatggatgggcctctcctgctcaccgatcctgggctgggcatcttgtccttggtgggtgggggccaaggaaggagtggtggggcttggcccagagtctggtgtggctgtgactgaccacagcttgtgatgccccagccaagacctcaggcacaccccgtcccccactccgccccccctgggttagacaactgagagtcacagtgtggtgggagaaggga

SEQ ID NO: 131723 - DNA, 601 bp, Human
gatccagccagatggtgaagaagtcctctgtcttgcggtagcacatccagttcaccacatctggtttgtccagcttggcttctagctgattccccaggcagccgggcactgtgagcagcagccctcactctggactctggattccccccgtgacccttacccccgtcaccccagatgctgcagtgaccagacccaccccccacctcccataccctcaacccccaggtacaaagcacacttaccctcccctgcttacaccccctctccctgctgtccccccagtagccaaagcccaggcttmcctgaggaagggaaggcgctgaggtgctgaggccaaggccgctgacccctgcctctgcagagcaaacacccagtctggcgctcctttattgccaaagtccaaggtgggaacagataggtctgggggcatgggggctgggcctaataggggccgggcatggatgggcctctcctgctcaccgatcctgggctgggcatcttgtccttggtgggtgggggccaaggaaggagtggtggggcttggcccagagtctggtgtggctgtgactgaccacagcttgtgatgccccagccaagacct

SEQ ID NO: 131724 - DNA, 601 bp, Human
agccagatgctcaatcttgtccctgcccaatctagacacagactctaagccacaggcttgagcaggcctgatattcaatgatgctcagtgtcagcttactcaatgagaagccctgataagacctctgttgggtggagctgtagggcttcaaaaggatggcagggacaggcaccatggctcacccctgtaatcccaacactttgggaggctgaggcaggaggatcacttgaggccaggagtccgtgaccagactaggcaatgcagtgagaccctgtctctacaaaaaaaaaaaaaaaaaaaatcagctgggcttagtggagtgcacctctagtcctagctactcaggaggcaaaggcaggaagattgcttgagcctaggaatttgaggttacagtaaactatgatcgcaccactgcactgtagcctgggtgacacagtgagattccagcttaaaaaataaataaatagggccgggtacggtggctcacacctgtaatcctagcactttgggaggccgaggcaggcagatgacttaaggtcaggagttcgagaccagcctggccaacatggggaaacctaatctctactaaaaatataaaaat

SEQ ID NO: 131725 - DNA, 601 bp, Human
tccctacccacgccactgaggcgaccccagccggtggtgacacacgtgaggccttcagtcagagcctcgtttgaggatgccaggcaaactggcgagatgcgtgttgtgtactgggctggcgaggcgagcttcagcagcgtcacgtcattgttcatggtggtagagttccagctagggtgtgtaatggcctgtggggtcagaaacagtccatgttctgatgggtgctgagcagggtaggccagggcatgtcctgaattcctcgttcccagcacccacccacctgcactgcccacttttcctycgtgtctgcagcccaggcactcacccgagagacggacagaacctgcaagggctctgcgtttgatgatcggtcatactcgcccaggacaacaaaatggcggccagggctgcaagggggtgggattaggcagctgcagggaggccagcgcgagagggggacagccaggggaggaggcaggaagaggcgaggggcggggcaggtggaatgcaggcactcacctgacattgcagtgggcagcagtgaccacccaggactggctgatgagagaaccaccgcagaagtggaagccgctgctgtcct

SEQ ID NO: 131726 - DNA, 601 bp, Human
agctggggcctaggccccacctctctatgcccagctcctaggtgctatccccgccccttcctgtgggctggcgcccgatgactgacatcgccttttcctgtagcccaggttctcttgggccggcctcttccggtcacctggcccgtcgcggtcccgcccttctttctgtcccgccttccaatggccccaaccccgtaactacccctgccggggtcctgttagccctgcccccgcacctgaagagcgtctggcgcaggatgcgagtgaccgtggccacgcggggctcgcggcccgtagatarcgcgtgtagctccatcttggacgccaccatccgtgtggtcatctcggcgtccgcggctactccagccccacagcagctgaggcaaaagggaggatcggtgtgggcagggctgggacgtgcggggaccggagtgggaacgagggggccgttcttttttgcgtacgggaactgggctcgggagtctcactagattttgggggcgatgaagtggatcttctcgcagctcttgtccgccacgaccgaatcgttagtggctcgcgtatcggcgcccagaatgaccccgtcctgaggagagggagg

SEQ ID NO: 131727 - DNA, 601 bp, Human
gattcactttaattagtgactatggaagcgaaaccatggctggtgggcagacagcctggcagggcagctgcacgacagccaggagggaggggtgtccaggccagggaagctagtggcctcagtgagccaggcggtgtcacggcctggagacctgagggtcccgtctgcttgcctgatgcgcttggtctgggctggtctctctgcctcgttatgaaccgacagggcccctacctcctgttcttcctcactttatcactgccaccatctccacggctaccaccgccactcttgcgccagctcrgaacccttcccaggccttactgctctgttccactcccaccctctctccactttacagttggggaaatggtggctcagagatctgaggaacgggcccaagatcacccagatgggtctgtctgagcccagagcctcggtgctcatccctgcattggtcttgaccctgtccccgagccagggccctgctgtttggctccaggaaagaccgcgtctgcctcccactccaacctcccactccagcccccatgacgatgaggactccccgctgcagcccccctgcctacatggctctaggaccagc

SEQ ID NO: 131728 - DNA, 601 bp, Human
aagagccatcgacgaaccagaagtgggggccagggcccttgctgcctgccctggctcccatagggcttgaagacaagctctgccactcatggcaggcgccaggttgcgcaccagtgtttccctgggcaggcggagtgtggttgcttctgaaggcgaactgggaagtgaggaaacctgccctaggcaggcctctgaaccgcagccctccctgcaaagccaccactttttcatgtctcaccctaaagggacagaacccacatctgaaacagctgctgcctctcagggcagaaagccctgtgcygcatccactggccaaatgacgcttcagaaaaccgtggaagcaccatgagcggcttttggatagagaacaaaagtcgacactctgagcatctcaggcgcagtagaagataatgtgtaatgaccaaattaccacagcctaaaaactcctccaatcgaatccaaattagcagaaataattatgattcactttaattagtgactatggaagcgaaaccatggctggtgggcagacagcctggcagggcagctgcacgacagccaggagggaggggtgtccaggccagggaagctagtggcctca

SEQ ID NO: 131729 - DNA, 601 bp, Human
gcacgagggcagaggagcccatgaagggaagagaggattgtgtggctggccgctgagggagctccatgaggtggtgtggccacacccagtgtgggaccaagacaagcaggggccaggggtacaggagcccctcatcggggttgtggctggggcagagctggagctaagggtggcgggggcaggggggcgggaggtggtacaaggtgacgttcagacttcctgaggcagtggagggcataagaggagtcacacctggcctcagacgaggagggtggctgaaaccacagcagggctgatgcakaggagggggcctgggccaagggagctggagatgtggggtgcacccagggccatctggaaagtgagctaggggcctggaatggatgggtcgggcacaggacagagcagccaaggtggtccttctggcttcaggatggcagaacacagaagaggagcagcccggggcagaggctgagtctggtttgcgagtgaatggggatgtgtcctggaggcagccagatgtagggctggggggagaggtctgggccaggacaaagcagaggggcctcagaaagggcagaaatggaagctgcagagtctc

SEQ ID NO: 131730 - DNA, 601 bp, Human
actcatccaacacttggtgtcacctgccccgcgctgtgtcccggacagggttggacactcgcagggaggcctcagactgggccctgcacgacaagaacccactggccggaggagtgacgaggtcctgctccctcccgccccgcttctccctcctcatctgccgtgtgatctcaccaagatccacttgattatttgctgggcctcattgattcctggctcgtggccttgggagccgcagagccttgtgtttctcttgcaaaaacaagcaatcacacgaaaggctgtgcctttgagtcctggygggcaaagactgtcaacggaagaggtgtccagaataaggctctattgtaggtgaggaaaaagggattccagtcccttccttcacagagccacatttccctgaaggctctgaagtcccatacgggaaaccatgagggccttccgggaaggaggggaccgctgatttctgcagcgagtccctccagcgtcccggcccctctccggctgggcctgtccccaaggcagccccacgtacttcacttctccgcgctgggatccgcgtgtgctgggcacaccacagctctgctgtcctggtgctctg

SEQ ID NO: 131731 - DNA, 601 bp, Human
gtctcaaaataaataaaagaccacacgggggcgccgtcttcaggcaacaactgctcctcctccatgaggatcatctcaggcccagtgggctcgtgctggggtggggtggcgacgcatggacattacttttctgggtccttacaacggctcaggcacatgataaagtgatgctgcttttaccgttgaacacactgaggccagaagttgagttgtgggccggggtcacaggctcacatggtctaagaggcagcttccagtcggatctgtttgtcgtgcgctgctctgcgctgctttctgaggrgctggtgtctttgcggtttctccccggccgcctgtttgttggtcttaaggcgtcagcctctcactcatccaacacttggtgtcacctgccccgcgctgtgtcccggacagggttggacactcgcagggaggcctcagactgggccctgcacgacaagaacccactggccggaggagtgacgaggtcctgctccctcccgccccgcttctccctcctcatctgccgtgtgatctcaccaagatccacttgattatttgctgggcctcattgattcctggctcgtggccttgggagccgcag

SEQ ID NO: 131732 - DNA, 601 bp, Human
tctggcctgggcgacagaatgagactgtctcaaaataaataaaagaccacacgggggcgccgtcttcaggcaacaactgctcctcctccatgaggatcatctcaggcccagtgggctcgtgctggggtggggtggcgacgcatggacattacttttctgggtccttacaacggctcaggcacatgataaagtgatgctgcttttaccgttgaacacactgaggccagaagttgagttgtgggccggggtcacaggctcacatggtctaagaggcagcttccagtcggatctgtttgtcgtkcgctgctctgcgctgctttctgaggagctggtgtctttgcggtttctccccggccgcctgtttgttggtcttaaggcgtcagcctctcactcatccaacacttggtgtcacctgccccgcgctgtgtcccggacagggttggacactcgcagggaggcctcagactgggccctgcacgacaagaacccactggccggaggagtgacgaggtcctgctccctcccgccccgcttctccctcctcatctgccgtgtgatctcaccaagatccacttgattatttgctgggcctcattgattc

SEQ ID NO: 131733 - DNA, 601 bp, Human
actctggcctgggcgacagaatgagactgtctcaaaataaataaaagaccacacgggggcgccgtcttcaggcaacaactgctcctcctccatgaggatcatctcaggcccagtgggctcgtgctggggtggggtggcgacgcatggacattacttttctgggtccttacaacggctcaggcacatgataaagtgatgctgcttttaccgttgaacacactgaggccagaagttgagttgtgggccggggtcacaggctcacatggtctaagaggcagcttccagtcggatctgtttgtcktgcgctgctctgcgctgctttctgaggagctggtgtctttgcggtttctccccggccgcctgtttgttggtcttaaggcgtcagcctctcactcatccaacacttggtgtcacctgccccgcgctgtgtcccggacagggttggacactcgcagggaggcctcagactgggccctgcacgacaagaacccactggccggaggagtgacgaggtcctgctccctcccgccccgcttctccctcctcatctgccgtgtgatctcaccaagatccacttgattatttgctgggcctcattgat

SEQ ID NO: 131734 - DNA, 601 bp, Human
cctgtaatcccagctattcaggagggtgaggcaggagaatcgcttgaaccttggaggcggaggtcacagtgagccaagatcatgccactgcactccagcctaggcaacagagtgagactctgtctcaaaaaaaaaaaaaaaaattagctgggtgtgcatgcctgtaaccccagctattcaggaggctgaggcaggagaatcccttggacctggggggcggaggttgcagtgagccaagatcgccccattgcaccactctggcctgggcgacagaatgagactgtctcaaaataaataaaaraccacacgggggcgccgtcttcaggcaacaactgctcctcctccatgaggatcatctcaggcccagtgggctcgtgctggggtggggtggcgacgcatggacattacttttctgggtccttacaacggctcaggcacatgataaagtgatgctgcttttaccgttgaacacactgaggccagaagttgagttgtgggccggggtcacaggctcacatggtctaagaggcagcttccagtcggatctgtttgtcgtgcgctgctctgcgctgctttctgaggagctggtgtctttgcggtt

SEQ ID NO: 131735 - DNA, 601 bp, Human
cctgtaatcccagcattttgggaggttgaggcaggcagatcacaaggtcaggagtttgagaccagcctgaccaacatggtgaaacgctgtctctactaaaaatacaaaaattagccgggcgtggtggtatgtgcctgtaatcccagctattcaggagggtgaggcaggagaatcgcttgaaccttggaggcggaggtcacagtgagccaagatcatgccactgcactccagcctaggcaacagagtgagactctgtctcaaaaaaaaaaaaaaaaattagctgggtgtgcatgcctgtaaycccagctattcaggaggctgaggcaggagaatcccttggacctggggggcggaggttgcagtgagccaagatcgccccattgcaccactctggcctgggcgacagaatgagactgtctcaaaataaataaaagaccacacgggggcgccgtcttcaggcaacaactgctcctcctccatgaggatcatctcaggcccagtgggctcgtgctggggtggggtggcgacgcatggacattacttttctgggtccttacaacggctcaggcacatgataaagtgatgctgcttttaccgttga

SEQ ID NO: 131736 - DNA, 601 bp, Human
gctgtcctctgcagggcagaagtacagagactggatgatgaagttcgccccagaccccagctaggccccaggcactgatcccatgcctagaaaaaacacaggtgggcggcaaccctaccttgtggggcatgcaggtgtgtgcaggcgatgtacccgacgattctttggtcctgaggtgtgcttcccacctgcacctgggggaggagggggtcagtgctgccacctgccagtcactgtggccctgagagcacaggacactggcagtgcccacccacccatgaggtcagaccctcacaagcckggctcctggctggattctggggtccgagtagggacaggatgtgtcctgcttctagggacttacggatctgggccagaggcgggtgctgaaagaaactattggcctgtggcgtggggagtgctggcggccatctgtgcaaagcatgggggaagtgccgaaccgcagcaaggctccccggaggcccaggccctgccatctcccagtgaccagcgtggccacggctctcagttccttgtccagtcctgtctgtggctctttcctccctccctcagttacaccctagacctggtcacaccctgg

SEQ ID NO: 131737 - DNA, 601 bp, Human
ttgtagtctttcaccctaatggtttaaggtgcaattcccagggttcagatcccagtgcaatcactgcctggctatgtgaccttgggctggttctccagcctctctgagtctcagcttcctccaccacaccacgtggagacatgcaatgcttccctctcggggttgttaagacacttaagtgaaacagcgatagaatggcagctggctcgaagcaagagcgcggcgccccgttgatgggtgttactagtggactcgtcctttgtctgcttcagaggcccccagccttccttgtcagaggttygtttttagggcatctctgtctccagctttctaggcagagcgtgggctcttcctgttctaggatttctagggggcagagaaatcagtcttgctaaataccccgcccacatgctctcgaggagcaggaattctttgagctgcctaacgaagtctgtctagctgtgactgagcccacagcctccccagagctggagacctgagtggggaggagcccggcctcaccagaggagcagttatcaaagttgaaatctccacagacgacgtcaaatgccaccagctcctcggggttggctgcgctgga

SEQ ID NO: 131738 - DNA, 601 bp, Human
aattagctgcaaggaaccatcgctgtgactgcagtctcgggctgtgaattataaattggttctgctgttggcctctcagatgtgttctttatggacatcttactgggctcaagaatgaattttggctgggatggaactgtctctactttgaaaatggtcggctgtgttattgcagctggtgtctgtatttgcctgattggtgctgcaagctgccaggctgccttcagcaggcgccgtacccagcagctctttcatgggggtcgacctgtggcctggcccggggaaattccaggccctttcstgtacccagcaggcaggggctcggggcagggctagctcctgaaaacaggtttgggaaatacccctagagatttagcaaggccagtacccctgggcgtgagggcgtgaggtctacctgcctggcccagctcccagctctcaaaagctctcaaaggtgagatgagggacaggtttctgccaaataaaagccctcatgagcccgagctgagctctcccatgtgggtcctgcccagtccctgtctccaccttagtcagggtgtgcctcgtccctggcctgggagcgcagtgcttacttctgcag

SEQ ID NO: 131739 - DNA, 601 bp, Human
ccaggagagcacctccgaggagtctcaaatggggctgtccctacgtggctgtgtgactctgcttatgttaccaagcctccaagcctctgtttcctcctctgaaacaagaatggttgctgtgggccccaagacgcttcagggaacaggctgtcatcccgcttctgagtgaggaaacccatgatggtgctaggggatccacagggagggcagggcgctggagcagggggatgtgacatctggaatccctttctggcactgttgccctgagacaagcagtatgcccgtctgcttcctgccagcytgtcccctggggcctcagcaccactgggccagaggcttaggaccccctcctgggagcccccattgcagagggcaggctggggccagggcctgggatggcaagtgcagtggtgagagaccctgcaaaggccgccaggtcagtgagtgcctggacggatgcaaaaggggcacccggcgaggcagggcctgcaaacatgggcttccacaaggttttcatcagccttaagataaatacactaatgacattcaggacattgttacagctcagaaatggaatccatcactgtcctttgcccttgat

SEQ ID NO: 131740 - DNA, 601 bp, Human
agccatggtctcctcccagtgtgggagcgggtgggtgggaccaaagcgctgggtttaagatctctcccctgcgggtccaaaaagggcctcagctgggggtaggccgagttgcctgtgggttcctggctgaatctgggctccggagcccgtcgaagtgttctgtccgccccagcctggccagcactcactttccctttctgaactcggacagaactgatcccacccgttccccagaatgggcttctgccctgagccaacaggggcctgttttgaggagcttggtctttgccatgagtctcgrggacccttgtgactgttcccaggttgacaggagctgagggagccaggagagcacctccgaggagtctcaaatggggctgtccctacgtggctgtgtgactctgcttatgttaccaagcctccaagcctctgtttcctcctctgaaacaagaatggttgctgtgggccccaagacgcttcagggaacaggctgtcatcccgcttctgagtgaggaaacccatgatggtgctaggggatccacagggagggcagggcgctggagcagggggatgtgacatctggaatccctttctggcactg

SEQ ID NO: 131741 - DNA, 601 bp, Human
ctgtgggcctggcaggggctgtgtgtggagccatggtctcctcccagtgtgggagcgggtgggtgggaccaaagcgctgggtttaagatctctcccctgcgggtccaaaaagggcctcagctgggggtaggccgagttgcctgtgggttcctggctgaatctgggctccggagcccgtcgaagtgttctgtccgccccagcctggccagcactcactttccctttctgaactcggacagaactgatcccacccgttccccagaatgggcttctgccctgagccaacaggggcctgttttgrggagcttggtctttgccatgagtctcggggacccttgtgactgttcccaggttgacaggagctgagggagccaggagagcacctccgaggagtctcaaatggggctgtccctacgtggctgtgtgactctgcttatgttaccaagcctccaagcctctgtttcctcctctgaaacaagaatggttgctgtgggccccaagacgcttcagggaacaggctgtcatcccgcttctgagtgaggaaacccatgatggtgctaggggatccacagggagggcagggcgctggagcagggggatg

SEQ ID NO: 131742 - DNA, 601 bp, Human
tctccaggaccctgtccacacatgcaggaggcaggtgggcccccatgcccgcccctgtgggcctggcaggggctgtgtgtggagccatggtctcctcccagtgtgggagcgggtgggtgggaccaaagcgctgggtttaagatctctcccctgcgggtccaaaaagggcctcagctgggggtaggccgagttgcctgtgggttcctggctgaatctgggctccggagcccgtcgaagtgttctgtccgccccagcctggccagcactcactttccctttctgaactcggacagaactgatyccacccgttccccagaatgggcttctgccctgagccaacaggggcctgttttgaggagcttggtctttgccatgagtctcggggacccttgtgactgttcccaggttgacaggagctgagggagccaggagagcacctccgaggagtctcaaatggggctgtccctacgtggctgtgtgactctgcttatgttaccaagcctccaagcctctgtttcctcctctgaaacaagaatggttgctgtgggccccaagacgcttcagggaacaggctgtcatcccgcttctgagtgaggaaacc

SEQ ID NO: 131743 - DNA, 601 bp, Human
ccctcctctgcatgcagcatgtagtcgatgcgccggccgttgcccttcagcagctccttccgccccttctggcccgagctcttgctggtgggaaacgccaggtactccctgcggccctcctcactctccaggaccctgtccacacatgcaggaggcaggtgggcccccatgcccgcccctgtgggcctggcaggggctgtgtgtggagccatggtctcctcccagtgtgggagcgggtgggtgggaccaaagcgctgggtttaagatctctcccctgcgggtccaaaaagggcctcagctsggggtaggccgagttgcctgtgggttcctggctgaatctgggctccggagcccgtcgaagtgttctgtccgccccagcctggccagcactcactttccctttctgaactcggacagaactgatcccacccgttccccagaatgggcttctgccctgagccaacaggggcctgttttgaggagcttggtctttgccatgagtctcggggacccttgtgactgttcccaggttgacaggagctgagggagccaggagagcacctccgaggagtctcaaatggggctgtccctacgtggctgt

SEQ ID NO: 131744 - DNA, 601 bp, Human
tcctcccccaagcaccgggcactcgatggaggggacatggcccagggatgggctgcagctgcaagggctggcagaggccccactgctccggacggtctatgcctcctcctcccccgaagacaccatcagtcgcatggctactggcaggtggtccgtcaggccggacagctgggtgataaaactgaattcttccacctcctggggtgagtgggagaggggagaaacagcctggtcagattccaagggcatcttgcagggagcggcctggggatccccaaagtgaggccccggggctggggtrggctgggaccttcctgcagtcagagggatggggcctggaggacctggggccctaagggtctgagggagtgatgggtatcattgtaagagtggcctggggcgtggggtttcagggagcggctgtcgagagctgcagggcccgggccctgctctctctttgcatggccctggctgctgggccctcctgactcacggccttccagtctgggcacagcccctcctctgcatgcagcatgtagtcgatgcgccggccgttgcccttcagcagctccttccgccccttctggcccgagctcttgct

SEQ ID NO: 131745 - DNA, 601 bp, Human
cccggtagcggccctcctgccggacctcccgagccgaggcgcggagattacggcggacacgctgctggctgtcccgtgacgggcgcagaacttcccgcaggagaggctggactggttcctcctagggggcaacaggggacggaggccagcgtaagcaggagttcgcgagcgggtcagggatcgggtttcgtaccggctgcacccgaagatgccctccacaccagctgcaccacgcccaatacctgggagcacacagtggccaccaagtggaagacattattctccgccgctctctccaaaycctccgacgtcttctgtgccgctgactcgaccgcgtcgctccggaggcgtttacaagcgagcacaagagcctccgccggctccgcactgcgcttccgcttcacccggagtacagcggtcctggcggcctccatagtggctgccgctgagcactgtgggagctcgcggggtgtgatgggatagctttccagttctgctttaggacccgccccccagcacgctcctcgacgctgcgaggtcccgccccgcgtgctggccgcggtaaaagtggtagcagcggaggcgagcggagggtttcccg

SEQ ID NO: 131746 - DNA, 601 bp, Human
ccatctcagtcagggtgaaaggcaatgtccttgcaagtacctagcaggcatcctcccctcaaattccttactgctctcctctagctcaccgggctccaggcaccttgcaaggagcaaagaaacggcttaagggcctctttactttcaggttctctgcctagaagtcctctcgatatgtggaataccctgccattcaccttctgcaagtcttcactcaaatgtcatttcctcagtgacactctcactgaagtggcaccactcttcctgctttgtctccccgcctccttacatcccttatcaycatctgacactgaatagacttgtttactgtttctgtctacctgcatgttaggtcctcactgctgtatccacagaatctaaaaaaatacctggcatatcgtaggcacgtagtaaacacatgttggatgaacaaccaaatctgtaaaatgaggccgtcacgccggatggatcatccatccccttaagatgaaactgtgctgcgactgggcccagtcttcttgcattaccatcctgagaagcccagcgaccaccttcaggggcatactcactttgcaggagcctgcagaggcggcttcaggtt

SEQ ID NO: 131747 - DNA, 601 bp, Human
aaaaaaagaataatgtcaggacgttagctttcttcatccgaggtttctctacttctaaggtacgaattaaaaaatagattttgttgtcactcatgttaagaatttctgattttatcgtctttatcttatcataagccccatatacatatttcccccctaagaatggatagctataaacaataaaggtgatgttgcaaaccttgtaaaatattcattaatgtaaaaatgatcaatctaagatgatctttccccaaattccctgtactataaagtcaggttcctaaaaggcacttagaataawttcttccttttcaggaggaaaagaactaaggacaatgttgttcgggagtggagcccagggaagcaaagcattctgattagattaagagcttaggatgcctcatgccccgtctgctcatgggcccccttaccagctcccattcttggctgtagggctgcacggagaggatgttctcaatccagcctggagtggccgtctccaagtagtaaatgtcatacacatagtcatcgtgtttttgttcttcctggcgcctgactcctggtccatcctcagacacagtcaatcgctcacggatcaact

SEQ ID NO: 131748 - DNA, 601 bp, Human
agcccagctccacaatgataggacatgctggaccccatgagaagggaacacagggaaaagaggagtgatggctctgagcgattccttcaaattccaaaggtcaaaaccaaaacccaagcgtaagaggtgcggaaaggcaggaggaagggccatgcagtggtccaaggtgggtacctgactgcaaatctgtcctaatgcaggtgcaggatgcagtgcttcttgattatagtctgagcatgaccattaggtgccaccttaagttttcttgttaagcattttagaatttgagaataggctgggygcggtggctcacgcctgtaatcccagcactttgggaggccgaggtgggtggatcacttgaggtcagaagtttgagaccagcctgggcaacatggtaaaaccttgtctctactaaaaatacaaaaattagccaggcatggtggcatgcacctgtagtcccagctacttgggaggctgaggcaggagaatcgcttgaacccaggaggcggaggttgcaatgagccaagattgcaccattgcactccagcctgggtgacagagcgagactccatctcaaaaaaaaaaaaaaaaaagataatgg

SEQ ID NO: 131749 - DNA, 601 bp, Human; identical to SEQ ID NO: 29204

SEQ ID NO: 131750 - DNA, 601 bp, Human
cctgggtgacagagcaagactctatctcaaaaaaaaaaaaagaatgaaactaaagaatattggccacaattaagacacaacaaacaacattgtactacatgtactacaggtactacaaacaagtattttaatggctcaaagattttttttcaacttccaaaacaatctaaatgttgcaaaagcttctttctaatgctgacagactaagcatgtttttttcttgtgaatcagtaaaacacagacaaagaggagttgttggtaatggggttcaaaccaaagaacattctaatggaaaacagaytactattgaggaaaaatcagactacagtttaatttcataatacaacatatttacataccagcacagaatatccctgggacttcactcctgattattatggtccgtactttcttatcagatttcaaagcatccacagcttttgatagctaaacagaaataggaagcataggaggaaaaagagaaaaaaaaaacaaaacatttttacattgatgacaataatatatcttaatattagaagcaaacagtttaatctttacactcaccatttttataagatttttactgagtgaatttttgcca

SEQ ID NO: 131751 - DNA, 601 bp, Human
attagtactttcagagatcagggcaagggaaggggcttgactgcaaatggacacaagaaaactttttaagtaacgaatatgttctgtatcatgattctgatcatggtttaaatacctgtcaaaattcatcaattatacattttaaattggtaaactttattccaagtaattcatacctaaataaaacattttttattccaacaaacaatatatgacaacaacaaaaaaacaaaaccctatatagctaaactaatacaaacttgttaaactactacaaatttgtggtatctatcccttcacrttacttatcaaactctctgaaggactaacagttaaatacataaatatgacaatctaagattctgaaacaacaacggccaggttacttcatagtccaacgtgcccacacatctatccagatcatgacatttttatccatatgaacagcacacaacattcaataatgcatgttgacaattttagtgacaagtcactctttagtcataacataatttactagaattcaaaagcagaagcaaaactacctttacttttttataaaacccacactggtgtaattcagtgaaacaatttagggttc

SEQ ID NO: 131752 - DNA, 601 bp, Human
ccattaggatgcctacaatttttaaacctcatattatcaagtgttggtaagcatgtggaacgcctgaaactctcatccgttgctagtgggaatgcaaaatgataccgaaaacagttggcagtttcttacaaaactaaacacacaggataaaaccagtaattctacttctgactatttacctgagagaaataaaattatgcattgccaaaaaggtgtgtgtgaatggtcacagaagtgatgcataaaagccaaacgatggaaaaacccaaatgaccatcacctaatgaataaacaaaccgtsaaacagtcatacaataaatactattctcagcaataaaataaaatacatgccaataaaatgaaactagtgaaacatgaatatggatgaagctcaaaccattatgttaaatgaaagaggtcagacacaaaagactacccatagtatgagtcaatttattttaaaattacagaagatgctaaactaggagcagcaaggagattagtactttcagagatcagggcaagggaaggggcttgactgcaaatggacacaagaaaactttttaagtaacgaatatgttctgtatcatgattctgatca

SEQ ID NO: 131753 - DNA, 601 bp, Human
aacaaaatttctaaaattcacaaaaaggtacaaaccataaaaggaaaaaaaaatgataaatcagtcttcatacatgtatacatacgtaacaaacctgcacattgtgcacacgtaccctagaacttaaagtataataaaaaaaagaaacaatatgtaaatttttaaaaaatcagtcttcacataaaaaacttttgttcttcaaaacaaattataaggcagaaaaatgacaggccatttagtggaagaaaacttaccaagtataacagataaaagtcttgtatcaagaatataaaaaaaaacaaaaaaaaaaccttacaactcaatgagatgagattctaagaaaaacattgggaaaaaattcaaataaacaagtcatcaaaacagatatacaggtgacacatatgaaatgtaaactaaaactacaatgaaatatgactttgtatccattaggatgcctacaatttttaaacctcatattatcaagtgttggtaagcatgtggaacgcctgaaactctcatccgttgctagtgggaatgcaaaatgataccgaaaacagttggcagtttcttacaaaactaaacacacaggataaaaccagta

SEQ ID NO: 131754 - DNA, 601 bp, Human
tgtggggtaaaacaaaatttctaaaattcacaaaaaggtacaaaccataaaaggaaaaaaaaatgataaatcagtcttcatacatgtatacatacgtaacaaacctgcacattgtgcacacgtaccctagaacttaaagtataataaaaaaaagaaacaatatgtaaatttttaaaaaatcagtcttcacataaaaaacttttgttcttcaaaacaaattataaggcagaaaaatgacaggccatttagtggaagaaaacttaccaagtataacagataaaagtcttgtatcaagaatataaaaaaaaacaaaaaaaaaaccttacaactcaatgagatgagattctaagaaaaacattgggaaaaaattcaaataaacaagtcatcaaaacagatatacaggtgacacatatgaaatgtaaactaaaactacaatgaaatatgactttgtatccattaggatgcctacaatttttaaacctcatattatcaagtgttggtaagcatgtggaacgcctgaaactctcatccgttgctagtgggaatgcaaaatgataccgaaaacagttggcagtttcttacaaaactaaacacacaggat

SEQ ID NO: 131755 - DNA, 601 bp, Human
gcctcaaaatctcaggctcaagcaatccttgcacctcagccccctcaagtagctgggattacaggaatgtgccaccacacccagttaagagggttttttgtttgtttgtttgtttgtttgttttggtagagatggggttttgccatgttacccaggctggtctcaaactcaagccatccacctgcctcagcctcccaaagtggcagaattacaggcatgagccaccgtgcctggctctgaaccccgctgtttaagggtctttatggaggtttcattacctccatagggagacatgaatgamtaaatcactggccactggtaactgagctgaatctctggcccctttcccctctggggggagagggtgctaaaagttctaatcctctaacccatggctgctttttctgacaagctgcccccccatcctgaagctatctagggtcatctcattacacaacaaaaagcacttggaccattcaggaaactcccagggttttaagagctctgtaccaagaacaagggcaaagaccaaatatattttttattctctttcacaacatatataaaaattaactcagaatacttcagagtcctaaatata

SEQ ID NO: 131756 - DNA, 601 bp, Human
tcctaacatgcccttctcaaccaaacctgagtttatgctaatgaactgactcttagagggcccctagatagctccaggacaggcgctggtcaccagaaatatcaagccatgatcagagggttagaactttcagtgccctacccacaccttcagggagtgagaggagctggagattgagctcagtcgccaatggctaatgatgtaatcaatcattatgtaaagaggcctccataaaaaatccctgaaacagggcttagggagctcccaggttagtgaacacatggatgtgctgggtaagtgrcacacctggagagggtatggaagctctgcaaccctccaccctaactttgctctaagtacctcctccacttgactgttcctcagttttctcttttataataaactggtaatagtaaataaagcactttcctgagtttcgtgagatgctctagcaaatcccattcctgagaccaattatgacgtctttttttctaacaccacttctgacaccaaatgtctgagggtttccacaccaattcttcaacatcaagcgggtatccaacaattcagttaaattctgccaccatccaaaattagtggg

SEQ ID NO: 131757 - DNA, 601 bp, Human
aatatatactcacatacatacacaaacacatctgaaaaaggctacatcatttgaacgaaattgttaacagacagaaataaacctggattggccaggcatggtggctcatgcctactcccaacactttgggaggccaaggcgggtgaatcacttgaggccacgagtttgagaccagtctggctaacatggcaaaaccctgtctctactaaaaacacaaaaataagctgggcgtgatggtgcacacctgtaaacctagctactcaggaggctgaggcacgagaatcacttgaacctgggatgyggaggttgcagtgagccgtgattgcaccactgtactgcactccagcctgggtgacagagcaagactcggtctccaaaaaaaaaaaagaaatgaacctccatcacacagactcggtctccagaaaaagaaaaaaaaaaaaagaaagaaaaaagaaatgaacctggattgcacaggtttataaaagctgaatctaggtttcaaatacatctctagcagatcatcattactatcactacttctggttcttcttggacttgcactgtagaaatgcaatgtttttgaaaacactgatggctctta

SEQ ID NO: 131758 - DNA, 601 bp, Human
ataacttgtattgcttttgcattatctactgcaaactcttttcatttaaatatatagttggaaatgtataatacactaagtagacaacgcatggaattgatacattatttaacaattttgagaaaacatatattttaaacaccacccactataatggccctctcctaaaatttcagtgttttaataaattccttcttttaaatattctttaggattagtatgtattaaatttctatacttatatttgcagtaaactactccaatgaactttagagaagttatgggaaaacacactattctytgttatgcactgcatgatgtctagcttccttggcccccactaaccatatgtcaataaagctcttcaacagccaaaaacgtccctcaaattccaaaaggctccacagtgggtgttaacgtccccttgagatctaatgctttaagccagtgatcttcaacctttttgttcctattattgctaaaagaattttgaagtatgtgctcctttgaacatttttatgctgacatttgaaatttttcatctaagtttaagtagtttgaaagatttcaatgtactatgaacactcacatttttaaacaa

SEQ ID NO: 131759 - DNA, 601 bp, Human
cctactcacatatagaccacttcacaacttccctctccacgaatcttaaaacctcctatcaatcctacgaaaagccagaaaagacattctaccagtacttaccaccaaagctatccatccaggacttgaacctatatactccgccctgcctcctgttaccatgaatgaactaactcattgagagtgacagaagacagacaaattccccagcagacagggatgtgtccccagtgaaacccaaccttcaagccactgacagtttaaagtctaaaaaccgagctgctggtttgagagagtccayaaacagagagagaacttctatccccatattaccctcactctcttgattggttccttctggatgatgccttttaaccaatcaaacagtgatttttccaagcccacccagggatgaatcagcacacacacctccattctaacccataaaaaccccagactcaccctctcaggtggctacccactttgggtcccctctcacagctgagagctttccttatgtcactcaataaaattcttctctgccttactcactctctggtgtccacgcacctcattcctcttggtcgcgggacaaggacct

SEQ ID NO: 131760 - DNA, 601 bp, Human
gtcaattatttagtcaaatctgaacatctatgtctttaaaccgcaagtttaatcaactaacattaatagtgagtacttgacttatttcaacatcttactattcaagatgttctaagtttatgctattttttctctttacatttttttaagattggatgaacttatctttggtttttgttttgttttttcttgaactgttttgttttgttttctttgaattttatcaagaatacaaaacccccagatgcaatattttaaactccctatcaaagcgaagaccttaaaattaaaagctttatgwctccaaaaagcaaaacccaatgacaaaggtataagccaagcatgcatcaagttgttcaaattagaactgaagtgagatttcttgaataaatatagaggaattaactccaaacaacaggaaaaatgaagataggagacaaatgacattcaaagaaaaatcagacccactgcctgttttagtacaaacctgtgagctaagaatggtttttacatttttaaatgcctggggaaaaaaatcaaaataaaaaattgtttcaaaatgcataaaaatcaaatgaaattcaaatttgggtatgcataa

SEQ ID NO: 131761 - DNA, 601 bp, Human
cacttgagtcaaggagttcgaaaccagtctgggaaacatgacgaaacaacacaaaacttagccgggcatggtagagcccatccctgctactcgggaggctgaggtgggaggatcacttgagccccggaggtcgaggctacagacagctgagatcgcaccactgcactccagcctgggcgacacagggagaccctctctcaaagaaggaaaaaaaaaaaaaaaacaccttaaaaccaaaagcccaagagctatttttctagacatgtaaaatcttggcttcccttgaaaataatgagaaataaaaaaaaaaattctaagcccctcaaccaactgaactgaccttcttttggccaaggggaccacagagaaacctcagaggctgaattcgtagctatgatgtgatgggaggtcagaccatctccctcaatagccgccattaggctttcttctaacgggctaaagagaaaccagcccttgaaagatgccactgctgatttcaaccaacagcctgaatgctgccccgcccttctgccgttctgtcaaaacaaccaaccagcatttcttcctgataaagagactaccaaccacagggtggttctgg

SEQ ID NO: 131762 - DNA, 601 bp, Human
tttagaaatctaaaaattcaccatttcctttgaatgaaacatctcaaaaatagtcacatgacttttttttttttttaaagaacaaaagaactcaattttattctaggattttactgtttaagaacagactttctaagatactaggaacaataaagtaaatttagtgactctgaatgaaatacagaactgctttctgatctctattttaataaaacagaagagctttcaaataagtcatgtctgtaagttgcttataaactctctttcattaaaaacacacagagtacaggaaatcacggtkgccaaagagaaaatacatttgcctttcagatcccatcaattctccagttgtagaaaatgtgaatataacaggaggcaagaggggaaaatggtacccaacagacaagggtgaaccctgatttgtatcagtactaatactgccacaatttaaagatgcctatggttcaacagccagctcacaaaatttctgaacattaggctgggagtcatggctcatgcctgtaatcccagcactttaggaggccaaggtgggggtatcacttgaggccaggagttcaagaccagcctggccaacatggcg

SEQ ID NO: 131763 - DNA, 601 bp, Human
aagttcacctgggtcaacctgcctcaactccgaattcatctgcacttggatgtccactaagcatcactaccttcacatatcaaacttgggactcctgagcgagaccttccatcccaatctagcaaaggatcagtcctaatttaccacaatagacattccaacaactgctccactcatgttcattctatcattctcagtcatgtcctaagagcagcaggagcttgggtagaaaagacagaggatcaaactcaggcaagttgagcagcattcttggaattttaggtagaggcagacaggaaarggattgcaagagaaggttcagcctgaagataagatgaaataattacagtatggctaacatgtttacaccaataagatataagccaatttgccctctcaatcaggtacctaccatgtgctcattactagacactaggtataagtgaagaaaaagccaactcatggttcttgcaatggggagatatggaaagtaccagatggtagagagaatccacattttctgattccacatcaagagatcaagatcaataaacttacaccaaaataattcaagagttcatcacattttaacaatgtataa

SEQ ID NO: 131764 - DNA, 601 bp, Human
tgccacataccatgttgaatgatttaagtgaagctacagaatgcaactgtggggagttcaaatgtcaaatcctggctcaatgccaccactgttaccactgtgagccctgagaaaagttgcttaatttttctaagcctatcatttccccacctgccttcctacctttctatatatacgcttatgtatctagcaaatacttaaaaagtttttactatgtgtggccactgtcctaagaaccttacaaagattacttaaacttctatcagccttatgctgtaagaactcatgactttcaatttayagatgacacactgaggcacaaaggagttgctgttacttgcctggtacagtctgagcacaggctgtctggtttcagggttttgctcttaaccattactgcctatcactagttctcacaccccagatccccaacaccgtaagccatccttccatccttcccctaaggacttgtgaccacgtacccgagaaaagggaaatgctgaaactcaataggaagcccgacagcacactggctctgtgcgccactaattccttgagacctacggcaacaccacagttcactgggttcaactggggaaac

SEQ ID NO: 131765 - DNA, 601 bp, Human
acttttttaaattatgtttttaacaggattaattcttacctgctactcgtatatcacaggctaaagccagttcaagaccaccacctaaagcgagtccatctattgctgcaattgttggtactggaagattagctgaaatggaaagaaaattttatgcttccttaataagattattatctcactgtgtaattcatttttaatttttttctgtgaatttatgctttaaatgggagatcatatacagacttttgtatcccttttacctttaacaaaatataagcatttccatcattattcttcaaaacattatataattactgtatagtgttccatcacatgtatgtgcaatatctttaaatcttcccatattattgaattactttcataaacattttttgttgaattaacagaatcacagttctacgatttcttaatcttagagccagaagtctttcacaagatgtttggttcatacaaagttcaaattgaaatgacttatacataattgtgaaatttatgatcctttatgggctacttcagtgcttggaatgacagagtctcattcaaagaaagacatctgctcaaacaagaaagaaactgt

SEQ ID NO: 131766 - DNA, 601 bp, Human
tacatgggaatatgtcaaagcattctgacttttatgacaaatttatttaatagaaactagaaaaataattctatttgtcagaatatgtagtccaaattcaatcaaacctacaaaaagtaggttctaattaatgcagccactattgcagaggactctaaagaacttaagtatattgggaaaaaattctagtttctagacctcatatggtatggcacagtgagttcacaagacaagacagaagaggttgttatagcataatctatcttttctcatctaatcaaaccaaacactgctctctatyttctggtagttgtaacacaaaacttttcataatcaagtcacagtaaatatccaaattaccaagttcatcttgctccctccccaaatttctgccacctactaacccccatctgtccccaaaaatcatgtaaacatcaccaaaaagtcgctgtattcattgctataacaaattgccataaacctggtacctctgaacaactgaaatttattctctctcagttttggaggccagaaatccaaaatcaaggtgtttgtagtgtggttccttcgagaggctctgtgagaaaatctgttccatgcc

SEQ ID NO: 131767 - DNA, 601 bp, Human
gcactcttctaaattgtcaagatgattaaatacaaatttatacactgattaaatacaagagacaaaggagacacaccaactaaatgcaacgtggaggcctcaactgtcttgaaccagaaaaaggacacttgtgagaaaagtgacagcatttgagtaaggtctacagattagttagtaataacataccagtattaactgtctacttttgttaactgtggtacagttctataacatgttaatatttgaggaagctgggtaaagcgtacataagagtgatttatactatctttgtaactattcygtaaatctgaaattactgcaacatgaaaagttaaattagtgttatagaaaacaaaaaacatgaatgaggtactctttcaaatttgaaaaaactacagatttaaccaaatgaaaaattaatcctgaactggaaaaacaaaatacaaaaagacggctacagacaactggagaaatccaattatgaatcatatattaaataatattactaaattcctgttaatattcttgggtgtgataatagtgttgattatgtaagagaccattcttgattcttagaaaacgtatgctgaaatattgaaag

SEQ ID NO: 131768 - DNA, 601 bp, Human
gaattcagttttatttttaaaagataagggaaatgaactgccgctcttcttaatttataggcagaactaatttaacttccttgattaactttctacatattctatttaatgactctgagaaaaaggtaggtctttcaacatctgctttctagactgcttaaagtgattcttgagaccatttatttaacttgatacaaaaataaacactatagaatattaaaatgtaaataagaccaccttgattactgctggataataagaaagtaacctgccactcataaaatgaataacctgttttttytaagagagcaagttactagcaatttttaaaaatgagagcaataaacactgacataaatttgaggttataaggaggaaattaaaatactcataaccaaaatcaccaattaattagattccattacttacataatttgaacacataaataaagctaattttaatgaaaaaagggcagttaaagtaaataacatactcatattattaattctccaatcttttctgtataactatcctttgaagttaatctcattctcttttctccaggagcagtaatttacgcattcaaatatacacactgag

SEQ ID NO: 131769 - DNA, 601 bp, Human
cacacaaatataaaaacattctagtttcacagtgtaatcttacgcgtagcaaaaagattattttataaaagtcaattttacatacgtagtaaagaaaagaaacctgaacactgaggattttttttccatctcttccacaatcttgacagatggtgctcactctgagtgacaagtaactataaaaaccagtaagtctatttcaaaggaaaagtggtcctttaaactactcataccaaatgccttttaagatcgtcactgttaagtctgatttcacctttgtgggtaacaaatcttggaagtrgtttggcgcgatttcaacgaatggaaaaatagaaagtctggatatacagtaagataacttttctgattaagtggttggtcatttcacaaaaataatgcaactgaagaatagtgcatttattaatttaatgaatcatagcccttcctcttccagccaagatagggtagcaaagactggatttaccttcctacctgaaaaactcaaaaaacagttttcaagacactggataaggcaacaaaggacagtaactgttgaaacaagcgacatgagcccttagactgcccaacctaacttggatga

SEQ ID NO: 131770 - DNA, 601 bp, Human
acaggtgaggttagtggttttgtaacagcccatattttctcaatctctttttgaaacactgatgtgatacatgactgatttcaaagtagctcattttaaatattaggcattcttggacctgtgaaaaattaatcttagaggagctctatggtgatttctcatttttcaaacacttgcttctggctgggaatagaacgggaacttccctaggcatgtttaaagttggccataaaaaaaggtaatgcaaaagtacagttagataattaaataagtgttctcaaccacttgacagagtgaatcytaacacggcatcaggtaaaagtttgctcctttgttttcataaaatgtcaaccacttcaacaggccaaatctccaagccgaacagaaatcccataacttatcacccaaaaggatgactatggccatttccagaggctttctctgccactgaaatgctagtgatcaagtgtaattattaacaggtcaaggaataaattgattccagggcagtggaaattatgttgatgaaatgaaaagtggtcttgctgacaatgcattatcatttctagacagcacatctgaacatcaaatctcacatcat

SEQ ID NO: 131771 - DNA, 601 bp, Human
ggagcaacaggtgaggttagtggttttgtaacagcccatattttctcaatctctttttgaaacactgatgtgatacatgactgatttcaaagtagctcattttaaatattaggcattcttggacctgtgaaaaattaatcttagaggagctctatggtgatttctcatttttcaaacacttgcttctggctgggaatagaacgggaacttccctaggcatgtttaaagttggccataaaaaaaggtaatgcaaaagtacagttagataattaaataagtgttctcaaccacttgacagagygaatcttaacacggcatcaggtaaaagtttgctcctttgttttcataaaatgtcaaccacttcaacaggccaaatctccaagccgaacagaaatcccataacttatcacccaaaaggatgactatggccatttccagaggctttctctgccactgaaatgctagtgatcaagtgtaattattaacaggtcaaggaataaattgattccagggcagtggaaattatgttgatgaaatgaaaagtggtcttgctgacaatgcattatcatttctagacagcacatctgaacatcaaatctca

SEQ ID NO: 131772 - DNA, 601 bp, Human
ctgctccagggctccaaatcaccacggagcaacaggtgaggttagtggttttgtaacagcccatattttctcaatctctttttgaaacactgatgtgatacatgactgatttcaaagtagctcattttaaatattaggcattcttggacctgtgaaaaattaatcttagaggagctctatggtgatttctcatttttcaaacacttgcttctggctgggaatagaacgggaacttccctaggcatgtttaaagttggccataaaaaaaggtaatgcaaaagtacagttagataattaaatragtgttctcaaccacttgacagagtgaatcttaacacggcatcaggtaaaagtttgctcctttgttttcataaaatgtcaaccacttcaacaggccaaatctccaagccgaacagaaatcccataacttatcacccaaaaggatgactatggccatttccagaggctttctctgccactgaaatgctagtgatcaagtgtaattattaacaggtcaaggaataaattgattccagggcagtggaaattatgttgatgaaatgaaaagtggtcttgctgacaatgcattatcatttctaga

SEQ ID NO: 131773 - DNA, 601 bp, Human
cgaaagtgctaagattacaggcgtgagccaccacgcccggcccatagacctattttttaaaacccataatacttctagtttttatgacaatatgccagttgtaactatttcccagtcttctttgaggtaaatccatacatattcaattgtgatgcttctaaatatattcaaggatatgcataatacaatatctaagcatgtatttaatagacaagaatataaaacaagatgctggcatgactactattatatcaaggtttatcctactgaggtggtatgattcagataattaacactttctttttttttttgagatggagtctcgctctgtcacccaggctggagcacagtggtgcgatcttggctaactgcaaccttcacctcctgggttcaaacgattcttctgcctcagcctcctgaggagctcggactacaggcgtgcgccaccatgcccagctaatttttgtatttttagtagagatggggtttcaccatattggccaggctggtctcgaactcctgacctcgtgatccgcctgcctcagcctcccaaagtgctggcattataggcgtgagccaccacgccaagccagataattaa

SEQ ID NO: 131774 - DNA, 601 bp, Human
tcacagaataatggtccagaaaggtacaccaggcctcacagagtccagtactcttctttaacaagtaataaaaattcaagagttgggtgtgtatgcccctatgactggggcacataaaggaacaggctcaggcaatcttaatcacaggtaacttagaggtatgtatagttgaacataaacatatattttaagggttagatagcaaactttataaaaaattattaaactgacattttagacaaagtatgcccatgtgacagactgctagtgcactccgtgtgtgtatgttatattttggtgrgaagtctgagaagcacaaagctactcaggagcaaaaccagatctccagtactataatccaggtctcttgattatcagtccagatggcagaaagggaagtgtcagcttagcctacagatgcatcattgaaacttagaactagcaatgcatgccctagaaaggtgccccagctactaatgtaaaaagccatgggataactaacatgtgtatggcactttccagtttacaaagcagtctttaaaaggtaacaaatataatgtctttaaaaaaaaactttgcaatacagatactatcatcacct

SEQ ID NO: 131775 - DNA, 601 bp, Human
catatcttcagaaacctctttgcagtacatttaggctagggcttttcaacccgtctcatctgtaaaatcaatcccctcttcctaaagagttatatatctcatttgttgatgcctcctttcccgttttctttggtattcatgtttgtaattatacctttttttttctcttttatagtttatgttttcattttggtgaagccttaaaatgagaaggcagatgacaatgctcagtaactagtctgctttcttgacccagagccttaatgatttttaagcttataaaggaaagttacggccgggsacggtggctcatgcgtgtaatcccagcactttgggaggctgaggcgggtgaatcacaaggtcagaagtttgagaccagcctggccaacatggtgaaaagccgcctctactaaaaatacaaaaaattagctgggcgtggtggcagacgcctgtaatcccagctacttgggaggctgaggcaggagaatcgcttgaacctgggaggcagaggttgcagtgagccaagatcacgccactgcactccagcctgggtaacagtgtgagactccatctcaaaataaataaataaataaataaataa

SEQ ID NO: 131776 - DNA, 601 bp, Human
ttaaattctttgccaagcaggtggatccttttgggacttgtttctaagctttgttaagacaggcctagagaattctttattttaaggatagtatggccctaccaaagcataatccttctgggtttctactttcttcagggtgtcctacaaagcctctttaatctgctattcagaattttaaatgttcccagttcacttctgtgtgaactctgggaattagtctgcttacagttctctttctctggtagttcctttgtggctttgttgagttttatcaaatgaaagcacatcttggcaatcwccaaccaactcaaggtcaccctcgtgcaaatttctgttcttctgtgtagctacttcctatcctgtgttgtatctcacatattaatccacttcagcctcctcagaattcctaggttcctctttctttcactgtagtctggaaaatgcctctaggcagaaagcagcagtgattttaggacttcccttagtagattattttctctcaggatcacagaactgtgctacctgtaatccagtgtatgaaaacagctgttccatatatttgcccaattctctagtaatttaaagtagaaagacacat

SEQ ID NO: 131777 - DNA, 601 bp, Human
ggtggcttacacctgtaatgccagcactctgggaggccaaggtgggcagatcacttgagcccaggagttcgagacaagcctaggaaacatggcacaaccctgtctccacaaaaaatacaaaaattagccaggcctggtgatgcacacttgtagtcccagctacttggggggctaaggtggggggatcacctgagcctgggagattgaggctgcagtgagccatgattgcaccactgcactcttgcctgggcgacagagaacctgtctcaaaaaaaaaaaaaaaaaaaaaaaaaaaaaaagwacacaatatttctgaacactgacctggagttctgtaagagggggtttggggaacactggacccacatggctctgtgacataccaaagaaacaatatctcacacatcatcttataaagccctcttttcctgtaacctcacccttgtggctattctttgagctaattacacaaaagttgtttgttcggtagtttttttttggtaacaccgacataagatcagcaatataagagatactttcaaagcatacttaatactcaaatatcttctgtacctttgctcatgactatgaatacagcagg

SEQ ID NO: 131778 - DNA, 601 bp, Human
acctaagaaggaagacattcagaatctaaatgataatcttacaatacagttgctcaacatacacaagagaagtggtatcggccagcctgatctaaactgagatcttcccaacagacttctgaacataacacctatcccaggtacatggaaactgtccagagaaacaaaactaatagaaagaggggatccaatggactcttctgtagcagcatacatgtatcagatcaattactagggctgcagtaagacatctacctacctacagtaaaaatatcatgccataacatgcctaaccaactaygtcttacatgtgttgcactttttcattctaatccctagttatttatatagacaatatgttatatattatatataagtatatgtgattgatttaaagtcatattagtatctacaaatgtattataaggattatggctaggctggatattttttcctttttgagattttgtgttaggttttcctttattaggttttgtggtaagtacataatatgtattatgtatgtgtaatacatatatacttgtgtcaaatgaacatgaatacataagccagccctaaagaaaagtcttgattacattat

SEQ ID NO: 131779 - DNA, 601 bp, Human
ctgtcttgaggctgtgaactcagatgcttgccctggtggctctgagaggtctctggaggcttctcctgcccaaccctcactcacacccatatgaccaagacgtgagcacatgactcaagtcagaccaatcaactctctctccttcagcgtggatcttgaacagagcaatggaaggaatggctgggctagtaaattggagtgaaggcctccaggtaaggctatctggagctgtacttccagggagaagtttctgtgatggtggaaagggtttgtgtttgcactatgtaatacagaagtcacyagccacatgtggctactgaacacttgaaatgtgactagtatggctcaagttttaatttttagttcattctgatcaatttaaatttaaatcattgcatgtggttagtggctacaatactagatggcacaggtctagagtctcctgccactgagagagtctctgggggccctttagcctcccatgagctcccttttggtggtaacactggtttctgttcaaaaccaaagaaacttgacatgacctacagttcatttcaacatgcccaatgtcttagtcaatgatgcagctgagggagaaggt

SEQ ID NO: 131780 - DNA, 601 bp, Human
gtggattatggtagagaagcctttagcaatcaggactggaatggggaaggaaggctggacagcaaaaacgtttttccagagcaaattaagcaaactggccacaattaaacacttttgtgatacagctttcattaatatttattatagaaagctttttcaactattatgccacacactgttagagaaacatacacacccaagtcttaatcattaaaaacaaaattacgcttatttttcaatgtttacatgcacctttaaaaacaaatatttgctgatacattgtgatatctttttaaaaaawattttgaagatgtattgttacctaccagaggaacacaaaatcttcctttcaaaatcttttatttaaagactgccatggtgtgcatctgtccattcttggccagctcccaccaatagcactgtgcacccctccgcctttgagtgctgtcttgaggctgtgaactcagatgcttgccctggtggctctgagaggtctctggaggcttctcctgcccaaccctcactcacacccatatgaccaagacgtgagcacatgactcaagtcagaccaatcaactctctctccttcagcgtggatctt

SEQ ID NO: 131781 - DNA, 601 bp, Human
gcctcttgggagccatgagaaccttcaatgccatggggagatgttggcagcaatctgagactactctcccctttcctccaagaccaaaagacctaaattcaaagtacagaataatgtgaaatatagatgttacttccccctttttatatttacatgtattaaaataatctaaagcaagctttgacatttcacattcaattacaatgtaatgtgtaaagaactgaccataccttatgactttggattataaagtatgttttagtaacatttaacggtggaaaacccaagctttttgttctgttttttttttttatccttcatcttttcccttctcaagagagcacaaagaaagaagtcatactgataaagggggatgctcataacaaatcttccaagttaaaagtatgtggataccaaattgagggcatttactgatatgcttagaagtgatctctgacttctgatagtaaataccacttttgaattacttataaatcttctctcataaatagaaaagccccacttcaggttgttttttccttgaaccatgggaggaaacactgcagtataatgctaactttggattataaagcccactgca

SEQ ID NO: 131782 - DNA, 601 bp, Human
gtaagattgggggagaagagatgataggggcaaaatcagaacagggtgcccagtaggcagctactgctgtcacccaagtacaacaggatggcagcttggaccgagacagcgcaaggtagggagagagatgtggaggacttggaataagtgttgtctgaaatgctagttaaatggatgctgggagaaaggaaaatcaatctaatggctagatttttagcctgagtgtgtgagtgtccgatattatgaacactgacaagaatggaggagggggaagctgtgctctggccaaggtaagtataakgtatcttttacacataagagtggagcagtcatgtgtgagactggacacagagaataaggtttaccaatgattagtatcatacaggtagcattcaaaaccaaggtcctgaataagatcacttagggagactgtttagacaaatgtcagcaagacctggacaggtgctcactgaggctgttcagctgctcaggtgcagccaaccacattttataagtcacctgttcctgttctaccactattcaccctacccttccttcaataaagctatgtctgcaggggtcttctaggaaagatattctt

SEQ ID NO: 131783 - DNA, 601 bp, Human
taaataaaaaacagggagagggcctctaaaaggaatctgggaataaagcattgcaacaggaatgcgtatgccataaacaatgtgtatattcagggagataaaggaagacaaaggtttttagaggaaaaaatgaagattacgtaactgtttcaaaataattatccttggctacaaagatcaataacaagtaacgccagcctgaggctggacaggcagttgaacagacatccttgcagaagtgtcttctgtataaggttacaatggccttcatgtaaggttgtggtttttgcagagtgttttstgatggttttagttatcaggcatacaagcataagaaccctcttttcatgggcttctcaattctatttgtcagggttatttttaacaccagtgattccattttgattcctcagagatttgagggagaattatggtcatgaactaagaagacgggggtaggcagatgtttgtactatttgtggtggagctccaacaagctcagagagagacttctaaacaagttccccaaatgatttgaatgttggccatgttttggctgctcaacatccactgcccccattaaaatcccggtcttgctttt

SEQ ID NO: 131784 - DNA, 601 bp, Human
tactctgagggggacaagaagccactgaacatctgagagcatcttctgagaaacagtggtatgggactgtcattctctaatgaagatttgagcttgtcaacctaaataaaaaacagggagagggcctctaaaaggaatctgggaataaagcattgcaacaggaatgcgtatgccataaacaatgtgtatattcagggagataaaggaagacaaaggtttttagaggaaaaaatgaagattacgtaactgtttcaaaataattatccttggctacaaagatcaataacaagtaacgccagcytgaggctggacaggcagttgaacagacatccttgcagaagtgtcttctgtataaggttacaatggccttcatgtaaggttgtggtttttgcagagtgttttgtgatggttttagttatcaggcatacaagcataagaaccctcttttcatgggcttctcaattctatttgtcagggttatttttaacaccagtgattccattttgattcctcagagatttgagggagaattatggtcatgaactaagaagacgggggtaggcagatgtttgtactatttgtggtggagctccaacaagct

SEQ ID NO: 131785 - DNA, 601 bp, Human
ccaaatgtaaagaggagaactagaaaaaaattacttcagttcaccttttcttaattctgaatatcaaactccaatattaacttagagttaggggtaaaagtgaagatagcgtatcctatttctgtcagttgactattttacaccaggcttgcttcattagattagatgatataatctgctagttcccttaggcatctgaattcaggattcctaaagtgccagttctttttttttattattattattattatactttaagttttagggtacatgtgcacattgtgcaggttagttacatatrtatgtatacatgtgccatgctggtgtgctgcacccactaactcgtcatctagcattaggtatatctcccactgctatccctcccccctccccccaccacaccacagtccccagagtgtgattgttccccttcctgtgtccacgtggtctcattgttcaattcccacctatgagtgagaatatgcggtgtttggttttttgttcttgggatagtttactgagaatgacgatttccaatttcatccatgtccctaaaggacatgaactcatcattttttatggctgcatagtattccatggt

SEQ ID NO: 131786 - DNA, 601 bp, Human
aggctcaaatgatccttctgcctcagcctccctagttagcatgccatgcctggcatcagactgtaagctccaaatgtaaagaggagaactagaaaaaaattacttcagttcaccttttcttaattctgaatatcaaactccaatattaacttagagttaggggtaaaagtgaagatagcgtatcctatttctgtcagttgactattttacaccaggcttgcttcattagattagatgatataatctgctagttcccttaggcatctgaattcaggattcctaaagtgccagttcttttttwttattattattattattatactttaagttttagggtacatgtgcacattgtgcaggttagttacatatgtatgtatacatgtgccatgctggtgtgctgcacccactaactcgtcatctagcattaggtatatctcccactgctatccctcccccctccccccaccacaccacagtccccagagtgtgattgttccccttcctgtgtccacgtggtctcattgttcaattcccacctatgagtgagaatatgcggtgtttggttttttgttcttgggatagtttactgagaatgacgatt

SEQ ID NO: 131787 - DNA, 601 bp, Human
acaaatatctcttcaagaccctgctttcaattctgctttcaatatatacagcgtgggactgctggatcatacagtaattccagtttaattttttgagaaatcaccataatgttttccatagtcaccaaaccattttacattcctaccaacagagaacaagaattccaatttctctacaccctcaccaacacttactatttttttttatagtagccatcctaatgggtgtgcagtagcattttgaaacccacccaatagtcccatagacagttctttttggataaacaaagaaattgacccytctgctgttaaagtttgaaacttgcatctgttttgagtttcttccccagaaaaggaccttcaggcctttcaaaaaaagtatcaaagaaccaaaactcagctgatcaccagaccagatgactccttgcccctccctagttcttgttttcttacacattgttacatttcttccctgctatataaacccctagttttagtgggttagggagatgaatttgaggctgagctcccatctcagcagcagcagccgattaaagccttcttccttggcaatacttgtcgtgacagtgatgggctttct

SEQ ID NO: 131788 - DNA, 601 bp, Human
atgggatgcggctcgacacactggcagtggaaggagggagcagaggagaggacagtgctcacgttctcaggcggggcggtgtgtggacggtggtggcatttgctgcatggtggccacagaagcatcatgggagagagagcaagtcaggccctaaggggctaataagctgcctatagggagctctgaagtagagagctgaacatccatgtcaggaggccaggagcgggctctgcagatcatcagaattggaactgtgtcataacctttcttaaacacacccctttctttcaactgaggtatrttctggtcataaagttttaagccaaggtaagttataacaccaatattcagtcagattatactctcctgatacttgtacctttaatttgtctttaggtagagacttctctcatatttgggaagaataaataagtttgtagtgagaatcttatctttttaaggcaaaaatctttttttatttgctctgtttccatcaatccaacaaatacttattgagcatctactgaatgtatggctctgcactaccttatgtggggaataaattatataatggtccttccctaaaagagctaacagctcc

SEQ ID NO: 131789 - DNA, 601 bp, Human
ttttgcagtcacatattttctgaagtaactcaacatcttcttatacatcaacatcttcttatttgtttgacctggaggaaaattaattttaacaatcaacattctgaaggagtgtccttccaatgaaaggtgacaaaggcacatgcacagggactgtgatgacggctgggtaaccacacaatgggatgcggctcgacacactggcagtggaaggagggagcagaggagaggacagtgctcacgttctcaggcggggcggtgtgtggacggtggtggcatttgctgcatggtggccacagargcatcatgggagagagagcaagtcaggccctaaggggctaataagctgcctatagggagctctgaagtagagagctgaacatccatgtcaggaggccaggagcgggctctgcagatcatcagaattggaactgtgtcataacctttcttaaacacacccctttctttcaactgaggtatattctggtcataaagttttaagccaaggtaagttataacaccaatattcagtcagattatactctcctgatacttgtacctttaatttgtctttaggtagagacttctctcatatttggga

SEQ ID NO: 131790 - DNA, 601 bp, Human; identical to SEQ ID NO: 86991

SEQ ID NO: 131791 - DNA, 601 bp, Human
aagctggagtgcagtggtgcaatctcggcccactgcaacctctgcctctcgggttcaagctattcttctgcctcagcctccggagtagttgggactacaggcagccgccaccatgcccggctaattttttgtatttttagtagagactggggtttcaccatgttggccaggctggtctcgaactcctgacctcaggtgatccacccacctgggcctcccagagtgctgggattacaggcgtgagccaccgcgcctggccgaaagaataatcatttatttctctgacaactgtagttttgtkttttttttgttcacttacttactgcaaaagataagatagccaatcagcattaaaaaaaacaaaaaatttgttcgatagccatcaagacaataaacaaaactggctttttatgtttaaagagggtttgtatttgtatttagtttgatagtaccttactaggttagattggtaacatatcgaaatcacaaaatatttcctgagtacttggagcagagaacaaggatcagcgatttagattttgtaggtggtctggccttaagaattaatacttaattagcagtcattactcactgccattga

SEQ ID NO: 131792 - DNA, 601 bp, Human
gacctcaggtgatccacccacctgggcctcccagagtgctgggattacaggcgtgagccaccgcgcctggccgaaagaataatcatttatttctctgacaactgtagttttgttttttttttgttcacttacttactgcaaaagataagatagccaatcagcattaaaaaaaacaaaaaatttgttcgatagccatcaagacaataaacaaaactggctttttatgtttaaagagggtttgtatttgtatttagtttgatagtaccttactaggttagattggtaacatatcgaaatcacwaaatatttcctgagtacttggagcagagaacaaggatcagcgatttagattttgtaggtggtctggccttaagaattaatacttaattagcagtcattactcactgccattgaaggatctgttattatctgtagcttggggctaggctaatttcagcaatttatttattggacttcttttggaatggcagcattgtactttttgcttttgtttttaagagatggccttgctctgtggcccaggctggattgcagtgacatggttatggctcactgcagcctcatattcctgggttctagc

SEQ ID NO: 131793 - DNA, 601 bp, Human
aataataataataatgacaataatttctaggtttttaaagttcttttaataaatagcgagagcattgtaatttatattttttaagatctagtaagtaccttcatgtctcattcaacattattctactttgcttagtcctagagctgtctgaatttttgctaaattagaccttacagaaatatgagatgagcaaataccaaatcattggaaactactatgggtgggaggtagggagacgtgatttctccaggtttaaagataaatttatatagatccttttcactccagatactttaacaayaatttaatattcattttaaaatgttgaccagatgtggtggctcacgcctgtaatcccagcactttgggaggccgaggctggtggatcacctgaggtcagggtttcaagaccagcctgaccaacgtggtgaaaccccatctctacaaataccaaaaattagctgggcatggtggcaggcacatgtagtcctggctacgggggcggggggagggctgggggcggggggcgcgaggcgggtgctgagacaggagaatcacttgaacccgggaggcagagtttgcggtgagctgagtttgtgcc

SEQ ID NO: 131794 - DNA, 601 bp, Human
ctttgggaggccgaggctggtggatcacctgaggtcagggtttcaagaccagcctgaccaacgtggtgaaaccccatctctacaaataccaaaaattagctgggcatggtggcaggcacatgtagtcctggctacgggggcggggggagggctgggggcggggggcgcgaggcgggtgctgagacaggagaatcacttgaacccgggaggcagagtttgcggtgagctgagtttgtgccactgcactccagcctgggtgacagagactctgtctccaaaaaaaaaaaaaaaaaaaaaaaaattgttagagaacctactacatgttagactcacagctgttcactgttgcagccattagttacatgtggctatttaaaatgatataaatatctaaatgctcagtttctctgtcaagtagctaacttatattgggtagtgtggataagaacattttgttttgattgattgacagggtctcattctgttgtccaggctggagtgcagatcatagctcaccgcaactttgaactcccttactcaaatgatccttccaccttagcctcctgagtacctgggacaacaattgtgtaccaccatacct

SEQ ID NO: 131795 - DNA, 601 bp, Human
tgcagatcatagctcaccgcaactttgaactcccttactcaaatgatccttccaccttagcctcctgagtacctgggacaacaattgtgtaccaccatacctggctatttttaaaattttatttttgtagagacagggtctcactatgttgcacaggctggtcgcccaactcccaggatcaatcgattctcccactcggcctcccaaagtgctggaattacagttgtgagccactgagcccggccattttctttaattctgaatgaaataggggtttaaatagagatgtatgctctgtcasttttttttttgttttattttgaaacggagttttgctctgtcttgtgctcactgcagcctccgcctcctgggcttaagtgattcttgtgcatcagccttccaaatagctaggattacaggcatgcaccaccgtgcctgcctgagttgtatttttagtagagatggggcttcaccacgttggccagggtggtcttgaactcctggcctcaagtgatcccatctactttggcctcccaaagtgctgggattacaggcataagtcactgcagctggcctctattagacttttttttttttcttg

SEQ ID NO: 131796 - DNA, 601 bp, Human
ggcttcaccacgttggccagggtggtcttgaactcctggcctcaagtgatcccatctactttggcctcccaaagtgctgggattacaggcataagtcactgcagctggcctctattagacttttttttttttcttgagacggagtctctttcgtccaggctggagtgcagtgggcgtgatctcggctcaccgcagcctctgccctccgggttcaagcaattctcctgcctcagcctctcgagtagctgggattacagacgcctgccattgtgcctagctaattgttttgtatttttagtasagatggggtttcaccatcttggccaggctggtcttgaactcctgacctcctgatccaccttccttggcctcccaaagtgttgggattacaggcgtgagccactgcgcccagcctgtaagactttttaaaaggatttttctggctgcagggttgaaagtaaagtgcagagtacggtgagaccactttagaagacttagaatattccagacaagaggagatggtgacagagaccagagtttgataggttagatatggggtataagaaaaagtgaggagttaagggtggtctcaagatgttga

SEQ ID NO: 131797 - DNA, 601 bp, Human
aagtaaagtgcagagtacggtgagaccactttagaagacttagaatattccagacaagaggagatggtgacagagaccagagtttgataggttagatatggggtataagaaaaagtgaggagttaagggtggtctcaagatgttgatctcaagatggtctggctaggtgcggtggctcacgcctgtaatcagcactttggtaggccgagatggactaatcacttgatcctaatagttcgagactagcctgggcaatataatgagaccctgtctctacaaaaaatgcaaagttgggcatggyggcacgtgcctgtgtcccagctactcaggaggctgaggcaggaggatcgcttgagctggggaggacgagactgcagtgagccgtgatagcactactcagctccaacttgggctacaagagtgaaaccctgtctcaaaaatgtttattttgagcatatgacgagatgtgaaaagctacagggataataggcttaagaatgagaataagggagtcctgtgttaattttgagtgtaggtatgtttgaggtctattaaatatccagatgaaaaggttaccgaagcagtttgatgtacaagtcag

SEQ ID NO: 131798 - DNA, 601 bp, Human
ctctgctctaggccacttccaacatttgaaggtcaggagattaaaaggaatcgtctaaggagatgaaaggtaggaaaaccaagagtagtgccctggaagtcaatgacgtgtttcaaggagtgagttatttaactgagtcaaatgctggttcagtaagagtactgagactgggttaataaggtcattggtgacttgacaaagagcgatttccaagagtggtgagggtgaagtgtgattacggtgctttgaagagacagggagaggaagcgaaggcattcttagggagttgcactttatgaaragcagagaagtggagtggaagcttcaaggttagttgagaaacttagtaacattattgtctgagtgcctttatttagtcctattttcacagcaacctgtgagatagacctggcagttaaatcataccaattttatagatgataaaccctaagacattattagtaagttaggtggttccctgcagtttctcatcagtgcttgctcctgtcttttcaaccaagacgctatgactttgcttggcagggtcccaagaaatctaattctggctgtaccataatagatacacctttaattgttgccc

SEQ ID NO: 131799 - DNA, 601 bp, Human
ttattaagaatagcaaaatattccaaaaaaccttaggaaacggcaattaagtcacttgttaagccgctttatccataaatattttaattgcaatataaggaatagcttttaacaatcagatattaagataatttctgagtttgatttgcatgccccagtttcaaatctttaagtgagatacattgctaagaagaaaatacttagctttttgtagttacttttctgttcgtacatgaaaatgtcttaggaggaaagaaaaaatgagtattatttgggcaaatatatctaagtcattagcctraatgagtgcttctcaaacttgagcatgcattagcatttccagaaaggcttgatagtctaggcaaaatactttgacatctacttcagcaaaatggcttgctgaagaaaccaagactggcagggatattacattattggcaaaagttacccagatctgaagattagaagcgcttatgtagcaaaacaatataatgaaaaaaaatcccagattttcagtgtgttgcaataaacatgttaaagtgcctcagggctgggcatggtggctcacctctgtaacccagcactttaggacactgaggtg

SEQ ID NO: 131800 - DNA, 601 bp, Human
catggcggcacgcacctgtagtcccagttacttgggaggctgaggtgggagggtggcttgagcttgggaggcggaggttgcagtgaactgagataatggcactgtactcctgcttgggtggcagagtgagaccctgtcttaaaaaaaaaaaaaagtaaaatgcctcacgtaactcattagttacaagtgatactgattgcaaatgtaacttttctagtttgtaaccagaggcttgtctcaagatctatacttagaaaatttgctattctaattattattattattattattattattattwttatttttttttttttttttttttgagacagaatctcgctctcttgcccaggctagagtgccgtggcacggtctcggctcactgtaacctctgcctcccgtgttcaagcgattcttctgcctcagcctcctgagtagctgggattacaggcacgtgccaccatgcccggctaatttttgtatttttagtagagatggggtttcaccatgttggtcaggctggtctcgaactcttgacctcgtgatccgcccgcctcggcctcccaaagtgctgggattacaggcgtgagccgccccacct

SEQ ID NO: 131801 - DNA, 601 bp, Human
ggcggcacgcacctgtagtcccagttacttgggaggctgaggtgggagggtggcttgagcttgggaggcggaggttgcagtgaactgagataatggcactgtactcctgcttgggtggcagagtgagaccctgtcttaaaaaaaaaaaaaagtaaaatgcctcacgtaactcattagttacaagtgatactgattgcaaatgtaacttttctagtttgtaaccagaggcttgtctcaagatctatacttagaaaatttgctattctaattattattattattattattattattattattwtttttttttttttttttttttgagacagaatctcgctctcttgcccaggctagagtgccgtggcacggtctcggctcactgtaacctctgcctcccgtgttcaagcgattcttctgcctcagcctcctgagtagctgggattacaggcacgtgccaccatgcccggctaatttttgtatttttagtagagatggggtttcaccatgttggtcaggctggtctcgaactcttgacctcgtgatccgcccgcctcggcctcccaaagtgctgggattacaggcgtgagccgccccacctgac

SEQ ID NO: 131802 - DNA, 601 bp, Human
gggtttcaccatgttggtcaggctggtctcgaactcttgacctcgtgatccgcccgcctcggcctcccaaagtgctgggattacaggcgtgagccgccccacctgactttttattttttatttattttttttggagacagtctctcagtatctgcccaggctggagtgctcactgcaacctctgcctcccaggttcaagtgattctcatgcctcagcctgtcgagtgactgggattatgggtgtgcaccaccacgccctgctaattttttttttgttttttttgagggactctccctctcrcgcaggctggattgcagtggtgtgacctctgctcacttcaagtgattctgcctcctcagcctccccagtagctgggattacaggcagaccccaccacacccgactaattttttgtatttttagtcgggacagggttttgccacgttggccaggctggtctcaaactcctgacctcaggtgatccacccgtcttggcctcccaagtgctgggattacagatgtgagccacctcgcctggctatattctaattcttaatatgaggctgtttcataatctttacttaattcacacttgaaaca

SEQ ID NO: 131803 - DNA, 601 bp, Human
ccaaagtgctgggattacaggcgtgagccgccccacctgactttttattttttatttattttttttggagacagtctctcagtatctgcccaggctggagtgctcactgcaacctctgcctcccaggttcaagtgattctcatgcctcagcctgtcgagtgactgggattatgggtgtgcaccaccacgccctgctaattttttttttgttttttttgagggactctccctctcacgcaggctggattgcagtggtgtgacctctgctcacttcaagtgattctgcctcctcagcctcccsagtagctgggattacaggcagaccccaccacacccgactaattttttgtatttttagtcgggacagggttttgccacgttggccaggctggtctcaaactcctgacctcaggtgatccacccgtcttggcctcccaagtgctgggattacagatgtgagccacctcgcctggctatattctaattcttaatatgaggctgtttcataatctttacttaattcacacttgaaacatccctgatttggataggactactagttactgctaataattgaagtaatcaagattatatggtaaac

SEQ ID NO: 131804 - DNA, 601 bp, Human
acgacttcttgaacagaaaacacaaggtaaatattgggataagttttattttatttatttattttttttaatttttttttttttgagacagaggcttactctgtccagccgaggctggagtacagtggtgtgatctgggctctctgcatcttctgcctccggggtttaagtgattgtttgtttgtttttttcttttttgaggtggagtcttgctctgttgccaggctggagtgcagtagcatgatctcggctcattgcactgcaacctctgcttcccaggttcaagccattctcttgactyggcctcctgagtagctggcactacaggcatgcactaccacgcccggctagtttttgtgtttttagtagatacggggttttaccatgttggtcaggctggtctcgaactccagaccctaagtggtgatttgcccacttttgcctcgcaaagtgctgggattacaggcgcaagccaccacacccagctgatttttgtttgtttttgtttttgttttgagatggagtctcactctgttgcccaggctggagtgcagaggtgcgatctcggcttaccacaacctccgcttcccaggttcaagca

SEQ ID NO: 131805 - DNA, 601 bp, Human
tagataaatcgattgattgatcacttgatagatagataaaattgaatggtagatgatagatttatttggaatttaaaatttgagctctgtttttgaagacatacttgatttgtatatatgcagtaccatttggatcattccattttcttatattattattcataattgaattccaaatagaattagcaagtgttaaggcatatgaaaatgaaggactcctataatttcagtgctttaggtagctgaggccgtaggatcacttgaggccaaaagttcaagacctcacctttaccccccccccaaaaaaaaaaaaaaaaagcccagtgtggtggcatgtgtctgcagtcccagctacttgggagactgtggcgggaggatcgcttcagcccaggagtttgagagtgcagtgagctgcagtcgtgccactgctgtacagcctgcatcgcagagcaagactttactaaaaatttaaaagaaaaaatactgatttaggataatcattttacctttcataggacagggaaagaacgttaatcttgtttaatatagggcgaaaacacatttgaagaacatagagcagtattaattgaatttttgggga

SEQ ID NO: 131806 - DNA, 601 bp, Human
aaggactcctataatttcagtgctttaggtagctgaggccgtaggatcacttgaggccaaaagttcaagacctcacctttaccccccccccaaaaaaaaaaaaaaaaagcccagtgtggtggcatgtgtctgcagtcccagctacttgggagactgtggcgggaggatcgcttcagcccaggagtttgagagtgcagtgagctgcagtcgtgccactgctgtacagcctgcatcgcagagcaagactttactaaaaatttaaaagaaaaaatactgatttaggataatcattttacctttyataggacagggaaagaacgttaatcttgtttaatatagggcgaaaacacatttgaagaacatagagcagtattaattgaatttttggggaagaaaaatctcatgaagtaattttacccatatatgtatttttaaatattgaatgttgtaaataaactttcttagtttttactctatggaaataattttttttttttaacagaaagtcaaaaaaagaagcaacaagatgattctgatgaatatgatgatgacgactctgcagcctcaacttcatttcagccacagcctgttcaacctcagc

SEQ ID NO: 131807 - DNA, 601 bp, Human
agcccagtgtggtggcatgtgtctgcagtcccagctacttgggagactgtggcgggaggatcgcttcagcccaggagtttgagagtgcagtgagctgcagtcgtgccactgctgtacagcctgcatcgcagagcaagactttactaaaaatttaaaagaaaaaatactgatttaggataatcattttacctttcataggacagggaaagaacgttaatcttgtttaatatagggcgaaaacacatttgaagaacatagagcagtattaattgaatttttggggaagaaaaatctcatgaastaattttacccatatatgtatttttaaatattgaatgttgtaaataaactttcttagtttttactctatggaaataattttttttttttaacagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggtagcacataggattgcttaaaatctaacatttttagg

SEQ ID NO: 131808 - DNA, 601 bp, Human
attaatagaagttaatcttctgataaaaattttaaatcaagaactgaatttacccacaaaaatttaaaaaatttgaaagaaaattgaccaatttatcattttttaagtgaattggacactgatatttgaaggtgagctcttttaggggaaaaaataagtgggttgtgtttttaagtcatggtttagtggtaggtagttattgtaaataggccatctggttttacttttgagtgtctttaattttggtggtagtatttcctttctctaaaaaaaaaaagtgtgtgtgtgtgtgtgtgtgtggatatgtatgtatttgacacagggtctcttactctgtcgcccagactacagtgcagtggcgcagtcacagcttactgcagccttgacctcctgggctcaagtgatcctcccacctcagccctctgagtatctgggactacaggcgcacactactgcacccagctaatgtttaaaatttttgcttttttaaaaagatatggtctcactttttgcccagcctggtttgaactcctgagttcaagcagtccttgagccttggcctctcaaaacttctgggattataggcatgagctgctgcacc

SEQ ID NO: 131809 - DNA, 601 bp, Human
tagaagttaatcttctgataaaaattttaaatcaagaactgaatttacccacaaaaatttaaaaaatttgaaagaaaattgaccaatttatcattttttaagtgaattggacactgatatttgaaggtgagctcttttaggggaaaaaataagtgggttgtgtttttaagtcatggtttagtggtaggtagttattgtaaataggccatctggttttacttttgagtgtctttaattttggtggtagtatttcctttctctaaaaaaaaaaagtgtgtgtgtgtgtgtgtgtgtgtatatrtatgtatttgacacagggtctcttactctgtcgcccagactacagtgcagtggcgcagtcacagcttactgcagccttgacctcctgggctcaagtgatcctcccacctcagccctctgagtatctgggactacaggcgcacactactgcacccagctaatgtttaaaatttttgcttttttaaaaagatatggtctcactttttgcccagcctggtttgaactcctgagttcaagcagtccttgagccttggcctctcaaaacttctgggattataggcatgagctgctgcacctagcc

SEQ ID NO: 131810 - DNA, 601 bp, Human
agttattgtaaataggccatctggttttacttttgagtgtctttaattttggtggtagtatttcctttctctaaaaaaaaaaagtgtgtgtgtgtgtgtgtgtgtgtatatgtatgtatttgacacagggtctcttactctgtcgcccagactacagtgcagtggcgcagtcacagcttactgcagccttgacctcctgggctcaagtgatcctcccacctcagccctctgagtatctgggactacaggcgcacactactgcacccagctaatgtttaaaatttttgcttttttaaaaagwtatggtctcactttttgcccagcctggtttgaactcctgagttcaagcagtccttgagccttggcctctcaaaacttctgggattataggcatgagctgctgcacctagccaaataaaaaatctcatttcacagggtacattcattcaatctttttcttttcaaaatccaacacaactctgaaatagagatttcttctttttctttaatactctgtggatattttccaagtggaaaaagtggtgaatttgctttcccattacacatattttagatgaggcctcttgtacatattgagagt

SEQ ID NO: 131811 - DNA, 601 bp, Human
cgtgctgatgtgccgtggcacgatcatagctcactgcagccgcagcctcccaaagtgctgggattacaggtgtgagtgagcctcagcacctggcctcctttttcttctatttggaaccaaaataactttcccagaagctctttagctccttacgtattatgctgtgagggaacctgggaaattaagtatatagaatttggcctataaagcaggaaatacagcacaaggaaagggatttggttggccagcaagatgtgccacacgaggctattagttgtttttttttcttttttttttttttgagatggagttttgctctgttgcccaggctggagagcagtggtgtgatttcagctcaccacaacatccgcctcctgggttcaagcgattttctcctgcctcagcctcctgagtagctgggattacaggagtgtgccaccccacccgacaaattgttgtatttttaatagagatggggtttcaccatgttggtcaggctggtctcgaactcctgatctcgtgatccatctgcctcggcctcccaaagtgctgggattatagtcgtgagccactgtgcccggccctagcctgcgttttatgt

SEQ ID NO: 131812 - DNA, 601 bp, Human
ttagaatgttgataatggccaggtgtggtggctcacgcctataattccagcactttgggaggccaagacaggcagatcacttgatcaggagttcaagaccagcctggccaacatggtgaaacctcatccatacaaaaattagcagtgtgtagtggcgggcacctgtaatcccagctactcgggaggctgaggcgggatcatcagttgaacttgggaggcggaggttgcgttgagccaagattgcaccactgcactccagcctgggcaacagagcaagactccatctcaaaaaaaaaaaaaagaaaaaaatggaatgttggccgggcgcgcagtggctcacaccggtaatcccagcactttgggaggccgaggcgggtggatcacctgagggtcgggagttcgagaccagcctgaccattgtggagaaaccccatctctcctaaaaatacagaattagccgggcgtggcggtgcatgcctgtaatcccagctactccggaggctgaggcaggagaatttcttgaacccgggaggcggaggttgtggtgagctgagaccaggccattgcactccagcctggacaatgagtgaaaccccgtctc

SEQ ID NO: 131813 - DNA, 601 bp, Human
gcaccactgcactccagcctgggcaacagagcaagactccatctcaaaaaaaaaaaaaagaaaaaaatggaatgttggccgggcgcgcagtggctcacaccggtaatcccagcactttgggaggccgaggcgggtggatcacctgagggtcgggagttcgagaccagcctgaccattgtggagaaaccccatctctcctaaaaatacagaattagccgggcgtggcggtgcatgcctgtaatcccagctactccggaggctgaggcaggagaatttcttgaacccgggaggcggaggttgyggtgagctgagaccaggccattgcactccagcctggacaatgagtgaaaccccgtctcaaaaaaaaaaagaatgttaataacaatacttcattagatagtttcttgttgaagcaatttgtaattcccggaaagttgttagccatgcttcaagtttacaaataggtgaagttttaaggtatctagagtttaagtagttggattggtttgtctggcaaaagtaaatagttgggatgtaagggtaaatttttgaaaattactcttaacgttgtaagattttagatgcatgcctttatgcttgg

SEQ ID NO: 131814 - DNA, 601 bp, Human
ccagcctggacaatgagtgaaaccccgtctcaaaaaaaaaaagaatgttaataacaatacttcattagatagtttcttgttgaagcaatttgtaattcccggaaagttgttagccatgcttcaagtttacaaataggtgaagttttaaggtatctagagtttaagtagttggattggtttgtctggcaaaagtaaatagttgggatgtaagggtaaatttttgaaaattactcttaacgttgtaagattttagatgcatgcctttatgcttggtgagcctctgcattcgagtatttagccytgcgcttatttttattcccaggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtattcctctttttatgtttttcatatttagtggattttctaagttcacgcataaaatattaaatttatctgcagcatacgttgcacttaaaagtacaatgcgttaacaatctattttt

SEQ ID NO: 131815 - DNA, 601 bp, Human
tctgtgtagggtgtaagagtgaggtgttggagcgggaccgcctggctagaggaggtgactaatctttccagactgcctgtaggggttggaagtgagttaagggagttagttgtcagccgcggagttcagggaattctttggaacgggtcggctgcatgttgccggaaaaattaaaatttcttaacgctgtaataacgatggtcttacacctacacacaacaggaaaactgaaatgggaatcccagccagtcgcttccggcagctttctgttgggattcaagtgtgaacagaaatttattaygacagaagaagacgttaatgttcactcataaaggattcaattagggcttggactagctcttcactgcacatgtaatggcatctttgtagtgtagtttgggaagatctgaattggctcaacaagtagtatgagaatgcacctgtatgtgggacttgcaagatgttggcatttgacttagtgtgttgaattttggtattccagacctgcacggagaaaggacaatgacaagatcttgatactttatcattggggatactagagaaggagaggaagtgggcgtcaaggtgtatctttgaatga

SEQ ID NO: 131816 - DNA, 601 bp, Human
ctgcaacctctgcctcccaggttcaagcgattctactatctcagcctcccgagtagctgggattgccagcatgcgccactatgcccggctaattttgtatttttttttttagtagaggcgaggtttcaccatgttggtcaggctggtcttgaactcctgacctcaggtgatctacctgccttggcctcccaaaatgatgggattacaggtgtgagccactgcacctggccaagtggttactcttctaaacacatacatggtttaacttaattgaatcctcgaaacaacttgaagtaggttytgttaccattttacacatgaggatactgagcacagaaaagttaaataacttaacaaagctcattcaactaataactggtagacctaggatttgagctcatgtagtcttacttcagagcccatatagccacatgacatcatggttattgctttcctataactgtctacttaaatgaattatcattggtgggtggtgtcttttcatcttaggctgacttccttcctatttaacatacataaggattccacttgtctgtcagttaatttgagcttggggggttccaaaacagttttgataatt

SEQ ID NO: 131817 - DNA, 601 bp, Human
aattacagataatcccagtaagaataggaggaagtcagtatgattttatgggacttaaaaaaaaattaactcagtatgtatgaaagtggaaggaaacaggaaatacaaacaagaatgaatataaaacagtagtagactaaaacagatgatgaactgagtctgaaaaatgcaggtgggcacagtggctcacacctgtaatcccaggactttgggaagctgaggtgggaggattgcttgaagccaggagttatgtggaccagtttggaccacacagcaaagaccctatctctgttaaaaaaawttttttttttttaaagcagcatgggtaacataaggagaccacatatctacaaaaaagataaaaaaattgactgggtgtggtggtgcgtgcctgtgtcccaggtacttgggaaacagaggcaggaggatcacttgagcctgggaagtcaaggctgcagtgagccacaattgtgccattgtactacagcctgggtgactgagtgaggctctttctcaaaaaaaaaaaaaaagaaaaaagaaaaagacatgtagggggacaactaagagatcatttgcttctttcggcgtaagaaggataaca

SEQ ID NO: 131818 - DNA, 601 bp, Human
ccatgcctggctatttttttttgagacggagtctcgctctgtcgcccaggctggagtgcagtggcacgatctcggctcactgcaagctccgcctcctggattcatgccattctcctgcctcagcctccccagtagctgggactacaggcgcccgccaccacgcctggctaagtttttgtaattttttaggagagatggggtttcacagtgttagtcaggatggtcttgatctcctgacctcgtgatctgcctgcctcggcctcccaaaatgctgggattaccggcgtgagccaccgtgccyggccctaattttgtatttttagtagagacggggtttcaccatgttggtcaggctggttttgaactcctgacctcagatgatccacccgccttggcctcccaaagtgctgggattacaggcgtgagccactgtgcctgacttgcatttatttaatgatcatttctcctgttcctttgtggaaatccattcaagtgctctgctatagttcgctagtaggatttcctggcctttgtcatatggctccctgactggttaggcgctcccttaactgtggttatatgttgtcattgttcattgcac

SEQ ID NO: 131819 - DNA, 601 bp, Human
agagatggggtttcacagtgttagtcaggatggtcttgatctcctgacctcgtgatctgcctgcctcggcctcccaaaatgctgggattaccggcgtgagccaccgtgcctggccctaattttgtatttttagtagagacggggtttcaccatgttggtcaggctggttttgaactcctgacctcagatgatccacccgccttggcctcccaaagtgctgggattacaggcgtgagccactgtgcctgacttgcatttatttaatgatcatttctcctgttcctttgtggaaatccattcragtgctctgctatagttcgctagtaggatttcctggcctttgtcatatggctccctgactggttaggcgctcccttaactgtggttatatgttgtcattgttcattgcacattacatttatataaagtaaagacctttcttcctttccttagggtgaaaggaaacacttttaggcattgtatcattttatcatcagtgtcattttactttttagtaaaggctgtttttgttttcgttttttgagacagccttgctctgttgcccaggctggagtgcagtgacacaatcttggctcactgc

SEQ ID NO: 131820 - DNA, 601 bp, Human
atgctgggattaccggcgtgagccaccgtgcctggccctaattttgtatttttagtagagacggggtttcaccatgttggtcaggctggttttgaactcctgacctcagatgatccacccgccttggcctcccaaagtgctgggattacaggcgtgagccactgtgcctgacttgcatttatttaatgatcatttctcctgttcctttgtggaaatccattcaagtgctctgctatagttcgctagtaggatttcctggcctttgtcatatggctccctgactggttaggcgctcccttarctgtggttatatgttgtcattgttcattgcacattacatttatataaagtaaagacctttcttcctttccttagggtgaaaggaaacacttttaggcattgtatcattttatcatcagtgtcattttactttttagtaaaggctgtttttgttttcgttttttgagacagccttgctctgttgcccaggctggagtgcagtgacacaatcttggctcactgcagcctcaacctcctggagtcaagtgatcctcttgcttcagcctcctgagtagctggaactacaggcatgcaccaccac

SEQ ID NO: 131821 - DNA, 601 bp, Human
ggttatatgttgtcattgttcattgcacattacatttatataaagtaaagacctttcttcctttccttagggtgaaaggaaacacttttaggcattgtatcattttatcatcagtgtcattttactttttagtaaaggctgtttttgttttcgttttttgagacagccttgctctgttgcccaggctggagtgcagtgacacaatcttggctcactgcagcctcaacctcctggagtcaagtgatcctcttgcttcagcctcctgagtagctggaactacaggcatgcaccaccacactcrgctaatttttgtatttttgtagagatgaggttttgccatgttgcccaggctggtcttaaactcctagtctcaaatgatctgcctgccttgcccttccaagtcctgggattacaggcgtgcagcactacgcccggctaaggctgatttttttgatggttagcagctttgcttttatcatgaaccagagtcttattccactaagtaggacctcttttggtaatttttgtggattataggttatttgcttgttttggagcaaattgtgaatcatccagactgtctcacctgcacctcagactc

SEQ ID NO: 131822 - DNA, 601 bp, Human
ttgcctgcagaattagataattaatggttttctataatacaacctactgcaacctactgcagtagtctaatctcccaggactctactaagcatatcaaatatgtcagccatgttggatccctggctgtttgctgaacaagcctgtataaccctcatgctgtacctttctcttccatagtcttatctcaagttctacctcctctgaactctttccttcctgactttaatgtggttttaactctttcagtgactcacattgtattttgtacatgctctgagtattctgccttgtatgacagtkgctttacacttgccttgtctcctttactgtaatacaatctcactcaggtgaagcactatgtgccttgcagtaccacagagccttcctcattcccagtacagttcaaattccttaaccatggctacctctgaccacatccactatactagtctccttttactttctttacagctgtaattactggccttattgccttatgcttcaaactgtctggggttgggacattcatatacatatggattgctgtcagcttgatcttaacaggattttttttctttacactgtttcaagtctttgctc

SEQ ID NO: 131823 - DNA, 601 bp, Human
ttacggatgtgagtcactgtgcctggtttaaataagacgttttagaatactgttaagacagctagaattttgtgttaaggagtttggtactgagaatatgagggaggggatttcccttgcttttttctatttgaggactaactataagacagatatatctggtcaggcatggtggctcacgcctgtggtcccagcactttgggaggccgagtgggcggattgtgaggttaggagatcgagactatcctggctaacacggtgaaaccttgtctctactaaaaatacaaaaaattagccaggygtggtggcgggcgcctgaagtcccagctactggggaggctgaggcaggagaatggcgtgaacccgggaggcggagcttgcagtgagcgccactgcactccagcctgggtgagacactgtctcaaaaaaaaaaaaaaagacagatatatctagagaaccatcttcagcttgctattcccaaagttggtatgattcaggttatgatctgttcatttaaatgcaaggtttggagcctagaaagtgagggcatgtgagtcggggagtgagagagtgaggatgggttggttggcaagggctgggg

SEQ ID NO: 131824 - DNA, 601 bp, Human
tggtctcgaacccctgacctcgtgatccgcccgctttggcctcccaaagtgctgggattacaggcatgagccactgtgcccgacccacaatagcacgttttaagaaacctctctactaaaaatacgaaagttagctgagcatggtggcaggcgcctgcaatcccagctactcaggaggctgaggcaggagaagtgcttgaacccaggaggtggaggttgcagtgacctgagattgcgccattgcactccagcctgggcatcaagagtgagactctgtctcaaaagaaaagaaaaaaaaaaaggaaaaggaaaagaaaaaaagaaaaaagatatccagttcgtgtaaaaaaaaaaaaatccttgctgtaggagaaacatctatgatgaccttaacttaaggctgggttaagataggtagagtgctggagttaggcacaagttctggtgccagcagcagatatatgtgatagtccagatattaaccgattagtagtccttaggtgaattcatcttatacaattgtgatatagcttgcttttattttagtttttcgttctgtcttatttttagaaaatttttatgaggtcagttgagtttagag

SEQ ID NO: 131825 - DNA, 601 bp, Human
atccttgctgtaggagaaacatctatgatgaccttaacttaaggctgggttaagataggtagagtgctggagttaggcacaagttctggtgccagcagcagatatatgtgatagtccagatattaaccgattagtagtccttaggtgaattcatcttatacaattgtgatatagcttgcttttattttagtttttcgttctgtcttatttttagaaaatttttatgaggtcagttgagtttagagttggagattaggtagccaccagggggctccaatgaggagttacaaaggttttgctrgttctcttactggcaaatcctctgatgttacccgtcagttcaccttaggtgaatcacttagtgtctggactatcagggaaatggaggcaggtgaattgcaggagtataattcattgtttcttaattagagatatactttcaatgaccaagctctattctagactaatgaatcaacagcccaggcattctttttttttggtagatgagtgtggtaaatggtttattgaaataaaacttacagaggaatatttctaagtcctaggtattcatttttgtgtcctttgaaaaaactccctgggt

SEQ ID NO: 131826 - DNA, 601 bp, Human
tttcatttcttttgctcttatgctctagttagcaaccttaatataaaacttgcagtaaccaaagtgatagaagatcttcagtacttaatatttactttgtcaaagctagcatgtcagggatacctgatggcgtgctagactgtctagcattgagtgctgctttaagtcagttactttgcaccttacctcactacttaggtggcagatagtagtaggggttcagagtgcctttaaataaagcttaaaagcgcttttacgtgttaggctaattctaatttcttttttttttaattaaaaaaawtttttttaagactagtcaaagtgcagtagtgagaagcagggaaagagtagatcaggagctcaatctgtaactgactgtgaacaatcgagattactcattaccttcagaccagcttttatcccctttaatgcaagctaggttactgtacctgtttgctttaagagtgatgatgaattgattagttgcactgcttagaatctgaaagggaaaaagccagctggaccttttgagtcttaaaagcaactgctaggaatgaggcattagtgcttaggatgagaatttctcccctttattacctgt

SEQ ID NO: 131827 - DNA, 601 bp, Human
taccatccttatcaaaagtatcttcagcaactttgtaattacctagataccgaaagattattgatggtagccccacttatgataattgctctgattgaagttttgagacagatttgctacttggctcagagtagtaagcaacaacatggtaaagttaacagtcatttgctggctataataggagacaatacattggctagatcgtctcttatgctgaatttgatgctatcatcagaaattgcatatttaacagtaacagttctgtgactgtcaatctttgatttctttctgtggctttttycccccccttcaatcaatgccttttctctttcctaggcaagactggtgtctttgtactttgataccaagaggtaccaggaagcattgcatttgggtaagtaagctggtaataagtcatctcagctagctaaatgaatgtattctaaaccacctggctactcttactaattacctgttaataatttatattctactgacttctaagaaggatttaaagtagcttacagttctgcatttgtcatgggaaaatgtcatttgaaagtttaaaaaactagctagagttaatctgtcaaatttagag

SEQ ID NO: 131828 - DNA, 601 bp, Human
ccttatcaaaagtatcttcagcaactttgtaattacctagataccgaaagattattgatggtagccccacttatgataattgctctgattgaagttttgagacagatttgctacttggctcagagtagtaagcaacaacatggtaaagttaacagtcatttgctggctataataggagacaatacattggctagatcgtctcttatgctgaatttgatgctatcatcagaaattgcatatttaacagtaacagttctgtgactgtcaatctttgatttctttctgtggctttttccccccscttcaatcaatgccttttctctttcctaggcaagactggtgtctttgtactttgataccaagaggtaccaggaagcattgcatttgggtaagtaagctggtaataagtcatctcagctagctaaatgaatgtattctaaaccacctggctactcttactaattacctgttaataatttatattctactgacttctaagaaggatttaaagtagcttacagttctgcatttgtcatgggaaaatgtcatttgaaagtttaaaaaactagctagagttaatctgtcaaatttagaggacaaa

SEQ ID NO: 131829 - DNA, 601 bp, Human
gcatttgggtaagtaagctggtaataagtcatctcagctagctaaatgaatgtattctaaaccacctggctactcttactaattacctgttaataatttatattctactgacttctaagaaggatttaaagtagcttacagttctgcatttgtcatgggaaaatgtcatttgaaagtttaaaaaactagctagagttaatctgtcaaatttagaggacaaatgggtagttttaagtttacttgaatttggagcagtaaaatcaattccattttaataactgaaatttaaaaaaagtgtatytatattttgcatatagtactctgttaaatttcagatttaggtttttaaaggcaaatgtttggcttactgtcctatttactatatctgcttatatacttaaaatctattttaaaaatcaagaaattaattgggtacaaatatatttggaagctggagtggctaactgaagcctttttcctgtgtggcctttaaacaccttgaaatcttctctgctttttttttttaatctatctatctatctatttattattattattattattttttgagacagagtcttactctgttgcccaggctgga

SEQ ID NO: 131830 - DNA, 601 bp, Human
gaatgtattctaaaccacctggctactcttactaattacctgttaataatttatattctactgacttctaagaaggatttaaagtagcttacagttctgcatttgtcatgggaaaatgtcatttgaaagtttaaaaaactagctagagttaatctgtcaaatttagaggacaaatgggtagttttaagtttacttgaatttggagcagtaaaatcaattccattttaataactgaaatttaaaaaaagtgtatctatattttgcatatagtactctgttaaatttcagatttaggtttttwaaggcaaatgtttggcttactgtcctatttactatatctgcttatatacttaaaatctattttaaaaatcaagaaattaattgggtacaaatatatttggaagctggagtggctaactgaagcctttttcctgtgtggcctttaaacaccttgaaatcttctctgctttttttttttaatctatctatctatctatttattattattattattattttttgagacagagtcttactctgttgcccaggctggagtgcagcagtgtgatctcagctcgctgcaacctctgcctttcaggtt

SEQ ID NO: 131831 - DNA, 601 bp, Human
gattgcctgagctcaggagttggagaccagcctaggcaacatggtgaaaccccgtctctactaaaaatacaaaaaatttgcaggacatggtggtgcacacctgtaatcccagctacttgttaggctgaggcagaagaatcatttgaacccgggaggtggaggttgcagtgagccaagattatgccactgtactccagcctgggcaacagagcgagactctgtctccaaaaaaagaaaaaaatttcagaacttttttttttctttgagatggagtctcactctgtcgtccaggctggagtgmaggggtgtgatgttggctcactgcaacctccgtctcctgtgttcaagcgattctcctgtctcggcctcccgaatagcagagattacaggcacctgtcaccatgcctggctaatttttgtatcttttagtagagatggggtttcaccattttggtcaggctggtctcaaactcctgacctcaaatgatctgcctgccttggcctcccaaagtactgggattacaggtgtgagctaccgtgcctggcctcagaacatttttatcaccccagaaagaaacttcctattcattagcagccctgg

SEQ ID NO: 131832 - DNA, 601 bp, Human
gtggaggttgcagtgagccaagattatgccactgtactccagcctgggcaacagagcgagactctgtctccaaaaaaagaaaaaaatttcagaacttttttttttctttgagatggagtctcactctgtcgtccaggctggagtgcaggggtgtgatgttggctcactgcaacctccgtctcctgtgttcaagcgattctcctgtctcggcctcccgaatagcagagattacaggcacctgtcaccatgcctggctaatttttgtatcttttagtagagatggggtttcaccattttggtyaggctggtctcaaactcctgacctcaaatgatctgcctgccttggcctcccaaagtactgggattacaggtgtgagctaccgtgcctggcctcagaacatttttatcaccccagaaagaaacttcctattcattagcagccctgggcgattactaagctatttgtatctttgtagatttgtctgttctgggtatttcttaaaaatgaaatgatacaatatttgtttctctgtgattgtcttctttcacgtagcattatgttttcagggtttatgttgtagcatgtgtcagtacttcattc

SEQ ID NO: 131833 - DNA, 601 bp, Human
aatattcagatcctttgcttattttttaattggttatttgtgtttttattttttagaaacagggtctcactctgtcacccaacctggatggagtacagtggtgcagtcatagctcactgcagcctggaaatcctgggctccagcaatcctcctgcctcagtctcctgagtagctaggactataggcgtgtgccaccacacccagctcttgtttttattttttattctgaagttcttttcttttttttaagtttgttttaatgtcgggtacatgtgcaggtttgttacataggtaaacttgsgtcatgcagtttgttgttcagattttttggtgctcaggtgttaagcctggtacctattagttatttttcttgatccttttcctcctcccaccctctgataggccttagtgtgtggtgttcccctccgcgttcaggtattctcatcatttagctcccacttacaagtgagaacatgtggtatttggttttctcttcctattttagtttgctaaggataatagcctccagctccattcatgttcctgcagaggacgtgatctcgttcttttttatggctgcatagtattctgtggtgtatat

SEQ ID NO: 131834 - DNA, 601 bp, Human
aagcttggaaagaactaatttttatgttatcccaagtgatagcataggttggcagtagtagcaggttcaatcaaagttaagctcattgggagcaactcaacttctaagcaataggggattggttaggtcaactatggtatatcagtctgaagaaatactgcttagccatgtataattaagttcatggatttggcattatgtgaaagctgtacactgagtgcatttaggcaaaagcacatccacaaatgataaatatttgaaatgaaaatataagatgttggattccctctcccatgccccrtgacagttgcataaatataaaactatcaggcttagaaaagctatcttaaagtagttaatattattagaacaggtcattcaggcagtctagagatgtttaggtcaactccctgacctgtgaatgtgatgtcatggagggtaaacatggccttttcctgtggctccaaaagatagcaggactggaatggtggtgagaagcatggaagaaagatggtacagtatgtgtttttcaggtcccttttaagttgagtctctaactcctttgggaacttatattggcaatatgacattgagctgggag

SEQ ID NO: 131835 - DNA, 601 bp, Human
tgctagtctttcagaatcaggcagacattttagaaatccccttcccagctcctcttggagaattctcctcatcctttaaatattctgtcctcataggtgcagagcacaggacagagggtcaggaaatagcttacagatcagccagtaacagccaactgagccacccagaatgaggaaggaagggttaaggagaggtttgaaaaagtggacaacaaaagtatgacagacctacttataaagaagtctacagaattattcaattcttttgggaataaatgaaatattgactaagaactctctytggatctttggattacataagggctatgttttaataatacctgttacactgggatttgacttaaacttatagttctgcttgttgtgtctattgcttttggtaggttcagttcagctttctaacattggagtttttctactcttcaggctgagctgtgacccagagtggagaaaacctagcttttgcaatgtgatgggcatatgggtttaggggttgggctgattgtctgtgtgggcagagtctttattacaatggaattctgttaaaaagaaatttgcccaaaccttcctttagaagcat

SEQ ID NO: 131836 - DNA, 601 bp, Human
tgcaaaaagaggccctttttttttttttgttaccttaatgcccaagtaggtatgagtgtgacttctgagagcagacagttaggacctacgcaaagatgacgtctagactgtctcctctttgtattttgcttgattatcactagtaaagtaagtgtaatctttctggatttcaactgcagtggtctctaaacacagactgattggctgtctatataatctcactgtatctctggaggagtggccacatagatgatttcttccctctctacaagtggccctaattggctttttttttttttttgagttggagtctcattctttcattcaggctggagtgcagtggcgtatctcggctcactgcatcctcctcctcccagtttgaagtgattctcctgtctcagcctcccgagtagctgggattacaggcatccgccactatgcccggctaattttttgtagtagagacagggttttgccatcttggccaggctgtcccaaactcctaacctcaagtgatccgcccacctcaacctccaaaagtgctgggattgtaggtgtgagccactgcatccagccacgcatcttccagtatagtaataac

SEQ ID NO: 131837 - DNA, 601 bp, Human; identical to SEQ ID NO: 35195

SEQ ID NO: 131838 - DNA, 601 bp, Human; identical to SEQ ID NO: 35196

SEQ ID NO: 131839 - DNA, 601 bp, Human; identical to SEQ ID NO: 35197

SEQ ID NO: 131840 - DNA, 601 bp, Human; identical to SEQ ID NO: 35198

SEQ ID NO: 131841 - DNA, 601 bp, Human; identical to SEQ ID NO: 35199

SEQ ID NO: 131842 - DNA, 601 bp, Human; identical to SEQ ID NO: 35200

SEQ ID NO: 131843 - DNA, 601 bp, Human; identical to SEQ ID NO: 35201

SEQ ID NO: 131844 - DNA, 601 bp, Human; identical to SEQ ID NO: 35202

SEQ ID NO: 131845 - DNA, 601 bp, Human
ctttgggaggccaaggcgggcggatcacgagatcaggagttcgagaccagcctgaccaacatgcagaaaccccatctctacaaaaaaatgcaaaaattagctgagcacgatggtgcttctgtaatcccagctactcgggaggctgaggcaggagaatcgcttgaacctgggaggaggtggttgctgtaagccgagattgcgccactgcactccagcctgggcaacaagagcgaaactgtctcaaaaaataaaaaataagcagctacagttactaagtagcttagtcaggcactagtggttrttgtgttatgtagaaaaatatatcaattcagtaatggctcacagagctctcttaacagctttccatttttacaactcatcgtaaatgtaaagagggaagaatgtacacagaaagtgcctttaagctctcagaggatgagttccatccgctgaaaagcaccaggggccttgcggatactatttttttttttttttttataaaaaggcaggcctggggcaggcttgcacagcactctacacacggcaaaacagccctgtgctgcacactgagaggaacacgtaagccgcggtggttagatac

SEQ ID NO: 131846 - DNA, 601 bp, Human
tgctcttcaaaggggaactttgatgccatgtgggaatgtggatctgcactgccagagtccaactttacaagagaggctaaaaatctggactcctcaatgaatattttatgtgaaattttaaaaaatatgtgggccaaaaccccatctgcaagccaaatctggcatactgtttgctaccctgaatggaaaatgtggctgaatatacctatctctgtagggcatattctagggagagagcagacaaatcattcagggcactttttcaaacgaccaccctcacggtgagacctacattatctgycctcagccacagggccttgggccctgtggaggataagtttactatacctgaaaaaagggtgacacccaggactcaaaataagactttcctccatatgtcaggaggcggtctcaggtagcttcacaagggcagtcaggtgtcaacagcaagcccaacagatgactgataatgagagctcccacctgaggtcaaggcagtgactaaaagtcccaccaaaaggggcaagctggccagcagaagccagggctctgctgttgaactcaagtaaaacaggccctaggggggcagccatgcactcac

SEQ ID NO: 131847 - DNA, 601 bp, Human
tgtcatttgctttgcctggaatgttcttcccatctcttaactcccaaatagccctctagggagccacccctgcctccactccctcaaggtagggctggggtcctttctcttgaagtcctcttgctggcccctcatagcttgccatcatctaatgtgtgggcaactagacagttctccagaggcagggcccctgtttcacgaatccctcctttcccttcagaggtcaacatacagaaattatccagtcataaatgagctggctgagaagattaagtcaatgtcacaattagggacttaaackatgcaaggaattgaatctcctgggtatcttgggttccccagggtcctaccaaggttggggattgtgaaggaaatagtgatgtaaattagtataccctgactgcctctgccaggacagccagctcccacatgtcctactcaccccaggtcggtgcagtggaagggagtgaccacataggccccactctgagttgaggaggagatgaggccgccctcccgggcctcccggacagggtccaccatggtccggggcatcatatacagctccttggaatggtcaaagcaccccctgaccttcact

SEQ ID NO: 131848 - DNA, 601 bp, Human
gagccccaggtattttcatttttacgtgaatcctccagttccctagttaatcacacaggtgctcctgtacctgtcatttgctttgcctggaatgttcttcccatctcttaactcccaaatagccctctagggagccacccctgcctccactccctcaaggtagggctggggtcctttctcttgaagtcctcttgctggcccctcatagcttgccatcatctaatgtgtgggcaactagacagttctccagaggcagggcccctgtttcacgaatccctcctttcccttcagaggtcaacayacagaaattatccagtcataaatgagctggctgagaagattaagtcaatgtcacaattagggacttaaactatgcaaggaattgaatctcctgggtatcttgggttccccagggtcctaccaaggttggggattgtgaaggaaatagtgatgtaaattagtataccctgactgcctctgccaggacagccagctcccacatgtcctactcaccccaggtcggtgcagtggaagggagtgaccacataggccccactctgagttgaggaggagatgaggccgccctcccgggcctcccgga

SEQ ID NO: 131849 - DNA, 601 bp, Human
cctgctggagatgagtacttgggccccatcccagccctaaaacaggaacccatgggttaacaagagccccaggtattttcatttttacgtgaatcctccagttccctagttaatcacacaggtgctcctgtacctgtcatttgctttgcctggaatgttcttcccatctcttaactcccaaatagccctctagggagccacccctgcctccactccctcaaggtagggctggggtcctttctcttgaagtcctcttgctggcccctcatagcttgccatcatctaatgtgtgggcaactaracagttctccagaggcagggcccctgtttcacgaatccctcctttcccttcagaggtcaacatacagaaattatccagtcataaatgagctggctgagaagattaagtcaatgtcacaattagggacttaaactatgcaaggaattgaatctcctgggtatcttgggttccccagggtcctaccaaggttggggattgtgaaggaaatagtgatgtaaattagtataccctgactgcctctgccaggacagccagctcccacatgtcctactcaccccaggtcggtgcagtggaagggag

SEQ ID NO: 131850 - DNA, 601 bp, Human
tttctcaggcaaggattccttatttcatccagaacatgagggggatggtcttaggcttcttgaactgcagttgtcattaaattatagtcatatagcaggaccgcagtccagcatttgttattaagtgttaagtgacaaggattagaaccttgactccaagcctaaactgaagagtgtttttccagctactcagctgcttaagctggcccacaagtacagaccagagacaaagcaagagaagaagcagagactgttggcccgggccgagaagaaggctgctggcaaaggggacgtcccaacraagagaccacctgtccttcgagcaggtgagtaggccccaccttagggtgaacactgggggcgggctgttgcagtgatgtaaaatttcttggcctgaaattactgtgaagagtaaaaccgagctttttaacactgagtcagcagctgagcccagcagcttcttgtgactagagcaggccctgtgagtgctcacaaagtggttgtgtgttctaggagttaacaccgtcaccaccttggtggagaacaagaaagctcagctggtggtgattgcacacgacgtggatcccatcgaggtgcgttt

SEQ ID NO: 131851 - DNA, 601 bp, Human
aaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgaggtaagaggcagctttacaccaaaatactgtcrttcacaaatctttctcccaaataactggctggcttaacctatgagaagttctatctgacgatcagcttggaacagccaaacagaattaacgcaactaataaccttgaaaatctcagaaaacagtaagccaagctaactgcctctttttgtcttttcagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataatt

SEQ ID NO: 131852 - DNA, 601 bp, Human
tgtttacattttaaatgggagaaatcagtctaagtaaagtaggagctgaatcgttttaatgaaaaaaaaaaaaaatttcaaaaaggatgagaaagacagacggaagacatactaggtaatgagaaaattcacttaagattttggatttgctataaccaatatatcgtccttgaataaaaaggaaaccccgttttacctctggtggttccagagaccctgctgctctcctctcctcctgggcccagacagcactgacacgtccccgctgtcggcttccccacccgattatctacttcccttrtgcagcgtggtcaccaggccatgagaaccctaagcgcaggagccctctgccatcctcctcctccccacaccgcaccatgcccgtagtgaagggactgaaagggtcttttcccactgactgaccattactcctgtctctactaaaaatgcaaaaaaaaaaaaaaaaattagctgggcgtggtggcgggcgcctgtagtgccggctactcgggaggctgaggcaggagaatggcgtgaacccgggagacggagcttgcagtgagccgagatcgcgtcgctgcacgccagcctggacgacaga

SEQ ID NO: 131853 - DNA, 601 bp, Human
caagctgcttcctctttggctgcctcaggcctcctggccccagaggctgctggagatttctcccccaaggacttggccttgtgctcagcagccttctcttctcgcttccggaatttcttttgtgttttcttccttttcttttttgggggccctgcagtttctgagccttgagttttgccagctgaaatgcaaaataagaaagagttaagtcccaatctcatggcccattcaataggcaggaaaggctcaccaaggctttgatcccaggaagatgccgaaagaggatcaggatcgggggccwgagacactgatcctagagctcagaaccacaaccttgacccagtagttctgcttgtgagaattcatcaggcacaaagatgaggcttcaaggacgttcatcaccattatttgagtgaaacattagaaaaacctgaatatccacctccactaacaatttctggccctgctttacaataagctaccatgctgccatcaaacacaatggcaagggctttcattttagctgctgggggttatgtttacattttttcttttttgagatggagtctcaatctgttccccaagctgaagtgcagtggcg

SEQ ID NO: 131854 - DNA, 601 bp, Human
acaggcagagcagtgacggcactccagcaaacctgcccgcctacctggccccgggcctcctggatcttctcatgcagtcgctgtcgcagaacatccagagcaaagacagactcaggctcagtggccaggccatctgcagggaaggagacaggactgcagggggccctctcttcccctccccctccctccctagggccacgaatccctgtcccactgtggccactcatggatctgcagggcaattccagtaaattccactccaccgcttcaacctggactggttcctacaacatcctccagracaggtaactcagtgcctcacgaggtaggtcaccgtggtatgagaaaacacttcctacggtgcaagccaaaccacctcctccaaattttgtagcctgggccccagaacaagttggctctcacaaggcccctgcagagacctgagggcagggaagctcttcaagccaagctgctccaggtcctcagagagacacagccttgccccctgacatcctgctagccatgtggcctggaatgccacacagttccttcggtcccatccaccctagcactcctgtgatctttgctcttggggaagtct

SEQ ID NO: 131855 - DNA, 601 bp, Human
acatggtttcaaatgtcatacatcgttttatagatgaggagggtcaagaccactgcctagaacttggagttggcgtctgaacacctgtcctgaccgctgcccattctgttcacgaggtacccaacgaagccctccccaatggcctttcccatccccgggccaacaagagccctacaccagcccaaacgagacctgtgcttcaggaacaagggcccagagccttgctcacctcttaggaaccacacactgtacctcgggatggcggaggagagtagctggggactgtcccccacacagcacraggccttaaggaagggccccaggaaaagggtgggtaggggccaacacaggggagacagtaccattcagcacaaagagctgcattggtgcttcctgtgcctggccactcagctcaagtccctactcaactcacaggactattacgacattcagagaaacagacacaggaggtgcccatcccagtgtcagttcagcaaaggcagcttcccagaaggaaggaggctgatgagcttggggactgaggttctccaagaaaataactgctctcccagagcacacctgctggggccctgccagactc

SEQ ID NO: 131856 - DNA, 601 bp, Human
tgggtcaagatgtatccagctgtacctttcatgtgcggtttattgtatacatccgttgaaacatattaagacaaaaaagggaaaacaaagaccacaaaggagggacagggaagaacccggaaggcgctggcagcacagggaggaggcaggtgtttgcagtcagacctgagtcccaggccccactcagcccttcctgcctgggaccagagcactgtcccagatctctccaaacctgttttcccgtgggtgaaagaatgacccgggaagtatttaccgttccttcctgagaactcagcgataytgaacacagtgctgcctcacagtaaacactgacaaatggtgagcattactgagggcagggcctcgacctacaccatacccggttttcttcatgaattttccactcctctgcctcccgctcctccagggctgcacctccggggcaggagccctcaccaagtcaggcctcagtatgccttatccgccacctgattccaaatcaaagtaaaacatctctccccagatgtgtacacagcactcctctaaattaaagggctgtgtgctggctctgggtaccccacccggctctccctggcctttg

SEQ ID NO: 131857 - DNA, 601 bp, Human
ccaaacccccatgatttaggagacaagataagggttttagattaagtaaatttactgaggatccagaggaaggtcttcaggactcagaccttagttatagattaacataagtcaattacttacgtcttgagatgaatgcacacttacacatagacatatagcttagaaggtatataagctctggaaaactttgtaattttgagttggtctggagataatttccaggtcttctccttgtaactggttacagaaataaaaagtctctttctccccagttcatctgcatctcgttattgggccrcgagagatagcagccccaccctcagtttggtccaggaacagtttgatctcttcttggccaatctctggtgagacccaccagaatggaggagagccgggactgggtgcactgccagcttccaaaactcctgcacgtggtctcagtcctccagggattatgatgggtgtgaaggagctgagcattctctaaggagccagcacatgacacccagctcaccgcccaccaaccacatcctcaccgtcatctccaaggctctctcatgtcctcttcctgcctttcgggggatcactccctctgact

SEQ ID NO: 131858 - DNA, 601 bp, Human
gaatataacaaaatcccaccaagagttttgcctagacctttcctgggccttcaagcatgacaaaataacgaaggaattcttaacaggacccatttaggattaaacaagttttattggggatctgaagaaattccccaggactccacaaataagtttactgggggtctgaaggaacttcccaaacccccatgatttaggagacaagataagggttttagattaagtaaatttactgaggatccagaggaaggtcttcaggactcagaccttagttatagattaacataagtcaattacttaygtcttgagatgaatgcacacttacacatagacatatagcttagaaggtatataagctctggaaaactttgtaattttgagttggtctggagataatttccaggtcttctccttgtaactggttacagaaataaaaagtctctttctccccagttcatctgcatctcgttattgggccacgagagatagcagccccaccctcagtttggtccaggaacagtttgatctcttcttggccaatctctggtgagacccaccagaatggaggagagccgggactgggtgcactgccagcttccaa

SEQ ID NO: 131859 - DNA, 601 bp, Human
tgaggccaggtgggaatggggaatgactgcggaggagttccagggagttttggtgggctggggatggaaaagttataaaatttatttcacaactctgtaaactaactgaaaataattcatttgaaacaggtgaattttatggcatatcaatgacacggcaataaagctgtttctttcaatggtgccatcaaccccagccccttgaccctaagctgaaggaagagagatgctaggtgtgttcagtagggctccgtcaaagctgattttttgaagttatgggcagcattccgagtaagatgtkttgtggcaggtcaggtctcactaacgcaggcctccctaacaactgtttcagtactgactgagtggttaaattaaatattaaaagccagtgcccttataaaaaggctggaatataacaaaatcccaccaagagttttgcctagacctttcctgggccttcaagcatgacaaaataacgaaggaattcttaacaggacccatttaggattaaacaagttttattggggatctgaagaaattccccaggactccacaaataagtttactgggggtctgaaggaacttcccaaacccccatgat

SEQ ID NO: 131860 - DNA, 601 bp, Human
tgaatctcggaatcattattctaagtgaaggaagtcagatgcaaaagaccatgtaacacaggactccattcataggaactgtccagaaaaggcaagactggagagacagaaagtgattgtctgaggccaggtgggaatggggaatgactgcggaggagttccagggagttttggtgggctggggatggaaaagttataaaatttatttcacaactctgtaaactaactgaaaataattcatttgaaacaggtgaattttatggcatatcaatgacacggcaataaagctgtttctttcaayggtgccatcaaccccagccccttgaccctaagctgaaggaagagagatgctaggtgtgttcagtagggctccgtcaaagctgattttttgaagttatgggcagcattccgagtaagatgtgttgtggcaggtcaggtctcactaacgcaggcctccctaacaactgtttcagtactgactgagtggttaaattaaatattaaaagccagtgcccttataaaaaggctggaatataacaaaatcccaccaagagttttgcctagacctttcctgggccttcaagcatgacaaaataacgaa

SEQ ID NO: 131861 - DNA, 601 bp, Human
tgctgcgtgcagtttaaaatagctaaaaaagcagaaacagccgaaatgtccttcagctgatgaatggataaacaaaatgtggtctatctgtacaatggattattcagtaataaaaaggaattaaatactgatacatactacaacatacatgaatctcggaatcattattctaagtgaaggaagtcagatgcaaaagaccatgtaacacaggactccattcataggaactgtccagaaaaggcaagactggagagacagaaagtgattgtctgaggccaggtgggaatggggaatgactgcrgaggagttccagggagttttggtgggctggggatggaaaagttataaaatttatttcacaactctgtaaactaactgaaaataattcatttgaaacaggtgaattttatggcatatcaatgacacggcaataaagctgtttctttcaatggtgccatcaaccccagccccttgaccctaagctgaaggaagagagatgctaggtgtgttcagtagggctccgtcaaagctgattttttgaagttatgggcagcattccgagtaagatgtgttgtggcaggtcaggtctcactaacgcagg

SEQ ID NO: 131862 - DNA, 601 bp, Human
ccacaagaatggtatgtattgctgcagacgtacagacagtggaaccctcagccaggcgcagcggctcacacctataatcccaggacttggggaggccgaggtgggcagatcacttgagcccaggagtttgagaacagcctgggcaacatggcaaaaccccatctctaccaaaaatacaaaaattagctggatgtggtggtactcacctgtagtcccagctactcaggaggctgaggtgggaggaccaattgagcccaagagattgaggctgcagtgagccaagatcatgccactgcactcyagcctgggtgacagagcaaaaccttgtctcaagaaaagaaaaaggaaaagaaaattagaaccgttatacactgctgatgggaatgtaaaatggggcagtcactttggaaaacagtttgctagtttcttaaaatgttaaatcagactttctgtatgacccagcaattcctctgctgggtatcaacccaagagaaatgaaaacatgttcacacaaagtcttgtacacaaatgttcatagcagtgctgcgtgcagtttaaaatagctaaaaaagcagaaacagccgaaatgtccttcagctga

SEQ ID NO: 131863 - DNA, 601 bp, Human
ataaatacatagaaattaaacaacataattctaaataagcaatgggtcaaagaagaaaatcaaaagatacactgagctgaatgaaaatgtaaacacaacataccaaaatttatgagatataactaaagctgtgtttcaagggaaatttatagctgtaaatgtctacattagaaaaaaaatcttaaatcaagtgtgtaagcttccattgtaagtaactacaataagaaaagacagaacaaattaaacccaaagtgagaagaagggaaattaataaaggaaaccaatgaactagagaacagaragaaaaagataaagtaaaaaaatatcaaatggcagttctctgaaaagatcaagagaattgacaaagctttagctacattgaccagagagagagagaacacaaataactaaaatcaggactaaaagaggagacagcaattccaatcttacagagattaaaaggatttcaaggaaatactatgaacaactgtttgccaacaaattatgcaacttaggtaaaatggacagattcttacacataaactagaaagcggttagaagaaaatataagattaaatctttgtgacactggattaagatt

SEQ ID NO: 131864 - DNA, 601 bp, Human
gaatgaaatcagaaattaacaaaagaaatttgggaaacctataaatacatagaaattaaacaacataattctaaataagcaatgggtcaaagaagaaaatcaaaagatacactgagctgaatgaaaatgtaaacacaacataccaaaatttatgagatataactaaagctgtgtttcaagggaaatttatagctgtaaatgtctacattagaaaaaaaatcttaaatcaagtgtgtaagcttccattgtaagtaactacaataagaaaagacagaacaaattaaacccaaagtgagaagaagggaaattaataaaggaaaccaatgaactagagaacagagagaaaaagataaagtaaaaaaatatcaaatggcagttctctgaaaagatcaagagaattgacaaagctttagctacattgaccagagagagagagaacacaaataactaaaatcaggactaaaagaggagacagcaattccaatcttacagagattaaaaggatttcaaggaaatactatgaacaactgtttgccaacaaattatgcaacttaggtaaaatggacagattcttacacataaactagaaagcggttagaag

SEQ ID NO: 131865 - DNA, 601 bp, Human
gagtttcttctctagccacaggggaatgaaatcagaaattaacaaaagaaatttgggaaacctataaatacatagaaattaaacaacataattctaaataagcaatgggtcaaagaagaaaatcaaaagatacactgagctgaatgaaaatgtaaacacaacataccaaaatttatgagatataactaaagctgtgtttcaagggaaatttatagctgtaaatgtctacattagaaaaaaaatcttaaatcaagtgtgtaagcttccattgtaagtaactacaataagaaaagacagaacraattaaacccaaagtgagaagaagggaaattaataaaggaaaccaatgaactagagaacagagagaaaaagataaagtaaaaaaatatcaaatggcagttctctgaaaagatcaagagaattgacaaagctttagctacattgaccagagagagagagaacacaaataactaaaatcaggactaaaagaggagacagcaattccaatcttacagagattaaaaggatttcaaggaaatactatgaacaactgtttgccaacaaattatgcaacttaggtaaaatggacagattcttacac

SEQ ID NO: 131866 - DNA, 601 bp, Human
acttgagcccaggagttcgtgaccagcctaagtaacatggcaaaaccctgtctataaaaaatgcaaaaatcagctaggcatgatggtacttgcctgtagttgcagctactcaggaggctgaggtgacctaagccttgggaggtgggggctgcagtgagctgtgatcataccactgcactccagcctgggtgacaaagtgagactccacctcaaaaaaaaaaacaaacaaacaaaaaaaaaaaaacaaaaaaacaataattggacaccaaaatcctaccccactctcagtaatggatagaawaattagaaagaaaatcagtagatacaaatgacttgacatcactggacaccaactgacatctctagaacactccacctggcaagagccgaagtcacgttctcctcaagtgcacatggaacagtgtccaaggtcaatcatatgctggaccataaaacaattctgagaaattcgaaaggactgatatccacagagtttcttctctagccacaggggaatgaaatcagaaattaacaaaagaaatttgggaaacctataaatacatagaaattaaacaacataattctaaataagcaatgggtc

SEQ ID NO: 131867 - DNA, 601 bp, Human
tgactctttgtttggggcccagtcctttggatgttaatctgattgggtcggtgcgcctaaataattaaataattcctcctcaaccccatcggtctctctgattccttaattatcccgcagcaatacatgaagcaaaaactcacagaattgaagggtgaaacagtcaattcaccagtaatggttgggccaggcatggtgactcacgcttgtaatcccagcactttgggaggccgaggtgggtgggtcacttgagcccaggagttcgtgaccagcctaagtaacatggcaaaaccctgtctayaaaaaatgcaaaaatcagctaggcatgatggtacttgcctgtagttgcagctactcaggaggctgaggtgacctaagccttgggaggtgggggctgcagtgagctgtgatcataccactgcactccagcctgggtgacaaagtgagactccacctcaaaaaaaaaaacaaacaaacaaaaaaaaaaaaacaaaaaaacaataattggacaccaaaatcctaccccactctcagtaatggatagaataattagaaagaaaatcagtagatacaaatgacttgacatcactggacaccaact

SEQ ID NO: 131868 - DNA, 601 bp, Human
gaaaagtaagaaataatgtaatgcatgtcttaactgaataactgtctttgtttcttgcttctgtaatactcttccccctgcacaaatctccccccaccccacaaaatgcttaaaaggtagcttgactctttgtttggggcccagtcctttggatgttaatctgattgggtcggtgcgcctaaataattaaataattcctcctcaaccccatcggtctctctgattccttaattatcccgcagcaatacatgaagcaaaaactcacagaattgaagggtgaaacagtcaattcaccagtaayggttgggccaggcatggtgactcacgcttgtaatcccagcactttgggaggccgaggtgggtgggtcacttgagcccaggagttcgtgaccagcctaagtaacatggcaaaaccctgtctataaaaaatgcaaaaatcagctaggcatgatggtacttgcctgtagttgcagctactcaggaggctgaggtgacctaagccttgggaggtgggggctgcagtgagctgtgatcataccactgcactccagcctgggtgacaaagtgagactccacctcaaaaaaaaaaacaaacaaacaa

SEQ ID NO: 131869 - DNA, 601 bp, Human
aagggctggagtcctttaaaaattaactggctgtttttctgtggctagtgagccttatctctccctttcccaggcattgcgaagactctgtttctctagctgtgcagctgcaaggtcactaaacagataatcttgagtcataaaacgtgttgttccttgaaaagtaagaaataatgtaatgcatgtcttaactgaataactgtctttgtttcttgcttctgtaatactcttccccctgcacaaatctccccccaccccacaaaatgcttaaaaggtagcttgactctttgtttggggcccrgtcctttggatgttaatctgattgggtcggtgcgcctaaataattaaataattcctcctcaaccccatcggtctctctgattccttaattatcccgcagcaatacatgaagcaaaaactcacagaattgaagggtgaaacagtcaattcaccagtaatggttgggccaggcatggtgactcacgcttgtaatcccagcactttgggaggccgaggtgggtgggtcacttgagcccaggagttcgtgaccagcctaagtaacatggcaaaaccctgtctataaaaaatgcaaaaatcagct

SEQ ID NO: 131870 - DNA, 601 bp, Human
tactagaacaggaattaaaagaaattaaaaactgtgtaagcaaaaactcagttgtatgtaaaaaaccaattccccttgaggaagagaaagggctggagtcctttaaaaattaactggctgtttttctgtggctagtgagccttatctctccctttcccaggcattgcgaagactctgtttctctagctgtgcagctgcaaggtcactaaacagataatcttgagtcataaaacgtgttgttccttgaaaagtaagaaataatgtaatgcatgtcttaactgaataactgtctttgtttctygcttctgtaatactcttccccctgcacaaatctccccccaccccacaaaatgcttaaaaggtagcttgactctttgtttggggcccagtcctttggatgttaatctgattgggtcggtgcgcctaaataattaaataattcctcctcaaccccatcggtctctctgattccttaattatcccgcagcaatacatgaagcaaaaactcacagaattgaagggtgaaacagtcaattcaccagtaatggttgggccaggcatggtgactcacgcttgtaatcccagcactttgggaggccga

SEQ ID NO: 131871 - DNA, 601 bp, Human
gtattttcagtagagacggggtttcaccatgttcgccaggctagtcttgaactcctgacctcaggtgatccacctgccttggcctcccaaagtgctgggattacaggcatgagccaccccatctggccaacttttttaagatcaaaaatcttactaaagagaaacattctgccatgatataaagtgaatacatcacgaaaatataacaaacagaaatatatacatacctgacaacctagccccaaaatactagaacaggaattaaaagaaattaaaaactgtgtaagcaaaaactcagttrtatgtaaaaaaccaattccccttgaggaagagaaagggctggagtcctttaaaaattaactggctgtttttctgtggctagtgagccttatctctccctttcccaggcattgcgaagactctgtttctctagctgtgcagctgcaaggtcactaaacagataatcttgagtcataaaacgtgttgttccttgaaaagtaagaaataatgtaatgcatgtcttaactgaataactgtctttgtttcttgcttctgtaatactcttccccctgcacaaatctccccccaccccacaaaatgc

SEQ ID NO: 131872 - DNA, 601 bp, Human
ggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagctgggattacaggcacacaccatcatggctggctaatttttttgtattttcagtagagacggggtttcaccatgttcgccaggctagtcttgaactcctgacctcaggtgatccacctgccttggcctcccaaagtgctgggatyacaggcatgagccaccccatctggccaacttttttaagatcaaaaatcttactaaagagaaacattctgccatgatataaagtgaatacatcacgaaaatataacaaacagaaatatatacatacctgacaacctagccccaaaatactagaacaggaattaaaagaaattaaaaactgtgtaagcaaaaactcagttgtatgtaaaaaaccaattccccttgaggaagagaaagggctggagtcctttaaaaattaactggctgtttttctgtggctagtgagccttatctctcccttt

SEQ ID NO: 131873 - DNA, 601 bp, Human
ttaagctttgactatatgctgcctgtgagagacatacatactttagaaactaagatacaaataggtcaaagcaaaaggatagtagatttgctatgcaaacaaccgtaagggagcttgaggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagctgggattacaggcacacaccatcatrgctggctaatttttttgtattttcagtagagacggggtttcaccatgttcgccaggctagtcttgaactcctgacctcaggtgatccacctgccttggcctcccaaagtgctgggattacaggcatgagccaccccatctggccaacttttttaagatcaaaaatcttactaaagagaaacattctgccatgatataaagtgaatacatcacgaaaatataacaaacagaaatatatacatacctgacaacctagccccaaaatactagaacaggaattaaaagaaattaaaaactgtgt

SEQ ID NO: 131874 - DNA, 601 bp, Human
tttaagctttgactatatgctgcctgtgagagacatacatactttagaaactaagatacaaataggtcaaagcaaaaggatagtagatttgctatgcaaacaaccgtaagggagcttgaggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagctgggattacaggcacacaccatcayggctggctaatttttttgtattttcagtagagacggggtttcaccatgttcgccaggctagtcttgaactcctgacctcaggtgatccacctgccttggcctcccaaagtgctgggattacaggcatgagccaccccatctggccaacttttttaagatcaaaaatcttactaaagagaaacattctgccatgatataaagtgaatacatcacgaaaatataacaaacagaaatatatacatacctgacaacctagccccaaaatactagaacaggaattaaaagaaattaaaaactgtg

SEQ ID NO: 131875 - DNA, 601 bp, Human
tggattttttttttaagctttgactatatgctgcctgtgagagacatacatactttagaaactaagatacaaataggtcaaagcaaaaggatagtagatttgctatgcaaacaaccgtaagggagcttgaggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagctgggattacaggcrcacaccatcatggctggctaatttttttgtattttcagtagagacggggtttcaccatgttcgccaggctagtcttgaactcctgacctcaggtgatccacctgccttggcctcccaaagtgctgggattacaggcatgagccaccccatctggccaacttttttaagatcaaaaatcttactaaagagaaacattctgccatgatataaagtgaatacatcacgaaaatataacaaacagaaatatatacatacctgacaacctagccccaaaatactagaacaggaattaaaagaaat

SEQ ID NO: 131876 - DNA, 601 bp, Human
gagatcgttagactggattttttttttaagctttgactatatgctgcctgtgagagacatacatactttagaaactaagatacaaataggtcaaagcaaaaggatagtagatttgctatgcaaacaaccgtaagggagcttgaggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagcwgggattacaggcacacaccatcatggctggctaatttttttgtattttcagtagagacggggtttcaccatgttcgccaggctagtcttgaactcctgacctcaggtgatccacctgccttggcctcccaaagtgctgggattacaggcatgagccaccccatctggccaacttttttaagatcaaaaatcttactaaagagaaacattctgccatgatataaagtgaatacatcacgaaaatataacaaacagaaatatatacatacctgacaacctagccccaaaatactagaacagg

SEQ ID NO: 131877 - DNA, 601 bp, Human
gaatttaaatgctacactagaaaatacttaatacaaaagaaggtagtaaaagatgaacagaagaacaaaaaggcataaaacatagaaaacaaattgtgaactgatagatggaaatccaaccacagcaataataacattgaatgggaatagaatgaacatgccaatcaaaaggcagagatcgttagactggattttttttttaagctttgactatatgctgcctgtgagagacatacatactttagaaactaagatacaaataggtcaaagcaaaaggatagtagatttgctatgcaaacarccgtaagggagcttgaggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagctgggattacaggcacacaccatcatggctggctaatttttttgtattttcagtagagacggggtttcaccatgttcgccaggctagtcttgaactcctgacctcaggtgatccacctgccttggcct

SEQ ID NO: 131878 - DNA, 601 bp, Human
gagcaaacactaacaaaataactttaaaatatacacttaaaaagaaaaagggaatttaaatgctacactagaaaatacttaatacaaaagaaggtagtaaaagatgaacagaagaacaaaaaggcataaaacatagaaaacaaattgtgaactgatagatggaaatccaaccacagcaataataacattgaatgggaatagaatgaacatgccaatcaaaaggcagagatcgttagactggattttttttttaagctttgactatatgctgcctgtgagagacatacatactttagaaacwaagatacaaataggtcaaagcaaaaggatagtagatttgctatgcaaacaaccgtaagggagcttgaggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagctgggattacaggcacacaccatcatggctggctaatttttttgtattttcagtagagacggggtttcaccatgttc

SEQ ID NO: 131879 - DNA, 601 bp, Human
tttttttttgtatttttgtaaagatggagtcttgccatgtgggccaggctgctctcaaactcctggcctcaagtgatctacctatcttggcctcccaaagtgctgggattgcaggtgtgagccaccacacccagcctgatttattcattgactttgtatcttgagaccttgctaagctgacttagctgatgggctcacagcataaacatatataatatatatgacaataatagcataaaggagcaaggaggcaatgaagttattatatatactggagcaaggaaaggtcaccagacaatarcttgaatatacaggaagaaatcaagagtaaagtcagtgataaatatacagtgtaatataaaagacttgaaaagtgtttttctccttacttgtcttactgaattgaaaagaaataagattgtgtgaaacaataattataacaccatgttgttgagtttataacatatatagatgaacatatacgacaataatactacaaaccacaagcaaggagggaggaaatggagttatactggagtcaagttcctgtattttactaaaattagtattaatctgaagtagatcctgataaattaaaatg

SEQ ID NO: 131880 - DNA, 601 bp, Human
caagcaattctcatgcctcagcctcccaagtaggtgggattacaggcgcaccaccacactcaactttttttttttttttgtatttttgtaaagatggagtcttgccatgtgggccaggctgctctcaaactcctggcctcaagtgatctacctatcttggcctcccaaagtgctgggattgcaggtgtgagccaccacacccagcctgatttattcattgactttgtatcttgagaccttgctaagctgacttagctgatgggctcacagcataaacatatataatatatatgacaataayagcataaaggagcaaggaggcaatgaagttattatatatactggagcaaggaaaggtcaccagacaataacttgaatatacaggaagaaatcaagagtaaagtcagtgataaatatacagtgtaatataaaagacttgaaaagtgtttttctccttacttgtcttactgaattgaaaagaaataagattgtgtgaaacaataattataacaccatgttgttgagtttataacatatatagatgaacatatacgacaataatactacaaaccacaagcaaggagggaggaaatggagttat

SEQ ID NO: 131881 - DNA, 601 bp, Human
tggttcaattgattgtggcaagtattatagaaaaataattgatttattcttgtttttcttttttcttttttttttttttttagactgtgtcttgccctgttgcccagtctggagtgcagtggtgtgatctccagtcactgcaacctctccctcctgggttcaagcaattctcatgcctcagcctcccaagtaggtgggattacaggcgcaccaccacactcaactttttttttttttttgtatttttgtaaagatggagtcttgccatgtgggccaggctgctctcaaactcctggcctcragtgatctacctatcttggcctcccaaagtgctgggattgcaggtgtgagccaccacacccagcctgatttattcattgactttgtatcttgagaccttgctaagctgacttagctgatgggctcacagcataaacatatataatatatatgacaataatagcataaaggagcaaggaggcaatgaagttattatatatactggagcaaggaaaggtcaccagacaataacttgaatatacaggaagaaatcaagagtaaagtcagtgataaatatacagtgtaatataaaagacttgaa

SEQ ID NO: 131882 - DNA, 601 bp, Human
aattgtatagacatttctcctaatttggtaaattattctctaaatatttcatgttttatgatgctactgtaaatggtatttaaaatttttcatggttcaattgattgtggcaagtattatagaaaaataattgatttattcttgtttttcttttttcttttttttttttttttagactgtgtcttgccctgttgcccagtctggagtgcagtggtgtgatctccagtcactgcaacctctccctcctgggttcaagcaattctcatgcctcagcctcccaagtaggtgggattacaggcgyaccaccacactcaactttttttttttttttgtatttttgtaaagatggagtcttgccatgtgggccaggctgctctcaaactcctggcctcaagtgatctacctatcttggcctcccaaagtgctgggattgcaggtgtgagccaccacacccagcctgatttattcattgactttgtatcttgagaccttgctaagctgacttagctgatgggctcacagcataaacatatataatatatatgacaataatagcataaaggagcaaggaggcaatgaagttattatatatactggagca

SEQ ID NO: 131883 - DNA, 601 bp, Human
taattgtatagacatttctcctaatttggtaaattattctctaaatatttcatgttttatgatgctactgtaaatggtatttaaaatttttcatggttcaattgattgtggcaagtattatagaaaaataattgatttattcttgtttttcttttttcttttttttttttttttagactgtgtcttgccctgttgcccagtctggagtgcagtggtgtgatctccagtcactgcaacctctccctcctgggttcaagcaattctcatgcctcagcctcccaagtaggtgggattacaggcrcaccaccacactcaactttttttttttttttgtatttttgtaaagatggagtcttgccatgtgggccaggctgctctcaaactcctggcctcaagtgatctacctatcttggcctcccaaagtgctgggattgcaggtgtgagccaccacacccagcctgatttattcattgactttgtatcttgagaccttgctaagctgacttagctgatgggctcacagcataaacatatataatatatatgacaataatagcataaaggagcaaggaggcaatgaagttattatatatactggagc

SEQ ID NO: 131884 - DNA, 601 bp, Human
tctcactatgtcacccaggctggtctcaaacttctgggctcaagtgatctggccaccttgacctcccaaagtgctgggattacaggcatgagccatggtgcctggtttatattgcagttttaattgtatagacatttctcctaatttggtaaattattctctaaatatttcatgttttatgatgctactgtaaatggtatttaaaatttttcatggttcaattgattgtggcaagtattatagaaaaataattgatttattcttgtttttcttttttcttttttttttttttttagactgwgtcttgccctgttgcccagtctggagtgcagtggtgtgatctccagtcactgcaacctctccctcctgggttcaagcaattctcatgcctcagcctcccaagtaggtgggattacaggcgcaccaccacactcaactttttttttttttttgtatttttgtaaagatggagtcttgccatgtgggccaggctgctctcaaactcctggcctcaagtgatctacctatcttggcctcccaaagtgctgggattgcaggtgtgagccaccacacccagcctgatttattcattgactttgta

SEQ ID NO: 131885 - DNA, 601 bp, Human
tccatctggggagaagtgacagtttagcaatgtaagtcttccaatccatgagcatggtatatttctccatttatttatgtcttctttaatttttgtcatcaatattttgcagttttctgtttttttgtgaccttctttttctttttttttttttttttgtcagggtcttgctgtgtagcccaggctggaatgcactgcaatctctgcctactgggctcaagtcatcctctcacctcagcctcctgagtagcaggggctacaggtgcatgccaccatgcccagctaatttttttttttttttgtagagacagggtctcactatgtcacccaggctggtctcaaacttctgggctcaagtgatctggccaccttgacctcccaaagtgctgggattacaggcatgagccatggtgcctggtttatattgcagttttaattgtatagacatttctcctaatttggtaaattattctctaaatatttcatgttttatgatgctactgtaaatggtatttaaaatttttcatggttcaattgattgtggcaagtattatagaaaaataattgatttattcttgtttttcttttttctttttttttt

SEQ ID NO: 131886 - DNA, 601 bp, Human
cttcagaattccataatttttgtgtattgtgtgaaaggctaaagtccctttcttccctcaatggatatccagtcatttcagccatttgaattgaaaatactttcctttctctatcacattaccttagcacccttatcaaaaagcaactcttaaaaaatcaatggactatttctgtgtaggtctatttctaaactctgcattctattccattgaactatctgtctatcctaatatcaacctattctgattactatgtaaaattttagaatcagctgtcaactttacaaaaatttcttctggrgttttaagtgagattatgtggactctgtagatccatctggggagaagtgacagtttagcaatgtaagtcttccaatccatgagcatggtatatttctccatttatttatgtcttctttaatttttgtcatcaatattttgcagttttctgtttttttgtgaccttctttttctttttttttttttttttgtcagggtcttgctgtgtagcccaggctggaatgcactgcaatctctgcctactgggctcaagtcatcctctcacctcagcctcctgagtagcaggggctacaggtgcatg

SEQ ID NO: 131887 - DNA, 601 bp, Human
atttttgcctaccccaagttcatgaacattttctcttattttcttcagaattccataatttttgtgtattgtgtgaaaggctaaagtccctttcttccctcaatggatatccagtcatttcagccatttgaattgaaaatactttcctttctctatcacattaccttagcacccttatcaaaaagcaactcttaaaaaatcaatggactatttctgtgtaggtctatttctaaactctgcattctattccattgaactatctgtctatcctaatatcaacctattctgattactatgtaamattttagaatcagctgtcaactttacaaaaatttcttctggagttttaagtgagattatgtggactctgtagatccatctggggagaagtgacagtttagcaatgtaagtcttccaatccatgagcatggtatatttctccatttatttatgtcttctttaatttttgtcatcaatattttgcagttttctgtttttttgtgaccttctttttctttttttttttttttttgtcagggtcttgctgtgtagcccaggctggaatgcactgcaatctctgcctactgggctcaagtcatcc

SEQ ID NO: 131888 - DNA, 601 bp, Human
aaatgtgcccactttaggtatacggttttgatgagtttcacacaatgtatgtacacatgtaatcaccccagtaaggtccctcctgaccctgacaaccatggatctgattccctggcgtttcccatacacggaatcctctgatacatgctcttttatgtctggccgcatcacaccgcatgctgttttgaagattcacctatattgtcacgtgtatcaatcgttcgttctttttcatttctgagaagcacgccattgttaatccgccacaattcatttattctgtctcctattgacagacacygtggttttttcactgttcggggccactagcaacaaagcttctgtaaacactcatgtgcaggtatttgtggacctgtgttttcatttcccttgagtaaataccaaggaatggaaaagatgggtcatatggtaagtgtatgtttaactttgtaagaaactgccaaactgtgttccaaagtggtgactgaattttccattcccgccaggaatgtacgagaaccacagtccttgccaacacttgatggtcactcttttatcctttagccatgctagtggatgaggagtggtatctaagtgtgtc

SEQ ID NO: 131889 - DNA, 601 bp, Human
ccatttttgtagttggtagatcgtttggctgtagggaaatcttggtggaaataattttccttcaatgtggcaaaaatggttccattttttaaaactttgaaaattaatttaatttgagggataacttacatccaataaaatgtgcccactttaggtatacggttttgatgagtttcacacaatgtatgtacacatgtaatcaccccagtaaggtccctcctgaccctgacaaccatggatctgattccctggcgtttcccatacacggaatcctctgatacatgctcttttatgtctggcygcatcacaccgcatgctgttttgaagattcacctatattgtcacgtgtatcaatcgttcgttctttttcatttctgagaagcacgccattgttaatccgccacaattcatttattctgtctcctattgacagacactgtggttttttcactgttcggggccactagcaacaaagcttctgtaaacactcatgtgcaggtatttgtggacctgtgttttcatttcccttgagtaaataccaaggaatggaaaagatgggtcatatggtaagtgtatgtttaactttgtaagaaactgccaa

SEQ ID NO: 131890 - DNA, 601 bp, Human
tgtagggtttggtactatctgtggtttcagacatccactggggatctcggaacctatcccccgcaggtaagaggggactatcgttttcacaagggcaagcctgaaaggcgtctatctcctggcccagttcctattccttcccccgaaatcagtccctttcaactaattcatctgttacttcttatcttataatgcttgtgtgtgtttacctccacctttctaagtcctgtgaccacggagcgatttatctcgaatagcttcttgaaaccgaaacgtgggaggcaaaacatttgaactttayatgtcctaaattattttttccatttttgtagttggtagatcgtttggctgtagggaaatcttggtggaaataattttccttcaatgtggcaaaaatggttccattttttaaaactttgaaaattaatttaatttgagggataacttacatccaataaaatgtgcccactttaggtatacggttttgatgagtttcacacaatgtatgtacacatgtaatcaccccagtaaggtccctcctgaccctgacaaccatggatctgattccctggcgtttcccatacacggaatcctctgatac

SEQ ID NO: 131891 - DNA, 601 bp, Human
tgggtaacagagcaagaccctgtctcttaataataaacaaaactacaacaacaaaaaacccacaaactaagatatatacacatttttttttagagagaccacattcacgtaacctttattacagtatattgtttttgttgttgttgttgttttgttgttgtttttgagatggagttttgctcgttgcccaggctggagtgcaaaggggcaccttcggctcactacagcctccgcctcccgggttcaagcaattctcctgcctcagcctcccgagtagctgggtttacaggcgcccaccacyacgcctggctaattttttgtatttttagtagagacaggtttcaccatgttggccaggctggtctcgatctcctgacttcaagtgatccacccgcctcggacagtatattgttataattgttctattttactattaattatggttgttaatcccacccggtgcctaatttataaattaaaccctatcataggtatgtgtgtacaggagaaaacatactctctgtagggtttggtactatctgtggtttcagacatccactggggatctcggaacctatcccccgcaggtaagaggggacta

SEQ ID NO: 131892 - DNA, 601 bp, Human
ggcattttggttttcctggaaaacaggagtagaaaaatcacatcactcaccctccttctctcacctgccccactttacctgtcccgccttgtaattcaggcatcacaccctgcgacgggccttcatctgccaagatggtccctctgccccacaggtgatgctctgagccccacctgagcatctccaaacccagtccagatctggccctcctcccactcagagaagagggaggcggtctgctcctcccagctcatcagcccgactgctcctgcagactctgagagccaccccggcttcccaktgacctccttccactcagcacccccttcccctgggagaccggaatgaaccacactgaaatgagcacgtcgaggtcactgtcgaacccaccgagggaggccaggacagcctcatggccaggctgagccaggagcccagaccagttcctgccagggagaggagccaccaacttcccctagtatctccctgctgtctcagaggctcatgttctggaaacaatcattgtctttaaggtgattttatgtatattaaagtcacgtacagtagttcccttatccacaccttcgcttgctggagtttc

SEQ ID NO: 131893 - DNA, 601 bp, Human
gaccccagccactgtctgcccatgactgctgaggccccaaagtgaaccacccagctgagcccagtccaccccaggaagcccagggagagatagtaatcaatgattgtgattgttttccatggatggagtggtgtgttctgcagccatggatcactgacacgagtgggaattagcagacacagcaggggagagacaagagtggtcccaacagaggccatagcacaggcaaaggcctggagtcaggacagtatggcaggtggacgagtgacaggccacgttggctggagcacagagggcgagrgcagaggagggagagatgaggctggggaggtcaggaaggcaggatcagatcatggagagcctcctaccttatgttctggaaagatcactccagctgctgtgagaagaagggggacagggctgatggggatggggagacaagtctgaggctgtcacagagatgagggcagccccaccggagccctggagcaggacgtcgaaggcagggaggccagtgggcacgcgagctgctgaagagcagggctggcaggatttgggaacccagtgtaggggtgagagcaaagggagagttgaggatggc

SEQ ID NO: 131894 - DNA, 601 bp, Human
aggttccctaacagccatgctgcagaatgagaacacaggagatgaagtttagtctaggagcaggatttagggcacaagtgcatggaagccacccgagggtcccagtggaaggggcacagcgtcagcctggagtgtggagcagaggccaccagaaacagtcacagaacaaccatcactgtggcgatgggcctgacgtgggcccgtgtgccagaccctgtaacggccagcgttgcagtctgaggtctacgttcggggagcctcacagcccacacattcaccagacacgtcgaagccaaggccrggcagagtggagtttcagaacatgtctacaaaccatgaggccccctcccatcaagagatggggtctgatattctgtgtttctaagaaataaatgcagcagaagtgatgctgggtgacttctgaagccaggcccaaaaaggtgatctggcttctgtctcatctttcttgggatgttggtcttggagcctcccaaccaagctaagcaggagcccaggccccagggagaggccctgggtaggtgtctcagatgacagccagcatcaactgccagagatgcagggaagtctttgcagtgacccc

SEQ ID NO: 131895 - DNA, 601 bp, Human
aaaaattagccaggtgtggtggtgggcgcctgtaatcccagctactcaggaggctgaggcaggagaatcacttgagcccaggaggcagaggttgcagtgggcagagatggtgccaatgcactccagcctgggcgacagagcgagactccatcacacacacacacacacaaaagccggcgacacgcatttggtcaaaactgaagctccagctccatcgtgctctctgagtggctgcaggacgagggccaagtcagggtagagactggggaaggagcggccccctccctcggagccacaggakgaaagaggacctgccccagctcccacatggcacacatgtgccagggctgcaggacaattctgtgacatgggagccactgaagggaggcactgacattataccttggcaacgagacgcgctgcagatggtcaggttccctaacagccatgctgcagaatgagaacacaggagatgaagtttagtctaggagcaggatttagggcacaagtgcatggaagccacccgagggtcccagtggaaggggcacagcgtcagcctggagtgtggagcagaggccaccagaaacagtcacagaacaac

SEQ ID NO: 131896 - DNA, 601 bp, Human
gcctctggagaaggagctgggttttaccgacctggcgagcccacgagcccacgagcccacatgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacctcactgacttacttcttgatggcaaacacagttaacccaatggtggtgttctggagcctgaactgctcgttgaggatgtcgatgttgaaygtgccctcccagacaatgggagccagccaaggggtcaccacgaggacatccttcctactgcacatggagagaggcgtgcggtcacatggagctggcagggtgccacccacatgcgcctctggcacacggccgcccccacctggaaactccactcagcttctgcctcctctgaccacccttccagaggcagccgcccttccccgggaaaccaaccagaggcaaatgcgactccaaccgggcaaatcattcccagccctccctcaacattggacctgcgggaacacacagcaagctgagctt

SEQ ID NO: 131897 - DNA, 601 bp, Human
ctggtcagtgagcaggaaacatctggagccttgtattgagggggtggctcagcatgacggccggccacagttacagagaggagggggcagcagaagccaccatccctgggtgagacgcagcctctggagaaggagctgggttttaccgacctggcgagcccacgagcccacgagcccacatgagctcagtaagatgctgcatgaatgacctttcccatctaccctctgggaggacaaggctggccgccaccccactctgtcttgaacacaaggagagacctcaatgtccacagtcactcgmcactgcctgggtctctaccctcggccacctcactgacttacttcttgatggcaaacacagttaacccaatggtggtgttctggagcctgaactgctcgttgaggatgtcgatgttgaatgtgccctcccagacaatgggagccagccaaggggtcaccacgaggacatccttcctactgcacatggagagaggcgtgcggtcacatggagctggcagggtgccacccacatgcgcctctggcacacggccgcccccacctggaaactccactcagcttctgcctcctctgaccacccttc

SEQ ID NO: 131898 - DNA, 601 bp, Human
tgtctggggccaactgctttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccggccacagttacagagaggagggggcagcagaagccaccatccctgggtgagacgcagcctctggagaaggagctgggttttaccgacctggcgagcccacgagcccacgagcccacrtgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacctcactgacttacttcttgatggcaaacacagttaacccaatggtggtgttctggagcctgaactgctcgttgaggatgtcgatgttgaatgtgccctcccagacaatgggagccagccaaggggtcaccacgaggacatccttcctactg

SEQ ID NO: 131899 - DNA, 601 bp, Human
cagccacttcctttggtgtctggggccaactgctttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccggccacagttacagagaggagggggcagcagaagccaccatccctgggtgagacgcagcctctggagaaggagctgggttttaccgacctggcgagcccacragcccacgagcccacatgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacctcactgacttacttcttgatggcaaacacagttaacccaatggtggtgttctggagcctgaactgctcgttgaggatgtcgatgttgaatgtgccctcccagacaatgggagccagccaaggggtcaccacgag

SEQ ID NO: 131900 - DNA, 601 bp, Human
tgcccacagctgccgagaagtcaagtatgtgtctgcggttgcctggctagctccctctctggcctggcccagagtcccagggccttgtgggtcagccacttcctttggtgtctggggccaactgctttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccggccacagtyacagagaggagggggcagcagaagccaccatccctgggtgagacgcagcctctggagaaggagctgggttttaccgacctggcgagcccacgagcccacgagcccacatgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacctcactgacttacttcttgatggcaaacacagttaacccaatg

SEQ ID NO: 131901 - DNA, 601 bp, Human
tggcccagctgcccacagctgccgagaagtcaagtatgtgtctgcggttgcctggctagctccctctctggcctggcccagagtcccagggccttgtgggtcagccacttcctttggtgtctggggccaactgctttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccrgccacagttacagagaggagggggcagcagaagccaccatccctgggtgagacgcagcctctggagaaggagctgggttttaccgacctggcgagcccacgagcccacgagcccacatgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacctcactgacttacttcttgatggcaaacacagtt

SEQ ID NO: 131902 - DNA, 601 bp, Human
ccacgcagctgcccctcttatggccaggccggccacgtgctccctcattataagctgcacgcgaggcctccacacacccgcctctgcaccctagagcttcctccctccaggcttgaactgcacctattcctaagagtaagtcattcctggcctccgccactgtcgctggcccagctgcccacagctgccgagaagtcaagtatgtgtctgcggttgcctggctagctccctctctggcctggcccagagtcccagggccttgtgggtcagccacttcctttggtgtctggggccaactgcyttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccggccacagttacagagaggagggggcagcagaagccaccatccctgggtgagacgcagcctctggagaaggagctgggttttaccgacctggcgagcccacgagcccacgagcccacatgagctcagtaagatgc

SEQ ID NO: 131903 - DNA, 601 bp, Human
tctcctgccctgtcctgagcgagtcctcgggctgcgactcacttcatcctcttcccagcgatgggggaccaccagcaccccctcttactaaggagggctgagggcaggtggctggaggctggtagcaggccgcaggctggcgcccgctcactccccctcagcctggcctgagccacgcctccccacgcagctgcccctcttatggccaggccggccacgtgctccctcattataagctgcacgcgaggcctccacacacccgcctctgcaccctagagcttcctccctccaggcttgaacygcacctattcctaagagtaagtcattcctggcctccgccactgtcgctggcccagctgcccacagctgccgagaagtcaagtatgtgtctgcggttgcctggctagctccctctctggcctggcccagagtcccagggccttgtgggtcagccacttcctttggtgtctggggccaactgctttgcctgccccacctacatctgacagagaagtgaccacggctctgccagcatcctctttctagggtccaaggacagcaaacaggtgtccccctcctgctatctctggtcagtgagcag

SEQ ID NO: 131904 - DNA, 601 bp, Human
aatctgcacacatacgccagcggagttgacgcgacccccgggccccgggactcggcttgcacgagccagtctggggaccggggaggcggggagagggaaggggaaagcgcggacgcggcccaaacctccagtagccgcagccgccgtcgccgagtagggccgggcagccagccgggcctggcgcagcatcagtgcccgctgccgcttccgctcgatactcgcccgcaccgaggcaggcagctccgcgggttgctctaaagccgccgcctccggcaaagccccgtcggccgccgccatctcyggcccactccgaggacctagctcccagctccacgcacgcgcactgcacgccgaggcgagccagccgccctgcaccgcctctgcgctccccgcacccagcggcctttctgagtgagagcgcctgcgcagttaaggggctcggggtggcctgcccgggcgctgggcggagtctgggtatgcgcggacacggagtacccgcctaactacctgctctcttgtcatccgggagaagggtccgtgctgagatcatatctcacgacctggtcacctttaaaataggtctcgcttggtgattcagagt

SEQ ID NO: 131905 - DNA, 601 bp, Human
cctctcgggttcaagcgattctcctgccttagcctcccaagtagctgggattacaggtgcaagccaccatgcccggataatttttgtttttgttttgttttgttttttgagatggaatctcgctctgttgctcaggttttagtgcagtggtgcaatctcagctcactgcaaccttcacctcctgggttcaagcgattctcctgcctcagcctcccaagtagctgggattacaggcacgcaccaccatgcccagttaattcttgtatttttagtagagatggggttttaccatgttggccakgctggtctcgatctcctaacctcgtgatccacccacctcagcctcccaaagtgctgggattacaggcatgagccactgtacccagccctaatttttgtatttttagtagagacagagttttgccatgttggccaggttggtcttgaactcctgaccgcaggtgatccacctgccttggcctcccagagtactgggattacaggcgtgagccaccgtgcctggcccctcttccacttttaaggaaacctgtgtgcttacattgggtctacctgaataacccaggatattctccctatgtca

SEQ ID NO: 131906 - DNA, 601 bp, Human
aatatttctgaatcccagccatgtacaaggtacttgtattagtgctacattagttataagaaactaccacagacagagtgacttaaaacaacacacatttattatcacacggatctctagtttattctgacatgggtctcagcaggctaaaatcaaggtgttggcagggctgtgttcctttctggaggctctaggcaagaatccatctccttgccttttccagcttctataggctgcctgcattccttgactcatgaccccttcctccatcttcatagccagcaatggtggcttctcacayggcatcacccacttcttccataatcacatgtccctctgactcttggctttcctcttctactttttttgtttttttgaaatggagtcttgctctgccacccaggctggagtgcagtggcacgatctcagctcagtgtaacctccacctctcgggttcaagcgattctcctgccttagcctcccaagtagctgggattacaggtgcaagccaccatgcccggataatttttgtttttgttttgttttgttttttgagatggaatctcgctctgttgctcaggttttagtgcagtggtgcaat

SEQ ID NO: 131907 - DNA, 601 bp, Human
aaacatctatctaaacctatgaaactgtcagtaaacgtatgctgaattagattataaatagaaaagttgtcctctgactgtattgtcacaggaatcaaaagtacacgtggtcagtgagtttgatcaactgtggtgggctcaccaaagaaacagtttgttgacagattagccacatcagacctaaatatgaggtcatctccaaaaatctccaaccgcaggaaattaccaattactactactcatctccttcaagatcaataattgtctctatcgacttgacttctgatctgcaggatatatwtttttttaattttggtaccaagatgatgtaaaaagtcttcattctacttttaaaactttacattatatacctttactctttatagtatttacttagattttaagagaatttacacactaagaattatgctcaggatacctctcacaatatgttaaaaggaccataatattaatcagcatagccaaactcaaatttaacataatcaagtgatacactcatatttcgtatattctgagacatcacgttttccgcaatttaacatccctgaaaatgctgcatcaccaatgcacttaatggtac

SEQ ID NO: 131908 - DNA, 601 bp, Human
gttctccttgctactacagaggaaggactggtgtaaagcactgaaaagattaaagggccaaattcatcagaactctttccaaatcctctcaatacagcagtggctaattttgggaaggttctttaatgaaatgctcttatatggcacagcttattacaggaaacctctctacaaagccatgaatgtgtgccttaccttgtgattcaggaattgctaagtaactatataaaaagatgtgtataaggatgttgatcatggagttgcttaacttcgtgtcaaacagtgcttccatttttatttwaaaaaaaaatttaaggatcttaggatagaaaagaacaggaagagcaaaaattaaaatgttgctgatgattgtctctgagtaggaaaatcatgcaataagagctctttgtaattctcttttctgcactgtaactgaattacacttgtaatgacaaaggaaaaacaaatcctcacaatgagaaggattacaacaacttgtgttcctcacaacaaggaaggcttacattcaatttttggttttgcttttttgtttttaagacatctgaccttattcactctccaaaaccacttatgaatccta

SEQ ID NO: 131909 - DNA, 601 bp, Human
aaaagctgtaaaggacaccaaaacaactggagaatattaaattatacacaaggtagcagcattatattaatgctaagtttcttgagtatgatcgttgttctttagctatgtagaagaacaccattgttttttgttttttgagacagggtttcactcttgttgcccaggctggagtgcaatggggggatctcagctcactgcaacctccacttcccaggttcaagcaattctcttgcctcagcctcctgagtagctgggactacaggcacacaccatcatgcccagctaatttttgtatttktagtagagacaagatttcaccatgttggccaggctggtctcaaactcctggcctcaggtgatctacccgcctcggcctcctgaagtgttgggattacagaagtgttgggattacaggcataagccactgctcccagccgaatgccattgttctgaggagaaacatgctgaagtgtttataagaatcacaatgtctgcaacttaaatggcttggcaaaatatgtgtgtgtgaaagaaaaagtaaatatggcaaatgtcaacatcaggtaaataaaaaaaatttaagataaatacttttttc

SEQ ID NO: 131910 - DNA, 601 bp, Human
gggaagcagacttttcttcaaaaatgtcaatgtcataaaaaatacgagctgtgtaaatatcccagaaaagtttagaaagacttggtacctaaagccaatacccaatcctagactggattctgttctagaaaggaattactaaaaagaacattagatcaactaacaaaactagaatatggagggcagattagacataaatactaaatcaatgttaaatttactcaagttaacaatatactttggttatgtaacaaaatatatccctattaggaaatatacactgtaatacttaagggtaaakggtggtgatgtatacaacttagtcttaaatggttcggaaaaaaataaatactgtgtatgtatagaaagagcatgcaaatgatgatgcaaatagcataaagtgttaacagtaggtaatctggaaaaaggatatatgagtggccctttgtattattatccttgcaattttttataagtttgaaatatttccaaacaaaatagtttaaaaagacaggagctaccttgaaggggattctactgggcaaattttggacaatttcaacaccaaaatgaatcatgactggaatggactataatacat

SEQ ID NO: 131911 - DNA, 601 bp, Human
gccataacatacataattattactgaagtattacttatacaagggtttcattcatctatgaagatgttgcttttttttttgaattttgaaaaggaccaatctaaatttcctttatttaaatataaaattctataaaacaggtcactgaactaaaaaatcacattttttcatatgtcagttcatggccacacatagtacaagtcttacggtacatgtcatcttctaggttttcttctggtccatactcatgttgatgaacaatcgtctcccttttccacacgctgcttcttactgctcgccgcaattctgaaaaaaaaattttaaagtcatcttttcagtggtgctattcaggtgaatccaaaaatccaactccatcaagctttcagccatgtacatgtgtgtgtgtctatgtgtatttaaaccatatatagtttaccttaattttataacaaagttgattatacaaacttggcaaacttactttcttacctcactagttcggcctgtgaatcaagttgtcactggagcagtgtgaaacaagagattcagaaatggttatgtgggttggtggtatgcaaaacagaaccatattcagaagtga

SEQ ID NO: 131912 - DNA, 601 bp, Human
tcggccttccaaagtgccgggattacagatgtgagctactgcgcccgccgataatacaattttcatatgctttgtaattgactagtcaaaaactaatatacttctcaagtcattacttgggggctggagaacttgagtcttttgttcttttctttgttgttctaatgcttcctttttctcacttagaggtaatccctaaagagagaggaaatgtcattgtagggcatcctagagaattggaatgctaatatgtagaaaaataacttttgctttggttattgggagacttacataactttcytggagttggcttgtttttaacaccagctggcagccaaatcactgtccatttgggtcttgccgcgagaacctcagagtaaataagacaagtaaaacaaagcattcattaagcaaaggtttttatggttgatattttagtgtgggagaggcagatacaattcatgtttgataatacagcaaatctgaaatttttgtcagttgccacaatttggataacgatcgctggagtttaccctacacagtgatctgaatcagattattttggatgctttccttttagttaaaaatctattttttaaaa

SEQ ID NO: 131913 - DNA, 601 bp, Human
acttaactaaagaaaaaaatagaagtgaaaggatttgttattttgagagagtatagtttatttcagaagtgatggttgcctgttttaagtctgcgggctcaaggcatgttatctttcaagttgttcaatatcaaaatagatgagccaaaaagaagggaacagtgtgcttaaggtttaaaaacgtaatgttgaagttgttggttttagttactttacttttctattttacagggttggtttttgttttccattttgtgggtctaaaatttcttgtaaggctataagatgtacagtgtacccrtataaaattaggattgacttatagaggggaaatttatttggtttattaagatcctttcagatggattttatacctgcttctctatactagccaagtctgtctgagtgaagtggtaatgttatctttaatttacattttaaaacttttacatagttaaattttaataaaaaatctgttcttgccttgggaactaccatagatacgttttcttcagggtacattgagcgaattccccaaattgtattcgtattgttttatttcatttccctgttcccttacccaggttgtcttatgagttca

SEQ ID NO: 131914 - DNA, 601 bp, Human
gaagggaacagtgtgcttaaggtttaaaaacgtaatgttgaagttgttggttttagttactttacttttctattttacagggttggtttttgttttccattttgtgggtctaaaatttcttgtaaggctataagatgtacagtgtacccatataaaattaggattgacttatagaggggaaatttatttggtttattaagatcctttcagatggattttatacctgcttctctatactagccaagtctgtctgagtgaagtggtaatgttatctttaatttacattttaaaacttttacatagttaaattttaataaaaaatctgttcttgccttgggaactaccatagatacgttttcttcagggtacattgagcgaattccccaaattgtattcgtattgttttatttcatttccctgttcccttacccaggttgtcttatgagttcaatatcatgtttctgttcgtaagttcagattttgtctgtagtcttcacccctttatagtctctcaactatcaggtgaaagtggaacatttcttacctcttaatactttctgcctcctcccattctccagacaaatattgtcctttaatatag

SEQ ID NO: 131915 - DNA, 601 bp, Human
gtcttaaaagcctggtgcacaagatgattccttgggtttcaggaagtgaatattaagaactcttatttatcttaagtggaaatgaaattaaaccttactaataatacatagattaatggtgatccagtgtatatcataaatacatatgtatgtgttgaagatatgtgatcaaattcttttttactgagtacacaatcaaaaaagtttggacacccatcaggctataggattaaagtccagactctttagcctgaccctttatggtttccccagtctgtttctctattcttgtctcccataygctccccagcaatatcaaaataacttgcagatccctaaacacaccttgtttttgaacctctatgcctagactgccctccttgctcactacttgaggctgttgctatcctttatgacctagcctaattgttacctcctttgtgatgctttccccaactccctttgtcattgttcctaaaaaatgcttaatttgccttttagtgtgggagtcattcctttgtattgagattgtgcttgttccactagaatgggtcccctaacagtgacttttagtagtgtttagcaatagcacactaagcac

SEQ ID NO: 131916 - DNA, 601 bp, Human
gaatattttacaatctggattcttgatgtagtatagcatagaaacgtatgaactcacagattactgtcctttatatagtctttgttacaacttctcaattctgccattgtagcacaaaagcaaccatagacaatatgtaactgaatgagcgtggctattccactaagtttacttatgggcactgaaacttgaatttcatgtaatttgtatatgtcataaaatactcttgatttttttttcacgcatttaaaaatgtaaaaaccatttttagttcccagctatgcaaaaaacaggtagtaggctagattcagcccttaggctatagttttttagaccaatagtttagcctatacaagattgcttattttgtagttattataaagaacatttaggtttaatagcagaaattgtttgccccaacaggtccgttttttatctgatcttgtgaattgtcatgtgattgccgccccatcaatggttgctatgtttgaaaattttgtaagcgtaactcaggaagaagatgtacctcaggtaagagaacccctcatgctgaatcttgaggggttcttgaggggttactgaatcctggtacttccatata

SEQ ID NO: 131917 - DNA, 601 bp, Human
aaattaatattaccacctaagtcaaatttgagtttcttctattgtctcttttctgttctatggtaaagtgctaatgaccagtaggaatttagtatatatgtaatctattttggaataaaaatttctcagataatcagttacatatacaaaattatcagcttgctgccgtctttgctatattccatatgtaaccaaatactttagtcaaaattatgtaatgatctacttagatatgtctaactgaaaatctggtttacatttaagactgctaatgtttgtggtcgggtatttttttttttttgtgcaggggaaactagaatgggacctcaaaatttgtttctcctgaatttgtatttaattggtatcacctctgtaaggtgcatatccatcccttgctagaagagtataaatatataaaatacatattactcccaaaacgaacaggattttgtttctgttctggccttttacaagttgtttattaaaaaacattagaaattgtaaaaaaaagattagaatcatccaaaagtcattattaaaggtttattttgtgtgttttgaacctgtttgctatgaatatacttaagaataaaataatgcc

SEQ ID NO: 131918 - DNA, 601 bp, Human
ttggctcaatgacatgtctgaaatgcaaaatgtcatttttaaatctgcaaaatgtatagaaattcatcagaccgaagtgtagaagtgtgagagataggtaagagtaaaggatgcagactagggctttagaattctagacaggtggtccaccaattatacagagagagtaggaaggaagtttctgaataagaggcatggcaaagaagtcttggactgccagaaagatctgagcatctatttcaagtaacagtgtggaatgacttgattttcttgtttcctgaccccaaagtctaaaagaatkctttttttttttttttttttgagatggagtctcgctctgtcgcctaggctggagtacagtgacacgacctcaactcagtgcaacctccgcctcctgggttcaagcagttctcctgcctcaggctctcaagttgctgggactataggtgcccaccaccacacctggctaatttttgtattttttgtagagacagagtttcaccgtgttggccaggctggtcttgaactcctgacctcaagtaatctgcctgcctcagcctcccaaagtgctgggattacaggcgtgagccactgcgcccag

SEQ ID NO: 131919 - DNA, 601 bp, Human
ctataggtgcccaccaccacacctggctaatttttgtattttttgtagagacagagtttcaccgtgttggccaggctggtcttgaactcctgacctcaagtaatctgcctgcctcagcctcccaaagtgctgggattacaggcgtgagccactgcgcccagcctaagagttcttgttatttataggaatgaaactgtcatggatcttttgagcccctcaaaaagctgtacatcctggctcagctgtggtgctttcaaagttggaatttaattgcatagttctctgggaggagtgtagatcraataagcattagtgtcgtgtgtttttatttgatcgaattatagagagaagaaattttcattacagttttcagttttagatttttgtgtttgaaagagcataattttaaatattaaaaagtaattccattttcatatgaatgccatggagttagagctcagatttagaatgttaaggtctttctaatagaagtgcaaagatagcagttggattgaattgtgactcatgattcttttgtaggtgatctttgcagagctgtttcaacttccagcaccccctcacattgatgtgatgtacacaa

SEQ ID NO: 131920 - DNA, 601 bp, Human
ctcttactctgttcttcatcagatctccatcctgcttttagcagctaccactaagatggttgccaagtgatgattttctcattccattattttttctacatttattagtgggccttctgtaagagctgtcctttctcccccatttatttattcctttatttatatatcagtagggactaattaatttatatttcattcgatgggttataaactatgaggattatttattttgatgcccaaattgtccctgatatgtacatgaggagccccggtaagctctctctctctctctctctctctmtatatatatatatatttttttttttttttttaacgtccccagccattcattgagcattcccttattttctagaacaacatatttaggatcatcttgcgttttcttgccctatcactggaatcatctatttattcatggagccctagtttctagtaaagtagtaatggaatatggtatttaggagccaagatctgggcacttgatatgctcattgccattggggtgtcattggttctaagcctcttggtggacacacatccatccatccataactgtttttatgtccacctgtgtgtatat

SEQ ID NO: 131921 - DNA, 601 bp, Human
ctgactgtacctgttttccttgaaatgaactgtgtcggtcctggtacatttcctatttcattatgtcaactctgaagaatagatatgattatcaaaactacaatgaggaaatgacttccaagaggtcaagctagaatgagattgcttttgagtggtggagcccaaattcaggcgtaggtgcactaactgagtggccatgctgttagccactgtgctttttggcagatcaaaggtttatgcagtacttagaagtgctgggttttgagttttgtcctgtactggttccgagaatgataaggtrtagtctttgctatcagaaagctcaggcttttgttgaagattaagctttctttttgccccataggaataactccgcctaacattcaaggccttcataaccattgttcctactttgttatttttcacttctccccacatggacctctatttctgccaggtccatgtacttttttattttttccatactccctgttcttgactttgccattaccccagtctggaaagccctttctagctccacttccttttctccttctagattctagcccaagctcaatagctgtaaatattttttaaccgt

SEQ ID NO: 131922 - DNA, 601 bp, Human
ctctgtaaaatggaaataaaccatgccttgtttttcttttcctttaaaaagaaaaaattaaattctataaactcttcagagtgagctgggggcagggattattaaagctttacaggagtatattgagcccatcattgccagcagaaagtcttaaacagcccactttgaattattatatgtcggctggagccatttctaaattataacaagaatgagcagccttggcccataggacttgcccagtttttctgtatggcccattagcagatgaatgattagcaagctgtctccctgttgttamtgctcaaatggtcaaatagtgataaattgtagccaagtccccccatgttgttaccaagacaagtgccactaaatttccctggcctagataagaacccatggaatttctgaatgagaagacagtgtctctgaaccacaacaggactttgaggtatatatgtgtgggtggcggggtgggggggtactttcactatagaatataagtcttaacatttggccagacacagtaaaatgcttcccctggaggagatttaacacactggaatctaaatggtattttccttttgttcatttgccttct

SEQ ID NO: 131923 - DNA, 601 bp, Human
tattaaagctttacaggagtatattgagcccatcattgccagcagaaagtcttaaacagcccactttgaattattatatgtcggctggagccatttctaaattataacaagaatgagcagccttggcccataggacttgcccagtttttctgtatggcccattagcagatgaatgattagcaagctgtctccctgttgttactgctcaaatggtcaaatagtgataaattgtagccaagtccccccatgttgttaccaagacaagtgccactaaatttccctggcctagataagaacccayggaatttctgaatgagaagacagtgtctctgaaccacaacaggactttgaggtatatatgtgtgggtggcggggtgggggggtactttcactatagaatataagtcttaacatttggccagacacagtaaaatgcttcccctggaggagatttaacacactggaatctaaatggtattttccttttgttcatttgccttctatagcgaagtgatgatgacgacagaagcagtgacaggaaagacggggttcttgaggaacaaatagaacgacttcaggaaaaagtggaatctgctcagag

SEQ ID NO: 131924 - DNA, 601 bp, Human
ccccaccttttttttgagatggcatctcactctgttgcccaggctggagttcagtgacacgatctcagctcactgcaacctccacctcctaggtttaagcaattcttctgcctcagcctcccatattgctgggattacaggcacccgtcactactcctgcctgatttttgtatttttagtagggacagagtttcaccatgttggccaggctagtctcaaactcctgacctcaggaggcctccgcctcccaaagtgctgctgggattataggcgtgagccacggtgcccagtctcctaattrtcattttctatgctggggatcctagctgtaatataaaatgtagaggacaaaaatatcaagaggacagtaattggatttataagtccctaaaaagccagtgttatccaatgtgcaggtggtaaactgtccacagaatcaaggtaagctccctggggtctctctgcaaaagcaaaatgccggcacctattctcacctagatttaagttaaaggtatataggagagtggagctaattcattgtatcttcggacactactcccctaaatcttcatttgttcattctagaagaatgattaatgta

SEQ ID NO: 131925 - DNA, 601 bp, Human; identical to SEQ ID NO: 121786

SEQ ID NO: 131926 - DNA, 601 bp, Human
aagtcccccggggggcgctctgcttctctcccaacacccggacccttcccaatcccttagcgggacgaccctgcggcccaccgggcttcttctccccaggcccaggccagcgtccgagacccaagggcttttccccgcggggctggggctgggccggggagaactggagctgtggagccctttgccgggaggtttgcccacgcgactgaaggtgcgagtgggtgcagtgaaaccgctgcgacttcccgggagcagagcctcgcgccgctgcaagccccaggccgcgcatttttcctgcgcsctgcctcgggtctggaaagccgcatgtcggcctcggacacattgacctgcatgatgacctgcagttctttgccgaaggacaggcggcatccggagccgggatctgggaggcgagttccctggtgggcactcttgttagccgcgcccatgcaaggcccggaattatccgggatccccaacgcgggtttagatttgcaaagggcatgttccatgcagggtccgggtggacacgcgcggggccaaagaaaccaagcgcggtggtgtgggggcgaacgcgtctcagacctcagttcgcagagga

SEQ ID NO: 131927 - DNA, 601 bp, Human
gagcagagcctcgcgccgctgcaagccccaggccgcgcatttttcctgcgcgctgcctcgggtctggaaagccgcatgtcggcctcggacacattgacctgcatgatgacctgcagttctttgccgaaggacaggcggcatccggagccgggatctgggaggcgagttccctggtgggcactcttgttagccgcgcccatgcaaggcccggaattatccgggatccccaacgcgggtttagatttgcaaagggcatgttccatgcagggtccgggtggacacgcgcggggccaaagaaacsaagcgcggtggtgtgggggcgaacgcgtctcagacctcagttcgcagaggatctggtctcagtctgagaaaggagggcgtttccagacctcgctgcccacccccggcctctccccgggagttcaggccggctggcagtgtatccccagggccgggatcgtttgtgggtcctccccgaccgccctagactttgacagctggttactaattatctaaggagccgagcggttccctgagacagcacgtcgctcccgggccactccgctttaggacagagcccatcgcgtggcttcggacactg

SEQ ID NO: 131928 - DNA, 601 bp, Human
ggtggtgtgggggcgaacgcgtctcagacctcagttcgcagaggatctggtctcagtctgagaaaggagggcgtttccagacctcgctgcccacccccggcctctccccgggagttcaggccggctggcagtgtatccccagggccgggatcgtttgtgggtcctccccgaccgccctagactttgacagctggttactaattatctaaggagccgagcggttccctgagacagcacgtcgctcccgggccactccgctttaggacagagcccatcgcgtggcttcggacactgaagcgcygcgatttcggggctgagccttggccgcacgtccgcagcggcggtttggggtgggatatgaccttgcatttgaatttgtgctccgagggcctggcggtttgccctctagccaaaacaatcaggggaacttgtagattttttttccccaaacacactttggtataattcataggtttgaggttcttccctcgtcgctctcccgcccggaggtgatttctcccctaccgggagagaactcctgcaagagagttccgcgaggcggaaggtgtgagtcgcggaggctaagaggggtcgagagagt

SEQ ID NO: 131929 - DNA, 601 bp, Human
tggtgtgggggcgaacgcgtctcagacctcagttcgcagaggatctggtctcagtctgagaaaggagggcgtttccagacctcgctgcccacccccggcctctccccgggagttcaggccggctggcagtgtatccccagggccgggatcgtttgtgggtcctccccgaccgccctagactttgacagctggttactaattatctaaggagccgagcggttccctgagacagcacgtcgctcccgggccactccgctttaggacagagcccatcgcgtggcttcggacactgaagcgccgsgatttcggggctgagccttggccgcacgtccgcagcggcggtttggggtgggatatgaccttgcatttgaatttgtgctccgagggcctggcggtttgccctctagccaaaacaatcaggggaacttgtagattttttttccccaaacacactttggtataattcataggtttgaggttcttccctcgtcgctctcccgcccggaggtgatttctcccctaccgggagagaactcctgcaagagagttccgcgaggcggaaggtgtgagtcgcggaggctaagaggggtcgagagagtgg

SEQ ID NO: 131930 - DNA, 601 bp, Human
tcgggactgcgcgcttcccggtccccggctcccggccggagctggcctttctcgcggcctcgaggcaggtgcgccgggggcgtctagaaagtgggctgcattctaagaagccgaagttgggctccttaacgaacgcgctgcggactgcgctggagtccaggcttctctgctcgtgggcagcaaagtcattgtttgagaaggagcgtgcgggacggaccctgcgggcgccgcggccggcgtttgacacctgcgcttgggacacaatggccgcaggccctcttcgggaccggtgcctttctcsgtgttagggaacctctgaacctgagctgtgttttcaaacaaacaaacaaaaataaccagctctcccggctcttcccggtgaacacacgtgaattttggggtcagagggttgtgaaggtataactgcgccatcttactcctcactcttttaagtcggacttaaaaggttttgccattatttataaggttcttgggggctttttttaaaccctccccaattgttgggctaattcactgtttccacagaatcattcccacttagaacagtaccctatttttctaggtttcttaggcatacaaa

SEQ ID NO: 131931 - DNA, 601 bp, Human
gccgaagttgggctccttaacgaacgcgctgcggactgcgctggagtccaggcttctctgctcgtgggcagcaaagtcattgtttgagaaggagcgtgcgggacggaccctgcgggcgccgcggccggcgtttgacacctgcgcttgggacacaatggccgcaggccctcttcgggaccggtgcctttctcggtgttagggaacctctgaacctgagctgtgttttcaaacaaacaaacaaaaataaccagctctcccggctcttcccggtgaacacacgtgaattttggggtcagagggytgtgaaggtataactgcgccatcttactcctcactcttttaagtcggacttaaaaggttttgccattatttataaggttcttgggggctttttttaaaccctccccaattgttgggctaattcactgtttccacagaatcattcccacttagaacagtaccctatttttctaggtttcttaggcatacaaaatgaacacaggtaaaggcatttaaacaaaagaaaaatagccgaagaatttgctaaagcaatattcacttttaaaatgcaatttttcccctaaggttcgaggcgtcttgt

SEQ ID NO: 131932 - DNA, 601 bp, Human
cattttttgttcttcttgttacttcctcatattgtgtacttggaaattacctttgtaaatacttgagaaattcgttcttatatataattaatataaaaagtttgcatttctcaaaaacatctctatcaaagcctgtgttctcacgagtttaatatcaaagtcttaataaaataatcacaactacccaaatgcttataaaatatgttcgattactggatttttattcattaaacagaattaattttatttgacatatttaaaggcgccatttagaaataaaattgcttattatgttgcaatrctgtatctatttcagcctctacaccgttttcttttttgtttcacctgaaactagttttcccttccgttttttttcttgttctatcaagctaatatatatatcaacatacagtaatggggtgctggtttttgtaagttaaatatgtacctgcattaaataaatagtaaacatgtatatattgcttctttagtacttttgttctgtgctgcacactattttaatttctagttttaaattatatctctcttttcaaagcatctgttcaataagcaagaaaagatattggcaaagttgaaacca

SEQ ID NO: 131933 - DNA, 601 bp, Human
ctaatatatatatcaacatacagtaatggggtgctggtttttgtaagttaaatatgtacctgcattaaataaatagtaaacatgtatatattgcttctttagtacttttgttctgtgctgcacactattttaatttctagttttaaattatatctctcttttcaaagcatctgttcaataagcaagaaaagatattggcaaagttgaaaccattctagacaaataaaattcaaaggtgctaaaactagcagtttacacacctgtgtttatgagaaatgaaaagtataaccatgttcttatycagtatttaaaatttatgagaaacataatacaggaaaacaagcatctaaaattgttaatgtccgaaattgaagttatttgtccccattagcccagtagattttgtctggaaggtggagctgtggattttttttttttttaactacttgcctcacctcagtggtgtgatcctcccgtcccaaggagatacaacattgtattttggaaaacttttctaaaactctgaaaattatttactatttggctaagacatcctccttgcttcttagaaggtgaacacatacatttcacccctgtttta

SEQ ID NO: 131934 - DNA, 601 bp, Human
cgcggtggctcacgtctgtaatcccagcactttgggaggccgaggcagatggatcacctaaggtcaggagtgtgagcccagcctggccaacatggtgaaaccccatctctactaaaaataaaaaatttagctgggtgtggtgctgggcatctataatcccagttactctggaggctgaggcaggagaatcgcttgaacccaggatcctggtggaggttgcagtgagccaagatgccgttgcactccagcctgggtgacaagagcaaaactccacatcaaaaaaaataataataaataaatwaattaattaattaaataaaacaagagcttttctttttgcttaataagagagagtggtggtggtgcttttttattcctgaagatgggaagtcctcttttgcccactaacctcagaagaaagggatgaggtgtaccgtacaggggcagtcaccttctcctctgtttagcttccattttggcctcatgtctaccccaaagttgtagcttagatggggggaaaattcagaattttgcatagaccataggtagcaccccctagaaaaagaatgtttctccccagatgtctcccactagtacccta

SEQ ID NO: 131935 - DNA, 601 bp, Human
taaaaataaaaaatttagctgggtgtggtgctgggcatctataatcccagttactctggaggctgaggcaggagaatcgcttgaacccaggatcctggtggaggttgcagtgagccaagatgccgttgcactccagcctgggtgacaagagcaaaactccacatcaaaaaaaataataataaataaattaattaattaattaaataaaacaagagcttttctttttgcttaataagagagagtggtggtggtgcttttttattcctgaagatgggaagtcctcttttgcccactaacctcrgaagaaagggatgaggtgtaccgtacaggggcagtcaccttctcctctgtttagcttccattttggcctcatgtctaccccaaagttgtagcttagatggggggaaaattcagaattttgcatagaccataggtagcaccccctagaaaaagaatgtttctccccagatgtctcccactagtaccctaaccatctgcttgtctgtctagtgaggacccttggagggctgctaaaatgatcaagggttacatgcagcaacacaacatcccccagagggaggtggtcgatgtcaccggcctg

SEQ ID NO: 131936 - DNA, 601 bp, Human
ggtggttgctgtacaatggattggcttctgtcatgttcttcagtcacagcccccttgctacccagccagttgctctgaggagcctgtcagtgtatgcagcataccttaaactttttggcccctccttccacctccttctctttgaaaccaagtaggtgacagagtgaaatgtcttccctgagagaaaacccagcatctccccttgatacgtgaccatcagtcaatttccaaagaagacatttcgttgcagtcaataatattgattactattactgttaatttcctcctctctggaaaaagyatcaacaatagaatgcatttgtatagagagatatattcagaacttcaccctgttcttggaggatagtgggagggattgaatcctgaggcaatttaaggtgtttacccacatttaccaacactggtagagtgtggggacctcagctggtggccctgctcatgaagaagctatttctggctaaggcagggcacaggaaaagcatctgcatttggaactctgacccatcaattcttgtcatccccattcccatcccaaagttttttttctgtcccaagatttctcccacccaataattctaaa

SEQ ID NO: 131937 - DNA, 601 bp, Human
ctggtgaaaggaatggttttaggtgttcatttcatattgtggtgtttgtgcttttgttgggagcattacatgaatagattggaagaagcaacatgagagctgtttgctgcttagagcgagagacctttccaagaatgggttggccccccatacttggtgactagctctttaagaatttgtgttcctgacatgaagcaactctctgtagttcctggaaagcctaaaaaaattctcaggagccattgtctccaaagacccaacaacgcttgggccctgcccaatttaagctttatgcagcatytccagtctgtgctgcctctctgtattcaatgagaatttcttcagaaaggagaaggaggcaggaaaggcagactggaaacttctcaaaagacagaggtccagaaagtttctcaagatgctgaggaagggacgttttacaaatacaacagcctcttcaagagattgttgttattgttatttttgttttatttatttatttatttatttaactttttgagacggggtctcgctctgccacccagactggagtgcagtggcgcgatctcggctcactgcaagctccgcctcccgggttcacgcc

SEQ ID NO: 131938 - DNA, 601 bp, Human
cttgggccctgcccaatttaagctttatgcagcatctccagtctgtgctgcctctctgtattcaatgagaatttcttcagaaaggagaaggaggcaggaaaggcagactggaaacttctcaaaagacagaggtccagaaagtttctcaagatgctgaggaagggacgttttacaaatacaacagcctcttcaagagattgttgttattgttatttttgttttatttatttatttatttatttaactttttgagacggggtctcgctctgccacccagactggagtgcagtggcgcgatctyggctcactgcaagctccgcctcccgggttcacgccattctcctgcttcagcctcccaagtagctgggactgcaggtgcccgccaccacacctggctaattttttttttttttggtatttttagtagagacggggtttcactatgttggccaggctggtcttgatctcctgacctcgtgatccgccgcctcagcctcccaaagtgctgggattacaggggtgagccaccgcacccagttgttatttttgttttaaagtcacacgagacataaaagcttaagaaacattccttccttctgta

SEQ ID NO: 131939 - DNA, 601 bp, Human
ttgaggacacactgagttctgaacactgttcagcctgctacctcctcaaagggcaggtgagagactgaggcagccctcacactggggagcagctgcgagagtgtctcacacccaccagacacaaagcttcaggaatcggttttgtcacctccacacaagtcagatatgaagcgtttgcggggtacgtggcttgggttttgtttttagtgagaggtgatgcacaggctggtagttaggagcctgcaagcctgcaggctgggctcgtgtccaggctcctgccccaagtccacatgactttggrcaagtcacttcaccagtctgaacctcagtttcttcatctgtaaaatggaggtggctatacttctcacatggagcggtcgtaagaattagatgaaggaatatatttagaggatttggcacaatacctcaccacagaaaaggttcaataaatgtgaaccgttattgtgtctgttcacatcaaatgaaaaaatctcacattgctcccaggcccttgggatgatccacactggctttcgccattggtgactctactggtgccacacagggcccacggggaggagggaagacactgtgacagacc

SEQ ID NO: 131940 - DNA, 601 bp, Human
gccaggcacggtggctcacacttataatcccagcactttgggaggccgaggcgggaggattgcttgagcccaggagtttgagaccagcctgggcaacatggtgaaaccctatctctatttaaaaaaaaaaacaaaaaaacaaaaaaacaactctgtgttattttaagtatttatttttaaaatgtggtcttgctatgttgcccagcagatcttgaactgggcttaagcgatcctcctgccttggcctcctaaatagctgggattacaggctctagccacagggcccagctattttttttttaaacgattggaaagccttgggaaatctttttacttcattcctgccctgttctccctgactccagtattgactttctaaaacttcagctctttggtctggccaaggcctgtgtgcgctttctctgtctctgggctgggctggccttggctgtgggaagaatgcagccagggaggtcaggctgggaagcagggaggcctgtattgccactgagtcctcaggctgtgctccataccccgactaatgagatgccttgcagcacccagtagtgtctaagaatctctcgcacctggttttgaggtt

SEQ ID NO: 131941 - DNA, 601 bp, Human
gcaacccaaccatcctggttcttgccacggatcttatctggtttaagggttttcagaggagcaaacgcttttgagatgatcctagggccgctctctcattgccagaatatactcccctggaaataatgtgtggctctgatcagtttcctccaactcctggttcagccattgccctgtgagggctcactcggcttccagggagccctttaccctatttgtctccttccctcttcttctccctgtgtggctgctgactcagcggtcattctacactgaggaggctgccttatgggtgggccasatccaaaccgcaggcaaacgggtcgtgatggcgtggcaaccctcactgtgttggaggatggcactccggccacctcctccatctctggccatatcctgcccctcgctcggtccggctgcctcaggagaagctcagtagcctttggggacggccactctgttggtggcctctgcttgttggcttccgtgtgtcatcagggttggtgggggtcagtcacttgaaatctttgcagcaatgagttgggaaaaactgaccgagtacctgctccatcatgcttgattgagtgctcctgtgtgctgg

SEQ ID NO: 131942 - DNA, 601 bp, Human
tgctgggattacagttgtgagattgtgcccagcccttctgctttaattttcactctgggctcctcaacatggtccttgtcccaagcccagggactggcttctctttctctgagtgtagttatgtatctgggttctaaccagtaaggttataactgtggctaattcacataacttctctgagtctgaatttcctgcctacaaaatggagaaataggaccttccacacagggtgcatgtgaggatgaaaggagtgaatgtataaagacacctttcccgataacccatactaccctcattatgrctcttaacattagagagggctaaacaagggcagtgagaagactggcaggcagcagaaatcattttctttttgatctcacacaccagggcattccccctaagaggcagtgagatgtagcctggccctggaactagaaacagaggtggctgctgtgctagtgcctgagatgcacgatgctggggtcaaagacttgtgtccccacctcaggctgccaggatggcgtgtgtgccgtgacagggctcccgagtcatgcactcaggcagacagcaggctggagcccagcattcaggggtggcttct

SEQ ID NO: 131943 - DNA, 601 bp, Human; identical to SEQ ID NO: 131926

SEQ ID NO: 131944 - DNA, 601 bp, Human; identical to SEQ ID NO: 131927

SEQ ID NO: 131945 - DNA, 601 bp, Human; identical to SEQ ID NO: 131928

SEQ ID NO: 131946 - DNA, 601 bp, Human; identical to SEQ ID NO: 131929

SEQ ID NO: 131947 - DNA, 601 bp, Human; identical to SEQ ID NO: 131930

SEQ ID NO: 131948 - DNA, 601 bp, Human; identical to SEQ ID NO: 131931

SEQ ID NO: 131949 - DNA, 601 bp, Human; identical to SEQ ID NO: 131932

SEQ ID NO: 131950 - DNA, 601 bp, Human; identical to SEQ ID NO: 131933

SEQ ID NO: 131951 - DNA, 601 bp, Human; identical to SEQ ID NO: 131934

SEQ ID NO: 131952 - DNA, 601 bp, Human; identical to SEQ ID NO: 131935

SEQ ID NO: 131953 - DNA, 601 bp, Human; identical to SEQ ID NO: 131936

SEQ ID NO: 131954 - DNA, 601 bp, Human; identical to SEQ ID NO: 131937

SEQ ID NO: 131955 - DNA, 601 bp, Human; identical to SEQ ID NO: 131938

SEQ ID NO: 131956 - DNA, 601 bp, Human; identical to SEQ ID NO: 131939

SEQ ID NO: 131957 - DNA, 601 bp, Human; identical to SEQ ID NO: 131940

SEQ ID NO: 131958 - DNA, 601 bp, Human; identical to SEQ ID NO: 131941

SEQ ID NO: 131959 - DNA, 601 bp, Human; identical to SEQ ID NO: 131942

SEQ ID NO: 131960 - DNA, 601 bp, Human; identical to SEQ ID NO: 131926

SEQ ID NO: 131961 - DNA, 601 bp, Human; identical to SEQ ID NO: 131927

SEQ ID NO: 131962 - DNA, 601 bp, Human; identical to SEQ ID NO: 131928

SEQ ID NO: 131963 - DNA, 601 bp, Human; identical to SEQ ID NO: 131929

SEQ ID NO: 131964 - DNA, 601 bp, Human; identical to SEQ ID NO: 131930

SEQ ID NO: 131965 - DNA, 601 bp, Human; identical to SEQ ID NO: 131931

SEQ ID NO: 131966 - DNA, 601 bp, Human; identical to SEQ ID NO: 131932

SEQ ID NO: 131967 - DNA, 601 bp, Human; identical to SEQ ID NO: 131933

SEQ ID NO: 131968 - DNA, 601 bp, Human; identical to SEQ ID NO: 131934

SEQ ID NO: 131969 - DNA, 601 bp, Human; identical to SEQ ID NO: 131935

SEQ ID NO: 131970 - DNA, 601 bp, Human; identical to SEQ ID NO: 131936

SEQ ID NO: 131971 - DNA, 601 bp, Human; identical to SEQ ID NO: 131937

SEQ ID NO: 131972 - DNA, 601 bp, Human; identical to SEQ ID NO: 131938

SEQ ID NO: 131973 - DNA, 601 bp, Human; identical to SEQ ID NO: 131939

SEQ ID NO: 131974 - DNA, 601 bp, Human; identical to SEQ ID NO: 131940

SEQ ID NO: 131975 - DNA, 601 bp, Human; identical to SEQ ID NO: 131941

SEQ ID NO: 131976 - DNA, 601 bp, Human; identical to SEQ ID NO: 131942

SEQ ID NO: 131977 - DNA, 601 bp, Human
tgtgcagaataccgaaaaaaaaaaaaaaaaaaaggccgggtgcggtggctcacgcctgtaatcccagcactttgggaggccgaggcgggcggatcacgaggtcaggagatcgaggccatcctggctaacacagtgaaaccccgtctgtactaaaaatacaaaaaattagccgggtgtggtggcgggtgcctgtagtcccagctacttgggaggctgaggcaggagaatggcgtgaacccaggaggcggagcttgcagggagcagagatcacgccactgcactctagcctgggtgacagagygagactccgtctcaaaaaaaaaaaaaacgctctgtgggctaggtgtggtggctcacacctgaaatcccagaactttggaaggccaaggcaggcagatcacttgaggtcaggagtttgagaccagcctgaccaacatggtgaaaccccatctctactaaaaacacaaaaatcagctgggcgtggtggcaggtgcctgtaatcccagcgactccggaggctgaggcaggagaatcgcttgaacccgggaggcgggaagtggaggttgcagtgagccgagatgggccactccactccactcca

SEQ ID NO: 131978 - DNA, 601 bp, Human
ctaaaaacacaaaaatcagctgggcgtggtggcaggtgcctgtaatcccagcgactccggaggctgaggcaggagaatcgcttgaacccgggaggcgggaagtggaggttgcagtgagccgagatgggccactccactccactccaacctgagcaacagagcaagactctgtcttaaaaaaaaaacaacaaaaaaaactccatgttgctgaggagagcccaaaatccaccgtcagcactagcaaccccaaagactgagctggggggaacaaggcccgaatccctccacacccactctccasgctctcccctctccaaacatcagcacctgagccaggagggctggcagcaccttggagacgaagcttccccagaaccctcttcctagagaggaagagcagcctttctctaacagcaccttccctcccagccatgcttaccatgctgtggcccacttgcccacgatgaccacggtgtgaccctagtcctggaatgtccggcacaataggggtggcaggaggagcactctgcctctgtcagcggctgattggttacaagatgccctacaaacacactgtcagcagagtcagctgtttccagcg

SEQ ID NO: 131979 - DNA, 601 bp, Human
ttctcaactgtttaaaaatgtaaaacccattcttagcttgtgggtcatacaaaaacaggctgctttggccaacagaccagtttgctgaccccgctgtaggacaatagttctcaaatgtggccacactttagaatcacccgagggagtatttaaaaatcccagtatccaagctgcaccctggacctgtcagaacagctggggagtgggactacatatcagtagttaaaactttctaagtgataccaatgtgtagctaaatttgagaaccagttctaaggttctcaaatttagcttctcaaaygttaaagtgcatgccaattccctggggtggggggtgttaggatacagattctcattctataggcctggggtgaggcctgggtttctgcattttcaacaagttcccaggtgctgttgaagaggatggtctgggacacacttttgagtactggagttggattagcaactaactcccctttgcctcccaacctgtgtaatttgcctcaccatcaccagccttgacatctaatatggggaaatgctcttttaaatccagccggcacagtgacaaaattacaggctatggaggcagacccaaatt

SEQ ID NO: 131980 - DNA, 601 bp, Human
atgtaaaacccattcttagcttgtgggtcatacaaaaacaggctgctttggccaacagaccagtttgctgaccccgctgtaggacaatagttctcaaatgtggccacactttagaatcacccgagggagtatttaaaaatcccagtatccaagctgcaccctggacctgtcagaacagctggggagtgggactacatatcagtagttaaaactttctaagtgataccaatgtgtagctaaatttgagaaccagttctaaggttctcaaatttagcttctcaaatgttaaagtgcatgccarttccctggggtggggggtgttaggatacagattctcattctataggcctggggtgaggcctgggtttctgcattttcaacaagttcccaggtgctgttgaagaggatggtctgggacacacttttgagtactggagttggattagcaactaactcccctttgcctcccaacctgtgtaatttgcctcaccatcaccagccttgacatctaatatggggaaatgctcttttaaatccagccggcacagtgacaaaattacaggctatggaggcagacccaaattccaaccttcactttggc

SEQ ID NO: 131981 - DNA, 601 bp, Human
ctgctttggccaacagaccagtttgctgaccccgctgtaggacaatagttctcaaatgtggccacactttagaatcacccgagggagtatttaaaaatcccagtatccaagctgcaccctggacctgtcagaacagctggggagtgggactacatatcagtagttaaaactttctaagtgataccaatgtgtagctaaatttgagaaccagttctaaggttctcaaatttagcttctcaaatgttaaagtgcatgccaattccctggggtggggggtgttaggatacagattctcattctrtaggcctggggtgaggcctgggtttctgcattttcaacaagttcccaggtgctgttgaagaggatggtctgggacacacttttgagtactggagttggattagcaactaactcccctttgcctcccaacctgtgtaatttgcctcaccatcaccagccttgacatctaatatggggaaatgctcttttaaatccagccggcacagtgacaaaattacaggctatggaggcagacccaaattccaaccttcactttggcacttactgctgtgtgaccttgggcaagtctctggaatctctg

SEQ ID NO: 131982 - DNA, 601 bp, Human
tttgagaaccagttctaaggttctcaaatttagcttctcaaatgttaaagtgcatgccaattccctggggtggggggtgttaggatacagattctcattctataggcctggggtgaggcctgggtttctgcattttcaacaagttcccaggtgctgttgaagaggatggtctgggacacacttttgagtactggagttggattagcaactaactcccctttgcctcccaacctgtgtaatttgcctcaccatcaccagccttgacatctaatatggggaaatgctcttttaaatccagccrgcacagtgacaaaattacaggctatggaggcagacccaaattccaaccttcactttggcacttactgctgtgtgaccttgggcaagtctctggaatctctgtgcttgcctcttgaggtgtggagacatccactcatgcagatgctggaagaattaaataagataatatatatgtaaaacactccagacataccagattctcataaatagtagctgttaccattccttgcagagacttgggggttgtttctttgtttttttgtttttttagttttttccctctttccttgtccttcttgga

SEQ ID NO: 131983 - DNA, 601 bp, Human
ttgggtatgaggcaatctcctgctcttcctaggacttctctgtgacatccacaaggcatattgagtgccgtaaggcatttagtacaaattcaggaaacagtgaggggaagctgggaagaccatggattggtgggggcagaggggagggtcatgaccatgtagcaggaggtcaggttcatgatgttcatgaagtcgagatgaccatgaatttcctgtaactaacagggcatttttcttttttctttttcttttaatttttttttttgagacagagtctcgctatctcccaggctggagtgcrgtggcgcgatctcggctcactgcaagctccgcctcccgggttcacgccattctccggcctcagcctcccgagtagctgggactacaggcgtccaccaccacgcccggctaattttttgtatttttttttttttagtagagacggggtttcaccgtgttagccaggatggtctccatctcctgacctcgtgatctgcccgcctcggcctcccaaagtgctgggattacagccgtgagccaccgcgcccggccatttttcttttttaattaaaggaggtgtgagtactcctctcatgtgtat

SEQ ID NO: 131984 - DNA, 601 bp, Human
gggttcacgccattctccggcctcagcctcccgagtagctgggactacaggcgtccaccaccacgcccggctaattttttgtatttttttttttttagtagagacggggtttcaccgtgttagccaggatggtctccatctcctgacctcgtgatctgcccgcctcggcctcccaaagtgctgggattacagccgtgagccaccgcgcccggccatttttcttttttaattaaaggaggtgtgagtactcctctcatgtgtattgcttgttagtaattagccctgggaacctgccaggtasaggggtgtgggatgttcctggtggaggctgcatctgggaagcttaatggcccccaaacttcaggcgaaggagcatttaagaaggagaaggtgcacacagccccacggtgagcaaagggaaacctcagagctcctaagggctgattttctggaaaccacttccctcaacctgtgagcatgcgtctgcttcaggtaccttcctgttaccctatgctccaacttcagcagcctccgcaatagcacacttgcgtgagttcagccactgaggaatcaactggcaaggggggactcgatgcttcca

SEQ ID NO: 131985 - DNA, 601 bp, Human
accacgcccggctaattttttgtatttttttttttttagtagagacggggtttcaccgtgttagccaggatggtctccatctcctgacctcgtgatctgcccgcctcggcctcccaaagtgctgggattacagccgtgagccaccgcgcccggccatttttcttttttaattaaaggaggtgtgagtactcctctcatgtgtattgcttgttagtaattagccctgggaacctgccaggtagaggggtgtgggatgttcctggtggaggctgcatctgggaagcttaatggcccccaaacktcaggcgaaggagcatttaagaaggagaaggtgcacacagccccacggtgagcaaagggaaacctcagagctcctaagggctgattttctggaaaccacttccctcaacctgtgagcatgcgtctgcttcaggtaccttcctgttaccctatgctccaacttcagcagcctccgcaatagcacacttgcgtgagttcagccactgaggaatcaactggcaaggggggactcgatgcttccaatgcttttgggaagtcaagagtcagttttctcaggacttgtactctgcatgttcttcct

SEQ ID NO: 131986 - DNA, 601 bp, Human
ttgcgtgagttcagccactgaggaatcaactggcaaggggggactcgatgcttccaatgcttttgggaagtcaagagtcagttttctcaggacttgtactctgcatgttcttcctaagttggagaaacaccttgcagatggtctttagcatgtagactttcccaagggaagcctacctgagccaaggtgagctggttatggccagtcccttctcaggaccggattcagatgcgtgtgtctgggtagccaagtatagcacccaaatcaggcttggcttgggttgtggttctgtcactatccrgcagtgtgaccttaagttattagcttctctgtcccaatacctatccccttaggggtgcaatgaggcttaaatatgatcagacacacccagtgccaagcacagtgcctggcaaggaaggttagctgccattacagtattattgaattgactcagaaacttcagggtgttgagagaacggaagagcttgggttctccctgggttcttgacaagggtcttaccttgtagtttcaatcgggaaggatttccctttccatgaaccctgcttgtcatttgaaacatcagaaacaatgaactaagta

SEQ ID NO: 131987 - DNA, 601 bp, Human
gccctgtccactgcagggtgcctcttcctgcttggcacccattggactgggttggcagtgaagtctatgtgagttcttgttcagcaagagtggaaaacccttaaacaacatctcctatttgtgtaacatcagtttgcacgatgggcacaaaagtgcttaatttatctcaaggtgttttatggatggagacagaaatgagcggccgttcttcttcattgtctacaaccctacagccaggggaactagagggtttgcatccctacctgtaaacttcaatctcaccgtgaagaagaaggtcccygaagtctctgaacaccttgctctgtatgtatgtattctgagtggcagaattgtgggctgtaccaacatctgagcctgaggtagctttcttcatcattgtgtctccagcccatagccctgtgcctggcacatggtagacactccatatatttgtgaaataaagatatctattatagaaggcttcctgtcaaagcatatgcagaaaccccctgttttataaatttggtattcagtttaagaattaaactgagcctaggattagttttgttttatatagcatatatgtgctatataattatat

SEQ ID NO: 131988 - DNA, 601 bp, Human
tttttttttcttttcttggttacatttgctttgattttttttttaaataagaaaaccagtttgtgggcttcccttaagtatcactcaacttttactccttgagtcaagaatgtttactgtccctgcaggcctgtctgtatttctcctcttatgaattgagctcctaactaagccatgttaggtagaaagggatccggaattgaaaccagcccagcatttaaattgctttcatcttgcatcagctttttcttccacatttgcagatttttaatcttctaaactctttgcaaacatgaatctktatcctctcagaggaggaaatattaataagaactagcaaaagtccagtgctacaaacaaggaaactgaggcagcaatgctaactcattcaaaagctttcatttctggagttctcaatttcaagccagggaattgttcacattcttttcttccaaatgggcctctcagaagttcaccagacagaatcatttgtctctctgcctctgtccttaagaaaagtaaagtgtttagggagaaggtagagttatcaggacacagtactgggtccatcaagcctggcccagtctctccctgtcatctc

SEQ ID NO: 131989 - DNA, 601 bp, Human
tttactccttgagtcaagaatgtttactgtccctgcaggcctgtctgtatttctcctcttatgaattgagctcctaactaagccatgttaggtagaaagggatccggaattgaaaccagcccagcatttaaattgctttcatcttgcatcagctttttcttccacatttgcagatttttaatcttctaaactctttgcaaacatgaatctgtatcctctcagaggaggaaatattaataagaactagcaaaagtccagtgctacaaacaaggaaactgaggcagcaatgctaactcattcraaagctttcatttctggagttctcaatttcaagccagggaattgttcacattcttttcttccaaatgggcctctcagaagttcaccagacagaatcatttgtctctctgcctctgtccttaagaaaagtaaagtgtttagggagaaggtagagttatcaggacacagtactgggtccatcaagcctggcccagtctctccctgtcatctccccaacataatgatttggcttcatagaaaagatggctgtgtctactcataatttatgaacaatgaacatagttattaccttttggaagag

SEQ ID NO: 131990 - DNA, 601 bp, Human
tcctgcaaggcagtcatgtttgtctttgaacacacaggcgcagtagggtctatataacctgacatatgcagcctaaaaatcaccagagtttgctaagccatgtgataagaaccacagggcttacgggaaaaacaggattaaaaacacaacacttgaggccgggcgcagtggctcatgccttcaatcccagcactttgggaggctgaggcgggcggatcacttgaggtcaggagtttgagaccagcctggccaacacggtgaaactctgtctctaccaaaaatacaaaaatttagctgagcktggtggtgggcgcctgtagttccagctactcaggaggctgaggcaggagaatcacttgagcccgggaggcgaaggttgccgtgagccgagattacgccactgtactccagactaggtgacagaatgagactctgtctctgaaataaacttttttaaaaagcacaacacttgaaaacttcctcagcgacacattttgtttgttttgagatggagtcttgttctggtcacccaggctggagtgcagtggcacgatctcagctcactgcaacctctgcctcccaggttcaagcaattctcctg

SEQ ID NO: 131991 - DNA, 601 bp, Human
accagtgcacacagtggaccgaggcggctggtggatgtttgaggtgcgcatatgtacacacaggagcattgttagtattctcctatgtggttccattcagctggatgcaggcttctgaattcactaagtgttttccaaatgtgaaattgacattacactcaaattatccccaatatgtctatataattggaacagatttacactttcactacaataaatacacaactgactgtattttctacttctgctagacgtgatgctccttgtctggggcatgggtgctcaaagctgctggggtttyattccttcagtcaataaatatgcacagtaccaggcagtctgctaggctataaggatgcaacaagtaaagactcatctctttctttaagaggcagagaaaagtaaacatatcatcagcgtgcatgcagggtgactgactcctgccgtaagtctctgtctagtgcatgtaaaatacaaaggaaggagcagccatctcccaggatgaatcaagaagagcttcacaggggggcgacatgtgacacgagatgctttccaggcagaggaaacagcaaaggtgcagaggcaggagatggtcaggcca

SEQ ID NO: 131992 - DNA, 601 bp, Human
aaggatgcaacaagtaaagactcatctctttctttaagaggcagagaaaagtaaacatatcatcagcgtgcatgcagggtgactgactcctgccgtaagtctctgtctagtgcatgtaaaatacaaaggaaggagcagccatctcccaggatgaatcaagaagagcttcacaggggggcgacatgtgacacgagatgctttccaggcagaggaaacagcaaaggtgcagaggcaggagatggtcaggccatttgagaagtgcattaagattgtggtgagagataatgcaaataaaacagaygaatcacaaaggcccagttctgccagtctcaggtgttggggcttttctggaaagcagtgaggagccatcagatgtttccaagcagagcagaggcatggtgtgactttgttttagaaagatatcccaggctgcagcagtgtgaaaggaccctagagacggtgctggcacaggaaggcagagcaaggatgctggcttcttggaaccatgcacctgtgccatgcctttggcacttctgaccagtcatattggatagaaaccgaatgatctgcgtctgtatccaggaatagcccaacacccatg

SEQ ID NO: 131993 - DNA, 601 bp, Human
cacaggaaggcagagcaaggatgctggcttcttggaaccatgcacctgtgccatgcctttggcacttctgaccagtcatattggatagaaaccgaatgatctgcgtctgtatccaggaatagcccaacacccatgatgctgatgcctaggaatagaggaaagtagatgatctactcaccagggcctcagggatgtctcaactccaccttggatggcttttgctgctggacacaattgctgtggttcatagagccaacaatggggatggggccagtgagtggcttgagctaggaagtaagtrgaaggtgaatggctaccatctgccactgtcatttctcctatgggtcctctgtggctattaacctggcatctttggttaatcaatattaaaccagagcccttgtcatatgttcactttaagaacttgcattggtgaaggaagaagggaagatgctattccatttcttaatgcttcctaacacagtgcctggcacatggtaggtgctcaataaagtggcacgacctcagccttcctaaaaatgtcttttaaacaaggacagtgccaaagtaggaggaattgacgtgttttcagcaactgtta

SEQ ID NO: 131994 - DNA, 601 bp, Human
ggggccaggatgggtgagggcaacagggtgcagaggccattttagatcttgacgtgtgtgctgtgtaggcaacacagaaacggtgagtcacaggtgatcgagtccctggctccctggaggaaaaacaagtgtggtttctgaggggagcactgacccggccaattctggtttcagaggacctgagctgcttgccctggtcgtggtctctgcaaacaaaaatgaaagggcattcctgggggaggcattttgcagccctcttctcctactcccacctatcccttaagaaagattcttctccatrtgaagaaccacttgtgtcagttacctgtgagaggcacagacaagtctttctgacttctcaagagtgtcccaaacaagttagggttaaggattacccaggcttccatggagaagggtgccttacggaagaggtcttgacttctcagtgtggaagaaccttccaggtctcagctcttactgcttgaaggtccttggggtttcctactgagctctgcctctcctccttctaagaggcaagctgcctcacccaggccagggccgctctaaatgcagcctgtggacacgctttttgcttcctgtt

SEQ ID NO: 131995 - DNA, 601 bp, Human
tgtatatttgttaaagagctcccccagatgatttctgaagcacatgcaggtttcagaactatgccttcaaatgtcatccactctagacaggatcatttgcttttttgggcagcagtttctcaaaaagagcagcagcagtgctctcaaagatttctcaaaaacggcacattcatggagctttctgggagactgagaccataagcaggaggtaggaaagggaaacacggtcatcggtcatcagggtatctggtgagatgctggcttgaggagacgctgagccccctggggaactggagacagygctgttctgagggtgatcagagggtggcagccccagcccccacccaggagagccagaagcaggattcatcccctgtcctttctgctcaggggtctcgccttttaggtttctgataacagtatcagctaaagctctgagtaggcaattgttgaggactccgtgttatctccattgatgacttccctcaaacctgcctatgaaaccgtctccatttcaggaaagcctctctaggtgtcccttccacatccacctaaaacagacctttttctggattccttcttcatcccattcttcccccaa

SEQ ID NO: 131996 - DNA, 601 bp, Human
atttctgaagcacatgcaggtttcagaactatgccttcaaatgtcatccactctagacaggatcatttgcttttttgggcagcagtttctcaaaaagagcagcagcagtgctctcaaagatttctcaaaaacggcacattcatggagctttctgggagactgagaccataagcaggaggtaggaaagggaaacacggtcatcggtcatcagggtatctggtgagatgctggcttgaggagacgctgagccccctggggaactggagacagcgctgttctgagggtgatcagagggtggcasccccagcccccacccaggagagccagaagcaggattcatcccctgtcctttctgctcaggggtctcgccttttaggtttctgataacagtatcagctaaagctctgagtaggcaattgttgaggactccgtgttatctccattgatgacttccctcaaacctgcctatgaaaccgtctccatttcaggaaagcctctctaggtgtcccttccacatccacctaaaacagacctttttctggattccttcttcatcccattcttcccccaacttcccagaaagcaagaacacaggaacaca

SEQ ID NO: 131997 - DNA, 601 bp, Human
aacggcacattcatggagctttctgggagactgagaccataagcaggaggtaggaaagggaaacacggtcatcggtcatcagggtatctggtgagatgctggcttgaggagacgctgagccccctggggaactggagacagcgctgttctgagggtgatcagagggtggcagccccagcccccacccaggagagccagaagcaggattcatcccctgtcctttctgctcaggggtctcgccttttaggtttctgataacagtatcagctaaagctctgagtaggcaattgttgaggactcygtgttatctccattgatgacttccctcaaacctgcctatgaaaccgtctccatttcaggaaagcctctctaggtgtcccttccacatccacctaaaacagacctttttctggattccttcttcatcccattcttcccccaacttcccagaaagcaagaacacaggaacacaatcgaccccaggaagcaggtccaggtgtcttctctcctgatcgtcctgtccccactccgatcctaccttagctgtcttcctccgtgtcgctctcagggaggagatagagcatgggtaccaggggatcca

SEQ ID NO: 131998 - DNA, 601 bp, Human
tgggcaataacctgtgcctcagtgtggacatctttaactctgccctgcgggcaccagggcaagcctctctcacagcctggcatggatggagtgggcaggtagagccagcttttccaaagccctggtaacctcaagagagctaagtttgggaggtcacaggatgactctgggagactctcaggctttaatcagatctgtttaatgcccatctccaacccacaactcattgtggaacttgagcaagtaaattaatatctccaagtctccgtttctttacacttgcctcccatggaatctcctrtgtaacaggctcagcccggtgactgggacattgagcgggggctcaaatgatggcatccatccacctctccttatcccaggagctgtctgtgatcttttcctcttgctcccacaggcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcaga

SEQ ID NO: 131999 - DNA, 601 bp, Human
ggagtgggcaggtagagccagcttttccaaagccctggtaacctcaagagagctaagtttgggaggtcacaggatgactctgggagactctcaggctttaatcagatctgtttaatgcccatctccaacccacaactcattgtggaacttgagcaagtaaattaatatctccaagtctccgtttctttacacttgcctcccatggaatctcctatgtaacaggctcagcccggtgactgggacattgagcgggggctcaaatgatggcatccatccacctctccttatcccaggagctgtctgtgatcttttcctcttgctcccacaggcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacagtaaggacacgggcatgtggagggagggagcactcaggaccctcagtggccaaccactttccctctctgggtctgaac

SEQ ID NO: 132000 - DNA, 601 bp, Human
cttttctagtcctcttctctacccctgagattcccagggaagggtttgaagaggacagtgtaggcctacagatgaaggggaattggagccagacagcatgtggaacacacaccgccaatttcccattccaacacctctggaaaagatcgcgtccataaaccaccagcaccttttcccagtgaacttcaacttagcctttgcaatctaaacttccaagcagccattatcaaatgatcacaattggcatctaatttgcatcctgtttgccttccctaaaagagaagaatcttctagagtcccrtgtcctccaatttatacaccccaaacatctctaatcaagaaccatgaacacaagtgaaaaataccagtggcatgccatcctgggcattagagtttcttcctccatgccacccctgcatctctgcacacagactgtttctcatatccaatttctatacctaccccaagcctacctttcgaccacttatttcccatccaatcccatcctctgtttctctgcctttcatcctgagtcccaggcttccaatcctctggccaggtctggctatagcccctgacacaggagtttggggaggaatca

SEQ ID NO: 132001 - DNA, 601 bp, Human
agagtcccatgtcctccaatttatacaccccaaacatctctaatcaagaaccatgaacacaagtgaaaaataccagtggcatgccatcctgggcattagagtttcttcctccatgccacccctgcatctctgcacacagactgtttctcatatccaatttctatacctaccccaagcctacctttcgaccacttatttcccatccaatcccatcctctgtttctctgcctttcatcctgagtcccaggcttccaatcctctggccaggtctggctatagcccctgacacaggagtttggggaggaatcatggcttctctgcttcagaaaccccaaggaagtgttcagtataaagcactagtcttagatcagacagacctggatttaaatcctggctgtgatacttaccagctgtgtagcctaatgcaagttacttagccactctaagtccaatctctacatccataaaatggaaatagtatgcatttagagtcattatgaatatgaaataaacataggggtaaactgcgtttggtaagcataaaaaattataaagattatttataaagggactcttagaaggcaatgatggtgaaagaggt

SEQ ID NO: 132002 - DNA, 601 bp, Human
ccctgcatctctgcacacagactgtttctcatatccaatttctatacctaccccaagcctacctttcgaccacttatttcccatccaatcccatcctctgtttctctgcctttcatcctgagtcccaggcttccaatcctctggccaggtctggctatagcccctgacacaggagtttggggaggaatcatggcttctctgcttcagaaaccccaaggaagtgttcagtataaagcactagtcttagatcagacagacctggatttaaatcctggctgtgatacttaccagctgtgtagcytaatgcaagttacttagccactctaagtccaatctctacatccataaaatggaaatagtatgcatttagagtcattatgaatatgaaataaacataggggtaaactgcgtttggtaagcataaaaaattataaagattatttataaagggactcttagaaggcaatgatggtgaaagaggtttgtgtttcttccctagctgcatcggataagctgtgggtttgggggagaacagccaagtccagccttctatcttcagggctcaatccccactcgggcctgtggagctggtttctgagca

SEQ ID NO: 132003 - DNA, 601 bp, Human
gtatgcatttagagtcattatgaatatgaaataaacataggggtaaactgcgtttggtaagcataaaaaattataaagattatttataaagggactcttagaaggcaatgatggtgaaagaggtttgtgtttcttccctagctgcatcggataagctgtgggtttgggggagaacagccaagtccagccttctatcttcagggctcaatccccactcgggcctgtggagctggtttctgagcaccatctcacattccaatcacattttagtggcttctgaaaatctgccacagcctgtagsagagtctgagaccacatgtgccccacttcccttcctcccagagcctggtgatgtgctccccacttaccccatcccttcacctggccaggcttcctcagtggcgaggcctgggtgggatagtcagagagtggtcaccagcgacctgtggactgctgaggcccagcaggcctggccgcccatgaagagagagcccatggtgccctggaccaggaaataacctgcctccctgcatgagaagggcaagccgaggcaacagccagtgacctttgctcccgttccgtaccggaggcctccctggta

SEQ ID NO: 132004 - DNA, 601 bp, Human
tgagaaatccccactataaccaccagcccttttatctacctgaggagatgggagctatggtgtgggatgggggctctgtacctgtgtctttgcctgtgtatgcaccttgattctgtcttcactctgtctctccagtgtacgcacacaagcaggaacccccccagtattcccacacctcccggtttccatctgcaatggtggtcacagataccagcagcatcagtacactcaccaacatgtcttcaagtaaacaggtaatgccagcaggatttgcgggggttggggtgtgggcagggtgtgctaaggccatggatgtgcagaggttgtggcaagcatggactcggccagaaattagatccttctgaggctccctgttgtttgcaaagggaatccttaaggtcccagggcaaaaaaaaagggccacaggctgaaagggcttattgctcccccagattccccaggaagagcactaaacaaggacagaagtttgataggttgctggagactggatgacatagagcgcttaggcatttagattgagtgttccctaatagaatgatcaatggtccatggaaaaggtatttccaaggagggctcagga

SEQ ID NO: 132005 - DNA, 601 bp, Human
tatggtgtgggatgggggctctgtacctgtgtctttgcctgtgtatgcaccttgattctgtcttcactctgtctctccagtgtacgcacacaagcaggaacccccccagtattcccacacctcccggtttccatctgcaatggtggtcacagataccagcagcatcagtacactcaccaacatgtcttcaagtaaacaggtaatgccagcaggatttgcgggggttggggtgtgggcagggtgtgataaggccatggatgtgcagaggttgtggcaagcatggactcggccagaaattagrtccttctgaggctccctgttgtttgcaaagggaatccttaaggtcccagggcaaaaaaaaagggccacaggctgaaagggcttattgctcccccagattccccaggaagagcactaaacaaggacagaagtttgataggttgctggagactggatgacatagagcgcttaggcatttagattgagtgttccctaatagaatgatcaatggtccatggaaaaggtatttccaaggagggctcaggaggacagatcccctgctgaggttcatgctttgcaagagggatccctgaggatccac

SEQ ID NO: 132006 - DNA, 601 bp, Human
cagtacactcaccaacatgtcttcaagtaaacaggtaatgccagcaggatttgcgggggttggggtgtgggcagggtgtgataaggccatggatgtgcagaggttgtggcaagcatggactcggccagaaattagatccttctgaggctccctgttgtttgcaaagggaatccttaaggtcccagggcaaaaaaaaagggccacaggctgaaagggcttattgctcccccagattccccaggaagagcactaaacaaggacagaagtttgataggttgctggagactggatgacatagagygcttaggcatttagattgagtgttccctaatagaatgatcaatggtccatggaaaaggtatttccaaggagggctcaggaggacagatcccctgctgaggttcatgctttgcaagagggatccctgaggatccacaaagtagtcagcggagaaagtgagtaggaagtcagaggtcctgaggctgattcccctggacccagaatgccataagctctgggaatgacccagttgtgtcaacccatggggactccccagtagacagcctggcttttccaggggtaagcatccacttggggtttt

SEQ ID NO: 132007 - DNA, 601 bp, Human
tggatgtgcagaggttgtggcaagcatggactcggccagaaattagatccttctgaggctccctgttgtttgcaaagggaatccttaaggtcccagggcaaaaaaaaagggccacaggctgaaagggcttattgctcccccagattccccaggaagagcactaaacaaggacagaagtttgataggttgctggagactggatgacatagagcgcttaggcatttagattgagtgttccctaatagaatgatcaatggtccatggaaaaggtatttccaaggagggctcaggaggacagatyccctgctgaggttcatgctttgcaagagggatccctgaggatccacaaagtagtcagcggagaaagtgagtaggaagtcagaggtcctgaggctgattcccctggacccagaatgccataagctctgggaatgacccagttgtgtcaacccatggggactccccagtagacagcctggcttttccaggggtaagcatccacttggggttttatcaagaaatttagaatcaacttcctgctgcactgaaagtggggaatccagaggcttagtcactgtttcagttgatgactaagtcccac

SEQ ID NO: 132008 - DNA, 601 bp, Human
tttttggttttgttttaaggtcttatattccaacaggaatttcaaattcatttctggcgtgttcagatttattgcttatagcgatgtctgtttgcttcgctataaagaaatatctgaggctgggtaaaagaggttcaaaggctcatggttctgcaggctgcacaggaagcatgatgccagcatctgcctctgctgaaggcctcagaaggtttacaagcatggcggaaggtgcagacagggcaggtgcatcacgtggtgagagtgtgagcaggagggagaagggagaggccctgccctgggytcttatttatttatttatatttttatgttttgagacagggtcccgttctgtcacccaggctggagtgcagtggcgcaatcacagctcactgcagctttaacctcctgggctcaatcagtcctcccgcctcagcctccagagtagctgagactacaggcgcacaccacaatgacaggctaaatttttgcattttttttgttttgccatgttgcccaggctggtctcaaactcctgcgctcaagtgaactgcctgccttggcctcccaaagtgctgggattacaggtgtgagccaccatgcc

SEQ ID NO: 132009 - DNA, 601 bp, Human
gagaggccctgccctgggctcttatttatttatttatatttttatgttttgagacagggtcccgttctgtcacccaggctggagtgcagtggcgcaatcacagctcactgcagctttaacctcctgggctcaatcagtcctcccgcctcagcctccagagtagctgagactacaggcgcacaccacaatgacaggctaaatttttgcattttttttgttttgccatgttgcccaggctggtctcaaactcctgcgctcaagtgaactgcctgccttggcctcccaaagtgctgggattacmggtgtgagccaccatgcctagccctagactcttttaaacagccagatctcacgtgaactaactcaagcatgaattcctcacccatcaccatgatccattacctcccactgagcccgacctccaacactgggaatcacatttcaacatgagatttggaggggacacacatccagaccatatcattccacccctggcctcccaaatctcatgtccttctcacattgagaaatacagtcatcccttcccactagtccctgaaagtcttaactcattacagcattaactcaaagtccagagtct

SEQ ID NO: 132010 - DNA, 601 bp, Human
tgagcttgtaaaataaaaaaactatatacttacttccaaaatacaatggtggtacaggcattgggcagacgttcccatcccaaaagaaataaattggccaaaagaaaggggtaacaccccatgcaagtctgaaacccaacagggcaggcattaaatcttaaagctccaaaataatccttgattccatgtcccacatcctgggcacattggtgtgccaggtgggctcccaaggccttgggcagctctgttcctgtggcttttccatgctgaggttgcaagctgctagtggctttaccattcygaggtctagagggtggcaggcccattcccacagctccattaggcagtatcctggtagggactctgtgtgtggggcgggtggggctccaatcccacatttcccctcagcactgccctagtggaggttctctgtgggggctctgcccctgcagcaagcttctgcctgggcacccaggctttctgatacagcctttgaaatctaggtggaagctgccaaacctccttcactcttgcattctgtgcatctgcaggcttaacatcacatgaaacccaccaaagcttacagactgcaccctctaga

SEQ ID NO: 132011 - DNA, 601 bp, Human
tgtcccacatcctgggcacattggtgtgccaggtgggctcccaaggccttgggcagctctgttcctgtggcttttccatgctgaggttgcaagctgctagtggctttaccattccgaggtctagagggtggcaggcccattcccacagctccattaggcagtatcctggtagggactctgtgtgtggggcgggtggggctccaatcccacatttcccctcagcactgccctagtggaggttctctgtgggggctctgcccctgcagcaagcttctgcctgggcacccaggctttctgatamagcctttgaaatctaggtggaagctgccaaacctccttcactcttgcattctgtgcatctgcaggcttaacatcacatgaaacccaccaaagcttacagactgcaccctctagagtggtggtctgagctgtacctggggccctttgagccagggctgaagctagagcagcatgtatgcagggagcagtgtcccaaggctgtgcagggcagcagggcctttggtctggcccccaaaaccatattttcttcctaggcctctgggcctctagtgggaggggctgcctagaagatgtctgaaat

SEQ ID NO: 132012 - DNA, 601 bp, Human
cccacagctccattaggcagtatcctggtagggactctgtgtgtggggcgggtggggctccaatcccacatttcccctcagcactgccctagtggaggttctctgtgggggctctgcccctgcagcaagcttctgcctgggcacccaggctttctgatacagcctttgaaatctaggtggaagctgccaaacctccttcactcttgcattctgtgcatctgcaggcttaacatcacatgaaacccaccaaagcttacagactgcaccctctagagtggtggtctgagctgtacctggggcyctttgagccagggctgaagctagagcagcatgtatgcagggagcagtgtcccaaggctgtgcagggcagcagggcctttggtctggcccccaaaaccatattttcttcctaggcctctgggcctctagtgggaggggctgcctagaagatgtctgaaatacttcagtgccttttttccattgtcttggctatagcatgcagccctctttagtcaagctaatctctctagcaagctgttgctccataggccacttgaattccttctctaccacagggttaggctgcaaattttccaaactt

SEQ ID NO: 132013 - DNA, 601 bp, Human
attctgaagttcaaacttccacagatccctagaatatggacacaatgcagccaagttctctgcctgggcgtaaggagggtgacctttgctctagttcccaatcagttcctcatttccatctgagatctcatcagcctggccttcactctccatagttctatcaggattttggtcacaaccacttaacaggtctctaagaaattctaaactttccttcatcttcctgtcttcttctgttcctccaaactcccaatctctgcctgttacccattgccaaagctgcttccacatcttcaagtaycttttttttttgcggggagggggggcggcggggcggggggacggagttttgctcttgttgcccaagctggagtacaatggtgtgatctcagctcactgcagcctccacctcccaggttcaagcgattctgcctcagagtcctgagtagctaggattacaggcacaggccaccacgcctggctaattttttgtatttttagtagaaacagggattcaccatgttggccagcctggtctcgaactcctgacctcaggtgatccacctgcctcagcctcccaaagtgctgggattacaggcgt

SEQ ID NO: 132014 - DNA, 601 bp, Human
ccacagatccctagaatatggacacaatgcagccaagttctctgcctgggcgtaaggagggtgacctttgctctagttcccaatcagttcctcatttccatctgagatctcatcagcctggccttcactctccatagttctatcaggattttggtcacaaccacttaacaggtctctaagaaattctaaactttccttcatcttcctgtcttcttctgttcctccaaactcccaatctctgcctgttacccattgccaaagctgcttccacatcttcaagtaccttttttttttgcggggrgggggggcggcggggcggggggacggagttttgctcttgttgcccaagctggagtacaatggtgtgatctcagctcactgcagcctccacctcccaggttcaagcgattctgcctcagagtcctgagtagctaggattacaggcacaggccaccacgcctggctaattttttgtatttttagtagaaacagggattcaccatgttggccagcctggtctcgaactcctgacctcaggtgatccacctgcctcagcctcccaaagtgctgggattacaggcgtgagccactgcacctggcc

SEQ ID NO: 132015 - DNA, 601 bp, Human
caatgcagccaagttctctgcctgggcgtaaggagggtgacctttgctctagttcccaatcagttcctcatttccatctgagatctcatcagcctggccttcactctccatagttctatcaggattttggtcacaaccacttaacaggtctctaagaaattctaaactttccttcatcttcctgtcttcttctgttcctccaaactcccaatctctgcctgttacccattgccaaagctgcttccacatcttcaagtaccttttttttttgcggggagggggggcggcggggcggggggayggagttttgctcttgttgcccaagctggagtacaatggtgtgatctcagctcactgcagcctccacctcccaggttcaagcgattctgcctcagagtcctgagtagctaggattacaggcacaggccaccacgcctggctaattttttgtatttttagtagaaacagggattcaccatgttggccagcctggtctcgaactcctgacctcaggtgatccacctgcctcagcctcccaaagtgctgggattacaggcgtgagccactgcacctggccatcttcaagtatctttatagtaat

SEQ ID NO: 132016 - DNA, 601 bp, Human
aaatcccacccccatctcacaaaatattcaatgtgcctaacagaatgcctagtacatagtcaagtattcaaagtggtagccccctccctgttttctctcccgtctgtgatcctttaggagatagttgtctccccttccagtgactcttttttttttttttttttttttttgagatggaatctcactctgtcacccaggctggagtgcaatggtgtggtctcagctcactgcaacctccgcctactgggtacaagcaattctcccgcctcagcctcccaagtaactggaactacaggcacasgccaccacacctggctaattttttgtatttttagtagagacggggtttcactatgttggccaggctgctctcaaattcctgacctcgtgatctgcccgcctctgcctcccaaagtgctggaattacaggtgtgagccactggacccggcctagtgactctttcaatatccaattcagtgcttggtctacatgcagtcaaaggaggctgggagaagaaaatgtctcaggattactaccatctctcaagcacatcctacctcttgggcctgggctccggatccctgtttcccattctcctgc

SEQ ID NO: 132017 - DNA, 601 bp, Human
actacaggcacaggccaccacacctggctaattttttgtatttttagtagagacggggtttcactatgttggccaggctgctctcaaattcctgacctcgtgatctgcccgcctctgcctcccaaagtgctggaattacaggtgtgagccactggacccggcctagtgactctttcaatatccaattcagtgcttggtctacatgcagtcaaaggaggctgggagaagaaaatgtctcaggattactaccatctctcaagcacatcctacctcttgggcctgggctccggatccctgtttsccattctcctgctgatacacagactccctgctcacctatttcccaggaaaaaagcaaatagttcagggcctgtcaaagcacccataccctttgggcttagccaaatgcctgggctatattagatgttcagtaaataacaaagaatgaatgaacgaacgaacgaatgaatgcagaacccgtgttttttgatgcctccattttccaagcagcaccccagatgcttttctagcttacatttcctggagaaccctcttacccattctgcaaggtcgttatttttatacctgatttacaaagcag

SEQ ID NO: 132018 - DNA, 601 bp, Human
tcctgacctcgtgatctgcccgcctctgcctcccaaagtgctggaattacaggtgtgagccactggacccggcctagtgactctttcaatatccaattcagtgcttggtctacatgcagtcaaaggaggctgggagaagaaaatgtctcaggattactaccatctctcaagcacatcctacctcttgggcctgggctccggatccctgtttcccattctcctgctgatacacagactccctgctcacctatttcccaggaaaaaagcaaatagttcagggcctgtcaaagcacccataccytttgggcttagccaaatgcctgggctatattagatgttcagtaaataacaaagaatgaatgaacgaacgaacgaatgaatgcagaacccgtgttttttgatgcctccattttccaagcagcaccccagatgcttttctagcttacatttcctggagaaccctcttacccattctgcaaggtcgttatttttatacctgatttacaaagcagaaaactgaggttcaaagatgggtatggatctggtcaagttcaaacagatcataaattccagagctggacttccagactggctttctcac

SEQ ID NO: 132019 - DNA, 601 bp, Human
ccggcctagtgactctttcaatatccaattcagtgcttggtctacatgcagtcaaaggaggctgggagaagaaaatgtctcaggattactaccatctctcaagcacatcctacctcttgggcctgggctccggatccctgtttcccattctcctgctgatacacagactccctgctcacctatttcccaggaaaaaagcaaatagttcagggcctgtcaaagcacccataccctttgggcttagccaaatgcctgggctatattagatgttcagtaaataacaaagaatgaatgaacgaaagaacgaatgaatgcagaacccgtgttttttgatgcctccattttccaagcagcaccccagatgcttttctagcttacatttcctggagaaccctcttacccattctgcaaggtcgttatttttatacctgatttacaaagcagaaaactgaggttcaaagatgggtatggatctggtcaagttcaaacagatcataaattccagagctggacttccagactggctttctcactccaaactcattaaacaacgttcatcttccaatatccacttttaagcacccataataacaacccaagg

SEQ ID NO: 132020 - DNA, 601 bp, Human
cctagtgactctttcaatatccaattcagtgcttggtctacatgcagtcaaaggaggctgggagaagaaaatgtctcaggattactaccatctctcaagcacatcctacctcttgggcctgggctccggatccctgtttcccattctcctgctgatacacagactccctgctcacctatttcccaggaaaaaagcaaatagttcagggcctgtcaaagcacccataccctttgggcttagccaaatgcctgggctatattagatgttcagtaaataacaaagaatgaatgaacgaacgaaygaatgaatgcagaacccgtgttttttgatgcctccattttccaagcagcaccccagatgcttttctagcttacatttcctggagaaccctcttacccattctgcaaggtcgttatttttatacctgatttacaaagcagaaaactgaggttcaaagatgggtatggatctggtcaagttcaaacagatcataaattccagagctggacttccagactggctttctcactccaaactcattaaacaacgttcatcttccaatatccacttttaagcacccataataacaacccaaggttat

SEQ ID NO: 132021 - DNA, 601 bp, Human
gataatgatacctctttcatgggatcactgaaaggactaactgcacgaagacctgtaaaatacttcactcagcgcatgtcccaaaggaaacacccagcccatggaagctgggtcactcttggcttcccctgctagcacccctgagcggctctgagtttgggaaaagggtcttacgtggcaaagggcatttatttccccgtgttgagggggttgaaagaagtgctcttacataggggtgaagagcacaagccttgctgttgtgagaccccggccaacttacttatcacctctccaggccacrcttccctcatctgtaaaaccggaattataatcatgacttttaattaatggagccacaatgaatctcacataagttcatggtcatagaagtgacttatctgtcctcactgtctccacttcctcaccctcaattctctcttgagatcactgcagactggcctttatcctcacgcctcactgtgtccagctcacgatcccctccatgctgctgaaaccaatggttacttttcaacctctgtctctgacacagctgatctctccctccttttttccatgggagtttgggatactaccattcctg

SEQ ID NO: 132022 - DNA, 601 bp, Human
taccattcctggttcttctacggcactggccacttctcatctcctcagctggcaactcatcttcccaatatttatgtgttggagggccccgggcctcattctttggcctcttctcatctgtgctcactcctgggtgatctcctccagtcccatggctttaggtcaagtgtacacgccgatggttcctgtaattctgtgtacagtccggtcttccctactgagtgctcactcacagatccagtgctgcttcggcagggacagacgcatgtctaaaatatctaataagcctcttgaattcaaygtgcctaaaataggaactcttcattttgccctatttcatcctatcaaaattgcttcccccatgggcttctccatttccaaaactggtaccagttgttcaagtgagagagctgagagtatccctgattcttctctccacatcacatcagtctctcaataagttctactaggggaccctcagaatacatcctaaatctgacctcttctcacactcccatcaggactgccctagtcccagcccaggcccccttgtctctccctgatctccttaggtggcccttgcctgtctcccacttccacc

SEQ ID NO: 132023 - DNA, 601 bp, Human
cctctatgcttatttttctatggagtgctcatctccacctaaagttgtagtgtgtgtgtgtgtgtgtgtgtgtgtgtgcacgcatttgtttacttgtttattattcaaagccttcactaggaggtaaagcctgtgaagaagtgggcagggtgttgtttacagctgcatctccagtgtctaaaaaagtgccaagtacacagtaggcactcaaacgtgttaaatgaattcacgataatcacctacttcaaagggtcgacgtaagaactcgaggcagtgatgcttgtgaagcccttggtatggygcctggcacacagtaggatgtcgataaatgttagctcttaccattatgtaacaaatcctcttagaataaggatgtccttcacatttgccacagctaccacacctttcagacggagggccccgcggtctctcagagatcttctgggccaggcccccgtggggctgcgtgtgctgggcctccagttctaagggaccacagtgcaccccttatcagatgtttgtgtttagactctgaaggaggcaaataactctagttcttttgacaacattttgggctctgccaccattttattatgtgagc

SEQ ID NO: 132024 - DNA, 601 bp, Human
atcacctacttcaaagggtcgacgtaagaactcgaggcagtgatgcttgtgaagcccttggtatggtgcctggcacacagtaggatgtcgataaatgttagctcttaccattatgtaacaaatcctcttagaataaggatgtccttcacatttgccacagctaccacacctttcagacggagggccccgcggtctctcagagatcttctgggccaggcccccgtggggctgcgtgtgctgggcctccagttctaagggaccacagtgcaccccttatcagatgtttgtgtttagactctgraggaggcaaataactctagttcttttgacaacattttgggctctgccaccattttattatgtgagcaaacatttgatagctgggaagcccatccctaatgacaggccatagaatctcactggcgtctccttatctgcccttcttgtttgctcttcttttgaaacctgcaaggtcacaagccgttttctctctcctccacctgaaatctgaaaattggaaaaaggctgatagtgggaagtaaagagacttgagagtgggggtgggccaggggaggaagaggaggcaaagggtatcagagga

SEQ ID NO: 132025 - DNA, 601 bp, Human
acaggccatagaatctcactggcgtctccttatctgcccttcttgtttgctcttcttttgaaacctgcaaggtcacaagccgttttctctctcctccacctgaaatctgaaaattggaaaaaggctgatagtgggaagtaaagagacttgagagtgggggtgggccaggggaggaagaggaggcaaagggtatcagaggaccctgaccaacgtctcaagaatgtggaagggtcagaagcctgtctcctcacatgcacgcactgctcagcccccctcttttttttttttttttttttttttgtgagaccaagtcttgctctgtcgcccaggctggagtgcagtagcataatatcggctcaccacaacctccgcctcctgggttcaaacgattctcttgcctcagcctctcaagtagctgggactacaggtgtgcaccaccatgcccagctaatttttgtatttttagtagggatgtggtttcactatgttggccaggctgatctcgatctcctgaccttgtgatccacctgccttggcctctcaaagtgctgggattacaggcgtgaggcactgcgccaggccttcagccccactcttaaga

SEQ ID NO: 132026 - DNA, 601 bp, Human
gtctcaagaatgtggaagggtcagaagcctgtctcctcacatgcacgcactgctcagcccccctcttttttttttttttttttttttttgtgagaccaagtcttgctctgtcgcccaggctggagtgcagtagcataatatcggctcaccacaacctccgcctcctgggttcaaacgattctcttgcctcagcctctcaagtagctgggactacaggtgtgcaccaccatgcccagctaatttttgtatttttagtagggatgtggtttcactatgttggccaggctgatctcgatctccygaccttgtgatccacctgccttggcctctcaaagtgctgggattacaggcgtgaggcactgcgccaggccttcagccccactcttaagagtactgaggagcagcaggggcttgggccgaagaaccccatgttaataataacaattgtgccaaggaccatgctcaggactccacaggtgttgactcatctaatcacacaacaactcccatattataggggaagaaactgaggcacagagagagtaacttgtccaagagcacaaagcttagtagaaggctcctcacctccaagcatgattga

SEQ ID NO: 132027 - DNA, 601 bp, Human
ggctggagtgcagtagcataatatcggctcaccacaacctccgcctcctgggttcaaacgattctcttgcctcagcctctcaagtagctgggactacaggtgtgcaccaccatgcccagctaatttttgtatttttagtagggatgtggtttcactatgttggccaggctgatctcgatctcctgaccttgtgatccacctgccttggcctctcaaagtgctgggattacaggcgtgaggcactgcgccaggccttcagccccactcttaagagtactgaggagcagcaggggcttgggcygaagaaccccatgttaataataacaattgtgccaaggaccatgctcaggactccacaggtgttgactcatctaatcacacaacaactcccatattataggggaagaaactgaggcacagagagagtaacttgtccaagagcacaaagcttagtagaaggctcctcacctccaagcatgattgaaagagcacatgctgagtggccacctagacagctagtttgaagctgtggctccacactctcctagttcttaaaccatggacaattcactgactctcttttagccttgttttcctaatc

SEQ ID NO: 132028 - DNA, 601 bp, Human
cgaagaaccccatgttaataataacaattgtgccaaggaccatgctcaggactccacaggtgttgactcatctaatcacacaacaactcccatattataggggaagaaactgaggcacagagagagtaacttgtccaagagcacaaagcttagtagaaggctcctcacctccaagcatgattgaaagagcacatgctgagtggccacctagacagctagtttgaagctgtggctccacactctcctagttcttaaaccatggacaattcactgactctcttttagccttgttttcctaatytgtcaaatagacataatggtatcctcatatagggttatggttggagcactgatcaatgcgataacagtggcctttagtggtattggtaggtgtaagtgtgtgtgtgtgtgtgtgtgtgtgtgtgtgtgtgtgtgtgtgtgtgtttggggggatcttgagagaataagccactaagtcaaaggcagaaccttagatgccggcaaaagcaaaagggaaggaggagacacagggagacaaaaagagactccccagaagtgaaaaggaaagcagtgacactccatgacagttcaaatgaataag

SEQ ID NO: 132029 - DNA, 601 bp, Human; identical to SEQ ID NO: 131926

SEQ ID NO: 132030 - DNA, 601 bp, Human; identical to SEQ ID NO: 131927

SEQ ID NO: 132031 - DNA, 601 bp, Human; identical to SEQ ID NO: 131928

SEQ ID NO: 132032 - DNA, 601 bp, Human; identical to SEQ ID NO: 131929

SEQ ID NO: 132033 - DNA, 601 bp, Human; identical to SEQ ID NO: 131930

SEQ ID NO: 132034 - DNA, 601 bp, Human; identical to SEQ ID NO: 131931

SEQ ID NO: 132035 - DNA, 601 bp, Human; identical to SEQ ID NO: 131932

SEQ ID NO: 132036 - DNA, 601 bp, Human; identical to SEQ ID NO: 131933

SEQ ID NO: 132037 - DNA, 601 bp, Human; identical to SEQ ID NO: 131934

SEQ ID NO: 132038 - DNA, 601 bp, Human; identical to SEQ ID NO: 131935

SEQ ID NO: 132039 - DNA, 601 bp, Human; identical to SEQ ID NO: 131936

SEQ ID NO: 132040 - DNA, 601 bp, Human; identical to SEQ ID NO: 131937

SEQ ID NO: 132041 - DNA, 601 bp, Human; identical to SEQ ID NO: 131938

SEQ ID NO: 132042 - DNA, 601 bp, Human; identical to SEQ ID NO: 131939

SEQ ID NO: 132043 - DNA, 601 bp, Human; identical to SEQ ID NO: 131940

SEQ ID NO: 132044 - DNA, 601 bp, Human; identical to SEQ ID NO: 131941

SEQ ID NO: 132045 - DNA, 601 bp, Human; identical to SEQ ID NO: 131942

SEQ ID NO: 132046 - DNA, 601 bp, Human; identical to SEQ ID NO: 131977

SEQ ID NO: 132047 - DNA, 601 bp, Human; identical to SEQ ID NO: 131978

SEQ ID NO: 132048 - DNA, 601 bp, Human; identical to SEQ ID NO: 131979

SEQ ID NO: 132049 - DNA, 601 bp, Human; identical to SEQ ID NO: 131980

SEQ ID NO: 132050 - DNA, 601 bp, Human; identical to SEQ ID NO: 131981

SEQ ID NO: 132051 - DNA, 601 bp, Human; identical to SEQ ID NO: 131982

SEQ ID NO: 132052 - DNA, 601 bp, Human; identical to SEQ ID NO: 131983

SEQ ID NO: 132053 - DNA, 601 bp, Human; identical to SEQ ID NO: 131984

SEQ ID NO: 132054 - DNA, 601 bp, Human; identical to SEQ ID NO: 131985

SEQ ID NO: 132055 - DNA, 601 bp, Human; identical to SEQ ID NO: 131986

SEQ ID NO: 132056 - DNA, 601 bp, Human; identical to SEQ ID NO: 131987

SEQ ID NO: 132057 - DNA, 601 bp, Human; identical to SEQ ID NO: 131988

SEQ ID NO: 132058 - DNA, 601 bp, Human; identical to SEQ ID NO: 131989

SEQ ID NO: 132059 - DNA, 601 bp, Human; identical to SEQ ID NO: 131990

SEQ ID NO: 132060 - DNA, 601 bp, Human; identical to SEQ ID NO: 131991

SEQ ID NO: 132061 - DNA, 601 bp, Human; identical to SEQ ID NO: 131992

SEQ ID NO: 132062 - DNA, 601 bp, Human; identical to SEQ ID NO: 131993

SEQ ID NO: 132063 - DNA, 601 bp, Human; identical to SEQ ID NO: 131994

SEQ ID NO: 132064 - DNA, 601 bp, Human; identical to SEQ ID NO: 131995

SEQ ID NO: 132065 - DNA, 601 bp, Human; identical to SEQ ID NO: 131996

SEQ ID NO: 132066 - DNA, 601 bp, Human; identical to SEQ ID NO: 131997

SEQ ID NO: 132067 - DNA, 601 bp, Human; identical to SEQ ID NO: 131998

SEQ ID NO: 132068 - DNA, 601 bp, Human; identical to SEQ ID NO: 131999

SEQ ID NO: 132069 - DNA, 601 bp, Human; identical to SEQ ID NO: 132000

SEQ ID NO: 132070 - DNA, 601 bp, Human; identical to SEQ ID NO: 132001

SEQ ID NO: 132071 - DNA, 601 bp, Human; identical to SEQ ID NO: 132002

SEQ ID NO: 132072 - DNA, 601 bp, Human; identical to SEQ ID NO: 132003

SEQ ID NO: 132073 - DNA, 601 bp, Human; identical to SEQ ID NO: 132004

SEQ ID NO: 132074 - DNA, 601 bp, Human; identical to SEQ ID NO: 132005

SEQ ID NO: 132075 - DNA, 601 bp, Human; identical to SEQ ID NO: 132006

SEQ ID NO: 132076 - DNA, 601 bp, Human; identical to SEQ ID NO: 132007

SEQ ID NO: 132077 - DNA, 601 bp, Human; identical to SEQ ID NO: 132008

SEQ ID NO: 132078 - DNA, 601 bp, Human; identical to SEQ ID NO: 132009

SEQ ID NO: 132079 - DNA, 601 bp, Human; identical to SEQ ID NO: 132010

SEQ ID NO: 132080 - DNA, 601 bp, Human; identical to SEQ ID NO: 132011

SEQ ID NO: 132081 - DNA, 601 bp, Human; identical to SEQ ID NO: 132012

SEQ ID NO: 132082 - DNA, 601 bp, Human; identical to SEQ ID NO: 132013

SEQ ID NO: 132083 - DNA, 601 bp, Human; identical to SEQ ID NO: 132014

SEQ ID NO: 132084 - DNA, 601 bp, Human; identical to SEQ ID NO: 132015

SEQ ID NO: 132085 - DNA, 601 bp, Human; identical to SEQ ID NO: 132016

SEQ ID NO: 132086 - DNA, 601 bp, Human; identical to SEQ ID NO: 132017

SEQ ID NO: 132087 - DNA, 601 bp, Human; identical to SEQ ID NO: 132018

SEQ ID NO: 132088 - DNA, 601 bp, Human; identical to SEQ ID NO: 132019

SEQ ID NO: 132089 - DNA, 601 bp, Human; identical to SEQ ID NO: 132020

SEQ ID NO: 132090 - DNA, 601 bp, Human; identical to SEQ ID NO: 132021

SEQ ID NO: 132091 - DNA, 601 bp, Human; identical to SEQ ID NO: 132022

SEQ ID NO: 132092 - DNA, 601 bp, Human; identical to SEQ ID NO: 132023

SEQ ID NO: 132093 - DNA, 601 bp, Human; identical to SEQ ID NO: 132024

SEQ ID NO: 132094 - DNA, 601 bp, Human; identical to SEQ ID NO: 132025

SEQ ID NO: 132095 - DNA, 601 bp, Human; identical to SEQ ID NO: 132026

SEQ ID NO: 132096 - DNA, 601 bp, Human; identical to SEQ ID NO: 132027

SEQ ID NO: 132097 - DNA, 601 bp, Human; identical to SEQ ID NO: 132028

SEQ ID NO: 132098 - DNA, 601 bp, Human
ctactcaggagatttaggtggaaaaatcacttgagaccaggagttcaagactgcctgggaaacagagcaagagcctgtctctgaaataaataaataaagtcaattcattctttttttttttttttttggaaacagggtcttactctgtcactcaggctggagtgcagtggtgtgatcttggctcactgcagcctcgaacccccaggctcaagtgatcctcttgcctcagcctctcaagcagctgggtctacaggcatgtgccatcacactcaagttaatttttggtttcgggttttttttkttgttgttgttgaagaaacagcgttttgccatgttgcccaggctggtctcaaactcctgagctcaagcaatccgcctgcctcagcctcccaaagtgctgggatttacaggtgtaagctaccccatttggccaaactatctttcaagttgtgaattagatgataaatcaagagacttgtggctacattcacatgtcttttaattccatagctgagcaaggaacatatagtttttatacacattcatcattctttatatacttgtggatatagtacaggaatcagtaaactactattcagcc

SEQ ID NO: 132099 - DNA, 601 bp, Human
caaattcctgtttaggggaacaaaaaaatccccaccccaaacccatcggctttgattagtgtctttacagcagccatgctttagaagtaaacagaaaaaacacaagcaaacagttgtttaaaaagtctaaatatggcaaaaggccacaatactggcacaggtaataggaagtcatgggaaaaatctaagaggcttacaagcagtagtgacaacaaaaaattggaatagttatgagtttaggaatgaagctaaacatactgctctaaaaactaaaattagtctgagctgggcacagtagcatgcacctataatcccagctactcaggagatttaggtggaaaaatcacttgagaccaggagttcaagactgcctgggaaacagagcaagagcctgtctctgaaataaataaataaagtcaattcattctttttttttttttttttggaaacagggtcttactctgtcactcaggctggagtgcagtggtgtgatcttggctcactgcagcctcgaacccccaggctcaagtgatcctcttgcctcagcctctcaagcagctgggtctacaggcatgtgccatcacactcaagttaatttttg

SEQ ID NO: 132100 - DNA, 601 bp, Human
tctttaaactgttatcatcttttttattttttagaggtggggggtctcactttgttgtctaggctgaccttgaattcctgggctcaagaaatcctcccactttggcctcccaaagtgttaggattacaggtgtgagccaaccatacccaaatctgaagtgttatcatctttttaaaagcattcatttagggccggacgcggtggctaacccctgtaatcccagcactttgggaggcagaggtgggcagatcagttgaggccaagagtttgagaccagccttgcaaacatggcaaaaccctstctctactaaaaatataaaaattagctgggcatggtggcgctaatcccagctatgccagaggctgaggcacgagaatcgcttgagcctgggaggcagaagttgcagtgagccaagatcacgctactgcgctcccgcctggctaacaaggtgagagtctgtcacaaaaaaaataaaaaataaaagcactcatctaaacatcttacagtttactatggggcagagggaaagaattattatttatgttgtgttaaagctaactatgtataaagattaataacataagttccagttatagctca

SEQ ID NO: 132101 - DNA, 601 bp, Human
ttcatgtctaaaatatcctatgtataaaacagtgaaatcaggccgggcacggtggctcacgcctgtaatcccagcactttgggaggctgaggcgggtggaccatgaggtcaggagatcgagactatcctggctaacatggtgaaaccccgtctctactaaaaaatacaaaaaattagccaggcatggtggcgggtgcctgtagtcccagctactcgggaggctgaggcaggagaatggcgtgaacccgggaggcggagcttgcagcgagccaagatcgcgccactgcactccagcctaggygatagagcgagactccgtctcaaaaaaaataaaaaaaaaaacagtgaaatcactataagtgaaaggaactgccagtaggtgaatatacagagaccaggctggacctctgctctactaattgttaaaggatttaaaggctaataatatgtgccaaagaaatacaatttgaaaaatacagtgaaaggtgaaggggtccacagatccaagcctaggagagaaaactttctaaaattacctttccagaacagagggagaagaaattgtgaactgtactaaggtgcaaccctgagaagtactgga

SEQ ID NO: 132102 - DNA, 601 bp, Human
ctattcctcaggaatgtgttgaagctatagaagataacaaatgtgaaacctcacaaaaatgaaacagcaacaaacattcaaggttgagcctgagcaacatagtgagaccctgtctctacaaaaaaattttaaaaattagccaggtgtgatggtgcacgcctggagtcccagctactcaggtagctgaggtgggaggatagtttgagcccaggaggttgaggctgcagtgagccatgattgtgccactgcactccagcatgggcaacagggcgtgaccctgtctcaaaaaaaaaaaaaaaaatcaagattgtaaagacagctaagtattgtacagtattaagaacacagacttggggatgactctacctcttgctggctgtatgatctcaggcaagttatctaacctttctatgcttcaatgtcctcatccacaaaaatgaggataataataatatgcaactcataaggttttgaggattaaatgacttaatatatatgaagagcttagaatggtaactaatagtaaatgctatatgtattagcaattattactgatagtattcatgtctaaaatatcctatgtataaaacagtgaaatcag

SEQ ID NO: 132103 - DNA, 601 bp, Human
ctgcttgcttggcaagaaaaccaactcagaggccttaactgcagggaggccaatcaaaatccctactgcgaccaaacaagtagaaacctgtgacacaggtattccccagaagcaacactatttaagtcatttccccccaagcttttggccaagatgcacacaaacaattttgtgcagggaagatcatgtgatctaatggctaaagtaagcaaccaggaagcattaggccaagcttatccaacctgtcgctcgtgagtcacatgcagcccaggacggctttgaatgcagcgcaatacaaatycgtaaacttttttaagacattatgagtttgtttgttttttattccttagctcatcagctatcgttaatgtattttatgtgtggcccaggacacttcttcttccagtgtgggccagggaagccaaaagattgacacccctggattaggcaaattacttaacttctttgtctgcttccctgaatgtaaaacaggaaaatatctattcctcaggaatgtgttgaagctatagaagataacaaatgtgaaacctcacaaaaatgaaacagcaacaaacattcaaggttgagcctgagcaacata

SEQ ID NO: 132104 - DNA, 601 bp, Human
taaaaaaggccaggcatggtggctcacacctgtaatcccagcactttgagaaactgaggtgggcagatgggttgagcttaggagttcgagaccagcctgggcaacatagtgaaaccctgtctctacaaaaatgtaccaaaaatatagccagacatggtggtatgtgcctgtagtcccagctacttgggaggctgaggtgggaggattgctatagcctgggaggcagaggctgtggtgagctaagattgcaccactgcactccaacctgggctacagagggcgtctcaaaaaaaaaaaaaaagccaaaaaacaaaaaaacctgtaatcccagactttgggaggctgaggtgggaggatcgcttgaggccaggagttttgagaccagcctgggtaacacattgagattctgtctctacaaaaattttttttataaattagccaagtgtggtggcgtgtgcctgttgtcctagctacttgtgaggctaaggcggaaggatcatttgagcccaggaattcaaggctacagtgagctaaagattgtaccactgcattccatcctgggcaacagaatgagactctgtttcttttaaaaaaaaaagcc

SEQ ID NO: 132105 - DNA, 601 bp, Human
ttgtgtaggagtgatttaatttttaaaaaaggccaggcatggtggctcacacctgtaatcccagcactttgagaaactgaggtgggcagatgggttgagcttaggagttcgagaccagcctgggcaacatagtgaaaccctgtctctacaaaaatgtaccaaaaatatagccagacatggtggtatgtgcctgtagtcccagctacttgggaggctgaggtgggaggattgctatagcctgggaggcagaggctgtggtgagctaagattgcaccactgcactccaacctgggctacagarggcgtctcaaaaaaaaaaaaaaagccaaaaaacaaaaaaacctgtaatcccagactttgggaggctgaggtgggaggatcgcttgaggccaggagttttgagaccagcctgggtaacacattgagattctgtctctacaaaaattttttttataaattagccaagtgtggtggcgtgtgcctgttgtcctagctacttgtgaggctaaggcggaaggatcatttgagcccaggaattcaaggctacagtgagctaaagattgtaccactgcattccatcctgggcaacagaatgagactc

SEQ ID NO: 132106 - DNA, 601 bp, Human
atagggttgctacatataaaagtccagatatcatagaatgcctatacctgtcactgttttataacacagttgctgtggaatgatgggctttagaatgttatgctggtggagatgcactttacaagcctatgtggtagaagtggtgggtagaaacaaggataggaagtgcctctgacatacagtataaccaaatacaagttttatagtggactctatctcttaagagaaaggaaggattaggaagtcaacagttaaagccagaaagggaaacaaatacaataatgatagctaaaacacactragtacttaccatatttcaggatctttttttttgagatggagtctcgctctgtctcccaggctggagtgcagtggcatgatctcagctcactgcaacctccacctcccaggttcaagccattctcctgcctcagcctcccaagtaactgggattacaggtgcacgccaccatacccagctaatttttgtatttttagtagagatggggttttgccacattggccagggtggtctgcaactcctgacctcaagtgatccaccgccttggcctcccaaagtgctgggaatacaggtgtgagcc

SEQ ID NO: 132107 - DNA, 601 bp, Human
gatactctctttttcttttctctctctctctacatgttctcatctgaaggatattcttagactggaaagttcaataccaaaatcttacatgctgggctatgagcagatgtcctatatatatgtatgtaacttcaatcactgggagatgtccaggagtactttatccaggtcattctcccttgggtctgagataaaaataacctaagtcctatctggataatctgaagaagggaggaaatgcagtatttttaaaagtttagggtaaaaaagaaaaattaactaccatggattctttttgttyatttctaacaagttcaaatatttaaacattggtttacttttccttatcctgcccacaaactaaaaataattcaatactgtcaggtccaagatttaaggcaatagttttcaaactcttttttttttttaggtagcagaactctttctacaaatgaaatatttcttgatttatagggttgctacatataaaagtccagatatcatagaatgcctatacctgtcactgttttataacacagttgctgtggaatgatgggctttagaatgttatgctggtggagatgcactttacaagcctatg

SEQ ID NO: 132108 - DNA, 601 bp, Human
tttaaactgtatgttcaaataaaatcttatttggaacagataagtcagatctgctctagctgaaccccttctgcctgttctagctccagctgcctttcccagaagtagtccctgaaggtgcctccatggaacaactggaagccacacttctgctggaagtagatgttagggtagaaaaaaagtgggaccaatcaagtaaaagaacagaatacgatggctcattagaatcaataatttcttttattacatgaaagcaaacaaaaattgagcaatgtacaatgctgatgcactgttaataacyctgataatagagataaattctgataccacatactgactcattactgtgcatctcactgctacctgcccttaagatactctctttttcttttctctctctctctacatgttctcatctgaaggatattcttagactggaaagttcaataccaaaatcttacatgctgggctatgagcagatgtcctatatatatgtatgtaacttcaatcactgggagatgtccaggagtactttatccaggtcattctcccttgggtctgagataaaaataacctaagtcctatctggataatctgaaga

SEQ ID NO: 132109 - DNA, 601 bp, Human
tttcttccaagtgtcccttttttatgctttcttctgtagaggaccagtttatttgctaaggattccttagaaaggaatgcccttggccaggcacagtggctcacgcctataatcccagcactttgggaggccgaggcaggtggatcatgaggtcaggagttcaagaccagcctggccaacaaggtgaaaccctgtctctactaaaaatacaaaaattagccggatgtggtagcaggcgcctgtaatcccagctactcaggaggctgaggcagagaattgcttgaacgcgggaggcggagayggcagtaagccgagatcacgccactgcactccagcctgggcaacagagcaagactccaaaaaaaaaaaaaaaaaagaaagaaagaaagtaatgccctcgcattttgcactaaggaactagaaaaccttcccatcggtcctggcatagcgcctcttgtgtctggggtagatcttgtacctgctgaaactgcatagctcaactttcagggcagaagctccagaggctcaatgttaggtaatttctaataacataccaacctttgtaacaaagaatttggctacgtattagaatcagttcttt

SEQ ID NO: 132110 - DNA, 601 bp, Human
aggtcaggagctcaagaccatcctagctaacatggtgaaaccccatctctactaaaaatataaaaaattagcctggcatggtggcgggcgcctgtagtcccagctactcaggaggctgaggcagcagaatggcctgaacccgggaggcagagcttgcagtgaaccgagatcacgccactgcactccagcctgggcgacagagtgagactccgtctcaaaaaaacaaacaaacaaacaaacaaacaaacaaaaaaacaaacttcagaagcaaaaaactcccacaggttttttttttttttttaataaccagaagacctctagggttaagaaatgaatgccagatagtaacaacgctagaagaaaatatgagtaatgcaaaacttggcactatgctacattaaacctttcttctcacttatggatcctgaaagcaccttgagattgaatgattgcaatagaatctgaaattttcttaataagttatcaattaagctttgtgtaagttgagagtttggtgttttttgttttaattactgaatgtatttgtggaagaggctctatagcacaatataacctgccacgtgtcctctgaaaaactaaa

SEQ ID NO: 132111 - DNA, 601 bp, Human
tgggaggccgaggcaggtgggtcacaaggtcaggagctcaagaccatcctagctaacatggtgaaaccccatctctactaaaaatataaaaaattagcctggcatggtggcgggcgcctgtagtcccagctactcaggaggctgaggcagcagaatggcctgaacccgggaggcagagcttgcagtgaaccgagatcacgccactgcactccagcctgggcgacagagtgagactccgtctcaaaaaaacaaacaaacaaacaaacaaacaaacaaaaaaacaaacttcagaagcaaaaaactcccacaggttttttttttttttttaataaccagaagacctctagggttaagaaatgaatgccagatagtaacaacgctagaagaaaatatgagtaatgcaaaacttggcactatgctacattaaacctttcttctcacttatggatcctgaaagcaccttgagattgaatgattgcaatagaatctgaaattttcttaataagttatcaattaagctttgtgtaagttgagagtttggtgttttttgttttaattactgaatgtatttgtggaagaggctctatagcacaatataacc

SEQ ID NO: 132112 - DNA, 601 bp, Human
gggattctcctgcctcagtctcccaagtagctgggattacaggtgtgcgccaccatgcctggctaatttttgtatttttagtagagacagggtttcgccatattggccaggctggtcttaaactcctaacctcaagtaatccacccactttggcctctcgaagtgctggaattacaggcgtgaactactgcacccggccccattcttgtttcctatcactcccgcatatgccctatacaccatgcatacaaaacaaatggcccaagatcacacagctgttaagtacacagcagggatccaraaataagcagtctggttccagagtattaagtaggaaaaacactgaaattgtctaaatgtttactttctctgtgtttatgctatattctaaatctgccttaattgaaaatgaaatgtgtattttaaaaaacctcgtaagcggccaggcgcagtggctcatgcctctgatcccagcactttgggaggccgaggcaggtgggtcacaaggtcaggagctcaagaccatcctagctaacatggtgaaaccccatctctactaaaaatataaaaaattagcctggcatggtggcgggcgcctgta

SEQ ID NO: 132113 - DNA, 601 bp, Human
ggcattactcagattataaattctgctttctgcagtcagaaaaatgaataagatcatgtcctttgccaggacatgaatggagctagaggccattatccttagcaaactaacacaggaacagaaaaccaaataccacatgttctcacttataagcgggagctaaatgatgagaacacacggacacatagaggggaacaacacacactagggcctatcagagggtggagggtgggaggagggagaggatcaggaaaaataactaatgggtaccaggcttaatacctggatgatgcaataatckgtataacaaaccctatgatacaagtttacctatgcaatatacctgcatatgtacccctgaatttaaaataaaagttaaaaaaaattctcctttctattaaacaccttttttggacattgttatgtaactattactatatatagtgaatatctgatctttggtaatacatgggctagaaattgcatcagagtactcataagaatgaatattgggctgggcgtggtggttcacacctgtaattccagcactttgggaggctgagacaggcaaatcacctgaggtcaggagttcaagaccagc

SEQ ID NO: 132114 - DNA, 601 bp, Human
acacacacacacacacacacaaaaaacaataatccaaagctgaaaggaggccaggatggttttttatacttacttttttcgtctttgtctctcctttaacctggaatgatagatatctaccacagccatcttcagagctacaaataaattcatacatatactatatatacatatcatatatatattatataaataaataaaaccaagacaaaaataaatcttttacccaaactttgaacctcatattgctaattactccacactcactagtctagaaaacataaaaatattccagcataawgaatttgtctatcaataagtaaagttatttttccgctatttatatatcttatggcattactcagattataaattctgctttctgcagtcagaaaaatgaataagatcatgtcctttgccaggacatgaatggagctagaggccattatccttagcaaactaacacaggaacagaaaaccaaataccacatgttctcacttataagcgggagctaaatgatgagaacacacggacacatagaggggaacaacacacactagggcctatcagagggtggagggtgggaggagggagaggatc

SEQ ID NO: 132115 - DNA, 601 bp, Human
gggagaatcaattgagcctgagaggttgaggctgcagtgagccattattgtgctgctgctctccagcctgggcaacagagtgagaccttgcctctctcacagacacagacacagacacacacacacacacacacacacacacacacacacaaaaaacaataatccaaagctgaaaggaggccaggatggttttttatacttacttttttcgtctttgtctctcctttaacctggaatgatagatatctaccacagccatcttcagagctacaaataaattcatacatatactatatatacrtatcatatatatattatataaataaataaaaccaagacaaaaataaatcttttacccaaactttgaacctcatattgctaattactccacactcactagtctagaaaacataaaaatattccagcataaagaatttgtctatcaataagtaaagttatttttccgctatttatatatcttatggcattactcagattataaattctgctttctgcagtcagaaaaatgaataagatcatgtcctttgccaggacatgaatggagctagaggccattatccttagcaaactaacacaggaa

SEQ ID NO: 132116 - DNA, 601 bp, Human
gtgcacacctatagtcccagccacttgggaggctgaggctggagaatcacatgaacccaggaggcagaacttgcagtgagctgagatcacgccactgcactccatcctgggtgacagaacgagactccatctcaaaaaaaaaaagacaaaagcaaagaatgattcacaaatattaaaaaaaaaaaagtgtaacaatactgtcttgatgcctttattttatcttgttcttttacttcaaatagcttaaaacagtgtacccatattattcattgttcatcataacgtcaataaaggataaggrcagaggatataaaaataacacaggaattactatcctcaattgagagaaggaaaaattgaggtctaaggagggtaagagtcttctccaaggtcaaaagatgagtcacaagtggagcattctctcatggactatatgtggtcaatcactcaaagctgaggccaggcacagtggctcatgcctgcaatcctaacactttgggagctgaggagggaggatcacttaagtccaggagtttgagaccagcctggccaacacagcaaaaccccgtatctacaaaaaatacaaaaaattagccaggca

SEQ ID NO: 132117 - DNA, 601 bp, Human
agtggctcatgcctgtaatcccagcactttgggaggctgaggtgggcggatcacctgaggcctggagtttgagaccagcctggccaacatggggaaactgtgtctctactaaaaataaaaaattagctgggcatgatggcacgtgcctgtagtcccagcttcttgggaggctgaggcacgataattgcttgaactcaggaggcagacgctgcagtgagctgagatcgcgccattacactccagcctgggtgacggagcaagaccatctcaaaagtaataataataaaataaaaaataaaaataaaataaaaaagcctaacagtccgagtgcagtggctcacacctgtaattccagcactctgggaggccaaggcagtaggatgccttgagtctaggagttcaggaccagcccaggcaacattgtgagaccctgtctcaaaaaaaaaaaaaaaggttttttttcttttttgagacggagtctcaccctgtcgcccaggctggagtgcagtggtgtgatcttggctcactgcaacctccgtctcccaggttcaagcaattctcctgcctcagcctcccgagtagcttggactacaggcatgca

SEQ ID NO: 132118 - DNA, 601 bp, Human
gtggcatttattttaaaaatcactatatgtatttttatcaccgtcatataatattaaatatcatttattttgtctgtctataaccatccaaaataaagatcactttctgttatttatctaaaatatttttacaacctgaagattaaggttatgttatgcttaacacatagttgcaaaacatgactctatccagaaaattattcattaatattcacactgtaattactatacaaatttttaaaaaagaattttaatacaagttttattgactacaaattaatacatttatttatttgcttaatttatttatttatttttgagactaagtcttgctctatcgcccaggctggagtgcactggcgtgatctcggctcactgcaacctttacctcctgggttcaagtgattctcctgcctcagcctcctgagtagctgggattgcaggtgcatgccgccacgcctggctaattttttttttgtatttttagtagagatggggtttcaccatgttagccaggatggtcttgatctcctgacctcgtgatctgcccacctcagcctcccaaagtgctgggattacaggcaagagccaccgcgcctgg

SEQ ID NO: 132119 - DNA, 601 bp, Human
tattctttacaaaaaaagaatattatgacacacaactattacaaatattttaatacaaacattgtgattgttattatgacatcatccttcttagttgtggaagcctctatgttgtggaagaagaaaaagtacagggactttttctgccctgcttaggtatctctgatatttaaaataataaaggccaggcacgatagctcgagcctgtaataaggaggctgaggtgggaggatcacttgcacccaggagttcaaggctgcagcaagataccatcacaccactgcactccatcctgggcaayagtgcaagaacctgtctcttaaaaaacaaacaacaacaaaaaaccacagtaaggtcaaaggtggcatttattttaaaaatcactatatgtatttttatcaccgtcatataatattaaatatcatttattttgtctgtctataaccatccaaaataaagatcactttctgttatttatctaaaatatttttacaacctgaagattaaggttatgttatgcttaacacatagttgcaaaacatgactctatccagaaaattattcattaatattcacactgtaattactatacaaattttta

SEQ ID NO: 132120 - DNA, 601 bp, Human
tatttttttttttcctagcttacctttttattttttttgagacggagtctcgctgtgtcgcccaggctggagagcagtagcacgatcttggctcactgcaacctccgcctcccgggttcaagcgattctcctgcctcagcctcctgagtagttgggactacaggcgcctgccaccacacctggctaattttttttattttttagtagagatggagctacttgggaggctgaggtgggagaatcacctgagcctgggaggcggagactgcagtgagctgagccactgcactccagcctggayaactggagtgaggccctgtctcaaaaaataaataaataataaaggacctaaaatgtaacatacttatgatgatggctatatttttaaaaaatatagattttctgttgcccaggctggagtgcagtgacatgattatagctcactgcagccttgaactcctgggctcaagtgatccgctgcctcagcctcccaagtagctgggattataggtgcaagccaccatgcctggctagatatttatttacactaaaaagacacttaaccttgttgactgaaccctacgatgctatatattattaa

SEQ ID NO: 132121 - DNA, 601 bp, Human
agaaaaagtgtgatttcttgcatgtcccacctacacatcctcaagcaaggtaagtatttttttcatccttcatatgggtcattttacctttctccaaactaaattaactactacaacttaatttactgctaatgaagttttatttgacaactgtcatgcaaatatcatgcagagacaccagagcagcaactctggggatcactactgaccaaacaactaatccaaagatgtatctgcaaagaagatggagagtaaaactgactaacaataactggtagattggagcagtcagtaactctcsaactgctacttgggtcgtttcaatcagtaattaggttagttctatctactcttggactaacgatacagactttcatttatgacagctatttttttttttcctagcttacctttttattttttttgagacggagtctcgctgtgtcgcccaggctggagagcagtagcacgatcttggctcactgcaacctccgcctcccgggttcaagcgattctcctgcctcagcctcctgagtagttgggactacaggcgcctgccaccacacctggctaattttttttattttttagtagagatgga

SEQ ID NO: 132122 - DNA, 601 bp, Human
tgaatttttagtagagacggaatttcaccacattggccaggctggtcttgaactcttgacctcaggtgatccacccgcctcggcctcccaaagtgctgggattacatgcatgagccaccgcgcccagccacctcactgtcttttttttttttttgagatggagtcttgctctgtggcccaggctggagtgcagtggtgtgatctcagctcactgtaacctctgcctccccaggttcaagcaattttcctgtctcagcctcccaagtagctgggattacaggcacaccgccatgctcgactrattttttgtattttagtagagacgaggtttcaccatgttggccaggctggtcttgaactactgagctcaggcaatctgctcgcctcggcctcccaaagtgctaggattacaggtgtgagccaccgcgcccggccacctcactgtcttttaaactacacaggggcaggaactgctggcagtaatggacgagacaattaaaggcagatcttacattcttaggaagaattatggccaaaatttatggtattaactcccacaggaaaacaaagaagctacagacaaaataatccatccagaaga

SEQ ID NO: 132123 - DNA, 601 bp, Human
agtctcgctctgtctcccaggctggagtgcgttggggtgatctcggcgcactgcaacctccatctcctggattcaagcaattctcctacctcaacctcccaaagtagctgggattacaggcgcccgccactacacccagctaatttttgaatttttagtagagacggaatttcaccacattggccaggctggtcttgaactcttgacctcaggtgatccacccgcctcggcctcccaaagtgctgggattacatgcatgagccaccgcgcccagccacctcactgtcttttttttttttttgagatggagtcttgctctgtggcccaggctggagtgcagtggtgtgatctcagctcactgtaacctctgcctccccaggttcaagcaattttcctgtctcagcctcccaagtagctgggattacaggcacaccgccatgctcgactaattttttgtattttagtagagacgaggtttcaccatgttggccaggctggtcttgaactactgagctcaggcaatctgctcgcctcggcctcccaaagtgctaggattacaggtgtgagccaccgcgcccggccacctcactgtcttttaaac

SEQ ID NO: 132124 - DNA, 601 bp, Human
gtgtgatctcagctcaccgcaacctctgctacccgggttcaagcaatcctcccacctcagcctccaaagtagctgagactacaggtgtgcactaccatgcctggctaacttttgtatttttgtagagatggagttttactatgttgcccagattggtctcgaactcctcgactcaagcaatcctcttgccttggcctcccaaagtgctgggattacaggtgtgagccaccacgcccggcctcataacaacttttaattttttatagtgaaaaatcaaatggtaactatgtagagctctcayagaaataccacagaaaggcaagagatcgatggaagtactatctccacaagctatccatctctgtcctcatttttaaaactacttttaatactaaaatatttatgaacaaaataaaatgatgtctgggatttgcttcagaataatccagttgagggcaggagggaagagtgagtggtaaagatgaaaccagactggccatgtgttgaaaactgctgaagctggatgatggatacacgggagttcatcatattattatctctacttctatatatatttgaaagttcccatgatacaaagtag

SEQ ID NO: 132125 - DNA, 601 bp, Human
aatctaggccttactgccataccaacatattttgttttgaaacagggtctcactctgtcgctcaggctggagtgcagtggtgtgatctcagctcaccgcaacctctgctacccgggttcaagcaatcctcccacctcagcctccaaagtagctgagactacaggtgtgcactaccatgcctggctaacttttgtatttttgtagagatggagttttactatgttgcccagattggtctcgaactcctcgactcaagcaatcctcttgccttggcctcccaaagtgctgggattacaggtgygagccaccacgcccggcctcataacaacttttaattttttatagtgaaaaatcaaatggtaactatgtagagctctcatagaaataccacagaaaggcaagagatcgatggaagtactatctccacaagctatccatctctgtcctcatttttaaaactacttttaatactaaaatatttatgaacaaaataaaatgatgtctgggatttgcttcagaataatccagttgagggcaggagggaagagtgagtggtaaagatgaaaccagactggccatgtgttgaaaactgctgaagctg

SEQ ID NO: 132126 - DNA, 601 bp, Human
tgctaaccaaacaaggtgtttggtgaggacaaccaacctggctcagataaatgtctgcaatgctatgtaagaaatattttcacggtgagaataagggccttagtagactaccttcccagaactaaacttagaagccacatacacaaatgtcatgatgaaaggtacagaacaagccagagtccatattattttaacaatctaggccttactgccataccaacatattttgttttgaaacagggtctcactctgtcgctcaggctggagtgcagtggtgtgatctcagctcaccgcaacctckgctacccgggttcaagcaatcctcccacctcagcctccaaagtagctgagactacaggtgtgcactaccatgcctggctaacttttgtatttttgtagagatggagttttactatgttgcccagattggtctcgaactcctcgactcaagcaatcctcttgccttggcctcccaaagtgctgggattacaggtgtgagccaccacgcccggcctcataacaacttttaattttttatagtgaaaaatcaaatggtaactatgtagagctctcatagaaataccacagaaaggcaagagat

SEQ ID NO: 132127 - DNA, 601 bp, Human
cgccaccatgcccagctaattttgtatttttagtagacacggggtttctccatgttggtcaggctggtcttgaactctggacctcaagtgatccgcccgcctcggcctcccaaagtgctgggattacaggtgtgagccaccgtgcccagcccacttttatcttatttgtagattggggctcacacaaaatttaatttcaaaaatggtttccactgttaaagagccattatactaggctgaacttacatccataaggctatgttgcacccacagggctgtgttaagaagccaactattgccrggcgtggtggctcacacctgtaatcccagcgctttgggaggctgaggtgggtggatcacctgaggtcaggagttcgagatcagcctgaccaacatggataaaccccatctctactaaaaatacaaaaaaaaaaattagccgggtatggtggtgcatgactgtagtcccagctactcaggaggctgaggcaggagactcgcttgaacctagaaggcagaggttgtggtgaaccaagatggcaccactgaactccagcctgcgcaacagagccagactccgtctcaaataaaaaaaaaaaag

SEQ ID NO: 132128 - DNA, 601 bp, Human
tcgggaggctggggcagaagaatcacttgaacctgggaagcggaggttgcagtgagccgagatcacaccactgcactccagcctgggcgacagaccgagactctgtctcaaaaaataagtaaataaataaaaaataataaaataaaaagcttttaatttatctcctgtgaaataagtctcaaaattagtggtagacacaactgcagtaaactaactgctcatgaacattggtaaaataaagaagttacctctctgaagttcttttttcccctgtctctatactgtctatactctatactgkcactctgaggatagtctctgtctggccatgaaggttctgaaaacatactgatgtttatatattgggctaacacttgattactgttactctgcctaagcaccctgacaccacagaggaaggaagattgctgggtcactataacccctacgatgcaaacttcacaattaagacttgttctggcctgagaaataattacctgaattcgaagccattggaatggaaggactcaggccggaatcactacaacgaagaagaggaatttaaacttaggtcatatcaaacaaggtgatttccaaaagc

SEQ ID NO: 132129 - DNA, 601 bp, Human
ctgtaatcccagctgttcgggaggctggggcagaagaatcacttgaacctgggaagcggaggttgcagtgagccgagatcacaccactgcactccagcctgggcgacagaccgagactctgtctcaaaaaataagtaaataaataaaaaataataaaataaaaagcttttaatttatctcctgtgaaataagtctcaaaattagtggtagacacaactgcagtaaactaactgctcatgaacattggtaaaataaagaagttacctctctgaagttcttttttcccctgtctctatactgkctatactctatactgtcactctgaggatagtctctgtctggccatgaaggttctgaaaacatactgatgtttatatattgggctaacacttgattactgttactctgcctaagcaccctgacaccacagaggaaggaagattgctgggtcactataacccctacgatgcaaacttcacaattaagacttgttctggcctgagaaataattacctgaattcgaagccattggaatggaaggactcaggccggaatcactacaacgaagaagaggaatttaaacttaggtcatatcaaacaa

SEQ ID NO: 132130 - DNA, 601 bp, Human
ggcgcagtggctcatgcctgtaatcccagcactttgggaggccgaggcaggcagatcacctgaggtcagcagttcgagaccagcctggccagcatggcgaaaccccatctctactgaaagtacaaaaatcagctgggcatagtggcaggcgcctctaatcccagctacttgggaggctgaggcaggagaatcgcttgaatccggaaggcagaggttgcagtgagccaagatcgcgtcactgcactccagcctgggtgacagagcgagactccatctcaaaaaaaaaaaagtccctaacgcrgacaaatctgagacccagattctgaatctactgagacatacctcccccaattcccagtcatcgattaccaatcaccaaggatcatcagatagcgtatggcttaatcttgctctgtatactaatttcaaaataggacatactcaaagaggtaaaacgaagaaatagaaatactttaggtctctaactcagaaatccttatgtttctggcaagtaacatgcttctttgctcatgttatataaaaataaaaagtttaggctgggcacggtggctcacgcctgtaattccagcactttgggagg

SEQ ID NO: 132131 - DNA, 601 bp, Human
acttaggcctgggagtttgaggctacagtgagccatgatcacatactgcactccagcctggatagtagagggagaccctgtctcacaaaaaaagaaaaaagaaacaatgaacaagtcagtgcagatagtacagagaacaaaaatatatgatcatgttagccagttccttcatttaatttaattaattaatttatttattttttgagatggtcttaactctgtcacccaggctggagtgcaatggtgcgatcttggctcactgaaacctctgcctcccggattcaagcgattctcctgcctyagcctctggagtagctgggattacagatgtgtaccaccacacccagctaatttttatatttttttttcaggagagatgggttttcatcacgttggtcaggctggtctcaaactcccaacctcaggtgatctgcccgcctcagcctctcaaagtgctgggattacaggcatgagccactgcacctgacccagttccttcattttaattagccagtattaacttagttgtatttagattttgggggtagagtgttggcagtaagaaacttacaaaataaaactttgatttcactgtcttagc

SEQ ID NO: 132132 - DNA, 601 bp, Human
agtgacatcaacctccaactatttataggagctgatgggtggctggactacattccatttagtctcttcctctctggagagaacactccctaaggacacacacccaggaagagaaagccagggtgtgatactagaagagcctttagcacatgccagctggctcaggggcctgggtttgttagggatttacaactatgtgctcctgaggagcagcctggctctttcaggagtcaaacactaaatgcccaggtacagtcccagcaccaatggtcagggaagagccatggggcacagtgggggmagaatgcacagacacttggattctcaaggctgcatcacattgtttttagtgtcagcataaagcagtagtccctgctttggggattacatttcctacttcaaagggaaaggagataaagagaccttgctaagaggaggtaactttaactgctaaaaatctagaaaattgccacattatccagcaatgaggagtctgaggtcaccattatgtgggtaaggataaaaaaagcttgaaattccaggccattcaatatttgaatcaggctgacctatgacctccttcagcaatacatagatacta

SEQ ID NO: 132133 - DNA, 601 bp, Human
cgctacctctgaatggcgcttgtaaaagaaccattccgaagatggtcaagacagcatgtccaaatgtgaatgctttccaacttttaccgttcatgttaaacacaaccaacagaattggatgacccaggtccctggaagtctccaaagcccattttaaaaggcagatagatgtctttctggccacattcatttgtacggccatgcctctcaccctccctgggaggaactattccctgaggcctccagaaccgcccaacattcattaccaagccttgacctccggcaaggaccacacctcccwgcaaaccgcgattcaggggtggagggtgcgacctaagtcacatggccaaaaaaaaaaaaaaaaaaaaaaaaaaaagtcagctctgaaacctggctcatcaggaggactcatgagtgaagttaaccaccattacttgatcagactcctatgctgcctgaagccgggttattttaaacctctcgggggactcccagccaaatttaaaaccaccttggcaagcccaaaaaagtagcaggcatccagttaaatgagtccttagtcatccctaaaaggctcgaagtaaagtgcgccgcgtccccc

SEQ ID NO: 132134 - DNA, 601 bp, Human
taaccagtgttatcaaactcaacccattgtcaccacttggcgatagctgacttaagcccctccaaaaagagaataagatggcacctggcacagaaacaaggcctaaggtttctgtcatccagatatcaacccagcatgattcaacatcagcctgttctgatgacttccgagctggaattagaatgtagttgtttccttataacactgcctttaccacccgccccccaaaatctgcccatactctatgtgaaaggtatccacaaagtcaggagacttaggataaacttcatgttaattacaytttcaaataatatgcttgatatattttcatataaaatactctaatagttctaaaattaatctgaaacagtacaaataaatacatcataaagtgtccaaaaagtctggaaacaggaaaaatagtatatttgttgcatcttttgttttctttagattaacaatggatccactgcttaaactttagaggtatgtcacctgaaaagatctggtctggttgaagaaaaacaaactgaacatactatttgaaaatgtaaattaacatactgcttaaaaataagtttatccagtgtttcctgatttt

SEQ ID NO: 132135 - DNA, 601 bp, Human
ggtacctccctctctcacccaggaacccacttatacccctcccctctctcttctcaccacgcacagaagatgtgagaggaaaatcaagggaaacagtgtgcgtactctgtaatttgactccacttatgttttctatcgtgaaactgtaatcttgccagcagaagattctcagaggccccccgactgtctttgctagggcagatagatggaggatgacacaggacaaatgggaaatgaggaaagaaaggcaactgggtggctcctaccttgtgactagcaataagagctatagggtcctaayagcctccagccccagggtcagatttctgcagagagcttgggctgggggctgaagaacagtctgggcatctttcacttgattcaagggagttttaccctcttgtctaaaacccagaaacaaaccctatagcaaacccttgcagccttagaaacccatcctctatagctagaagccatgtgtatgcagccttttgcatagattgttattcttccctaacaggatacttgatatcactcctattgctgagtggggtgaggcagtatcatctcccagggggcaaaaattggttctgtgacaggt

SEQ ID NO: 132136 - DNA, 601 bp, Human
agaccactgaaagaggatctcacttctttccctttttaaccatctgtggggtttttttcttcgtcttccttttgcccctcctttctgcgtgtgttgcatagaaacagaaagtgcctttgtaccaattactaggcactaatttacgctcttcagtgggcgctgggcttgctggagaaacattaggaaaaggtgggagggtcggatgtgggggaggattctagcagtggaggaaggaatggcatgctacaagctttttctccaagcctgagaacagccaaagggaaagagagagagagagaggaaaaaaaaaaagaacacggaagatttggaagtcaagactaacaaatgcgacaaagctttttttttttttaatgaagaatgctaatgatcataaggcattcagaaatcaaactgatgggatagaaagcaggctccaactagagcatgtcagattgttttaggggcttctgaaagagtgaagactgggaaatcatccgcccacttttcttctcaatgaacttactaaggaaaaccattgtcagccattttcccaatatgtcatatgatgtttctccctgggaagttcaatctgggaatttcc

SEQ ID NO: 132137 - DNA, 601 bp, Human
ggagattacacagtatgaccactcacatgctagtcaaggcagataggcagcttttgaaacctggtggtgtgcttcaaagcccttcaagtccccccaaaacatttcaagagaacaatccccatctctctgagaaagggtggggatgtgctttcttaaagacaaaatgatggatgtgatgacctcccaaggtcacttccaacctccaagtgctattcttttgatactaacaactgctgccaccaagtgctctgagttaggcctaggcctgtgactaactttcaacaaaaagtggggcggagaragagagccaggattgctcaaagaccactgaaagaggatctcacttctttccctttttaaccatctgtggggtttttttcttcgtcttccttttgcccctcctttctgcgtgtgttgcatagaaacagaaagtgcctttgtaccaattactaggcactaatttacgctcttcagtgggcgctgggcttgctggagaaacattaggaaaaggtgggagggtcggatgtgggggaggattctagcagtggaggaaggaatggcatgctacaagctttttctccaagcctgagaacagccaaag

SEQ ID NO: 132138 - DNA, 601 bp, Human
gggataaaacaaatgtttactcgtggccttaatgcatcaaaaaggtattaaagtttcaggacgattccaggtagggagtggtaggaaacctctcagcagctctgccttgggctgttaaagagagtgctgctcccataaaaagggcataggccaccccagctcactccacctctgccctttcacttggttaattccatgaagcagccctttaaactaaggtgaaaaagaaaaatgttaaccatagactgaagtcccaggagagcaagtggggggaaagaattcaaatgaaagtactgcaaakaattcaaaatgaaggaaaaattcctaggcacccgcagagccaagcttgaagctaggggctttagcattttctgctgacaaatgcttccaactacctagtaccctcatgagctggtgaggctctgggagattacacagtatgaccactcacatgctagtcaaggcagataggcagcttttgaaacctggtggtgtgcttcaaagcccttcaagtccccccaaaacatttcaagagaacaatccccatctctctgagaaagggtggggatgtgctttcttaaagacaaaatgatggatgtga

SEQ ID NO: 132139 - DNA, 601 bp, Human
ctgcaggtcagagctgtccacccttcacaaaacagtccccactcaaccctccccctgagatctcagaaaaggaatatagtcccctctttgggcatgtatttctagagggtgttttgaaatttaggagcaagcagggctttgggaagaaatgcctcgggttaggctgggtgttagtgactcattcctgtaatcccaacagtttgggagactggagcaggaggatcacttgaggccaggagttcgagaccagcctgagcaatatagcgagatcccatctccaaaaaaaaaaaaaaaaaaaatwtttttaaattagctgggcatggtggtgcgtgcctgtggtcccagctattcaggagacctaggtgagagactgcttgagccaaggagcatgaggatgcaataagccgtgattgcaccactgcactccagcctgggtgacagagtgagaccccatctcaggaaaaccagcctggccaacatagtgaaaccctgtctctactaaaaatacaaaaattagctgggtgcggtggctcatgcctgtaatccagcactttggaaggccgaggccggtgaatcacttcaggtcagaagttcgagacca

SEQ ID NO: 132140 - DNA, 601 bp, Human
actgcaggtcagagctgtccacccttcacaaaacagtccccactcaaccctccccctgagatctcagaaaaggaatatagtcccctctttgggcatgtatttctagagggtgttttgaaatttaggagcaagcagggctttgggaagaaatgcctcgggttaggctgggtgttagtgactcattcctgtaatcccaacagtttgggagactggagcaggaggatcacttgaggccaggagttcgagaccagcctgagcaatatagcgagatcccatctccaaaaaaaaaaaaaaaaaaaawttttttaaattagctgggcatggtggtgcgtgcctgtggtcccagctattcaggagacctaggtgagagactgcttgagccaaggagcatgaggatgcaataagccgtgattgcaccactgcactccagcctgggtgacagagtgagaccccatctcaggaaaaccagcctggccaacatagtgaaaccctgtctctactaaaaatacaaaaattagctgggtgcggtggctcatgcctgtaatccagcactttggaaggccgaggccggtgaatcacttcaggtcagaagttcgagacc

SEQ ID NO: 132141 - DNA, 601 bp, Human
atgagccccatgcccaccaaacagaagatcactcccagggaaaggaaaggcaagggaccccgaattagagagagaaccctgattttgcaaacatttagccaaaagagaatacaatttaatgcagaagtaactgagaccctgaaatgccaagaaaaagattgtcccccagcagcagaaatggagagactgatgcctgattagtcaacacgtactctacctgctaggctgtggcattcataaggactcatggtgaaaagtgatgccactccagcaagtgtttccatccagctttttccctctrggctcaacctctgcacactgtatgcacaccacagtatggctgcagtggccataaatcctactcatacatgccacatgggccaccagcagcttttcaagcttttaacccttctactcttgggatggagtgagccactaagtcacatggcttgatgtttggcaccaaagaccacaaagaactgcaggtcagagctgtccacccttcacaaaacagtccccactcaaccctccccctgagatctcagaaaaggaatatagtcccctctttgggcatgtatttctagagggtgttttgaaattt

SEQ ID NO: 132142 - DNA, 601 bp, Human
gcccagaaagatgatgcaacctccccacaaccacatagctagcccttcaaagaccagaccctggcccagactaggtaattcctgccatcccagactatgctgcctttgttcagctatttgtgggaaacatagataataaatatctacctaggcattaaatattgaacaagatataaatgcctaatggcaaagctatcccaagaacagattctttgaatctttgcaattttggtgatttttatcaccatggaattcaaacctgtcatgttttagatgaagccaactcagagggcagatgacrtgcccaaggacgccctgcacaatagtgtgtgaccagattaaaaccaggtttcaaattgctccttcagttttatgcacaaaatgagattagatgtgaaagaagagcctggactcaaactaaaagcacagagactgacctttcacagtgcctttttttccaattctctgccttccaggcccttccttccaaatgcattgcctcagggggatcagacatagtttaggataaataagttgccactgagctttaattttcaaagtagcatttagaaaacctaagtccttgagcttaaaaaaactc

SEQ ID NO: 132143 - DNA, 601 bp, Human
ttactgggacacttcagtaagtgatccatgaccaaagagagaagagtcattttgtcttcttctcaaactaattgtcagaaagtcagaaacttcctggcccggtgtgatggctcacacttgtaaacacctgtaatccagcactttgggaggccaaggggggtggatcgcttgaggtgaggaggttgagaccatcctggccaacatggtgaaaccctgtctctactaaaaatacaaaaattagccaggcatggtggcacatgcctgtaatcccagctactcgggaggctgaggcaggagaatygcttgaaccctggaggtggaggttgcagtgagctgagattgcaccactgcactccagcctgggtgacagagtgagactctgactaaaaaaaaaaacaaaacggagaaagtcagaaacttcctgaatatactacatctgtcttctcactcctctatttccacctctcctactttttccatatgtgaaagggacatggccctcttataagaacagacaggaaccttccttcagaggtggaaatgcacaaacagtaacagtagggttgcccaacaaaggagtgtccttgttagaaagcaggtg

SEQ ID NO: 132144 - DNA, 601 bp, Human
atctaaattaaaggtgcattcacagatgtaactgtacaaaagagcactggctttcttatatgccagccataaccagtcagaataagcctaacaataaaagttcaggaccttggtgaagaaatgcataaagcctcaatataaaagaaaatgaacaaacaaaatgcttgccatgcctttggatggtaaggctcaatggtgtgaatatggcaattctgtacaaattcatctacggaattaacacacaccgtaagaatttctttttctagaacttgacaaagttatttctgaagttcatttggargaataaacatgcccaacttgccaagaaaattttgcggaagaacaaataataagtgagcacttgcaatactagttattaaaatggattattaaagctgtaataattaagatagtgagatagcagcacaggaaaagacaaatcagtggaacagagtagggtctgaaaataaccttaagaatctatagggattctgtacatggtaaatggggtatttcaaatcagtgaaacagaaaatgtttaattcagtaagtggcttagatgtcaggtaaaagaaaaaaattaaatcttagtccctacctc

SEQ ID NO: 132145 - DNA, 601 bp, Human
gataaaattgaacaaccatccctaataaaagctttcaggaaaataaaataattcctcagcagtataaaagatcagctctgaaacctttcctctgcaaggtcaacagtaaaataaaggtagtataactactaaagtctagcccaaagcataaatggacacccgctcccattgctataatttaacattttccaggaaatactaatgagtgcaattagataaaataagaagtaaatggtgagaagaagggggggttataaaataagaattatttgcagttgacacaactttctctttgaaaaaattcaagataactgaaaaatctaatctaaattaaaggtgcattcacagatgtaactgtacaaaagagcactggctttcttatatgccagccataaccagtcagaataagcctaacaataaaagttcaggaccttggtgaagaaatgcataaagcctcaatataaaagaaaatgaacaaacaaaatgcttgccatgcctttggatggtaaggctcaatggtgtgaatatggcaattctgtacaaattcatctacggaattaacacacaccgtaagaatttctttttctagaacttgacaaag

SEQ ID NO: 132146 - DNA, 601 bp, Human
gatgcattttgatgctcggggatggggctgcaaagaggaaaaaaaaaagagtttcccgtgaaaaactcaataaagacatggagttgaaaactacacttctgcaacttccattagataaacaggattttaacccacttcagcagacttttgagcaaaagtcaaaatacagattgttacaaccccatcaaggctgagcttcttgaggcaaaaataatgtcatgtatgacttttgtcctactcatggtgccaagcatttggtaaatgctcaaactttacacacacacacacacatacacacacwctctctctctctctctcgtcctcctcctggtcactcacattgaaatctgctcagatattactggctactggagaaacctgagctattgcagaattagactgcagtgaagtcctctttaaccccagtgaagcagttatgggggaaatgtttttctaaacatgttctatgaaaaatataacaaggggtcagaactcatagaatggttaagttgcaaaaagccaaaccaaaccaaaacaaaacgccctctctgctcggtcctttttggagccctttctccactcccttctgatgtggcggtga

SEQ ID NO: 132147 - DNA, 601 bp, Human
gtctttctttaatctcttctcccatttccaaacaattccagtttcttctatattcctcataaaagatgaactaacattgttctaagcataaagctaagggcttcccgtgcccttctcactgaattttcacaagcactccacaaggttgccccatttcacagatgagaaaactgagacttggagggttaaactctgtactcagggtcacataactggaaagcagagtaatgaactggccctgtctaccaaggcccgtgctcttggccacttggctgtcctgactcctgggggtcctggggayttgacaatttccacatccctctttccgattgctttccttggattcacactaatgtctgtgtcccactgaaaatgcagctaagtcctgcctgccagatgttatcaggccagcatccataacctcctgctgctccccaccccacaagatgaaggcaggggaggtgaaggccatgtctgtgtttggggaggacatacacaggcagacaagcagacgagctgttgaagatgagaaccacacttgttccacttataagtgactgccatcgccctggctcccaagagcctgcctctgcctactctt

SEQ ID NO: 132148 - DNA, 601 bp, Human
acatcttttattgatataaaatctgccttcctgcaaaggccatactttaagtcatattgtcttaacactagaagtaagtttgtgccaggtgtgtaatccctcacgcctgtaatcccagcactttgggaggctgaggcgggcagatcacctgaggtcaggagttaagagaccagcctgaccaacatggtgaaaccccacctctactaaaaatacaaaaattagctgggtgtggtggcgtgcgcctgtagtcccagctacttgggaggctgagacaggagaattgcttgaacccaggaagcgraggttgcagtgagccaagatcatgccactgcactctagcctaggcgacagagtgagactctgtctcaaaaagaaaaaaaaaaaagaaatgtttgttccttctgccacatcataatcctttaaatatctgcagacagatatgtctttctttaatctcttctcccatttccaaacaattccagtttcttctatattcctcataaaagatgaactaacattgttctaagcataaagctaagggcttcccgtgcccttctcactgaattttcacaagcactccacaaggttgccccatttcaca

SEQ ID NO: 132149 - DNA, 601 bp, Human
gaggacacagacatgtgaagactagggaagaccttgggaagacagggatgaagccaccatctacaagccaaggagagaggcctccaatgaaacgaacccgtcccctgcctctaccttggactcccagtctccagaactgtgaggaaataaagttctgttgtttcagccacccagtctgtggttgtgtgttatggcagcccaaactaatacaatgagaaagttgctaacatctctaagcaaatgagcttgccatttggtaccctatgggtcccctggaaagtattttttctgttttattccrcacaattgctggtttcataaattctttcaagagtaaaaaagctgagcctttttgctaaatttcttggtgttgtaggatggaaaagaattggcattgggtccaaccagcctcctacctggaacgagcatttctccctgagctcctgagtgcaggggccactcagcatctggttgttcctgagcatctctgtcacatcttttattgatataaaatctgccttcctgcaaaggccatactttaagtcatattgtcttaacactagaagtaagtttgtgccaggtgtgtaatccctcacgcctg

SEQ ID NO: 132150 - DNA, 601 bp, Human; identical to SEQ ID NO: 21227

SEQ ID NO: 132151 - DNA, 601 bp, Human; identical to SEQ ID NO: 21228

SEQ ID NO: 132152 - DNA, 601 bp, Human
atcatcacaacattgcagccacacaacagataagtcaacatctttaaaatgatcaccttcaaaaactatgggaagacatattatttctactatgaatagtccctccttataaccaggcatcctcttctctcaaatggttaatagccattctttcttctccctaacccagagagacccaggtgaagtgtctggttcaaggaagcctgtgcttctccagttgatacatcttgttcaagagggaaaaaaaaggaaacccagggtggagttctacattcaaaggtaaggaggcctggaggatggragaatttgagcagccacaacaaccaaacgatcagaaagagaggactatttgggcagaccactgctacttgacagagctggcagccggctgtaaggaacaagggggaatatacaccctcacaaacaggatgaggggggaggaggagaagcagggatgaaagcgactccactgcactgaggccttgcctttgcgctccatgggctgccccaagcgagcacgccacacgcaggaagccagaagggctggagggaaggggaggtggcgacggcagaccacagagacaccaggcctcgcgtggcg

SEQ ID NO: 132153 - DNA, 601 bp, Human
caggaggcaaagaaaacaagaccagccactcaggcaccacccttggccgatacagtcccatggtgctagacaataagcgacatctcttgctgtaaccacaggcaagctaatcctccacctgaggcctccttttcttcatgtgtaaaataagggacccaaggttcattgcagctagctgtaatactcctgactctcaggcctctaccagttctctacagacaggttgctttctgtgagaaacagaaccagcagagagaggcctggtagagtgagaagcaggatgcagaacaaaatcaaggaytgacttccagaaagggacatggggttcatattctgatcacccagtttccctagaaatgttgtcagatgacccctgggacagcaggaagaccgagtaacaaactgggctggattgttggcccgaagcagctcctagaggtctgggcattataccactggtactcgctatcctggcaggaccctcactaacaccagtgatgacagtgaaaacagtaacctgcccaagaccaagaaaccacagagacctcaatttacacatgcactttcctaaatgacaggtcaagatctaaaaccctagctc

SEQ ID NO: 132154 - DNA, 601 bp, Human
tggactttattaaagttaaaaacttgaacttcaaaagataccataagaaaaatgaaaaaggcaggccaggtgcagtggctcacgcctgtaatcccaccactttgggaggccgaggcggggggattgcttgaggccaggagttcgagaccagtctggccaacatggcaaaaccctgtctctactaaaaatacaaaaattagcctggtgtggtggcgggcacctgtaatcccagttactcaggaggctgaggcaggagaatcgcttgaacccgggaggcagaggttgcagtgagccaagatcrcgccgttgcactccagccagggcgacagagcaaaactccatctcaaaaaaaaaaaaaaaaaaaaaaaagaaaaatgaaaaagacaactcaatgaataggataaaatatttgcaaatcatatatctgataagggacctgtatctagaatataaaaagaattcttgtaactcaataataagaagataacccaatttaataatgggcaaaaagatctttgtaaatgggcaaaaaatttaatagacattctccaaagaaaagataccaatgaaggctggggatgtggctcatgcctgcaatccc

SEQ ID NO: 132155 - DNA, 601 bp, Human
taaactggactttattaaagttaaaaacttgaacttcaaaagataccataagaaaaatgaaaaaggcaggccaggtgcagtggctcacgcctgtaatcccaccactttgggaggccgaggcggggggattgcttgaggccaggagttcgagaccagtctggccaacatggcaaaaccctgtctctactaaaaatacaaaaattagcctggtgtggtggcgggcacctgtaatcccagttactcaggaggctgaggcaggagaatcgcttgaacccgggaggcagaggttgcagtgagccamgatcacgccgttgcactccagccagggcgacagagcaaaactccatctcaaaaaaaaaaaaaaaaaaaaaaaagaaaaatgaaaaagacaactcaatgaataggataaaatatttgcaaatcatatatctgataagggacctgtatctagaatataaaaagaattcttgtaactcaataataagaagataacccaatttaataatgggcaaaaagatctttgtaaatgggcaaaaaatttaatagacattctccaaagaaaagataccaatgaaggctggggatgtggctcatgcctgca

SEQ ID NO: 132156 - DNA, 601 bp, Human
gcacacacaacaacaacaaaaaagataaactggactttattaaagttaaaaacttgaacttcaaaagataccataagaaaaatgaaaaaggcaggccaggtgcagtggctcacgcctgtaatcccaccactttgggaggccgaggcggggggattgcttgaggccaggagttcgagaccagtctggccaacatggcaaaaccctgtctctactaaaaatacaaaaattagcctggtgtggtggcgggcacctgtaatcccagttactcaggaggctgaggcaggagaatcgcttgaacccrggaggcagaggttgcagtgagccaagatcacgccgttgcactccagccagggcgacagagcaaaactccatctcaaaaaaaaaaaaaaaaaaaaaaaagaaaaatgaaaaagacaactcaatgaataggataaaatatttgcaaatcatatatctgataagggacctgtatctagaatataaaaagaattcttgtaactcaataataagaagataacccaatttaataatgggcaaaaagatctttgtaaatgggcaaaaaatttaatagacattctccaaagaaaagataccaatgaag

SEQ ID NO: 132157 - DNA, 601 bp, Human
taacaccaaaagcacacacaacaacaacaaaaaagataaactggactttattaaagttaaaaacttgaacttcaaaagataccataagaaaaatgaaaaaggcaggccaggtgcagtggctcacgcctgtaatcccaccactttgggaggccgaggcggggggattgcttgaggccaggagttcgagaccagtctggccaacatggcaaaaccctgtctctactaaaaatacaaaaattagcctggtgtggtggcgggcacctgtaatcccagttactcaggaggctgaggcaggagaatygcttgaacccgggaggcagaggttgcagtgagccaagatcacgccgttgcactccagccagggcgacagagcaaaactccatctcaaaaaaaaaaaaaaaaaaaaaaaagaaaaatgaaaaagacaactcaatgaataggataaaatatttgcaaatcatatatctgataagggacctgtatctagaatataaaaagaattcttgtaactcaataataagaagataacccaatttaataatgggcaaaaagatctttgtaaatgggcaaaaaatttaatagacattctccaaagaaaaga

SEQ ID NO: 132158 - DNA, 601 bp, Human
agaatggtggttgccaggggctgggggcgggggaaatggggagttaattggtaggcataaagtttcattcaagcgagatgaatacgctctacagagctgcactatgacactgttcccatggtcatcaataacataatcgtacacttaaaattttgtcatgagagtacatcttatgttaaatgttctgaccacaatacaattaaaaaaaaaaaaagaagaagaagaaagaaagagctaaaactctagttgggaggattgcttcaggccagaagtttgagaacatcctgggcaatacagagaraccccaattcattaaaaaaaaaaaaaaaaaaaaaagagctagaactataaaacttttagaagaaaacaaaggagtaaatcttcatgaccttgggttaggcaatgtcttcttagatataacaccaaaagcacacacaacaacaacaaaaaagataaactggactttattaaagttaaaaacttgaacttcaaaagataccataagaaaaatgaaaaaggcaggccaggtgcagtggctcacgcctgtaatcccaccactttgggaggccgaggcggggggattgcttgaggccaggagttc

SEQ ID NO: 132159 - DNA, 601 bp, Human
taaggtttcaaaacagtccaattcatagaaacaaagagtagaatggtggttgccaggggctgggggcgggggaaatggggagttaattggtaggcataaagtttcattcaagcgagatgaatacgctctacagagctgcactatgacactgttcccatggtcatcaataacataatcgtacacttaaaattttgtcatgagagtacatcttatgttaaatgttctgaccacaatacaattaaaaaaaaaaaaagaagaagaagaaagaaagagctaaaactctagttgggaggattgcttsaggccagaagtttgagaacatcctgggcaatacagagaaaccccaattcattaaaaaaaaaaaaaaaaaaaaaagagctagaactataaaacttttagaagaaaacaaaggagtaaatcttcatgaccttgggttaggcaatgtcttcttagatataacaccaaaagcacacacaacaacaacaaaaaagataaactggactttattaaagttaaaaacttgaacttcaaaagataccataagaaaaatgaaaaaggcaggccaggtgcagtggctcacgcctgtaatcccaccactttg

SEQ ID NO: 132160 - DNA, 601 bp, Human
atacatatacaacagaatactattcagccttaataaaagaaggaaattctgctatgtgcaacatggatgaaccttgagcaccttacgctgagatcagctagtcgcagaaaaacatatattgcatgattctccttatataaggtttcaaaacagtccaattcatagaaacaaagagtagaatggtggttgccaggggctgggggcgggggaaatggggagttaattggtaggcataaagtttcattcaagcgagatgaatacgctctacagagctgcactatgacactgttcccatggtcakcaataacataatcgtacacttaaaattttgtcatgagagtacatcttatgttaaatgttctgaccacaatacaattaaaaaaaaaaaaagaagaagaagaaagaaagagctaaaactctagttgggaggattgcttcaggccagaagtttgagaacatcctgggcaatacagagaaaccccaattcattaaaaaaaaaaaaaaaaaaaaaagagctagaactataaaacttttagaagaaaacaaaggagtaaatcttcatgaccttgggttaggcaatgtcttcttagatataacacca

SEQ ID NO: 132161 - DNA, 601 bp, Human
ggtgggaaggcctgctaaaagaaacttcattcaaaggcctgagtaggaatgttctctaaagatttttttttttttgaaacggagtctcactctgtcgcccaggctggagtgcaatggcgcgatctctgctcactgcaacctccgcctcccggattcaagccattctcctgcctcagcctcttgggtagatgggattacaggcgcatgccaccacacccggcaaatttttgtatttttagtagagacagggtttcgccatgttggccaggctggtgtcaaactcctgacctcaagtgatccrcctgcctcggcctcccaaagtgctgggatcacaggcgtaagccactgctcccagccatctctgaagattttttcttttttttttttttttgagacggagttttgctcgtcacccaggctggagtgcaatgccgccatcttggctcaatgcaaccgccgtctcccaggttcaagtgattctcctgcctcagcctcccgagtagctgggattacaggcatgcgccaccatgcccgactaatttttgtatttttagtagagacggggtttcaccatgttggccaggctggtcttgaactcctg

SEQ ID NO: 132162 - DNA, 601 bp, Human
aaaattcagcagctagttctagtctggtgaacttgtgtgtccagaagcctccacttccctgtgcgaccttcataggaattgttacctaggatgcctggactaggcatgcaggtttcctgacatgttccagtcctctgctgtcggttcagcagtgggctggccaccaccagcaatcacttgttacctgccaccatcagaaaacatgacatgctagaaatacactcacaggaccgaggaggtccaaagcaagaactgcaactccagagaggaagagagggccacaggagccaataaatctacyggtgtttactcctcctttccatatcttgctttctccttctcctgctgtttgagtcccactgctccctgtgaggtgggaaggcctgctaaaagaaacttcattcaaaggcctgagtaggaatgttctctaaagatttttttttttttgaaacggagtctcactctgtcgcccaggctggagtgcaatggcgcgatctctgctcactgcaacctccgcctcccggattcaagccattctcctgcctcagcctcttgggtagatgggattacaggcgcatgccaccacacccggcaaattttt

SEQ ID NO: 132163 - DNA, 601 bp, Human
tatacaacagaatactattcagcctttaaaaaaaagaagaaaattctgcaatatgcaacatggagatgaaaattcagcagctagttctagtctggtgaacttgtgtgtccagaagcctccacttccctgtgcgaccttcataggaattgttacctaggatgcctggactaggcatgcaggtttcctgacatgttccagtcctctgctgtcggttcagcagtgggctggccaccaccagcaatcacttgttacctgccaccatcagaaaacatgacatgctagaaatacactcacaggaccraggaggtccaaagcaagaactgcaactccagagaggaagagagggccacaggagccaataaatctactggtgtttactcctcctttccatatcttgctttctccttctcctgctgtttgagtcccactgctccctgtgaggtgggaaggcctgctaaaagaaacttcattcaaaggcctgagtaggaatgttctctaaagatttttttttttttgaaacggagtctcactctgtcgcccaggctggagtgcaatggcgcgatctctgctcactgcaacctccgcctcccggattcaagcc

SEQ ID NO: 132164 - DNA, 601 bp, Human
cagagacaaagagttcagggctcggctgggcgcagtggctcacgcctataatcccaacactttgggaggccgaaggggacggatcacgaggtcagaagatcgagtcttgctctgttgcccaggctggagtgcagtggcagaatctccgctcactgcaacctctgcctcctgggttcaagcgattctcctgcctcagtctcctgagtagctgggattacaggcgcatgtcaccatgccctgctaatttttgtatttttagtaaagatggggtttcaccatgttggtcaggctggtctcgaaytcctgacctcgtgatctgcctgcctcagcctcccaaaatgctgggattacagatgtgagctactgcacctggcccagcctaggaaatttttaactcagctaacattggtgaacaatccatatctcaactaggggagacttacccctcatttctactaggccacatgtagatgattcactgtagggattagccctattattattatttttttagttgtgtgaaattttatatcccagagagttctattccatttcaattgaactgttcctattgaaatatctgctacgtgcttcattctgt

SEQ ID NO: 132165 - DNA, 601 bp, Human
gatacccttcattggctaaaccctcccaatagccaaaaaaaaccccagaagagtcatgccagttcctattccagggggtgctcacaagagaatgtgactgtcaaatctgtgcctacagaggaaaccattccacttctttgtttttctgccaacagaaacaattcgtggtggctgtcccatttcctttttcctggcatatcaagcctggctccgagacttaaagggaaaacagagacaaagagttcagggctcggctgggcgcagtggctcacgcctataatcccaacactttgggaggcckaaggggacggatcacgaggtcagaagatcgagtcttgctctgttgcccaggctggagtgcagtggcagaatctccgctcactgcaacctctgcctcctgggttcaagcgattctcctgcctcagtctcctgagtagctgggattacaggcgcatgtcaccatgccctgctaatttttgtatttttagtaaagatggggtttcaccatgttggtcaggctggtctcgaactcctgacctcgtgatctgcctgcctcagcctcccaaaatgctgggattacagatgtgagctactgcacctg

SEQ ID NO: 132166 - DNA, 601 bp, Human
accagcctggccaatatggtgaaaccctatctctactaaaaatacaaaaaaattagctgggtgtggtggaagccacctgtaattccagctactcgggaggctgaggcaggagaatcgtttgaacccaggaggcataaggtatagtgggccgagatcgcgccactgcctgggcaacaagagtgagactctgtctcaaaaaaaaaaaaaaattaaacacattagccaggcatagtcgtgtacacctatcatcctagctactcaggaggctgaggtgggaggattgcttgaggccaggagtttsaggttacagtgagctgactgcaccactgcactgcactctagcctgggcaagagtgagatcttgtctcaaaaaagaaaataaaataaagcagggccagttcctgatgtcaagtcctgccatacactaaactaagggagatggggcaggatgccttgcctctactgcaaacaaaccttctgactttcatcccttcagggagctggatcctagacagagagctagctttccattggtgcagagatgagggcagatcctgcccttccccacctcgagtttagccagttagtggtctaattaacc

SEQ ID NO: 132167 - DNA, 601 bp, Human
gtggctcatgcctgtaatcccagtactttggaaggccaaggcaggaggatcacttgaggccaggagttctataccaccctgggcaacacagcaagaccctatctctaaaaaaaataattaaatgtgaagctgaggcaggcagatcacctgaggtaaggagttcaagaccagcctggccaatatggtgaaaccctatctctactaaaaatacaaaaaaattagctgggtgtggtggaagccacctgtaattccagctactcgggaggctgaggcaggagaatcgtttgaacccaggaggcataaggtatagtgggccgagatcgcgccactgcctgggcaacaagagtgagactctgtctcaaaaaaaaaaaaaaattaaacacattagccaggcatagtcgtgtacacctatcatcctagctactcaggaggctgaggtgggaggattgcttgaggccaggagtttgaggttacagtgagctgactgcaccactgcactgcactctagcctgggcaagagtgagatcttgtctcaaaaaagaaaataaaataaagcagggccagttcctgatgtcaagtcctgccatacactaaactaagg

SEQ ID NO: 132168 - DNA, 601 bp, Human
tagacaacttacttattgaagagatgattgtccaccttgatcttgctgtaggctttgaagtcatctggcattagcatgacaggaacaggaacattgctcagctcattgatctgaaaagcaaggagaacgtaaggctctcagccaggaggccacctgcctcagagacactaagctacaatgtggatgccacaatcttgctaaaagcatgtccaagtttccctctctgtctttttttgtttttttgagacagggtctcattctgtcacccaggctgaagtgcagtggcatgacaatggctcaktgcagccttcacctcctggactcaagcaatctgcccacaccagccccccaagtagctgggactacaggtgcacatcaccacgcccagctaatttttttgtattgtgtagagacaagttctcactgtcctgagctcaagcaatcctccagacttggcctcccaaattattgggattacaggtgtcagccaccacacctggcccctccctgcctttatttctgttcttctcttcaagtaagttcccaaccttgtcctattttacctattgaaactctccacctgataagggccagctcaaaa

SEQ ID NO: 132169 - DNA, 601 bp, Human; identical to SEQ ID NO: 27863

SEQ ID NO: 132170 - DNA, 601 bp, Human; identical to SEQ ID NO: 27864

SEQ ID NO: 132171 - DNA, 601 bp, Human; identical to SEQ ID NO: 27865

SEQ ID NO: 132172 - DNA, 601 bp, Human; identical to SEQ ID NO: 27866

SEQ ID NO: 132173 - DNA, 601 bp, Human; identical to SEQ ID NO: 27867

SEQ ID NO: 132174 - DNA, 601 bp, Human; identical to SEQ ID NO: 27868

SEQ ID NO: 132175 - DNA, 601 bp, Human; identical to SEQ ID NO: 27869

SEQ ID NO: 132176 - DNA, 601 bp, Human; identical to SEQ ID NO: 27870

SEQ ID NO: 132177 - DNA, 601 bp, Human; identical to SEQ ID NO: 27871

SEQ ID NO: 132178 - DNA, 601 bp, Human; identical to SEQ ID NO: 27872

SEQ ID NO: 132179 - DNA, 601 bp, Human; identical to SEQ ID NO: 27873

SEQ ID NO: 132180 - DNA, 601 bp, Human; identical to SEQ ID NO: 27874

SEQ ID NO: 132181 - DNA, 601 bp, Human; identical to SEQ ID NO: 27875

SEQ ID NO: 132182 - DNA, 601 bp, Human; identical to SEQ ID NO: 27876

SEQ ID NO: 132183 - DNA, 601 bp, Human; identical to SEQ ID NO: 27877

SEQ ID NO: 132184 - DNA, 601 bp, Human; identical to SEQ ID NO: 27878

SEQ ID NO: 132185 - DNA, 601 bp, Human; identical to SEQ ID NO: 27879

SEQ ID NO: 132186 - DNA, 601 bp, Human; identical to SEQ ID NO: 33038

SEQ ID NO: 132187 - DNA, 601 bp, Human
atacaagttttccaaaattctgtttttcactagaaagcttaaactttatcactggcaacaaatactgtcacttgttttatgtgacaggtttgctttactcattctcaagaaaatgactgccaaatacccaagtgtgaacaactgtaatttgtcagttgttcttcaggtaaaatagtattccataaaaaagcagctagttcagcatgcaactctaataataacacaagtgcttttcctggtaaccatcatgttttggtatgcagcagaaacattttagtcatacttcctcttatttttttttttttcttttttgacagggtcttcactctgtcgtccaggctcgagtacagaggtatgatatcagcttactgcaacctccacctcccaggctcaggtgatccttctgcctcagcctcccaagtagctgacaccacaggtgcacaccaccacacccagctaattttttgtatttttgtagagacagggtttcactatgttacccaggctggtctggaactcctaggctcaagcgatccactcacgtcagcctcccaaagtgctaggattacaggtatgagctactgcacctggcccatacttt

SEQ ID NO: 132188 - DNA, 601 bp, Human
tttcactatgttggccaggctggtctcaaactcctgacctcaggtgatctacctgccttggcctcccaaagtgctgggattacaggcgtgagccaccgcgcccagcctaaaaaatattttttaaatgtcagttgttaatattaccaatcttcagaaaagactaagtattgggaagctatcaagcacatgaatacaagttttccaaaattctgtttttcactagaaagcttaaactttatcactggcaacaaatactgtcacttgttttatgtgacaggtttgctttactcattctcaagamaatgactgccaaatacccaagtgtgaacaactgtaatttgtcagttgttcttcaggtaaaatagtattccataaaaaagcagctagttcagcatgcaactctaataataacacaagtgcttttcctggtaaccatcatgttttggtatgcagcagaaacattttagtcatacttcctcttatttttttttttttcttttttgacagggtcttcactctgtcgtccaggctcgagtacagaggtatgatatcagcttactgcaacctccacctcccaggctcaggtgatccttctgcctca

SEQ ID NO: 132189 - DNA, 601 bp, Human
caataaactaattacaaggtaacataaataacatccttatgaaaaattacggcatttactaagataaaagtttaatgagaagggtgacatttgtttttcattttgaaaatctctttaatatctggtttaatatagacgatagctggatgctcataactgcttctgtatttaatctgttgtgatgtgttattttggtagagtggggtttttttttgagacagagttttgctctgtcacccaggctggagtgcagtgatgtgatctcagctcactgcagcctcctcgcctcctgggttcaagygattctcatgcctcagcctcccgagtagctgggattacaggctcgggccacacacccggctaatttttgtatttttggtagagacagggtttcaccatactggccagcctagtctcaaacttctgacctcaagtgatccacccgtcttagcctcccaaagtgctgagattacaggtgtgagccaccatgccctacccttggttaaggcatttttaaaaatctggctttatacacatacgaagctgaaaatggaggagtattttaatagctttttcagaaaactgtggctattcttgtttg

SEQ ID NO: 132190 - DNA, 601 bp, Human
atcaacgggagctaagtggcaacttaatttatgtcttccaatccatgaacatgaacattcagtcttaattttttttcttttttgagatggagtcttgctctgtcaccagactggagtgcactgctgcaatctcagctcactgcaacctccacctcgcaggttcaagagattctcctgcctcaacctcccaagtagctgggactacaggcgcatgccaccatgcccagctaatttttgtatttttagtagagatggggtttcaccgtgttggccaggatggtctcgatctcttgacctcatratccgcctgcctcagcctcccaaagtgctgcctggccttaatctctttcatcagcattttacaattttccatatacagttccttcacattttgctagacttacacgtatttctttctgttctgaagccattgtaaatggcattgtgttggtaatttcattttgaattgttcactgctagtatatggaaatatgactgacttttctttttttactttaaaatgctgttttcatgtgatgtatgactgatttttgtgttgatcttgctaaacttacaggatttttttttttgtatacttcat

SEQ ID NO: 132191 - DNA, 601 bp, Human
tttttaattaatttttcttgagatagggtctatatcacccaggctgaactcaaactcttggcctcaagcaatcctcctacttcaggtgcccaagtagcaggattataggcatgtgacaccatgccccactatcagtattttttaaagtttggtccattctaattggtatttgaatctactgtggttttaatttgtatttccttaatgagtaaatgatgttgaacatcttttcatgtaatttttttttaccatctacattattttgggtgagctttttgcccatttaaaactagggttgtayagacttgtttcttttgagagctcttcatatactctagataccagttctttgtcaggtgtgatttgtaaatattttctcccaacctgtcgattgcttttccattctcttaacagtgtttttctcagagcaaaagtttaaaattttgattaagtcctattcatcaatttttcttcttatggatgtttttaaattattatctaagatttttttgcctaactccaggacataaagattccttcatgtttcctctaagttttatggtttcacattttacatttagattataattttgagttaatt

SEQ ID NO: 132192 - DNA, 601 bp, Human
gatgctaaaacagtctcatttactctaaggtaaaacttctcatttctctaaggtaaatacccaagaataggattgcatggtctcatggaaaatgtgtttataagaaatggccaaactactttctggagtagctgtatcatcccgcattcccatcagcaatatatgagagttccagttgctccacatcctcactagtgctttttaaaaaataggctaggtgtggtggctcacgcctgtaatctcagcacttcagaaggccaaggtaggaggatcacttgatcccaggagttcaagtccagcrtgggcaacagtgagatcccatctctatttaaaaaacagatgaaaattgcacatacttatgtacaacatgatgttttgaaatatgtaactaacactttttatagttagggtttttttttaattaatttttcttgagatagggtctatatcacccaggctgaactcaaactcttggcctcaagcaatcctcctacttcaggtgcccaagtagcaggattataggcatgtgacaccatgccccactatcagtattttttaaagtttggtccattctaattggtatttgaatctactgtggttt

SEQ ID NO: 132193 - DNA, 601 bp, Human
ttattgttcaagtgttatgaaccactggaagctgtctctttctgcttgtaaggtagtcacttttcaacaatacaatggcttttgttacatggctgatagagcaaaatctgatcacctggattacagaccatttaaccaatttcaatagggcctcctgaggaaagacagaatggacaggagtcattctacgtcctgtaatttcaggtccccagaacaattgattctgttctttttggatgcaaaagctttaaagcaagagggggatgagggagggaggatatactgtaggcggaaagaaagrgatgtgctgaccacagagttctgctagttccattctggaaaggcctaaggccagttctgtaggagaatgaagggacaaccccttactaccataaaccccagctggcaacttcaattaaagcacctagggaactactgaagccaacaaacccaggtcattcacaagcagcaaataaaaagggcaaagttccaggtaagataaggtctcaccagccacagagagaaagtagagtccttccataaagaaacctcaagagaatgaggttctcttgaggaaaaataacagtgactgaacatttac

SEQ ID NO: 132194 - DNA, 601 bp, Human; identical to SEQ ID NO: 33039

SEQ ID NO: 132195 - DNA, 601 bp, Human; identical to SEQ ID NO: 33040

SEQ ID NO: 132196 - DNA, 601 bp, Human; identical to SEQ ID NO: 33041

SEQ ID NO: 132197 - DNA, 601 bp, Human; identical to SEQ ID NO: 33042

SEQ ID NO: 132198 - DNA, 601 bp, Human; identical to SEQ ID NO: 33043

SEQ ID NO: 132199 - DNA, 601 bp, Human
atctcctgccttctctcgccagatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcrtaccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaag

SEQ ID NO: 132200 - DNA, 601 bp, Human
tgggaccttgtgaaactttcctggggacccaaatgcttagggaaaagcccttgagccctggcacaggctcaagccacagtgactttgtcatctattcccttcaagcacaggatctcacccccaccccaccctgccatctccctttcctggccatctgggttctggtggatcagcaaacaggctcacacacctgagctgtctctttacagccctgggatcactgcataaggttgccctgggccagagccagtgagcgcttgctggatctcagcctgtcttctaaccgcctgctgcggaggtmtctctccctcctaggcagaactctgcccgagccagtggggaaacccaggcagcacgagagctcttctttccctaaccttgctcagttagaaagacatccaagacatccctggactgaaggaagcaaagcagcatataaagaatgggctagggcaggggcagggaggagcagtgagaccagcagaacagcagcagtgctgggagtcttggcctgtaagtggaggaggctctgctagtctggcctgaggcttcctgggcccttcccaggcatggaccaggatgtaaggatatgcctggtggg

SEQ ID NO: 132201 - DNA, 601 bp, Human
ttgtgttgctctccggagtttgtactttaggcttaaacttcccacacgtgttatttggcccacattgtgtttgaagaaactttgggattggttgccagtgcttaaaagttaggacttagaaaatggatttcctggcaggacgcggtggctcatgcccataatctcagcactttgggaggcctaggaaggtggatcacctgaggtccggagttcaagactaacctggccaacatggtgaaacccagtatctactaaaaaatacaaaaaaaaaaaaaaagaagaagaagaagaagaagaagaaaataaagaaaagttagccgggcgtggtgtcgcgcgcctgtaatcccagctactccagaggctgcggcaggagaatcgcttgagcccgggaggcagaggttgcattaagccaagatcgcccaatgcactccggcctgggcgacagagcaagactccgtctcaaaaaataataataataaataaaaataaaaaataaaatggatttcccagcatctctggaaaaataggcaagtgtggccatgatggtccttagatctcctctaggaaagcagacatttattacttggcttctgtgcactat

SEQ ID NO: 132202 - DNA, 601 bp, Human
tgcatctacttctaaagcagctgttcaacagaaacagaatgggagccacacacataattctacattttctagttaaaaagaaaaaaaaatcattttcaacaatatatttattcaacctagtacatacaaaatattatcattccaacatgtaatcagtattttaaaaatcagtaatgagaccaggcacggtggctcacgactgtaatcccaggactttgggaggccgaggcgagtggatcatctgagatcaggagttcaagaccagcctggccaacatggtgaaaccccatctctactaaamactagctcagcatggtggtgggtgcctgtagtcccagctactcgggaggctgaggcatgagaatcacttgagcccaggaggcagaggttgcagtgagccaagattttgggggattctgtgacatacaaaaaaaatcagtaataagatatcttgcatactcttttcgtactcatatacttccagcatatctcaattcacaatttctaagtaaatgctctatctgtatttacttttataaaattcacaattaaaaatgaaggttcacatagtcaagttgttccaaacacacttaaatgtctc

SEQ ID NO: 132203 - DNA, 601 bp, Human
ttttcgtactcatatacttccagcatatctcaattcacaatttctaagtaaatgctctatctgtatttacttttataaaattcacaattaaaaatgaaggttcacatagtcaagttgttccaaacacacttaaatgtctcctaggctgggtgtggttgctcacacctgtaatcccagcactttgggaggctgagatgggcggatcacctgaggtcaggagtttgagaccagcctggccaacatggtgaaaccccgtctctactaaaaatacaaaaattagctggatgtggtggcactcacmtgtaatcccagctactcaggaggctgaggcaggataattgcttgaacccgggaggtggtggaggttgcagtgagccgagatcgcaccactgccttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatca

SEQ ID NO: 132204 - DNA, 601 bp, Human
cttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatcattggttctcagatctggctactcagcagaaccaagaatccacagaaacggcttttaaaagcacagccccacagcccccagccccagccttacctacctggaggctgggaaggactctgattccacgaggcagcctatgttttttgatggagggatgtgacaggggctgcatctttaacgtttcctcttaaatactggagacagcttcgaggaggagataactggatgtgtcttagtccatttgatggagggatgtgacggggctgcgtctttaacgtttcctcttaaataccggggacagcttcgagaaggagataactggatgtttcttagtccattttctgttgcttgtgacagaatacctgaaactgggcaatttatatggtaaaaaatt

SEQ ID NO: 132205 - DNA, 601 bp, Human
catcatggccaggtgcggtggcttacgcctgtaatcccagcactttgggaggccaaggtgggtggatcatgaggtcaggagtgagaccagcctgaccaacatgctgaaacctgtctctcctaaaaacacaaaaattagctgggcatggaggtgcacgcctgtaatcccagctactcaggaggctgaggcaggagaatcacttgaacccgggaggcggaggttgcaataagcctagattgtgccactgcattccagcctgggcaacagagcaagactccgtctcagaaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcagaggagtaaactgaggttccaaaaggtttagcagttgcccgaggaatattaaattggcaaaagcaggtagaata

SEQ ID NO: 132206 - DNA, 601 bp, Human
aagcctagattgtgccactgcattccagcctgggcaacagagcaagactccgtctcagaaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcaraggagtaaactgaggttccaaaaggtttagcagttgcccgaggaatattaaattggcaaaagcaggtagaatataaagcaaggagtatttggcaacggttcttttttatgattaaaaacagccgaagaaagacttctacttgtgcctttgaaggagtaactgcatttgaccttcccaccagtaacaaccatcaaatctctattaaattaaacacacacacacacaaacaaaaacagctattgtgaaggtatcagcgactaagacaactaaggtttgaggggccaggatcctggagagatg

SEQ ID NO: 132207 - DNA, 601 bp, Human
gcccggcctcatgttttttatttttcaagttgaaatgaggtctctctatgttgcccaggttggtctcaaactcttgagctcaagtaatcctcccaccttggcctcccaaagtgcggggattacaggtgtgagctaccatgcccagccaagatcagtgttaatgaatcaactatatatattacataaggtgtctttaaacagaaataaggttatatattgatcgattggtaacaatgttgtgaccagcagcttacagggtacctagccttgtatttctcctataaataatttgctcgttgastgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttcttcagagacatgtgtttctaaggtctgcactctgccccaccctccccatccactgtcccccagcccgtttcctcctccacttacttcccagccctgtgccttctgccttctc

SEQ ID NO: 132208 - DNA, 601 bp, Human
tgtctttaaacagaaataaggttatatattgatcgattggtaacaatgttgtgaccagcagcttacagggtacctagccttgtatttctcctataaataatttgctcgttgagtgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttyttcagagacatgtgtttctaaggtctgcactctgccccaccctccccatccactgtcccccagcccgtttcctcctccacttacttcccagccctgtgccttctgccttctcttttctgagtttgctaagggcactgctggctcaagagcagtaactaacagtctctcgcctcttctctccatggcaaccagtgacctttggagaatgtaaaccttatcaccaatctcttaaagcccttcggtgccttcccaggatgacgtccagctgaggtccttggcaagacccagggcgccccctcc

SEQ ID NO: 132209 - DNA, 601 bp, Human
caccctgtaacctgaacagcctgcagcagccctgcccagtagaacttcctgatgtgatggaaatgctgtgtctgcaccactagccacatgtggccacaggattctcgaaactggtggtgcagttgaggagctgactttatattttatctcattaaatttaaatgtaaatagctacgtgtggcttgttggctagcctattggaaaacacgggcttagagagacacagggagaactcactgtaatgcactaaaagaaggtaaaaaaaaaaaaatcctaagaaatattcctaaaatactttaayatagggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgcgccactgcactccagcctgggcgacagagcgagacttcatctcaaaaacaaaaaacaaaaaccaaaaa

SEQ ID NO: 132210 - DNA, 601 bp, Human
ggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgcgccactgcactccagcctgggcgacagagcgagacttcatctcaaaaacaaaaaacaaaaaccaaaaaaaaamacttcagcatgattatttaaccaaaatgcaggttagttgttcaccggatgcagagtccaattaacaagagcaaggcctggtaccaaaaaaagtgaatttactccgaaactagcttgggtgaggggtacaaagcatcctgcctttctttaaaagtgctgcttccccttggaagtagaaagtggacacttttataaggtaaggggggaagtgtgcaagggcaagtgggggggtccctctgctagttccgtgcatactctacaggacagttgacttggcaccttcctggttagtaataagctg

SEQ ID NO: 132211 - DNA, 601 bp, Human
ccttcctggttagtaataagctgtagcagtggccaagtgggcatgctttcagtatgccctcccagtgaatgaaagtcctgaggcaacccccaagggtggaagtgccaggccaccacccactggaggtgaaagttccgtgatgggtttgctttggtctgcgaatctactgtcatgtggagagatctgtgctctggaagagcatacagttagaaaagcttgccctgaagggaatgtatggtgaaggggaggtgaaaggttatatttgcatttctgaagggctaagtaggaaaccgggaaccargggagaggagaagagaagagaggataattttttttaagaaaagcaacatattccctttttcttagaaaaaatggagcactcggttacaggcactcgaatgtagaagtagcaatatataaattatgcattaatgggttataattcactgaaaaatagtaacgtacttcttaactttggctttcagagttcgaaccaacgtggcctcaaccagatttggaatgtcaaaaagcagagtgtctatttgatgaatttgaggaaatctggaactttgggccacccagggtaagataaaacaccttc

SEQ ID NO: 132212 - DNA, 601 bp, Human
gtcctcctctctgggcagtacagggttggcatacctcctgaagtgaattaggaactacactcattccagcttccagtttggtctttatctgtcagtgccttactgtcctctgcattgttgagtctcagtcaccttgtccaagttccattggccagaaagggctagaagcacagaagggctggaagtggcatttgttcctcactcacattctggtgggaagaacttagtggtgtggccttagctgactgtaagggaggctgggaaatatagtctagcgagtgccctggaaaaagccggcacrgcattccccatggaaagctgtcaggcacggctacagtctaccccctgccaaccagtatctgcatggaccctccttccacactcagatgcatttacccccagccccaagagagccaaccgatgcccatgtggtcaccacagccacctccgagtccaagatttccaggtgacatgcagtctcctctctcccagcttcaggaatggcttcttctgatctacacacagacacagacacacacacacagacacacacacacacacacacacacacacacgatggagaggggcaggataactgcaa

SEQ ID NO: 132213 - DNA, 601 bp, Human
ctgaccgtgttatctgcctgcctcggcctcccagagtgctgggattacaggcatgagctaccacgcccggcctttaaatttttactttgggccgggcacggtgccttacgcctgtaatcctaacatttcgagaagctgaggcacgtggtggatcacttgatgtcacgagttcagaccagccactgcactccagcctgggtgacagagtgagactctgtctcaaaaaaaaaaaaaaaagaaagaaaaacttttactttttacatgttattttcatcaatttaatgaatttaaataacaaatrtataaatttgatattaataaaatggaagcatttggtaatcatgttttgggttttgtgcttcctctgcagctctctagatgagaccacctatgaaagactagcagaggaaacgctggactctttagcagagttttttgaagaccttgcagacaagccatacacgtttgaggactatgatgtctcctttggggtacctcttgacttcttttacttttctgtttccccctctaagaattttagttcactaaaatgaagaatttccctccagcagagctaagcatcaagtagcatgtagttgta

SEQ ID NO: 132214 - DNA, 601 bp, Human
catacacgtttgaggactatgatgtctcctttggggtacctcttgacttcttttacttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatggatggatggatggatggatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgc

SEQ ID NO: 132215 - DNA, 601 bp, Human
tacacgtttgaggactatgatgtctcctttggggtacctcttgacttcttttacttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatggatggatggatggatggatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgctc

SEQ ID NO: 132216 - DNA, 601 bp, Human
tcccctagcctctactagagcctgtaactgcagggaaaccaagttgcaggctaaactctgcccacacatgcagacattgattagcaagctacaaaaacagtcatgaaacctgtttttataggattagtgaagccccagtttgaccagagtactttgcatgaatgttttgttagaagcaaatgtgccaatattctagcagctgcgtttggtttacttcttcttcttctttttttttttttttgagttgaagcctagctctgtcacccaggctggagtgcagttgtgtgatctcagctcactrcaacctctgcctcccaggttcaagcgattctcccgcctcaacctcctgagtagctgggattacagacatgtaccacaatacagggctaagttttgtatttttagtagaaatggggtttcaccatgttggccaggctggtctcaaactcctgatctcaagtgatccacccgcctcagcctcctaaagtgctgggttaacaggcatgagccacggcacctggcaaaagtcatcttttggtttacttctattgaactgaaaaagtcacaaatatatttatatttaattaaatatatttatata

SEQ ID NO: 132217 - DNA, 601 bp, Human
tagagacagggcctcgctctgtcacccaggctggagtgcagtggcacaatcatagctcactgcagcctcaagcttctgggctcaagtgatcgttccacctcagcctccctagtagctgggactacaggcacatgccaccatactcggctaattattttattttatttatgggtctcgctatgtttcccaggctggtctcaaactcctggcctcaagcgattctctcacctcggcctcccaaagcaccaggattacaggtgtgtgccagcacacccagccacaaatctataaatttagaaargaggactatttctaaagagggtcccactacctgtaggcaggaagcagagcctctggccataactgaaaaacaagcacttccaagaaggggcaaagggaacatgaatttatgctgagaggcgtagctaagcatacatattcaacagattatgggaggatctatgaatattcacaaagggaggatctatgaatatgcacacatgtggagtaagctaacgtgtgcagcatgtctcccatgttcaccttaggcagaaacttaacactaacatgtattacagggcaacaaaatgagactgcatat

SEQ ID NO: 132218 - DNA, 601 bp, Human
gctgggattacaggcagctccaaagtgctgggattacaggcatgagccaccatgcatggcctgaaataatttttttgaaagggctagtttctatttagcccttaggggaaaaaaaactaatggcagttagggagggaatagaacgagtcctgtttgaactcctttcccatcatggccaaaacttaaaattttttttagatatctctgggctccccttggccaaaagatagtttgttgagtcagttgggagcttagaattttgtttttatttctcacatcattgaatcaatttgaaccaggygacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatagtttggacttgtgattaactacattgaaat

SEQ ID NO: 132219 - DNA, 601 bp, Human
tctcacatcattgaatcaatttgaaccaggcgacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatrgtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacg

SEQ ID NO: 132220 - DNA, 601 bp, Human
agcactctgaggttgactctgtggagcactgatccctctgtgttataattgtctatttacacgtcagctaccacctataacacactgagttcctcaacagcagggacactgtccattctttgatcccagtgtctggaacagtgccaagtacatagtagggacttaataaatattgattcatatgtaaatgagacttttccaaaacatgctttcgttgatgcctctcagcatttatacaccttttaccaactcgctactggccacatagacaaatgaaagcagtaatccagatacacccaaraggacatctgttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagt

SEQ ID NO: 132221 - DNA, 601 bp, Human
aaagtgcatcctagcaagttggtatctactttagaaatgaaggaggtcatatgtatgtgaagtctccagacccaacatgccatcttatatgtgtctatttctacaagtgagctagtgacaacagtaattgctatttttgctcctacatgggtagggctgatcttgactaggaggagtcaataagactcaccagccgggcgtggtggctcacgcctgtaatcccagcactttgggaggccaaggcgggcggatcacgaggtcaggagatcgagaccattctggctaacacggtgaaaccccrtctctactaaaaaaatacaaaaaaattagctgggcgtggtggtgggcgcctgtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaa

SEQ ID NO: 132222 - DNA, 601 bp, Human
gtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaatagactcagattgtctaaggaataatgatgatgatgaagagaaagccctctktatctggtctatttgtagtcagttccaaaagcattaagaatttctgctgaactaatgcagctagtttctttcctgtcaccactttccttccaaaatagtttcaagatctgtgggggaaaaaatctatttacagtgaacagactggtgggaggaagttgagcattggggttttctgccctgtgtaaccttgccctaagttgggcagatggtatcacactacctggacatcatctgctcattcactatttgaccagttggtcattcattcacaaatgtcctttttgcaggagggatggaggt

SEQ ID NO: 132223 - DNA, 601 bp, Human
ggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaargagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccag

SEQ ID NO: 132224 - DNA, 601 bp, Human
ggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtatarggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcat

SEQ ID NO: 132225 - DNA, 601 bp, Human
tcgctggttaatgggattgagagaatgcttcatcttatagaaagaacagtgtctttggacccacagagacctggatttaagattagctctgccaattactgagtactctttactatgaacctctgttttcctcatctgtgaaactggaataatgaatcctaccgccaacaattgtagtcaagttggaaacaatttacacaaagtgccaaacaccaagcctggcacagtaggaaccgagtaaatagtggttaatatttttatcagtgtctgcattgctgacgtctccatcatttctatacayttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgttcgcccagtctggtgtgtagtggtgtgatctcagctcactgcagcctcaacctcctgggctcaggtgatcctcccacttcagcctcccaagtagctgggaccacaggcgcatgccaccacacttggcta

SEQ ID NO: 132226 - DNA, 601 bp, Human
tgtagtcaagttggaaacaatttacacaaagtgccaaacaccaagcctggcacagtaggaaccgagtaaatagtggttaatatttttatcagtgtctgcattgctgacgtctccatcatttctatacacttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgttcgcccagtctggtgtgtagtggtgtgatctcagctcactgcagcctcaacctcctgggctcaggtgatcctcccacttcagcctcccaagtagctgggaccacaggcgcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatc

SEQ ID NO: 132227 - DNA, 601 bp, Human
cgtctccatcatttctatacacttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgttcgcccagtctggtgtgtagtggtgtgatctcagctcactgcagcctcaacctcctgggctcaggtgatcctcccacttcagcctcccaagtagctgggaccacaggygcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatcattcagagcctctcgattggatggaggctctagaatgcacagaaaaaggctgccaccgtgtatctctgcaagtcatgcacaagatggggaacagcaggcttccccct

SEQ ID NO: 132228 - DNA, 601 bp, Human
ctcttttgttgaaagagtgttttcaaatttaaatgagcatttattggtcaaagatgcaccaactagtcttttgaagaattcaaggctctttagagaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgrgttgacgtggtactctaatagagttagagtctgcattttttttatgtcctctagtatgttctggttgatggttgagggcaacaaaccagcagtcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtat

SEQ ID NO: 132229 - DNA, 601 bp, Human
agaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgggttgacgtggtactctaatagagttagagtctgcattttttttatgtcctctagtatgttctggttgatggttgagggcaacaaaccagcagkcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtattttgtgtacttgtagaaatggaaagtgttgagataaaacatgaagcaatgatgacaaagtgctaactttttcttgttttaatttctttatgct

SEQ ID NO: 132230 - DNA, 601 bp, Human
ggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccttgaggacaagctctcagtgcttctgtgggaagtggcggcaagacggcagctcccagcgggggatggaggccgagtcagtctgctggtcactggaggccaggatgctgcctaacacagccgtcccgctcygggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccgga

SEQ ID NO: 132231 - DNA, 601 bp, Human
ggccttgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccrcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttg

SEQ ID NO: 132232 - DNA, 601 bp, Human
ccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctrcttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtat

SEQ ID NO: 132233 - DNA, 601 bp, Human
ttgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctacttgggagactgagacaggagaattgcttgaacccaggaggcgaaggttgtaacgaactgaaatcgtgccacagcactccatcctgggygacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaa

SEQ ID NO: 132234 - DNA, 601 bp, Human
caggagtttgagaccagcctgggcaacatagtgaaaccctgtctctactaaaaatacaaaaaattcgccaggcatggtggcaggcacctgtaatcccagctacttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcrgctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaa

SEQ ID NO: 132235 - DNA, 601 bp, Human
attgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggargaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccg

SEQ ID NO: 132236 - DNA, 601 bp, Human
gattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgtttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgt

SEQ ID NO: 132237 - DNA, 601 bp, Human
tttttcaaataaaggttgtttaatataaaaaaaattttgtttttttttctctcagcctttcacattggttcaaaatatctttcatctggctgcatttctgatttttgttttgtttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgtttkttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactggga

SEQ ID NO: 132238 - DNA, 601 bp, Human
cagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggytcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagac

SEQ ID NO: 132239 - DNA, 601 bp, Human
tttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataaraagacatggcagaagccagcctccgatctgtccacacgaatacggcattcccaaagcaacgtgcatgtgccattattcacgggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttgatgggtatagttggccttgtgtatctgtgggttccacatctgattcaaccaaccgtggatcaaaatatttgaaa

SEQ ID NO: 132240 - DNA, 601 bp, Human
ccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacrgcattcccaaagcaacgtgcatgtgccattattcacgggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttgatgggtatagttggccttgtgtatctgtgggttccacatctgattcaaccaaccgtggatcaaaatatttgaaaataaaaaacaaaacaaaaatgatacaaataaaaaccaatataac

SEQ ID NO: 132241 - DNA, 601 bp, Human
cttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacggcattcccaaagcaacgtgcatgtgccattattcackggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttgatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattata

SEQ ID NO: 132242 - DNA, 601 bp, Human
atcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttttttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatga

SEQ ID NO: 132243 - DNA, 601 bp, Human
agccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataycccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttc

SEQ ID NO: 132244 - DNA, 601 bp, Human
caccctgtacaattgtgcaggttattaactacacaaagggtgttggccacagttgagaggggctgtatccacctagagaaaggggtgccctgcacacagaggcaccacagggatgagcagcagcgcaggcaaagctgccgtcactcactctgaagacttcggggaggatcttgtccagtgttctgggtgggggtgagaggcaggggaagagtgggttagagaggggcaggcagcagcacctaccaggggttccttgttcttcaccaagcggacgatcttcaccgattcctcatcaaaatcytcatcgatattgtcaggcagaggcgggagaacggggtcaaaattcttctgggcaaccgtgtcatgtaccatgagcacagcctgccgggaaagccagagaaaaggaaggctggcccgccgctcacagggtcagcaggccgcagctggccggtggtatggagggtggcagacgccatgccagagagacaactgcccagacactagtgctgaggatcgctccctcagtctccactcctcagcctcattaggagagctccctccgcccccatcccaggagacccagaggcatggctgggcaggg

SEQ ID NO: 132245 - DNA, 601 bp, Human
ccgcacgtgtcaggagggcagggaggtgcccctaaggccttgaaccctgtccccaccagctttgcctgcctcaaggaacagcccagtccagctggcagagcaggaagaggtgcgcagacagtgggaggggcacagctgcccagatagggaaagaacacgagcccctcaggccccagacgttccacggaaaaggggccacgcctgtggacagcggatagatactgggcctacctttgtcacaaggctgatcatctgcggtttgcacaaaagacagatggaacagcattagtggagggaagcrgggaccctgcggctgagggcagccacggcccgagtgcctgaggagcccgccatctggcctctttccctttcctccaacgaacctgtgatctgagctgtggtacgttattaaaccccaagacctgctctaattagtcttcttgtatgtgtctcattagcaccagagaaagccagctcatcagtggcacagcagcctcaaggccactgcccttctaacctgacagcaagtctggaaaagtggccattgtcaggggcccagggagcagcttactctaggatcctgcggtgggaataggaccca

SEQ ID NO: 132246 - DNA, 601 bp, Human
taaaataaaaagtgtatcaacgtggacagttaaaactgagaattagtatgaactaggattgcatcaaaatcttgactcagcgggagcttcctgaccaaggggaaggatccgagaaggcctccttcagatgaaaccagctatataggacagcaagtaaagtctattctgggactgagttgcttctgactgcccccaccacccacaacaacttccaactcattctgctaactgaccctgttaagaaccaaaaaagatgagtcaccaagcccacacctcctggaagaactctgtcaaatatttmggttttgggtgagggtctcgccatcctgacatagactgggctgaacaaagaatctatgacagtgaaacagaagttcatttaggacacatcagacgatctcatccactagttttagaaatcccttcattcactgatgattcaaactggtttgatagcagtgataatgaccttgttagttggggtttcaatttaaaatacttggatttggcctaggagtatagtttgatgagtacagtctgtcacactcagatgaggtccctgacaggtgtcacattttgcgggagggcgcttatgtgaggg

SEQ ID NO: 132247 - DNA, 601 bp, Human
agccaatattgtatgtttctaaatgattctagacttaagttgatattcccctattccccttagagtttcttgtgtctttttttttttagatggagtcttgctctgtcacccaggctagagtgcagtggcgtgattttggctcactgcaggctctgcctcctgggttcaagtgtttctcctgtctcagcctcccgagtagctgggattacaggcatgcaccaccacacctggctaatttttgtatttttagtatgagacggggtttcaccatgttggcctggctggtctcgaattcctgacstcaggtgatctgcctgcctcagcctcccaaagtgctgggattataggcgtgagccaccatgccagcctcccccttagagtttctaaaggagaaaatttttcttttttctacatttttttttttttgagacagagtctcactgtgtcatgcaggctggaatgcagtggcatggtcatggctcactgcagccttgacctattaggctcaagtgatcctcccactcccacctcagtctcccgagtagctaggactataggtttgtgccaccacacctggctaatttttgtaatttttttgtag

SEQ ID NO: 132248 - DNA, 601 bp, Human
agataccacttcacacctactagtagtgctatgattaaaaagacagacaataacaagggctggtgaggatgtggagaaatgggaactcttgaacactgctgctgggaatgtaaaatggtacagctgccatggtagagttaaacatagaactaccctatgacccagcaattccataccaaggtatacacccaagagaaatgaaaacatatgttcacacaaaaacttgtatatgaacattcataacatgattcataatagctgaaaaggtagaaacaatctaaatgtccattaatcgataaaygggtaaacaaaatgtggtactctatacaatggaatgttattcagccataaaaaaagaatgaagtattgatacatgaatgaactttaaaaacattatattaagtgaaaaaagccagatacaaaaggtcttacattgcatgaatccatttatatgaaatgtttagaatagacaaatttatagtgacagtagattagcagttgcctgtggctaggaaggggctggaggaaaacagataatgggaaattctaatgggctcaaggtttctttttgaagtgatgaaaatactcttaaattgactgt

SEQ ID NO: 132249 - DNA, 601 bp, Human
gggagtagaaccggggactctgtgttgaacagcctcactgtgaccctgctgcctactcacagctgcagtgtggtggagcatgaacgggccagctgcatttcatcatcagcccacctgcttggaatgcagcattctggtgggcaataaaggagatgggatagatgacaaaaccggccaggctggaaggacactgggaatagaatgcagctgcttctcttgaaataacaaccatgggccagggagggttctgaatcctagaaagctggcactgcctgtggacctgatgatttggccttgagtyctaggaagctgcctcttattctcccagtgacttcttgactctttgaaaaatgagccatttccccctgcttattcaatcctgaaatatttgcaaaacaaaacaaagccaatatagtaaaacaaatgggcagattgatcctaaaattcatatggaaatgtaaaggacccagaatagccaaaacaagcttgaaaaacctgacttcaaaacttactacaaagctagtaatcaaagtaagacagtgtggtgctggcctaagaatagacatgtagaccaatggaatgggactgagactccagaaag

SEQ ID NO: 132250 - DNA, 601 bp, Human
agactgtttcaggtaggctgtgaagttgacttagtagtaaaagcccactgaagataatggtggttcagggcagtgtggcaaagatggtcagtgaaaagcttactgaaatcgttggtttcagaaacagtgactccacgtgtcatgcaaaatccttgaatgggaattcttattccagttttaccagcattgtgttttgactttgggaagacaaagtaatttgtgttgacctatgataatcttgagtattctgatatatattggttctctagcacctcttcttctcaattgttatgtttttttytcatacattatagagagacgtgttttaggtacaaaggcaatgtccatgtgtagctgcattattactgccccttttagtcagtttcctaggtcaggctttttgtcctgtataccttctagtaaccaaatctaaatggtttatctcaaaggaaagatgttattgcttatgagtcttacttatagaactagatcctgttaaattttagtcttatgtatcgagggaaagaattattaaacttattttatttgactatgtcaagaatacagagctctcctaggattaattagtggttgacagtat

SEQ ID NO: 132251 - DNA, 601 bp, Human
ggaagacaaagtaatttgtgttgacctatgataatcttgagtattctgatatatattggttctctagcacctcttcttctcaattgttatgtttttttctcatacattatagagagacgtgttttaggtacaaaggcaatgtccatgtgtagctgcattattactgccccttttagtcagtttcctaggtcaggctttttgtcctgtataccttctagtaaccaaatctaaatggtttatctcaaaggaaagatgttattgcttatgagtcttacttatagaactagatcctgttaaattktagtcttatgtatcgagggaaagaattattaaacttattttatttgactatgtcaagaatacagagctctcctaggattaattagtggttgacagtattactaatctttaccagttgtggcaagaagggtggttttatttgagtacacgatgagtagagctttttacaaatgaaggaatgcatgggaattctaaaggcattatatttggactcgctaaagaattctgtgtttatggtaaaatgacttcaattaagctcatctaggttttgttctcatatgatatatttttgaaacttttt

SEQ ID NO: 132252 - DNA, 601 bp, Human
gaagggtggttttatttgagtacacgatgagtagagctttttacaaatgaaggaatgcatgggaattctaaaggcattatatttggactcgctaaagaattctgtgtttatggtaaaatgacttcaattaagctcatctaggttttgttctcatatgatatatttttgaaactttttgtttattcatttgccattgtgttctaagtaccacatcgagtacaacaggtgtcagtgtgaggtggtagagagaggagggctgtcagtatagaagaggtacatacgaaaatgttgcaaaggtgtrttgtatttttataggatttaattctctccaaaaccaaactcagtttaaaaaaatttttgtaatagcctaaaactatgcaatttgtaacacatttgatggattatctgtgggatctggtcccccaacccttcttgtcagtcatggaaatagtcataggcagatgggctgtgcacctgtgtgtttcttggcagaactgagttcagcgcccaatgggttgtgccctctgtgcttaggagctcctcccgtattgggaggcaggattgtacttgagtaatttgggatgtgcattttaccctttct

SEQ ID NO: 132253 - DNA, 601 bp, Human
tgcccatggcagtgacaagatgcatagccaaatccaaactcatttacctgtagatgcctctgtcactcatcagcagtggtgcagagggagagacaggccaacgcacaacgtgtagaatcacctttagttactagtccctttctcagaaaactcatatggttattttcctgtccctctcttggtgtccttatgtcactggcttatccatgacttaaggaaataataattcatggaacccatagtgagcaggaaaggagttctctggaaggctataaacaacactgatgtcaggtgttcctgmtagcgaatgtcatgatagctggagccacactcaagtgctaactgctgctttctggcctctggctctgcgtgcatgcacatatgagcacatgctcacacacacgcatgggtgtggctgcctgaaagcctggatctttcatgggatagcacgtggggcctttccttgctgtcttgaaacacacttcccacctcctctgcttgctgaaacctgtttactgcacatggatcatgcacagctcccgaacctctctgccatggagaattcactcttctgacttctcgcgcactctcagccttacgg

SEQ ID NO: 132254 - DNA, 601 bp, Human
actcatatggttattttcctgtccctctcttggtgtccttatgtcactggcttatccatgacttaaggaaataataattcatggaacccatagtgagcaggaaaggagttctctggaaggctataaacaacactgatgtcaggtgttcctgctagcgaatgtcatgatagctggagccacactcaagtgctaactgctgctttctggcctctggctctgcgtgcatgcacatatgagcacatgctcacacacacgcatgggtgtggctgcctgaaagcctggatctttcatgggatagcaygtggggcctttccttgctgtcttgaaacacacttcccacctcctctgcttgctgaaacctgtttactgcacatggatcatgcacagctcccgaacctctctgccatggagaattcactcttctgacttctcgcgcactctcagccttacggaagaggtagtttatgttagaatacaggagagctgtttttaaaggtcccttggtagatgtgggagtgttgaattagagtgacctaaagcacagagtctcttcaatttttttgggcatgctgatggaaaagggagcacaggctgtccccta

SEQ ID NO: 132255 - DNA, 601 bp, Human
ctgagaatgagtatgaggagtggctgaaagtctatcaggaagccagcaccatattgaaggacagagctcaacggttggaagagtgttacgagatcattgagaaggtaaccgcacacaatacagtcttttcagctccatgaaggacttaaccacctatttcacaaagtatttgaacaggaatccttttactatgtagggatgttctcttttcttgtgtcttaatgaaccgttagctctgaatcattttctttgctttaagaagcacttaattttcatggtctttctgaaagctctagccacyctcagctaaacattaatgatagcttaagaaatatcaggtcaaaaacagcatcagcgactttctgggtttgcttaagattaggcttaatgagattaactcacgctgttgagttacaggagcaatcagaatgctgtggaggctggttagatgttgtacatgctaagctttctcgcactaacttattctaatgatatttaaactttgccgttgctactccacattgcctactttgattttgttgttgttgttattcttttcagtttatcctaaggctttagctcactttcaatttattggttt

SEQ ID NO: 132256 - DNA, 601 bp, Human
agctctgaatcattttctttgctttaagaagcacttaattttcatggtctttctgaaagctctagccaccctcagctaaacattaatgatagcttaagaaatatcaggtcaaaaacagcatcagcgactttctgggtttgcttaagattaggcttaatgagattaactcacgctgttgagttacaggagcaatcagaatgctgtggaggctggttagatgttgtacatgctaagctttctcgcactaacttattctaatgatatttaaactttgccgttgctactccacattgcctacttygattttgttgttgttgttattcttttcagtttatcctaaggctttagctcactttcaatttattggtttccttcaagtgtgggagctgggtttcagctttttctgtctcatgttggcagccatagggccatccaatttccagtttctataacttttttttttaaatatagagacagggtttccctctgttacccaggacccaggctagaatgtaatggtgcagccataggtcactgcagcctcaaactcctgggttcaagctaacctcctacttcagccttctgaatagctgggactaca

SEQ ID NO: 132257 - DNA, 601 bp, Human
actgtcagtgtcctcgggataacctgcccatctgctctgctgccagatggcttctattctaacaagcccctgtatcaagaaatcagtgatgagtactgggctgcctgtgtgtgtagagtgagtccaccattgcaaggcatttggaaatgccatccatccagatgccatctgtagacacaagtataaaatagaggaaatagaacaactgtctcagaaccgtttgattgcctttctttgtcagaatttgttagtgctgttcttaagtatgtgccaatctttaactgaggatattttttcaatstagaatttgctgctacttggagccacagccatagaagatcgccttcaagcaggagttccagaaaccatcgcaacactgttgaaggcagaaattaaaatatgggtgttgacaggagacaaacaagaaactgcgattaatataggtaattatttttacaaataatttcctgatgctgggttttgtatttgtttttcaagtatcttttaaatgtgtctaaatgtttctcaaattcattgacagatgatgttttataggaatcttcattcacaaggctaaggaaaattgacctaaatcaaatga

SEQ ID NO: 132258 - DNA, 601 bp, Human
gctgctacttggagccacagccatagaagatcgccttcaagcaggagttccagaaaccatcgcaacactgttgaaggcagaaattaaaatatgggtgttgacaggagacaaacaagaaactgcgattaatataggtaattatttttacaaataatttcctgatgctgggttttgtatttgtttttcaagtatcttttaaatgtgtctaaatgtttctcaaattcattgacagatgatgttttataggaatcttcattcacaaggctaaggaaaattgacctaaatcaaatgaagatgcctycatgcctgttacaaacattaaaactatcatagttcctggaaaagaattagacacacttacatagggcatagaattcaagatttgacagctttgattttcttattgctttcttcacaaaattttagtctgagactaagagagcatgtttttactaggtttaaatatgcgttattattttatgtaattataaccattttaatggttttgcccattaatgggcttttctaagagccttgcatctttcccttcccagcttgttgacaacttccttgactgcagagcatcacagagatgaaaatt

SEQ ID NO: 132259 - DNA, 601 bp, Human
ctgggttttgtatttgtttttcaagtatcttttaaatgtgtctaaatgtttctcaaattcattgacagatgatgttttataggaatcttcattcacaaggctaaggaaaattgacctaaatcaaatgaagatgccttcatgcctgttacaaacattaaaactatcatagttcctggaaaagaattagacacacttacatagggcatagaattcaagatttgacagctttgattttcttattgctttcttcacaaaattttagtctgagactaagagagcatgtttttactaggtttaaatwtgcgttattattttatgtaattataaccattttaatggttttgcccattaatgggcttttctaagagccttgcatctttcccttcccagcttgttgacaacttccttgactgcagagcatcacagagatgaaaattgaagaaaaggaatttaagtcaggataactctgccgttgttaaaggagcacgttttaagtttgaaaaggagttgaagctactcattttttaaaaatctaatcttgattatttgaaacatttaaacactatctggtactttgatcagcattatggtgtaacaagac

SEQ ID NO: 132260 - DNA, 601 bp, Human
ccataatactttacattttcatgcatcctgtgtggattttaaggtatccagaagatatttgggaagatcaagtatctagcagttctccttctagatgaaaaaagggaagcagagcaagtaaatggagtgtctggcaagtgccaggcactatactaggagtgttttctgaaaactctttttttaatatttacatatgaacattcttatagctcgaggaggaaattctacatttcccagggctataccctacttaatgaccaaactggtactaggtctcagggctcttgacttctggtgtggrgcttatttagagggattcacatagcttttgcaaaaaatgctttctgaaatttgatttagaagaccacggagaatggtactacatttcatccattccaaggtgcacattgtttttacattttaatgtctctgaaatggggatgtcgtatagttgttgactcttagcttttaattgtcagcattatcttagtggtatgtaccataagagttcatctttagatttggtgacattaattatctttggtgtttggaggtgttggctctttttagagtttggttttttaaaatatatatatctatc

SEQ ID NO: 132261 - DNA, 601 bp, Human
tagagggattcacatagcttttgcaaaaaatgctttctgaaatttgatttagaagaccacggagaatggtactacatttcatccattccaaggtgcacattgtttttacattttaatgtctctgaaatggggatgtcgtatagttgttgactcttagcttttaattgtcagcattatcttagtggtatgtaccataagagttcatctttagatttggtgacattaattatctttggtgtttggaggtgttggctctttttagagtttggttttttaaaatatatatatctatctcgtagtytgagaatttatttttaaagtttaactttttattcataccttagaaaaaaaacacacagtcaaatcaagttccaagacatgtgtgtctcctgtgagccagtgaattgtatgtagatagacaatcatcttgtgtataggttttagtagtttgaaattggcatgttgccagaatcctgcaacactgtgcttgaatttatgctaactagctgtgttttgaggagttggcgattttctcttttagcttaaaaatttggcatcagctggtctaaagtgaaatttcagatgtagcccttgtgaattt

SEQ ID NO: 132262 - DNA, 601 bp, Human
gaaatttgatttagaagaccacggagaatggtactacatttcatccattccaaggtgcacattgtttttacattttaatgtctctgaaatggggatgtcgtatagttgttgactcttagcttttaattgtcagcattatcttagtggtatgtaccataagagttcatctttagatttggtgacattaattatctttggtgtttggaggtgttggctctttttagagtttggttttttaaaatatatatatctatctcgtagtttgagaatttatttttaaagtttaactttttattcatamcttagaaaaaaaacacacagtcaaatcaagttccaagacatgtgtgtctcctgtgagccagtgaattgtatgtagatagacaatcatcttgtgtataggttttagtagtttgaaattggcatgttgccagaatcctgcaacactgtgcttgaatttatgctaactagctgtgttttgaggagttggcgattttctcttttagcttaaaaatttggcatcagctggtctaaagtgaaatttcagatgtagcccttgtgaatttcgtagtggtcatttccttattaccactgaataaaacgt

SEQ ID NO: 132263 - DNA, 601 bp, Human
ttgaaattggcatgttgccagaatcctgcaacactgtgcttgaatttatgctaactagctgtgttttgaggagttggcgattttctcttttagcttaaaaatttggcatcagctggtctaaagtgaaatttcagatgtagcccttgtgaatttcgtagtggtcatttccttattaccactgaataaaacgtctattaaatagttatgcaatagatgtggagttttcgcagtctgtaattttttttaatggatgtaggatgagtgagaacaaaatcctagtgtgtattccattttaaagtarttaagttggcattagctttcctcttaaaccatttctgaattgaaatttaaagtctttcccccaccctccctgcattttgttacccatcatttgatacttttaaaaccatttcttatggtcttagaggtttattttttaaattttaatacattttattgtgtataaggtaaacaatatgatgttatgagatacatatagattatctttgaagtttaattttaggaagtgactcaatatgtcacttgcccctcctgtaattgcctgtacattttcttgttcattaaaaggaaggcgagttgc

SEQ ID NO: 132264 - DNA, 601 bp, Human
aggcgagttgccattctcaggtgaagctgggctgtgagggtgacaacactggtgatgttctcaatcttactgctgtttttcacagaagattcagtcctgtatttcttgattacctgcagctaacattgccaggtgctccactataagcttgggcaacttacattccacacttggggcatgagttaattatgagacaaatcagagaatgaaacagatgaggaagtaccaattgtgcagtgtagatgttaattatgactggcttttgtaatagttactagcaaatgttatctattatgtgccmgatactgcactaagtcctttacagatgttttatatttaattcccttggagaatttaaaaggcattatccccttttaaagataaaactgaggcacagagagatgaagtaacttagtctaggtcatacagatgtgagaaagctgaaaatctgagcacttaaccacaacacacagtgttcatttctcagaaggaacaatatgagttgtaaaggaccagggaagtcttcctggatgagaggagtttaaaacttgagccttcagagtttgtttaaaacaaaaatgactgagaatagaatgggtca

SEQ ID NO: 132265 - DNA, 601 bp, Human
caatcttactgctgtttttcacagaagattcagtcctgtatttcttgattacctgcagctaacattgccaggtgctccactataagcttgggcaacttacattccacacttggggcatgagttaattatgagacaaatcagagaatgaaacagatgaggaagtaccaattgtgcagtgtagatgttaattatgactggcttttgtaatagttactagcaaatgttatctattatgtgcccgatactgcactaagtcctttacagatgttttatatttaattcccttggagaatttaaaagkcattatccccttttaaagataaaactgaggcacagagagatgaagtaacttagtctaggtcatacagatgtgagaaagctgaaaatctgagcacttaaccacaacacacagtgttcatttctcagaaggaacaatatgagttgtaaaggaccagggaagtcttcctggatgagaggagtttaaaacttgagccttcagagtttgtttaaaacaaaaatgactgagaatagaatgggtcaggatgtcccaacgtggggagaagccgtgaggtgaggttgagggagcatgttcttctgtgtg

SEQ ID NO: 132266 - DNA, 601 bp, Human
gttatctattatgtgcccgatactgcactaagtcctttacagatgttttatatttaattcccttggagaatttaaaaggcattatccccttttaaagataaaactgaggcacagagagatgaagtaacttagtctaggtcatacagatgtgagaaagctgaaaatctgagcacttaaccacaacacacagtgttcatttctcagaaggaacaatatgagttgtaaaggaccagggaagtcttcctggatgagaggagtttaaaacttgagccttcagagtttgtttaaaacaaaaatgacygagaatagaatgggtcaggatgtcccaacgtggggagaagccgtgaggtgaggttgagggagcatgttcttctgtgtggcgagggttcctgagaagggcctgaagggtctcaagggagaggtgcccaggcgtgtgctccagggacaaggcctcagctccctggttctctggatgatgaggggctctggacgggctgtctttgatcccacctgggatagcttaaaagaccgtcttttgtcatgcattcttgttgtctgccagtgtttttcatacaggcaaacactgactgaccagattctc

SEQ ID NO: 132267 - DNA, 601 bp, Human
aaaactaatattcaagtgttaagcattgtttaaatttatatagtgaggccaggtgcagtggctcatgcctgtaatcccagcattttgggaggcggaggcagaaggatcgctttaaccaaggagttccagaccagcctaagcaacacagcaggacctcatctctacaaaaaatggaaaaattggccagccgtggtggcatatgcctgtagtcccagctgcttgggaggctgaggctggagaattgattgagcctgggatgtggatgctacagtgagccgtgatcgtgccactgctttccaasctgggtgacagagtgagactctgtcttgaaataataataatacattcgtatagtaataggatacatgtatacttaattctctgatgtcccaatgctgccgcatgaacccaccccatcatggcataaagccactgaacagaccagcagtgggagctgatttgagggtcaccagcaacctgtgaagtggtttgatatgaaaatatgagctgaacaatgagattccacttgtcagaacttttaacaagggctttgttactggcaggcacccatagcaccctttcaggcagtatatttaatatt

SEQ ID NO: 132268 - DNA, 601 bp, Human
acctcatcccctggcagtcattctgctttgtgtctctatgaatttcacagctgtaagtacctcgtgtaagttcaatcatatagtatttgtgatttttatgactagctcatttcatgtaacataatgtcttcaaggttcatccatatcggaccatgtgtcagaatttcgctcctttttaaggctgattaatattccattgcatgcctatactacattttgttgattcattaatccatcagtggacagttgagtagcttataacttttttttttttttttttttgagacgaagtctcactctsttgccaggttggagtgctgtgccaaacgaggctcaccgcaacctccaattccttggttcaagtgattcacctgcctcagcctcctgagtagctgggattacaggcatgcgccaccatgcctggctaatttttgtatttttagtagagatggagtttcaccatgttggccaggatggtctcaatccaacttttgactattgtgaatagtgctgctataaatgtggatatacaaatatctttttgagatcctgcttctaatttttggggacatatacccagaagtggagttgctgaatcata

SEQ ID NO: 132269 - DNA, 601 bp, Human
tgcgccaccatgcctggctaatttttgtatttttagtagagatggagtttcaccatgttggccaggatggtctcaatccaacttttgactattgtgaatagtgctgctataaatgtggatatacaaatatctttttgagatcctgcttctaatttttggggacatatacccagaagtggagttgctgaatcatatggtaattttacatttcactttttgaggaacagccatactgtttttttacagcagctgcatcgttttatatggtttgtgatttttccatattcttgccaacactggtttttttttttttaatagtagccactctaatgggtttgagagtggtatctcattggagttttgatttgtatttccctaattattagtgacaatggacatctttacatgtgccttttggtcatttgtatatcttctatggagaaatgtctattcaatcctttgcccattttttaatcaggtttttttttcagtgttatgacataatttgtattttttctacctccctttagtcccttagactgtaaggtccatggttaaaaacctgtttaaaaaaactgggcatctccaccttcaagacctt

SEQ ID NO: 132270 - DNA, 601 bp, Human
agttgctgaatcatatggtaattttacatttcactttttgaggaacagccatactgtttttttacagcagctgcatcgttttatatggtttgtgatttttccatattcttgccaacactggtttttttttttttaatagtagccactctaatgggtttgagagtggtatctcattggagttttgatttgtatttccctaattattagtgacaatggacatctttacatgtgccttttggtcatttgtatatcttctatggagaaatgtctattcaatcctttgcccattttttaatcaggtttttttttcagtgttatgacataatttgtattttttctacctccctttagtcccttagactgtaaggtccatggttaaaaacctgtttaaaaaaactgggcatctccaccttcaagaccttgctttgcacatattatgcactcagtaaatgtttgaatgaatgaacaagcttaagataattttctagtcatcaataagaatttctatttaaaagtcatgctgatgagatagtggctacagtagccatgaggggctgagtacaagttgatgttactaagaagtagaaaatgagtaagccaa

SEQ ID NO: 132271 - DNA, 601 bp, Human
ttttcagtgttatgacataatttgtattttttctacctccctttagtcccttagactgtaaggtccatggttaaaaacctgtttaaaaaaactgggcatctccaccttcaagaccttgctttgcacatattatgcactcagtaaatgtttgaatgaatgaacaagcttaagataattttctagtcatcaataagaatttctatttaaaagtcatgctgatgagatagtggctacagtagccatgaggggctgagtacaagttgatgttactaagaagtagaaaatgagtaagccaaaacascgcatcggtggacaggagagcagagtgctcctgcagaaaggctcctagaacccttggatgtgtgcacataccttatgaacacacccacagtgtctgtacttgaggcttcctttttttctgatgattttctggttcaaaggtatctctaaccttgaaaaaagcctcctttttctggaggtaactcagaaatgagcctctgttttccccttatatcagatgttttctggagtccaagagatgaactttaactctacatacacattgagacttctggtttacctagaccaaagagtggtttgt

SEQ ID NO: 132272 - DNA, 601 bp, Human
ttgaacttcatcttttagtataatgactgtaatttattcagtatctactgagcagaggtgcactttctatgtactgtttttgttcattattcaaaaggacactccatatttctgactagtgtctactgaggaagattctactccttccttgccttctcctccctctcatgctttagttgggttaaaaccattcctattcttattaaaatcgtatttggtggtggggagggggataaaagcagcgtcctagcgcaataaagtagatatacagtagagctttggtggagctcccaggttgagwttttaagtctcagggctccaataacaatgcagatgggacagggacacagaaaatggcccaacaattagaagcatttggcctggcttctctttatttcatctctcatataagtgtgaggggatccacacctggcccctatcagtttcatcagaccagtaagtatggccaggttcggactccaaatgctgtaaacaattaggatttatctctgtgttttgagtttgtcatatgctgccaaaataacttctaagctccataatatagatgagatcagtggtctttgaacaaggtggagtgatg

SEQ ID NO: 132273 - DNA, 601 bp, Human
tgaacttcatcttttagtataatgactgtaatttattcagtatctactgagcagaggtgcactttctatgtactgtttttgttcattattcaaaaggacactccatatttctgactagtgtctactgaggaagattctactccttccttgccttctcctccctctcatgctttagttgggttaaaaccattcctattcttattaaaatcgtatttggtggtggggagggggataaaagcagcgtcctagcgcaataaagtagatatacagtagagctttggtggagctcccaggttgagtwtttaagtctcagggctccaataacaatgcagatgggacagggacacagaaaatggcccaacaattagaagcatttggcctggcttctctttatttcatctctcatataagtgtgaggggatccacacctggcccctatcagtttcatcagaccagtaagtatggccaggttcggactccaaatgctgtaaacaattaggatttatctctgtgttttgagtttgtcatatgctgccaaaataacttctaagctccataatatagatgagatcagtggtctttgaacaaggtggagtgatgg

SEQ ID NO: 132274 - DNA, 601 bp, Human
gcctggcttctctttatttcatctctcatataagtgtgaggggatccacacctggcccctatcagtttcatcagaccagtaagtatggccaggttcggactccaaatgctgtaaacaattaggatttatctctgtgttttgagtttgtcatatgctgccaaaataacttctaagctccataatatagatgagatcagtggtctttgaacaaggtggagtgatggtgtgcaccccagggggacactagatgatatattaaaatgctggaaaaaaagttgtggtttcctattttttcagttaraaaagtactgagagattagctttattgataatacgtaaggattgccactggcatcctcaattttttttcctggcacactgaccagaaattggtctgagaggaatgggtaggaggagggaggcatggcgtttcaagtgagaaaggttgttactgagactctcactctttgatttgcttttagccaattgtgaaatattgccattcatgtgtattggttaaatggacttgtggactagagttagttttcattaaaatgactctcacagatgctgacttaatagaattcctgttaaaaaaata

SEQ ID NO: 132275 - DNA, 601 bp, Human
gtttgctcagagcaaagcattaattctttaacacaaaaggttttatgaaataagtatgtacagtcactgatggaatggctactgtggaatgaaaatggaatcagataaaattcattaatgatgcctgcggcagagactacattttccagcctctctgtggatgggtgtggccataagattaaattctcactggtggaatgtgagcagaagtgaggtgcgaccttgtgcattacccattgagaaggaaatctcttgccctggttcctcagcccttcccattttgctggctggaaatggtatraggctggagctactttgggggctatttattggcaacatcagagttgctcccctcgattgggcccctggatgactttgggaaacagaatctgcagattccctctggaatgtttttttgagaaaaggttatatattttgaactgttgcataggtggtagtctctttgtttatcctcaccctactaatcgtacagaacctgatattaaaagtagggtcaatacatggtgctccagcatgacacagtgcagggctgtcctcagagagagaggaggagggtctgatgctgctggccaaggagagc

SEQ ID NO: 132276 - DNA, 601 bp, Human
ctaattccacttctttgtcatttatgggtctgtttctatttgcttacttcttttgtttgttataggtcacatttttctgttattttgcatgtctagtaattttttttattgtatgatggttattttgtgattgagtgtctagattctgttgttttcttttaaagaatattgtgttttggcaggcagttacttgtgagtttatagtttactctagaactactgcagctttcctaccaagttataacctgttggtgctgctgcctaagaccccaagtgttccctatggtttttccactgtcartgctggaacttaagtatcttccaatcatgcatgagccctgggaatttttttttttatcttacagcactgatagttgttcttttttcatatatatgagaaaaaatatatgtatctattttagggttttctttccccaaatttcatgtcatgtccctgtacatgtgcataaattagcatttgcttaaagagccaaggggacccttacagatgcttgagctctttctctgtgcagttccttctctcccatatgctgctttgcagctcctagccacccagcattctctaacattctttgtctcc

SEQ ID NO: 132277 - DNA, 601 bp, Human
gaattgttaattaagttatggagtttgctaactaggtaactaagagtacagtaagaaaactctagggcagggattggcaaagtacaaccctcaggagaaatctgacccaacatctcttcctgcaaataaagtttcattgaacacagacatccccaaggctaggttaaagaagtgattgtcaagggaattgcgagcagacaagaagcaaacaagaaggagcacatttctttctttgtctccagctttggagtctctcattctctctctgcccctctcctgctggcagggcctagagccaccwgtgagtgaggagtgtggttggtagttcctactccagtagcataggctgaacacagaagggagcctggacagtgagagatgttaacagctggcacagaaatgaatttcaagtgtaaagatttaaaataggaaattaggtgcttgtgaaattattgggaaagtggaaggagcggaaggagcagaagccagcgagccctagagaggcttcaggtccatgccctgcagctttgttcccggagtcagagcactattgctgctacccaggagacctcagggagccactgccaacgtcctggcatcc

SEQ ID NO: 132278 - DNA, 601 bp, Human
agcctgggcaacagagtgagactccatctctaaataaataaataagtaaaagggtatctgttcttctttgtgtctctgtgtatttgactcctctaggtccctcatgtaatagtcttattgctctttgacttggtaatgaatactctaccattaaaaggagtcttggctaggcacggtggctcacgcctgtaatcccagcagtttgggaggccagagtggttgggtcgcttgagcccaggagttcaagagcagcttgggcaacatggtgaaaccctgtatctacaaaaaatacaaaaaaaawttagccagtgtggtggtgcttgcctgtagtctcagctacttgggaggctgaggtgggaggatggctttagcccaggtggcagaggctgcagtgagtcgagcctgggtgacagaatgagactctgtctcaaaaaaaaaaaaaaaaaattttaaaaagagtatctggctgctggagtgagcagagactaaagctgaagggaggcaaaggcatggaggcaggagcccacctagtagctggggatgctgatccaggcagaagatgatgggggtgttggagtggaggttgtggtattggtgatgg

SEQ ID NO: 132279 - DNA, 482 bp, Human
ccttgtccgtcttttgtgctaatggtactcttgaaagccccaactcacagagagagacaggcatgcatcatctgtcagggagcctgacaactcttgacttaccactgttggctttctaagtgaagaaaatcagtaattacatggtgcatcataaaggtatatcatgaaaaatgttgaatgtcaacagcgatgatggttcttaagctgagataacaacctactttgttgtgacaatggagtctcagggtattgtaagagaaaaattattatatgaaaggctaacatctgtcaagttccttcstcagtgaactttattctgtggtcaaatttctaagcatagttcttcctatataaggtaacttatgtagacctggacatgttttatttggaatgacttccatgatgtgtctaagacagaacctttgatgtagttcacttgattaatgggattatagccatcaagctttgttctgaggataatt

SEQ ID NO: 132280 - DNA, 601 bp, Human
aatctaatagttttaaacctcatttgcccacatttaaaattacccaattcatttaatgttgaaaaatatatattaatgaggaaaaagaaaaatgaaaaatgttctctgggtagacttccattacccagagaactggaataagtagaagtatatagtttatataaatttttggctcttttaattcactaataatacaataaccttgtgtgtatgtagtgtatatacatatatgcctgtgtgtatattggtagccattttttaaaaaatgcaactactcacaatagatattcatgttaacctagttttttctctcgtagctgagattgtatctctagatcaactaatatgtagctgcagctcggttttagagaactatgtagataacattttgtatatttctgtgatttatttaaaccttctcttacttttggacattgaggttgtttctaacctttaatgtctaggaaaagatctcattttgttttctactgtttattttgttagaataaattcctagaaggctcctaggtcaagagaaatatgccttcttgagtggaggtaatctatattcacacacacttaacacacatatgtacatata

SEQ ID NO: 132281 - DNA, 601 bp, Human
tcatgttaacctagttttttctctcgtagctgagattgtatctctagatcaactaatatgtagctgcagctcggttttagagaactatgtagataacattttgtatatttctgtgatttatttaaaccttctcttacttttggacattgaggttgtttctaacctttaatgtctaggaaaagatctcattttgttttctactgtttattttgttagaataaattcctagaaggctcctaggtcaagagaaatatgccttcttgagtggaggtaatctatattcacacacacttaacacacrtatgtacatataaatccatatactccttcttgccctccaagtaaattctgccagtttaattgtaatttatttactagggaatgaaaagagcttaccacagttctgcacgggtaatataaatgttggaaatgtgggtattttctcagtgttgtttgtggaattaaaatcctctgaaatgaggttgcatttaatatgttctaaatttgaggctatcatagcaaaaatgatatcttaatagatggctgcatagctcataacctgaaacactgatgaactttccatttacatagctgtctcctg

SEQ ID NO: 132282 - DNA, 601 bp, Human
acctgtagataaggtcaaagagggaacaggtatgccaagagggcctgaaccccacaatggggagcaaatctccacatgagatttggggtgacaaagcatatccaaaccatagcgtgcatatttaatttctgggtttcattaaagcaacagatatttgagtacttttaataggtctggcagtttgcccaggttgtagacataggattacatgacagtatgttctctactctcaagtttctgtttgtgctgttataaatttgagcagtcatcattaaatctcagctatacatttaagttctgttgtgacagttgccacaaaggaaacgtctaaggtgctaagtatatatggttaggaaaaatcttgcaaactttttctgtaaaggactagatagtaaatattttaggctttgtgtgccatatgctgtaggtgtcacctattcaattctcctgttgtaattagaaagcagctgcagatgacacataaacacacatcacacagacaaatatgtcagtgtgattatgccatacatacatctatatctatctgcatttgcatacttctcaagcacttttcaaaaatgaccatacaaatcataaagtg

SEQ ID NO: 132283 - DNA, 601 bp, Human
tgtcacctattcaattctcctgttgtaattagaaagcagctgcagatgacacataaacacacatcacacagacaaatatgtcagtgtgattatgccatacatacatctatatctatctgcatttgcatacttctcaagcacttttcaaaaatgaccatacaaatcataaagtgttaacagaattttggagaactgattttcatgcagctcatgttctgtgagtgctatgcccttgcccaagaccttcaaaaaggtcatcatacaaatcttatattcttggaaaattaaaaacctatacttrcaaatccagtgtcaaagaggaaatcacattggaaattagaaaatacttagaattgaatgattaaaaaatacttttgcatcaaattcatgggatatgaatatcccaaagagggaaatttttgtagccttaccgattagattacaaaataaaaaagacttaaaatgaacaagctatacatacaatttaaaatgttaataaaagagcaagagaagatcaacaaaaccaatagtaagattcttcaaaaaaactaatgagataggcaacaagcaagttgatgaaggaaaaaaagcaaaaagataa

SEQ ID NO: 132284 - DNA, 601 bp, Human
tctcagggggaatgctttcaacttttctccatttggtataatatttttgactgtgggtttgtcatagatgactttacattgaggtatgtcccttgtatgccgattttgctgagggttttaatcataaagggatggtggattttgtcaaagactttttctgcatctatttagatgatcatgtgatttttgtttttaattctgtttatgtggtgtatcacatttattaacttccatatgtaaaatcatccctgcgttcctggtatgaaacccacttgatcaaggtgtgttaactttttgataygctgttggatttggttagctagcattttgttaaggatgtttgcatctatgttcatcagggatattgttctgtagttttctctttttgttatgtcctttcctcattttggtattagggtgacactggctttatagaatgatttagggaggattctctatcttgtggaattgtgtcaataggattggtaccaatgctttgaatgtctaatagaattcagctgtgaatatatctggtcctgggcttattttttgttggcaatttttaaaattaccattttaatgtcactgcttgttattggtc

SEQ ID NO: 132285 - DNA, 601 bp, Human
ttgttgggtagaatgttttgtaaataagtgttaagtccatttgttctggggtatagtttaagtacattgtttctttgttgaatttctgtcttgatgatctgtctaatgctgtcagtggagtattgaagtcgccactattattgtgttgccatctatctcatttcttaggtctagtagtaattgttttataaatttgggagctccagtgttaggtgcatatatatttaggattgtgatattttcctgttggacaatcccttttatcattatataatgttcctctttgtctttttacactgcrattgctttaaagtttgtttggtctgatgtaagaatagctacttctgcatgcttttggtgtctgtttttttctacccctttaccttaagttcatgtgagtccttgcatgttaggggagtctcttaaagacagcagatacttggttggtgaattcttatccattctgccattctgtatattttaggtggagcatatatgccatttacattcaacgttagcattgagatgtaaggtactattctattcatcatgctatttgttacctgaataccttattttattgtgttactgtttgataggt

SEQ ID NO: 132286 - DNA, 601 bp, Human
gttcttttgtctacttgttcaattctgttgctgagagattccagtgtgttttgtatttctttaagtgtgtctttcatttccagaggttgtgattgtagagtttctgctgagaaatctgctgttaatctgatagggtttccttcataggttacctgatgcttttgcctcacagctcttaagattcttttctttgtcttgactttagataacctgatgactgtgtacctaggcgatgatctttttgcagtgaatttcccaggtattctttgagcttcctgtagtctagatctctagcaaagcyggagaagttttcctcaattattccctcaaatacgttttctaaagtttcagatttttcttcttctttgggtacaccgattattcttaggtttggtcgtttaacataatacaaaacttcttggaggctttgttcatttttttgtattgttggattgtgttaatttgaaagctttgtcttcaagctctgaagttcttttgtctacttgttcaattttgttgctgagatgttccagtatattttgtatttctttaagtgtgtccttcatttttagaggttgtgattttttttatttatgttgtc

SEQ ID NO: 132287 - DNA, 601 bp, Human
ttttggaggtgttaaaggacatcgttttgtcatattacctgaactatttttctggttccttctcatgtgggcacattatgtcagagggaagatctggggctcaagggctactgttcagattcttttgtcccatggggtgttctcttgatgtggtgctctccgccttttcctaggcatggggcttcctgagacctgaactgcagttattgttatttctcttctggatctagccacccagcagagctgcctggctccaggctgccactggggaatgtctacaaagagtcctgtgatgtggacygtctacaggtctctcagccatggataccagcacctgctttgttggaggtagcaagggagtgaagtggactctgtgagggtacttggttgtatttttgtttagtgcacttgttggcctccagccaggaggtggcactttcaagagaccatcggctttggtagtatagggggatacaagcttgccctagggtcacctggataagtatgggggtttctcaggcagtgggcagggccatagagctccgaagagattatgtcctttgtcttcggctaccagggtgggtagagaaagaccatcagg

SEQ ID NO: 132288 - DNA, 601 bp, Human
atcgttttgtcatattacctgaactatttttctggttccttctcatgtgggcacattatgtcagagggaagatctggggctcaagggctactgttcagattcttttgtcccatggggtgttctcttgatgtggtgctctccgccttttcctaggcatggggcttcctgagacctgaactgcagttattgttatttctcttctggatctagccacccagcagagctgcctggctccaggctgccactggggaatgtctacaaagagtcctgtgatgtggactgtctacaggtctctcagccrtggataccagcacctgctttgttggaggtagcaagggagtgaagtggactctgtgagggtacttggttgtatttttgtttagtgcacttgttggcctccagccaggaggtggcactttcaagagaccatcggctttggtagtatagggggatacaagcttgccctagggtcacctggataagtatgggggtttctcaggcagtgggcagggccatagagctccgaagagattatgtcctttgtcttcggctaccagggtgggtagagaaagaccatcaggtgagggcaaggttaggtgtg

SEQ ID NO: 132289 - DNA, 601 bp, Human
atcctcttctcataatctggaccttcaggttcccctgtggttcaggggcagacagttcccctttcacattttcacactttgggcactcacagttttttagctgtctcctgaagctcgcagcagtaatccactctcttccaagggtctgtggattctctcgactctcctggtatgttcctgtggtagttcttggagcaaaagttcacaatatgagtctccacatgctgctttgtttgtccaagtgggaactgcaagttagtcctgcctcctgtctgtgattttctcctataccccagttatyttattagatgcagaccaaaaaacccccaaataattaacattcatttatcattgaccacccccaacaacacactttcaatgctggaattgaactttctgaaactgataaggtacatctaccaaacccatgccacccaacaatcttccagtccttcttcctagatgcataaatacgaatcttttccttatttctatcctttagtgaccacttaattttcttttctttctttctttcttttttttttttttttttttttgagacagagtgttgctgttgtcacccagtctggagtgcagtggc

SEQ ID NO: 132290 - DNA, 601 bp, Human
tgcagaccaaaaaacccccaaataattaacattcatttatcattgaccacccccaacaacacactttcaatgctggaattgaactttctgaaactgataaggtacatctaccaaacccatgccacccaacaatcttccagtccttcttcctagatgcataaatacgaatcttttccttatttctatcctttagtgaccacttaattttcttttctttctttctttcttttttttttttttttttttttgagacagagtgttgctgttgtcacccagtctggagtgcagtggcaccatctcrgctcactgcaacctccgcctcctgggttcaagtgattctcctgcctcagcctcccaagtaactgggattacaggcacccgccaccatgcacagataattttgttatttttagtagaaatggggtttcaccatgttggccaggctagtctcgaactcctgacctcaggcaatccacccgcctcagcctcccaaagtgctgggattataggcgtgaaccatgaccacttaattttcaagagtagtatgtggtactgcttagctcatcagattctccaagtccctaataatttcctatttggg

SEQ ID NO: 132291 - DNA, 601 bp, Human
ccctttgacacgtgtggcagctgctgccagagcctccagccaggatctgggctagagggtggtacatgtataatttaagtaataacataaagattaaatatgtaattggaaatgatttcatagaataaaactgaagcctggtttatcttgaaaagaaattattgcagacatgtaaatagcttactgtaaagtttaattacagttttagtagcagacaagactcaattgataaatctccacaaggagagtcaagtaggactgaaaatctcactgcacttgcatgaaaacaacaaaagctaamatgccaaaccgaatgcaagctttgttcatttcctcaaagttaattgttttgactataatcatacagttattatttaatggccatacacaatttatttatcattttctaagagattaatttgaaggtctttttcttgttatttatgtggaatttacaggaaagtcagatattagattgtagttttagggggtgattatttttataactcaattgatttaaatgttaggttttgtcatttcgttgaatccatcagttatcatcagtattcattatttcagttccctctgagaaatgagagga

SEQ ID NO: 132292 - DNA, 601 bp, Human
aatttatttatcattttctaagagattaatttgaaggtctttttcttgttatttatgtggaatttacaggaaagtcagatattagattgtagttttagggggtgattatttttataactcaattgatttaaatgttaggttttgtcatttcgttgaatccatcagttatcatcagtattcattatttcagttccctctgagaaatgagaggatagttttgtgagtagaaaatgatttgaagagtttggcagaataaaactgaaaactgattcatctgacaaaactcttttaagttcggtasagaaacaaggactagatagttgtctcactaactccattcttggtgttcccttgactttgctgtttattgtgtttttttgttagaatttcttgaatttattaatttttgttacagttccatcatgaaacttactgaattatgtagatttaaattgttttccatggtatttctttattaatgtagaatttgaaaaattcacgcagttctggggagactattttaacttataccctctcctccttcctttttcatctgagcttcctctcatcaatcttaatatttacacctaaaatcttatga

SEQ ID NO: 132293 - DNA, 601 bp, Human
aggaaagtcagatattagattgtagttttagggggtgattatttttataactcaattgatttaaatgttaggttttgtcatttcgttgaatccatcagttatcatcagtattcattatttcagttccctctgagaaatgagaggatagttttgtgagtagaaaatgatttgaagagtttggcagaataaaactgaaaactgattcatctgacaaaactcttttaagttcggtacagaaacaaggactagatagttgtctcactaactccattcttggtgttcccttgactttgctgtttaytgtgtttttttgttagaatttcttgaatttattaatttttgttacagttccatcatgaaacttactgaattatgtagatttaaattgttttccatggtatttctttattaatgtagaatttgaaaaattcacgcagttctggggagactattttaacttataccctctcctccttcctttttcatctgagcttcctctcatcaatcttaatatttacacctaaaatcttatgagttgagacaatatagaaattaattattgatctgtaaattatgtgaaagttcccaacatagaagcatt

SEQ ID NO: 132294 - DNA, 601 bp, Human
tcatctgacaaaactcttttaagttcggtacagaaacaaggactagatagttgtctcactaactccattcttggtgttcccttgactttgctgtttattgtgtttttttgttagaatttcttgaatttattaatttttgttacagttccatcatgaaacttactgaattatgtagatttaaattgttttccatggtatttctttattaatgtagaatttgaaaaattcacgcagttctggggagactattttaacttataccctctcctccttcctttttcatctgagcttcctctcatcratcttaatatttacacctaaaatcttatgagttgagacaatatagaaattaattattgatctgtaaattatgtgaaagttcccaacatagaagcattttatatatattaaatcagtgttagaattcgtggctaggtacccgtagtgtaaaattgtatttaggagctgaaagaccgtgagtgtgaatggatgtttaggtggcaattggaaagatttcccagtattctgaagaacataagctatttgacctatttgacataagtcttatgcttccttttacttagatttctggtttgctttc

SEQ ID NO: 132295 - DNA, 601 bp, Human
tttgttacagttccatcatgaaacttactgaattatgtagatttaaattgttttccatggtatttctttattaatgtagaatttgaaaaattcacgcagttctggggagactattttaacttataccctctcctccttcctttttcatctgagcttcctctcatcaatcttaatatttacacctaaaatcttatgagttgagacaatatagaaattaattattgatctgtaaattatgtgaaagttcccaacatagaagcattttatatatattaaatcagtgttagaattcgtggctagktacccgtagtgtaaaattgtatttaggagctgaaagaccgtgagtgtgaatggatgtttaggtggcaattggaaagatttcccagtattctgaagaacataagctatttgacctatttgacataagtcttatgcttccttttacttagatttctggtttgctttcttttggtacatgttatacctgatactgttctacagcggtcttcagtaattttttaaatcttgaaatagaatggaaagattgagagtgacctgctgaggtaactggaccagaacaggttaggagcgcgtgtttata

SEQ ID NO: 132296 - DNA, 601 bp, Human
ttatcctctttagaagtatctgagggttaacaaaattggaaattgtagaggaaacaaatttgcactgaatttagacctaatttacctgaaaatgggattcctttaaaatccacagtgagcccacagttttgtcctgtgactgagattcagtcacaccttgaccatgtatttatttcataaattaagccttcaggccaggcatggtggctcacacctgtagtcccagcactttgggaagctgaggtgggtggatcacctgaggtcaggagtttgagaccagcctggacaacatggtgaaacyccatctctactaaaaacagacagtactaaaaaacatctctgctaaaaacataaaacactacctgggcatggtggtgcgcacctgtaatcccagctacttgggaggctgaggcaggagaattgcttgaacccgggaggtggaggttgcagtgagccgagatggcaccattgcactccagcttaggcaacagagcaagactctgtctcaaaaaaaaaaaaaaaaattaagccttcaagaaatgtatatgccaagttggagatgtgtcaatagagctaagcagatttttggtaactgccaaat

SEQ ID NO: 132297 - DNA, 601 bp, Human
gtgttttgaaacatagtagtttttctaatttatcagtctcattttctaattctatccttatgaccaatatctctgcctttgctctggatttatcaccttcatggacttttggacatgggagaattttatcctgatggaagtaaaactgcacggacttctcttgtgttatagaaatatgtgtgtgtgtgtatacgtgtatatatacacatgcatatagagatatatatgcatatctagatgagcataaatgcataaattatgcatagattataaatgcataaattatgcatagatatatgcrtatacctatatatgcatatatctataatgcatgtatgtatgtgtgtgcatatatatacatgcataaatataaatatacatatatctatattgtgtgtgtgtgtgtgagaatggagtgccatccttccccttcctgggctgtaagcttgtttgttagttaagacttcatggtagaaactggtgtattcatctttaaaatattttgcacattggtggtgcttaaacggcttactgaattggactctccaagaagggtatttcttaatagaaaactgtcttgctttatttgttttcgtttaca

SEQ ID NO: 132298 - DNA, 601 bp, Human
tgcatttagtgttggaagggatgagagattagttgtggatctgaggattattcttgcctcaacaagtggagaattggagatactcttcatgaggagtgacactcaagtttgagccccgtaatcaagagacaggagaaatgttaataagagaaaaccttttattttgtcagatccctttttgaggaagaacaaatgcagtttttgaaagcattaagcatttagaaaagggtgcagaaatgtagtaggacaaaatgtgccttaaaacatacagcctctttatgtccaaagcttccacacaacrtgaagtaattgtctgaaattacaagtgctactatagtgattgaactctagctgctaattgagccttcaggtttaaaaatacacaggcctcagcaattcaaagattattaaattacaccttcttgtgggaaccaacatcaatgtgtttgagcagtgagtagtgaaggtctttggggaggcaggggcagagggtgtctcattacagcgtttgccactgcagatctcttgagggttgttgctttttctcaagacgaaagattttgttaacacttcattccacagaatgttgaaaaaagtggag

SEQ ID NO: 132299 - DNA, 601 bp, Human
tgtccaatcagcatatgaatttgggggttaagttttaaatgaatgaaatttggggaacatatttacatgatagaagttccttaaatagaactcagagctcaactgtgggaaggtagacgaatgaataagatagcataagtacattgaaagataagtaagaggatgatgtgttaaggagtggtttggggagtaaagaagtcacccttagtgtattagtctgttttcacaccgcggataaagacatacctgagactcggtaatttataaagaaaaagaggtttaatggactcacagtcccatrtggctggggaggcttcacagtcaaggcagagggtgaaggaagaacaaaggcgaacaaaggcatgtcttacatggcagcaggcaaagagagaatgagagccaagcaaaaggggtttccccttagaaaaccagcagatctcgtgttacttattcactaccacaaaagcagtatgggggaaactgcccctatggtttaattatctcccaccagtccctcccacaacacgtgggaattatgggagccacagttcaagatgagagctcggtgggaatacagctgaaccatatcacttagataggg

SEQ ID NO: 132300 - DNA, 601 bp, Human
gtaaggaagcaattatggttaaatgaaatcataagggtagagccctaatctgataagattagtgtccttagaagagaaacacctgatctctctctccaccatctcaacgccatgtgagaacacggtgagaaggtggctgtctgtgagccaggaggagagcttttatcagtaacataattggctgacaccttgatctttgacttctagcctccataactttgagaaataaatgcctgttgtttaagccacccagtctgtggcattttgttatggcagcctgagcagaccgagatggaactgmaagtattgtcattaactgagatggagctatctggaggaaatgcatcatttggtgaggccactctggctggatattagtcctcagtgttctgaaacacattcttccctgttggattctgtcataaatgtagttgatgatgccagctctcaccatcaaggctcataagtgctatgagccagatgcaagggttttacttaacaatgaaaattttacctgtcaggtaaactgagtctatggcttgggctgacataaagaagccatgatcacattgagaagccatgttatccatattgcatggtg

SEQ ID NO: 132301 - DNA, 601 bp, Human
aaataaatgcctgttgtttaagccacccagtctgtggcattttgttatggcagcctgagcagaccgagatggaactgaaagtattgtcattaactgagatggagctatctggaggaaatgcatcatttggtgaggccactctggctggatattagtcctcagtgttctgaaacacattcttccctgttggattctgtcataaatgtagttgatgatgccagctctcaccatcaaggctcataagtgctatgagccagatgcaagggttttacttaacaatgaaaattttacctgtcaggtraactgagtctatggcttgggctgacataaagaagccatgatcacattgagaagccatgttatccatattgcatggtgaactgggactccagatagaagggcacttcattctcccactttactgtttaatggtgtcagatgtgtggctatggttccacaaagcctgactggacactcctaggccaccctccctcttgctgacttagaaacccatgctgtctgcctctaaccatctttatagtctttcattttagacctttttctgacccacattaattccttcagtcaagttacagttgag

SEQ ID NO: 132302 - DNA, 601 bp, Human
agacctttttctgacccacattaattccttcagtcaagttacagttgaggtccattgggtctgggagccattcattctctttaagataacatcacacagctttgctttaccctttatgttaattaatcctgctgtatgtcctgattgtggaatgtctctccaagcccacagccattactctgagcttctctttctgtagtccacacctgtaaatgcacttacgttttcatacttccttgccttttattcattctcatcgctttgcctgagtattctttcctctcttcctaactcaggacarcactgcctgtattagtcttctaggctgctatgacaaaataccacaaactgggtggtttaaatagcagaaacttgtcatctcacagtctggaggctaaaagtccaaaatcaaggtttctgcaggatcagtctcctctgatggttgaggggagtctgctccaggcttctcctccagcttctgagtgctcaggcgtcaccttccctctgtatatgactgtgtacacattgtcactttataggacaccagtcatgatagattagggcccaccctgaagatttcatcttaacttgattacctgtg

SEQ ID NO: 132303 - DNA, 601 bp, Human
aggatcagtctcctctgatggttgaggggagtctgctccaggcttctcctccagcttctgagtgctcaggcgtcaccttccctctgtatatgactgtgtacacattgtcactttataggacaccagtcatgatagattagggcccaccctgaagatttcatcttaacttgattacctgtgcaaagactctgtcttcaggtaaggtcacaggctgagagtactgggggttaggactccaacatacgttttattgtgggacattatttaacccataacattgccccttctttcctccatgagrgggaacatcacatcaccagcatcctaagcccttgtttgataacttggtgatcatcactcttccaggggagcataattggtcacctatgagactaataggtctgttggccactgtccttgtaactcttctgtcatgtttattctctgacttgcctgtcacccttactagaccatagtctccttgaggacaggatcaaaccagcattgtaccctgctcctgggcacatagaaagtgttcgtagacagaacacatgggcagtctcaagtaaacatattggctgttgattgttgtaacctcttc

SEQ ID NO: 132304 - DNA, 601 bp, Human
tcaagtgaagaaatactggtttaacatatacggtgtaaattgttctgctttctataaacttttatactaatatttttattattttgatatttgagagggaaagagtaatataatattgcagttcatatggcagccacagtttaattttatggcaaagtcaacgactttagagttgctgaagtatttatagtactgaaagctttgtgttggcaatttctttcaaaggaagcaattcttattattatatcatggacatgcacaccactctcatgctgtttaagacacctttttgtcccccccacaccaccaaacagggaactgggagggaaaaccaggcctcaaattttgtgtgcttgcttctcatgttttatttctaagtgaattagaccatatggtcacataaacccaaagctaggtggtacagggatttaagtttgtggccttgaagtgattctagttttgctttcaattagtggaaaataatgcattcatagaacaatttataactcacacagacccattcgtgaaaagcccactccagatattgttgcgtgtgtccaggagaagtggcagcgttgatctccatagagatgactaatca

SEQ ID NO: 132305 - DNA, 601 bp, Human
tgtactttctcagtgggttgctcatatacctttagtgacccatggaatatcattacaatgttttgcaggggtattttcaaaatgccaccaccaccaacatataggcatgatgtcctccacttcttgcagctttacatagactgagatacaggaaaagctaaagtgttttgcgtactctcactcagtacaatacttctaacaccagaaatgtggggagttttcccaacatagcaaaccaagcagttttctagcagcaaacaccaactgggtgtcctacaatttaactcagttggagttggaycccacagattaagggctcagccccacaaggctctccccgaccttagaatccaatcgcaagccccaccccctgacaccccctcatggttcgattaatttactagagtagctcacaaaactcagggaaacactttacttacattttcatatttatcataaaggatgttatggatgaacagccagatagagagatgcataggtcaagtatgggaagaggctcagagcctccctgccctcctcaggaacctgcatgtgttcagcaacctgaaagctcctgaaccctgatttttggggcttttat

SEQ ID NO: 132306 - DNA, 601 bp, Human
tgctcatatacctttagtgacccatggaatatcattacaatgttttgcaggggtattttcaaaatgccaccaccaccaacatataggcatgatgtcctccacttcttgcagctttacatagactgagatacaggaaaagctaaagtgttttgcgtactctcactcagtacaatacttctaacaccagaaatgtggggagttttcccaacatagcaaaccaagcagttttctagcagcaaacaccaactgggtgtcctacaatttaactcagttggagttggatcccacagattaagggctyagccccacaaggctctccccgaccttagaatccaatcgcaagccccaccccctgacaccccctcatggttcgattaatttactagagtagctcacaaaactcagggaaacactttacttacattttcatatttatcataaaggatgttatggatgaacagccagatagagagatgcataggtcaagtatgggaagaggctcagagcctccctgccctcctcaggaacctgcatgtgttcagcaacctgaaagctcctgaaccctgatttttggggcttttatggaggcttcaccacgtag

SEQ ID NO: 132307 - DNA, 601 bp, Human
aacactttacttacattttcatatttatcataaaggatgttatggatgaacagccagatagagagatgcataggtcaagtatgggaagaggctcagagcctccctgccctcctcaggaacctgcatgtgttcagcaacctgaaagctcctgaaccctgatttttggggcttttatggaggcttcaccacgtaggcatgactgattaactcactggccattggtgattcactcagccttcagcccctcccctccctggaggttgaggggtggggctggaagtcccaactctctaatcctgcmtcggtctttcctgtttcaccctgaagctacctagggaaaccaagggggtagggtgacctaggggtcactggtagccatctcattaacatgcgaaagacatcactcttgagattccaaaggtgtttggggctctgtgccaggtaacagggatgaagagcaaatacatatttcacaatatcacacacattacagacccccctgacttttgctctaatgtttctatcctttgcctcatgctacctttcacctgattggcttccgctggccttgcgttaaatccctgcaggtgtagctcactgg

SEQ ID NO: 132308 - DNA, 601 bp, Human
tcaagtatgggaagaggctcagagcctccctgccctcctcaggaacctgcatgtgttcagcaacctgaaagctcctgaaccctgatttttggggcttttatggaggcttcaccacgtaggcatgactgattaactcactggccattggtgattcactcagccttcagcccctcccctccctggaggttgaggggtggggctggaagtcccaactctctaatcctgcctcggtctttcctgtttcaccctgaagctacctagggaaaccaagggggtagggtgacctaggggtcactggtarccatctcattaacatgcgaaagacatcactcttgagattccaaaggtgtttggggctctgtgccaggtaacagggatgaagagcaaatacatatttcacaatatcacacacattacagacccccctgacttttgctctaatgtttctatcctttgcctcatgctacctttcacctgattggcttccgctggccttgcgttaaatccctgcaggtgtagctcactgggtaggatgggccttaggtaaagacagaatcctgagctgctctgtgggccagtcccctgggagtacctttaattt

SEQ ID NO: 132309 - DNA, 601 bp, Human
agagattcagaggaagattgacagtctgcgtcttctgtgatgagggtgccttttactcctccagcttagccgggaagctgccctcttccgtgggagaagttgtgctctgctcacccctctgagcttttcctcactttcccagcgaggagactctagaagttactctcagagtcacagtctgtttgccaccaatagtttggctatgcttttatgcctaagtgacaaactgtaagtttttacttttaagtaaaactcctgagtcacggaagcatgtttagtatctaagaatgtttgattctcmaagtattgaaaaagaagattctgctcacttgttcagcctctacttgatccctgttagcacagaaagatgcagtcagatttctcttgagcttggtgatatcctttataataacctttagagatccgttctattaatgaggcatgatattgttactccaattgtgcacacaagctgggggacctccctttcagaatggcatgtaaagaaattccttccctcctggaggcttcattatataccctacatgcagtgctcggcagtctgcttttaaggtgagtcattgtatagtatgatttctca

SEQ ID NO: 132310 - DNA, 601 bp, Human
ccagcttagccgggaagctgccctcttccgtgggagaagttgtgctctgctcacccctctgagcttttcctcactttcccagcgaggagactctagaagttactctcagagtcacagtctgtttgccaccaatagtttggctatgcttttatgcctaagtgacaaactgtaagtttttacttttaagtaaaactcctgagtcacggaagcatgtttagtatctaagaatgtttgattctcaaagtattgaaaaagaagattctgctcacttgttcagcctctacttgatccctgttagcamagaaagatgcagtcagatttctcttgagcttggtgatatcctttataataacctttagagatccgttctattaatgaggcatgatattgttactccaattgtgcacacaagctgggggacctccctttcagaatggcatgtaaagaaattccttccctcctggaggcttcattatataccctacatgcagtgctcggcagtctgcttttaaggtgagtcattgtatagtatgatttctcagacttcaagggcagataatacacatcacgagcctcagaacagcttacttttcagccttac

SEQ ID NO: 132311 - DNA, 601 bp, Human
ggggacctccctttcagaatggcatgtaaagaaattccttccctcctggaggcttcattatataccctacatgcagtgctcggcagtctgcttttaaggtgagtcattgtatagtatgatttctcagacttcaagggcagataatacacatcacgagcctcagaacagcttacttttcagccttaccttcctttacagagagagagataaagagagcaagagagtgcatgggaatacgagcgagatcacctctttgtctttttagaaatcctgtacgtgggcattaaaattaatttagagwttcttattatgtcctttcaataatagcaacaaaataattataatgacaacaatgaagtagccaccttgtgtcattttgtctttggctaagtcttgaattcctgtaatttaggtgtgagataagttggatgtaaataacattatttaaatcaagattatagggaggctggacgtggtcgctcacgcttgtaatcctagcactttgagagtctgaggtgggtggatcactcgagcccaggagttcaagaccagcctgggcaacatggtgaaaccttgtctctgcaaacattgtaaaaattag

SEQ ID NO: 132312 - DNA, 601 bp, Human
aattggacccatgaatatcaataatttcttaaaagtaaatactcagtaattctaaatactagcctttaaaatggtgacattatgctgtaactgcagtaagtcctgttagggcgctgttattagtcccataaagtgctcattcagaaataaaattctaacatgtcaaaaatcgaacccaaaactaagctataaaaaatttttaagtttaatgagtaacagtttgtcttaagccttttaaattatgacttacatgatctcttaaggcccccttggaagtttgaactgatgaagttttcttttraatggatcttcaccaaagagtggaattgaaaataagtccatgtatcttagtttgtctctgccattgtctcatgcagttgtgttttgtttattttagtttttgaaattaaaaatgactgaaagacctgtaccaagcatttctttcacttgccttctctaaatctgttcaagtttattcagaattataattttaactctttgatatctgatcaagcagaggcctcccacattagggagttaacgactgtgaaggcttaaacttatggacacttaccatagtgtttagcaattgtttagaaac

SEQ ID NO: 132313 - DNA, 601 bp, Human
atactagcctttaaaatggtgacattatgctgtaactgcagtaagtcctgttagggcgctgttattagtcccataaagtgctcattcagaaataaaattctaacatgtcaaaaatcgaacccaaaactaagctataaaaaatttttaagtttaatgagtaacagtttgtcttaagccttttaaattatgacttacatgatctcttaaggcccccttggaagtttgaactgatgaagttttcttttaaatggatcttcaccaaagagtggaattgaaaataagtccatgtatcttagtttgkctctgccattgtctcatgcagttgtgttttgtttattttagtttttgaaattaaaaatgactgaaagacctgtaccaagcatttctttcacttgccttctctaaatctgttcaagtttattcagaattataattttaactctttgatatctgatcaagcagaggcctcccacattagggagttaacgactgtgaaggcttaaacttatggacacttaccatagtgtttagcaattgtttagaaaccgtaagaacaattactagatcattagcaagcacttttttttggatgggggagaag

SEQ ID NO: 132314 - DNA, 601 bp, Human
ctttaaaatggtgacattatgctgtaactgcagtaagtcctgttagggcgctgttattagtcccataaagtgctcattcagaaataaaattctaacatgtcaaaaatcgaacccaaaactaagctataaaaaatttttaagtttaatgagtaacagtttgtcttaagccttttaaattatgacttacatgatctcttaaggcccccttggaagtttgaactgatgaagttttcttttaaatggatcttcaccaaagagtggaattgaaaataagtccatgtatcttagtttgtctctgccrttgtctcatgcagttgtgttttgtttattttagtttttgaaattaaaaatgactgaaagacctgtaccaagcatttctttcacttgccttctctaaatctgttcaagtttattcagaattataattttaactctttgatatctgatcaagcagaggcctcccacattagggagttaacgactgtgaaggcttaaacttatggacacttaccatagtgtttagcaattgtttagaaaccgtaagaacaattactagatcattagcaagcacttttttttggatgggggagaagctgcaaaa

SEQ ID NO: 132315 - DNA, 601 bp, Human
aagtccatgtatcttagtttgtctctgccattgtctcatgcagttgtgttttgtttattttagtttttgaaattaaaaatgactgaaagacctgtaccaagcatttctttcacttgccttctctaaatctgttcaagtttattcagaattataattttaactctttgatatctgatcaagcagaggcctcccacattagggagttaacgactgtgaaggcttaaacttatggacacttaccatagtgtttagcaattgtttagaaaccgtaagaacaattactagatcattagcaagcacttttttttggatgggggagaagctgcaaaatatctcctgaaattgctcttagggatgttccctctaattttaaaaagtaaaggggaaaaatgaatttgcattcactggtgtgtgctgtttcagtgtcagcaccatgagttaggattgtattgtgtgtcagaactttgctctgtgctggggatgtaagaccaaagtcaccatgctcatggcttcagtctcatgaagcatgacccgtgtaacattttaaaagagacaattcataaacacacttagagagcattgtagaaataaaggagaatgt

SEQ ID NO: 132316 - DNA, 601 bp, Human
atcttagtttgtctctgccattgtctcatgcagttgtgttttgtttattttagtttttgaaattaaaaatgactgaaagacctgtaccaagcatttctttcacttgccttctctaaatctgttcaagtttattcagaattataattttaactctttgatatctgatcaagcagaggcctcccacattagggagttaacgactgtgaaggcttaaacttatggacacttaccatagtgtttagcaattgtttagaaaccgtaagaacaattactagatcattagcaagcacttttttttggwtgggggagaagctgcaaaatatctcctgaaattgctcttagggatgttccctctaattttaaaaagtaaaggggaaaaatgaatttgcattcactggtgtgtgctgtttcagtgtcagcaccatgagttaggattgtattgtgtgtcagaactttgctctgtgctggggatgtaagaccaaagtcaccatgctcatggcttcagtctcatgaagcatgacccgtgtaacattttaaaagagacaattcataaacacacttagagagcattgtagaaataaaggagaatgtgagaaggagt

SEQ ID NO: 132317 - DNA, 601 bp, Human
gcacagattgagtctatagcttccagcatgagcgatgcagaagatgggtgatatctgcatttccaactgaggtactgggttcatctcactggggctagttggacagtaggtgcaggacagtgggtgcagcccaacgagcatgagctgaagcagggcgaggcatcacctcacccaggaagcacaaggggtcagggaattccctttcctagccaagggaagctgtaacagatggcacctggaaaattgggtcactcccattctaatactgcacttttccaatggtcttagcaaatggcacacwaggagattatatcccatgcctggctcagagggtcccacgcccacagagcctcactcattgctagcacagcagtctgagatcgaattgcaagatggcagcaagcttggggtggggcgcctgccattgacgaggcttgagtaggtaaacaaagcggccaggaagctcaaactgtgtggagcctgttgcagctcaaggaggcctggctgcctctgtagactccaactctgggggcagggcatggccaaacaaaaggcagcagaaacctctgcagacttaaatgtccctgtctgacagctttga

SEQ ID NO: 132318 - DNA, 601 bp, Human
gatcctgttgtgggatggggggaggggagagggatagcattaggagatatacctaatgtaaatgacgagttaatgggcgcagcacaccaacatgggacatgtatacatatgtaacaaacctgcatgttttgcacatgtaccctagaacttaaagtgtaataataatttaaaaaagaatattgtgatcctctggtttttcctgaaaaaatgtatccatgttttaatacaggtatagttcctcttcactgctgtgtattgttacatcatagcatcatgttttcatcctttcttctgttgatgracatttgggttgcttgcagttttttgttgttatgacagtgtctttgtgaacattcttgtatataacccctgctgtgtgaagctttttctaccatttatatatggtaagagacagggtccagtttcatccttctgtgtatggacatccagttttcacagcactatttattaaagagactgtccttttccctatttgtattcttggcaccagtgttgaaatcaattgaccgtatatgtgagttcatttttgggccttctattggtgagtctttttttgtgtgagtatcatgttgttttaatt

SEQ ID NO: 132319 - DNA, 601 bp, Human
atgaacatttgggttgcttgcagttttttgttgttatgacagtgtctttgtgaacattcttgtatataacccctgctgtgtgaagctttttctaccatttatatatggtaagagacagggtccagtttcatccttctgtgtatggacatccagttttcacagcactatttattaaagagactgtccttttccctatttgtattcttggcaccagtgttgaaatcaattgaccgtatatgtgagttcatttttgggccttctattggtgagtctttttttgtgtgagtatcatgttgttttmattactatcactttatagtatcgtttgaagttaggtagtgtgatacctcccactgtgttctttttcttcgtgattgctttggttttgttttgttttttttttcagttccagatgaattttaggattgttttctcttcatgaaaaatgactttgaaatcttgataggtattatattgactctttagcatgccttgtgtagcatggacaatttaacaatattaattattcctgtctatgaacattgtttttttcatttatttgcatctttttccatttctttctttaacattttatagtttt

SEQ ID NO: 132320 - DNA, 601 bp, Human
ttgttttttttttcagttccagatgaattttaggattgttttctcttcatgaaaaatgactttgaaatcttgataggtattatattgactctttagcatgccttgtgtagcatggacaatttaacaatattaattattcctgtctatgaacattgtttttttcatttatttgcatctttttccatttctttctttaacattttatagttttcagtgtacatgtctttcacctccttagttcaatttattcctattttattttatttgtagctattgtaaatgggatttttctcttgatttstttttcagaatgttcattgttagtgtatagaaatgttcctgatttttgttagttgactttagattttgcaactttattgtatttattagttctgagttttttggtggaatatttagggttttctctatataagatcatgttgtcagcagtgattgtttcattttgtactttccaatttggatgccttttatttctttctcttgcagaattgctctggcaaggaatccaacattcaatagacatgttggatttttgtcagatgcttttcctacgtctaatgagatcatatagtttttgtct

SEQ ID NO: 132321 - DNA, 601 bp, Human
aaaatgactttgaaatcttgataggtattatattgactctttagcatgccttgtgtagcatggacaatttaacaatattaattattcctgtctatgaacattgtttttttcatttatttgcatctttttccatttctttctttaacattttatagttttcagtgtacatgtctttcacctccttagttcaatttattcctattttattttatttgtagctattgtaaatgggatttttctcttgatttctttttcagaatgttcattgttagtgtatagaaatgttcctgatttttgttarttgactttagattttgcaactttattgtatttattagttctgagttttttggtggaatatttagggttttctctatataagatcatgttgtcagcagtgattgtttcattttgtactttccaatttggatgccttttatttctttctcttgcagaattgctctggcaaggaatccaacattcaatagacatgttggatttttgtcagatgcttttcctacgtctaatgagatcatatagtttttgtctttcattctgttaatatagtgtatcacatttattgatttccatatgttgaact

SEQ ID NO: 132322 - DNA, 601 bp, Human
atgccttgtgtagcatggacaatttaacaatattaattattcctgtctatgaacattgtttttttcatttatttgcatctttttccatttctttctttaacattttatagttttcagtgtacatgtctttcacctccttagttcaatttattcctattttattttatttgtagctattgtaaatgggatttttctcttgatttctttttcagaatgttcattgttagtgtatagaaatgttcctgatttttgttagttgactttagattttgcaactttattgtatttattagttctgagttttttggtggaatatttagggttttctctatataagatcatgttgtcagcagtgattgtttcattttgtactttccaatttggatgccttttatttctttctcttgcagaattgctctggcaaggaatccaacattcaatagacatgttggatttttgtcagatgcttttcctacgtctaatgagatcatatagtttttgtctttcattctgttaatatagtgtatcacatttattgatttccatatgttgaactatccttgcatcccagggataaatgccacttcatcttggtgaatga

SEQ ID NO: 132323 - DNA, 601 bp, Human
atggacaatttaacaatattaattattcctgtctatgaacattgtttttttcatttatttgcatctttttccatttctttctttaacattttatagttttcagtgtacatgtctttcacctccttagttcaatttattcctattttattttatttgtagctattgtaaatgggatttttctcttgatttctttttcagaatgttcattgttagtgtatagaaatgttcctgatttttgttagttgactttagattttgcaactttattgtatttattagttctgagttttttggtggaatmtttagggttttctctatataagatcatgttgtcagcagtgattgtttcattttgtactttccaatttggatgccttttatttctttctcttgcagaattgctctggcaaggaatccaacattcaatagacatgttggatttttgtcagatgcttttcctacgtctaatgagatcatatagtttttgtctttcattctgttaatatagtgtatcacatttattgatttccatatgttgaactatccttgcatcccagggataaatgccacttcatcttggtgaatgattcttttgatgtgg

SEQ ID NO: 132324 - DNA, 601 bp, Human
tattgtaaatgggatttttctcttgatttctttttcagaatgttcattgttagtgtatagaaatgttcctgatttttgttagttgactttagattttgcaactttattgtatttattagttctgagttttttggtggaatatttagggttttctctatataagatcatgttgtcagcagtgattgtttcattttgtactttccaatttggatgccttttatttctttctcttgcagaattgctctggcaaggaatccaacattcaatagacatgttggatttttgtcagatgcttttcctrcgtctaatgagatcatatagtttttgtctttcattctgttaatatagtgtatcacatttattgatttccatatgttgaactatccttgcatcccagggataaatgccacttcatcttggtgaatgattcttttgatgtggtggcaaattcaatttgctgtattattgaggatttttgcatctgtgttcatcaaggatattggcttgcagtattttttttttttgtgatgtccatgtttggtttttgcatcagagtaatactggcttcataaaaggatcccttcctcttttattttttttg

SEQ ID NO: 132325 - DNA, 601 bp, Human
taagatcatgttgtcagcagtgattgtttcattttgtactttccaatttggatgccttttatttctttctcttgcagaattgctctggcaaggaatccaacattcaatagacatgttggatttttgtcagatgcttttcctacgtctaatgagatcatatagtttttgtctttcattctgttaatatagtgtatcacatttattgatttccatatgttgaactatccttgcatcccagggataaatgccacttcatcttggtgaatgattcttttgatgtggtggcaaattcaatttgctrtattattgaggatttttgcatctgtgttcatcaaggatattggcttgcagtattttttttttttgtgatgtccatgtttggtttttgcatcagagtaatactggcttcataaaaggatcccttcctcttttattttttttgaaggcgtgtctaaaaaattcatgtcagttcttcattacagcatttggtacaattaaacagtggagccatctagccttgggattttctttaatagaagacttcttattactgattcaatctcctcacttgttagtggtctatttagattttctatttttc

SEQ ID NO: 132326 - DNA, 601 bp, Human
gccttttatttctttctcttgcagaattgctctggcaaggaatccaacattcaatagacatgttggatttttgtcagatgcttttcctacgtctaatgagatcatatagtttttgtctttcattctgttaatatagtgtatcacatttattgatttccatatgttgaactatccttgcatcccagggataaatgccacttcatcttggtgaatgattcttttgatgtggtggcaaattcaatttgctgtattattgaggatttttgcatctgtgttcatcaaggatattggcttgcagtattttttttttttgtgatgtccatgtttggtttttgcatcagagtaatactggcttcataaaaggatcccttcctcttttattttttttgaaggcgtgtctaaaaaattcatgtcagttcttcattacagcatttggtacaattaaacagtggagccatctagccttgggattttctttaatagaagacttcttattactgattcaatctcctcacttgttagtggtctatttagattttctatttttcgtgattcagtcctaataagttgtatatatgtagaaatttatccacttattcta

SEQ ID NO: 132327 - DNA, 601 bp, Human
tccatatgttgaactatccttgcatcccagggataaatgccacttcatcttggtgaatgattcttttgatgtggtggcaaattcaatttgctgtattattgaggatttttgcatctgtgttcatcaaggatattggcttgcagtattttttttttttgtgatgtccatgtttggtttttgcatcagagtaatactggcttcataaaaggatcccttcctcttttattttttttgaaggcgtgtctaaaaaattcatgtcagttcttcattacagcatttggtacaattaaacagtggagcyatctagccttgggattttctttaatagaagacttcttattactgattcaatctcctcacttgttagtggtctatttagattttctatttttcgtgattcagtcctaataagttgtatatatgtagaaatttatccacttattctaggttatccatttttggggaatataatttgttcataatgttctcttatggtcctttggatttccgtgctgtcagttgtaatattgcctctttcattgctgattttatttattttgagtcgtattttgggttatctctctagtctagctaaaggttt

SEQ ID NO: 132328 - DNA, 601 bp, Human
cagctcagctttgcctgtgagctacactgttagctggtacctctaatcaggtacctttgctgccaggtacacaaagctaccaccaagatctgtacactcattgctttgtttccacctgaccccaggtggtctagttgtgctgtattccgctgtgttccctttgaggtgagaccagagtggacttcctaagaagcatcttggaatgctagggaagctggatatttgctttcgggttctcttttccctctgtagaaaccatggtttttgggaaatcccgtctgtgaggccctgggccaacttragggatggggtggggcaatgttgtcaaagtgagatagtttctctcaccctttccatgcggcttttattccatgctgtggaccacacaagtgactctgacttattcctaacttggggagttttcaccaaggcgttcttgtctgtggatagttgctagttgaactttttgtggggtaggggggtagtgaaacctgtgacctcctatcccaccatcttgctgatgtcgtctgaattctctttgtacattagttttgtgatctaggaactctgaactctcttattaattctaatatgtagatta

SEQ ID NO: 132329 - DNA, 601 bp, Human
ctaccaccaagatctgtacactcattgctttgtttccacctgaccccaggtggtctagttgtgctgtattccgctgtgttccctttgaggtgagaccagagtggacttcctaagaagcatcttggaatgctagggaagctggatatttgctttcgggttctcttttccctctgtagaaaccatggtttttgggaaatcccgtctgtgaggccctgggccaacttgagggatggggtggggcaatgttgtcaaagtgagatagtttctctcaccctttccatgcggcttttattccatgctrtggaccacacaagtgactctgacttattcctaacttggggagttttcaccaaggcgttcttgtctgtggatagttgctagttgaactttttgtggggtaggggggtagtgaaacctgtgacctcctatcccaccatcttgctgatgtcgtctgaattctctttgtacattagttttgtgatctaggaactctgaactctcttattaattctaatatgtagattattctggatttttaaatgtaaacaaaaataccacttctgaataacagtttggatatacccttccagtttttatggtc

SEQ ID NO: 132330 - DNA, 601 bp, Human
atgcttattgtagattttctgtaagtactgtttatcaggttattatgaacattgtttcgagtgtatcaactaattttcctgtatttattgacatgatcttatggtttttcttttttaatcttttgatttgtgaactacattcaataatttcccaatgttaaaccaatctagctttcctagaaatagccaacttggtcatgatgtgttactttttaaaatacattatttgattttgttttaggtatttgtttaaaattttatatccatatttgaatgtaatttgcctatagtgttcattttyctgcattgtccttattggattatggtaccacagttacattatccataataatgagttagggaagctttccctctttatctcctttgacttagtttatgtaaagctgaaattatttcttccttgaatgcttgatagaactcacttgaaattttctttgtgagaaaatttaaactactaagtcaacttctttaattattataagattattcggccaggcgtggttgctcaaacctgtaatcccagcattttgggaggccaagatgggtggatcatgaggtcaagagatcgagaccatcctgg

SEQ ID NO: 132331 - DNA, 601 bp, Human
ttattgtagattttctgtaagtactgtttatcaggttattatgaacattgtttcgagtgtatcaactaattttcctgtatttattgacatgatcttatggtttttcttttttaatcttttgatttgtgaactacattcaataatttcccaatgttaaaccaatctagctttcctagaaatagccaacttggtcatgatgtgttactttttaaaatacattatttgattttgttttaggtatttgtttaaaattttatatccatatttgaatgtaatttgcctatagtgttcatttttctgmattgtccttattggattatggtaccacagttacattatccataataatgagttagggaagctttccctctttatctcctttgacttagtttatgtaaagctgaaattatttcttccttgaatgcttgatagaactcacttgaaattttctttgtgagaaaatttaaactactaagtcaacttctttaattattataagattattcggccaggcgtggttgctcaaacctgtaatcccagcattttgggaggccaagatgggtggatcatgaggtcaagagatcgagaccatcctggccaa

SEQ ID NO: 132332 - DNA, 601 bp, Human
aatcaagatcacgccactgcactccagcctggcggcagagtgagactgtttcaaaaaaaaaaaaattattcatacattctcatttcttagaagtcaggctgttatagtaagcttttttttctgcagatttattttattaaattttcaaatttattggcctaaagttgttcacacctatcatcttttttatttatgactatagcatctctcagttttattcaagttatatatttcagattttatttattagagaattgtgatcaggggagtttattagatttttcaaaggacaaccttttgsctttgtccaacagacattttaggtatgtgaattatacctgttaattttgctcttatctattgtggtattagtatttttcttgtcagtgtcttctaaagtatgtctttatatatttaaggtattcattatttaactgatatcttggttataaataattatctctgtttttctttaattttgattttagtcaattttttgtttataattttgtttattacttttgtacttagaatcatcctttatttagaaatgaaagattaaaaaaatttttttaacattagttttatttgtatctctaac

SEQ ID NO: 132333 - DNA, 601 bp, Human
agtttattagatttttcaaaggacaaccttttggctttgtccaacagacattttaggtatgtgaattatacctgttaattttgctcttatctattgtggtattagtatttttcttgtcagtgtcttctaaagtatgtctttatatatttaaggtattcattatttaactgatatcttggttataaataattatctctgtttttctttaattttgattttagtcaattttttgtttataattttgtttattacttttgtacttagaatcatcctttatttagaaatgaaagattaaaaaaawttttttaacattagttttatttgtatctctaactgtaatcaaactatgtctctgatctggaattttattccgacctatgatgttaagacttcaaatctatggttgaaaattccagctttatgatagaatcacctgaagtgctttttagagacatttgcccagttcccttcagttcccttccgcactcactaaatgtaggggtgggatggggtggtaaaatctcagaatatttaaaaaatatatatcatagacagttcttgatgcacaatcaggtttggaaaccactgatttaaatatatt

SEQ ID NO: 132334 - DNA, 601 bp, Human
ctgtaatcaaactatgtctctgatctggaattttattccgacctatgatgttaagacttcaaatctatggttgaaaattccagctttatgatagaatcacctgaagtgctttttagagacatttgcccagttcccttcagttcccttccgcactcactaaatgtaggggtgggatggggtggtaaaatctcagaatatttaaaaaatatatatcatagacagttcttgatgcacaatcaggtttggaaaccactgatttaaatatatttattttccaaatagctacctgattgttccagcrccattcattgagcaagctttttccttattactggtttgggattcctcctttaccatgtgtgttaaactccagagtatgctgggggttgttctgtggctcattggttctattagcagtcttgtgccagcgtcacagacttagtgattcaaactttatgacatattttaatgtttattaatgctagacctccctcttccttattcttattttttaaaacgtatctcatctttctcctcaaaaaatttaggatatttttcatttaaacatgttattcagaacaaggttggttgtatgtgatca

SEQ ID NO: 132335 - DNA, 601 bp, Human
acctccctcttccttattcttattttttaaaacgtatctcatctttctcctcaaaaaatttaggatatttttcatttaaacatgttattcagaacaaggttggttgtatgtgatcatcttttccatgtcatttccactgctttgttgttaagataatttcttctgtgtgtaaacttgtgttgttacataattattttctttgagtttgtgagaaatacgtaatttccttgattttctaactggctcttattggtgcataggaaagttcctgattttctttcagtagagtttttaaagcgcrctctgccttttggctctgctgagattctttcagttcctggattgtgtctcttgtccttgcactgactgtgccattcttccttttatttggaatgttcttcatcactgcccacactcccacctgtacctaatgatttcttaagctttagatttctgctgaatcatcccttccccaggatgttccttcagacttttcactaggtcatgacctcctgctgtgtacttcatcacaatctacatcttctgttacagtgctctgtttcagtgcaatcactcttccctgctggattgtaaacgtctt

SEQ ID NO: 132336 - DNA, 601 bp, Human
tccttttatttggaatgttcttcatcactgcccacactcccacctgtacctaatgatttcttaagctttagatttctgctgaatcatcccttccccaggatgttccttcagacttttcactaggtcatgacctcctgctgtgtacttcatcacaatctacatcttctgttacagtgctctgtttcagtgcaatcactcttccctgctggattgtaaacgtcttcaggtccaggaaggttttttgttttgtttaagtctttaaaccatctgagttaatttttgtctatggtgtaaggaaggkatccagtttcaatcttttgcatatggctagccagttatcccagcaccgtttattgaatagggagtcctttccagactggataaaggtggtacatatacaccatgggatactatgcagtcataaaaaagaatgagaccatgaccttcgcaggaacatgggtggagctggagttattagccttagcaaactaatgtaggaacagaaaaccaaataccacatgttctcatttataaggaggagctaaaggatgagaacacatggacacatagaggggaacaacagacactggggcttactgga

SEQ ID NO: 132337 - DNA, 601 bp, Human
tcccagcaccgtttattgaatagggagtcctttccagactggataaaggtggtacatatacaccatgggatactatgcagtcataaaaaagaatgagaccatgaccttcgcaggaacatgggtggagctggagttattagccttagcaaactaatgtaggaacagaaaaccaaataccacatgttctcatttataaggaggagctaaaggatgagaacacatggacacatagaggggaacaacagacactggggcttactggagggtggagagtgagaggaaggacaggatcagaaaatayaactaatgggtactaggcttaacacctaggtgattaaataatatgtataagaaacccccatgactcaagtttacctatatatcaaacctgcccatgtaatcctgaactttaaaataaaagttaaattaaaaacaagatttttgtttttgtttttgctgttgtctccttaatcaggagagcagaccgcacacaatgggtatttaataaattgcttaaatgaatgcatgaatgcttgcttcagcaacataactttggcaatgtggagattgtggtggaataggagagaagatgtagagaagc

SEQ ID NO: 132338 - DNA, 601 bp, Human
tggcgagagagagagaaccaggtgaatgggatacctctggaggagctggccttgggaagaaaggtgagggaaaggtggggacatttgctttcctccctgtacactgtgaaggtaaggcatgagggagaatgcccctcagaaactgttgtttgcctcaaaatccaacaaagctctttttaggtttgaaaagaaagcagttcttttttgctcattcatagaatacctttcagtgagttgcttctaaggacggtagcagagtttttgctgtcattgttttgttttattttttggtttttagacggtctcactctattacccaggctggagtgcagtggcacgataagggctcagtgcagcctagacttcctgggctcaggtgatccttccacctcagcctcccgagtggctgggaccacagatgtgtgccatatgcctgactaatatttgtaatttttatggagatgggatttcatcatgttgcccagatagttttaaactcctgggctcaaatgatctgcccgccttggcctcctcccaaagtgctaggattacaggcgtgagccactgtgccctgcccttggtagagttttgaagacagttg

SEQ ID NO: 132339 - DNA, 601 bp, Human
cctcccaaagtgctaggattacaggcgtgagccactgtgccctgcccttggtagagttttgaagacagttgttatgatgttaagtcattgcactgagtcactaggccatcctttggctttacaggacataaaatatgggagtttcatcaccagacagtgggcggtactgggtttcctactgggtggacagtcctgctagtgggagagttctgtccttagtctgtgcccttggactgtagatatagacatagaaggtcatctccctttatttcgcctttctgccttcattgtcactggggaracagtccccccaagtcttcctgtgtgtgacgctgtgcaggtggtacatagaaatgcccatcagtgatacttattttgatgctgctgtgatcctgagaattttcccacttataggtgctctctttgggatatctgttggcattcaactgttttcaacagaagtctccaaaattggtactcatccagggttatgttaactgcccagtgtaccgaagggtgatgtggacaggtggaaaaagactgggttaatctcttagtgagactaagtgtttttttacaagtggttggttgtctgagggtt

SEQ ID NO: 132340 - DNA, 601 bp, Human
tttcctgtaggaattcaggcccagtgttccagaactcctgatttttcaagaagagacagaaatctgtactgcatagcccaaataaatcttggattagatgctggctgcaaccacactagtttgcaatttttgtaatgggaagaaaatatttatgatctatgtaacacacaaatgttggtgttaaacagatacttttactctagaatctttgggtaaaatgaagtctgatgaccttgttaaaacatattatgtaatgcttgactttggtcattcaggaaatacctactgtgtgcgttaacaygtaatttagtacatattttctctttaaaatgagcagttgctacaaatgaaacctggcccagaagtagcagattgtcattctgcaaaatatttgggagacctgtcttttgccttttaggttttgttagtttgatggaggtaacgttacttttggttcttccattgtatttaattgacagtatcatcttctaaagaatttcagttttacagattggagtagtgaactcagggaagcattaaaaactagtagaaagatttgagtagattgggcaacttggcaccaaggccactggtagggacg

SEQ ID NO: 132341 - DNA, 601 bp, Human
aaatgaaacctggcccagaagtagcagattgtcattctgcaaaatatttgggagacctgtcttttgccttttaggttttgttagtttgatggaggtaacgttacttttggttcttccattgtatttaattgacagtatcatcttctaaagaatttcagttttacagattggagtagtgaactcagggaagcattaaaaactagtagaaagatttgagtagattgggcaacttggcaccaaggccactggtagggacgtgcacactcttttcttaataacttagaggtgatgaactcctgaktgattgcctcagctaacagatatttggctgtcactaaaaattatctaagttgtattacttgaaaacttagaatttaaaagtgttaccatagaggcagatgtgcctctagaattacctgtgtccagaccaccaaaaatgaccagacattccccttgcttcatatgagtgactgctacttcttgactttttaaagagttagctttggccaggcacggtggctcacaccggtaatcccagcactttgggaggccgaggcaggcagatcacctgagatcaggagttcgagaccagcctggccaa

SEQ ID NO: 132342 - DNA, 601 bp, Human
catttgcttattgactggtgttttcattgtggtagagccacacaatttttgtttttgattgtcattacttatatagatttttgagaggaacctaagattgtttttttctttcttgctcattaacttgtaatatctcaaatatatacttaataaagtaaaaattgacttaagtaaagggtgagaaaaagattatgaacttaagaaggattaaaaccaatttgcatagctctggagagactgtctttccttgtattacttggggaaagcaaaaattaaaagagatgagatctattatctgaawcatggatagtgtgacctacccagagtacctactttttaaccttccagtgggtgttgaaatctgattcagcacattcttggagagtgatgagtaaatttgttgttatataaagatttttcaaaaataagcatcggattcaaacatgagtagaaaggatgagatgttaatttaagtgattatgggaagctgtgatttatacacatgaaatcattcatttagagatgggtagtaagaacaatgaggatcttagggactgagtatctgtttcctaggacactagagacagcattaggtagtgat

SEQ ID NO: 132343 - DNA, 601 bp, Human
aaaccaatttgcatagctctggagagactgtctttccttgtattacttggggaaagcaaaaattaaaagagatgagatctattatctgaatcatggatagtgtgacctacccagagtacctactttttaaccttccagtgggtgttgaaatctgattcagcacattcttggagagtgatgagtaaatttgttgttatataaagatttttcaaaaataagcatcggattcaaacatgagtagaaaggatgagatgttaatttaagtgattatgggaagctgtgatttatacacatgaaatcrttcatttagagatgggtagtaagaacaatgaggatcttagggactgagtatctgtttcctaggacactagagacagcattaggtagtgattaacttaagaattctgaagtgtgattgcctagatttgaatcctggttctagtcctttctagctctctgaccaggagcaaattacctaagctgtctctgcctggaccttcccatctgtaaaatggtgttaataataacatctacctcatagcattattgtgaggataaaagtgagttaatatatgcagatttctagaagagtacatagcat

SEQ ID NO: 132344 - DNA, 601 bp, Human
gacaaaggaagctcacaccccagttgttttgtgggctacattcttggcgatgttttatcgttgcccctgataatttccccatttttaagaaaaaagaattcataggcttagcatgtggttgatttaagcctaacttttgactgattctatatgggattctgactctctgattaactttgatgttctaactttacctagcgaatattttttttctttattttatcgaacagggaagaggtcttttgatttttggattatttggtataatattatattcttgaaatcatcctgtgactgtcaraaagctgactgtaaatgaacagtgagccactgcagacagaaacaattattcagggaaacataaattcataatcactgggcctaaaatgaattagtgagtaatccaatctgggggtgagaaatgagcccttggcaacattgtttttaggctacagatggtccttgaaacactattagccggtggatctgagcacctgaaaggtttaaggaagcctgggtctgtgctgaaggtgtctttgggtaaactgtcatatttgcatgcagcatccttttagaatatcaatgagatctttatatgcat

SEQ ID NO: 132345 - DNA, 601 bp, Human
gattctatatgggattctgactctctgattaactttgatgttctaactttacctagcgaatattttttttctttattttatcgaacagggaagaggtcttttgatttttggattatttggtataatattatattcttgaaatcatcctgtgactgtcaaaaagctgactgtaaatgaacagtgagccactgcagacagaaacaattattcagggaaacataaattcataatcactgggcctaaaatgaattagtgagtaatccaatctgggggtgagaaatgagcccttggcaacattgtytttaggctacagatggtccttgaaacactattagccggtggatctgagcacctgaaaggtttaaggaagcctgggtctgtgctgaaggtgtctttgggtaaactgtcatatttgcatgcagcatccttttagaatatcaatgagatctttatatgcatgtgttatgtcatttccaagcaccctgtcagtaaatggatgggtggcatcagcccgaatgcaaaggaaaggggttcatctggaactgaaatagcagaaagggagcaggagatggatatttgatggctgcccttccctgtgcat

SEQ ID NO: 132346 - DNA, 601 bp, Human
ctattctagccatttgctgagaagaaagacatttgtggaggtctcctcaataggaatttttattaaccataagtgatttaaaaccattgtcaaacctgtaacttttaagagttactgtgacagaatgaggggaaaatattctgaagtttaattagaaactatagaaattagacggccaggcatggtggctcacgcctgtaatcccagcactttgggaggccgaggtgggtggattgcttgaactcaggagtttgagaccagcctgggcaacatgatggaaccccgtctctacaaaaaatasaaaaattaggctagtgtggtggcaggcgcctgtaatcccagctcctcgggagcctgaggtgggaggatggcctgagtctgggagggcaacagagccagaccttgtctcacaaaaacaaacaaacaaaaactgaagaaattagaagatgaataatggctgtggtaatttactttcttgtaagtaaaggtctttacctactttacaagaaagatctttacttacaataaaataagttacctgtaaatggccttaaatattgattaggttgtaagagagaatatgaaattagataaaatgtag

SEQ ID NO: 132347 - DNA, 601 bp, Human
gccttaaatattgattaggttgtaagagagaatatgaaattagataaaatgtagcaatatttgatgtcatcatttccttcctcacccacgcctcttctggagtgggcagttggtcacatgatcttgcccctcttcagcgattgcactgtggctgttactgtcaggagatgcccgtttgtaggtctgctggtagaagtctgagatagactggctcagagacaagctgtaccagtaagaacgccctaagaaactgttcaagccagagagagcagttgccagcgggcagtggttactggagctrgaatgccagatgaagtctgatgggtttggctctgatgggtcttgtgcatccaaaaccaggtagccagaaggagccagttgatcaagcagatatagaaagatccccagagagaagcagaggtatcatccaagagatgtgaaagatttttccacatcccaattgctacctggattcctgagacttggttttcattttcttctgtgaatctagtgaccatatacctttttccttgcggtaacatgggacataactgattttcttgaatgcgagagagctttaactaaaagaagattgacattt

SEQ ID NO: 132348 - DNA, 601 bp, Human
ctggaatgccagatgaagtctgatgggtttggctctgatgggtcttgtgcatccaaaaccaggtagccagaaggagccagttgatcaagcagatatagaaagatccccagagagaagcagaggtatcatccaagagatgtgaaagatttttccacatcccaattgctacctggattcctgagacttggttttcattttcttctgtgaatctagtgaccatatacctttttccttgcggtaacatgggacataactgattttcttgaatgcgagagagctttaactaaaagaagattgacayttaagacaaaatgaaatattgcaaatagtcaagaagatctacacttgggtccagaatgttatagaattaagaaaataactttctgtggcatcagagattgaaaaaaaaaaagccgtcgagaccaggagcagtgtggctgtgaatccttccagagcccagatgtacaaggcagcagaagcaacaaaggctgtggccagcaacgaaggcagagtccccggtaggcggaggtccccgtgcacagtgtggtgcagcagtgaacccaagattttccttcacagggcaggggaactatttcctaat

SEQ ID NO: 132349 - DNA, 601 bp, Human
ctgtgaatctagtgaccatatacctttttccttgcggtaacatgggacataactgattttcttgaatgcgagagagctttaactaaaagaagattgacatttaagacaaaatgaaatattgcaaatagtcaagaagatctacacttgggtccagaatgttatagaattaagaaaataactttctgtggcatcagagattgaaaaaaaaaaagccgtcgagaccaggagcagtgtggctgtgaatccttccagagcccagatgtacaaggcagcagaagcaacaaaggctgtggccagcaaygaaggcagagtccccggtaggcggaggtccccgtgcacagtgtggtgcagcagtgaacccaagattttccttcacagggcaggggaactatttcctaataagcattggcattcaggttagtaaccagttgataggattatatcaacctgtctctaagtcaaaacagattattcaacttttttgagtggtattttagaatacataggtcaaaggtgggcatggtggcacacacctgtagtcccagctacttgggaggctgaggagggaggcgtgcctgagctcaggagttcaagtcagcct

SEQ ID NO: 132350 - DNA, 601 bp, Human
cgtcgagaccaggagcagtgtggctgtgaatccttccagagcccagatgtacaaggcagcagaagcaacaaaggctgtggccagcaacgaaggcagagtccccggtaggcggaggtccccgtgcacagtgtggtgcagcagtgaacccaagattttccttcacagggcaggggaactatttcctaataagcattggcattcaggttagtaaccagttgataggattatatcaacctgtctctaagtcaaaacagattattcaacttttttgagtggtattttagaatacataggtcaaagrtgggcatggtggcacacacctgtagtcccagctacttgggaggctgaggagggaggcgtgcctgagctcaggagttcaagtcagcctgggtaacatagggagatcctgtctctaaaaataaatattaaaaaagaacatgtagatcagaatttggatgacttttttttcctcaggtgcagagatggtaggggcatactttcaatccctggtacatgactttctttctggtctgcttagcaatatgtgtgaaatgtggccaaggatatgggacttgttgtgcctgtgccatataagagcctc

SEQ ID NO: 132351 - DNA, 601 bp, Human
ggagttaattatgacaattatcatttgatgttgtgggggctaaatgtgggtatttttggtgtttttccttttttttgttacatatgttaaactctgagtcttttgacaacaccaaaaggcattatgacaactgtatatacatttaactttgctttcagggagactagttcaaggtagtaaaacctcaaaatggatttgcaactgaattaaggttttctgagtagagataaggctgaggtagccaaaactacttctgctatctctttagaaaaagtacttttattcagtctgttcttaaaakaaataagtgtggttgttttcttttttaccataagcagaatgaaaacaaaattagaagtcattacttttttttgccccagcttactttttgttatggaggtaaaaattacataacataaaactaaccattaaaagtgaacaattcagtatatttagtacattcatgttttgcaaccaccacctctgtctagttccaaaacattttcattacccccaaattaaaatcctgtatccattaaacagtaactcaactctttcccctcaaaatcaccagtctgttttctgtctctatggatttacc

SEQ ID NO: 132352 - DNA, 601 bp, Human
ctagttgttttgaatattgttatatggtatccctggaaatcagattctctcccctaaccacggtctattattgttgactcttgagggctgccatctgtttagtgatttttccaaaggttgcattctttactgtgtatcattactgaagcctctgttctgttgacatatggttactgacatttccattttgttatctcattggtcagccagttatgtgacagaggatttccttaaatgtctggaaccaaaaagaaaagaaaaaaacaaaacaccaaacatttttctagtctttgcagcttarttctgacctaagtcattccctcaatgctaaaccaggtcacccatgactctgccttagccttcacctcctgctgtgcagaacccacagatccaccagtggggcaaacctatggtcctctcaggtcttctccaagcatgtggcagtcctaggcatggatttttcaccctagcttccacagcgtatacattttttattccctctagaaacttccttcttagcctctgccttccctgctttttggtctgtcccttactagtttttattccctctagaaacttccttcttagcctccaccttccc

SEQ ID NO: 132353 - DNA, 601 bp, Human
ccaggcggaacagagccatatttctcttctttcaaaagcaaatgggagaaatatcgctgaattctttttctcagcatgggatatccctgagaaagagaatgtgtacctggaggtaggtctctaaactggcccccctgggtgtggtcgtctcttatggtcgagactgcagaggtgagatagactccagtctcccatagcgctcccaggcttattaggaagaggaaattcccacctaataaattttggtcagaccggttgatctcaaaaccctgtctcctgataagatgttatcaatgacaayggtggccaaaacttcattagcaattttaattttgcctcggtcctgtggtcctgtgatctcgccctgcctccacttgccttgtgatagtctattaccttgtaaagtacttgatgtctgtgacccacacctattcacacactccctccccttttgaaactccctaataaaaacttgccggtttttgcagcttgtggggtatcacgggacctaccgacgtgtgatgtctcccccggatgcccggctttaaagtttctctcttttgtactctgtccctttatttctcaagctggccaacactta

SEQ ID NO: 132354 - DNA, 601 bp, Human
ataaaaacttgccggtttttgcagcttgtggggtatcacgggacctaccgacgtgtgatgtctcccccggatgcccggctttaaagtttctctcttttgtactctgtccctttatttctcaagctggccaacacttaaggaaaatagaaaagaacctacatgaatatcggggcaggttccccaatagagcagcgtactattttgctcagtgggggacactgtaggtcatagagtccatcttggatgggtatcaacttgaagttagtgtctgcctgcctgcctgtctctcatatgtttgttyggggggcctatctgtatatatacttttgtcttatttgaagattccagtttttttcatagagaggcagtaaaagatgcccaaggatgttctgactccctttcaacttatccttgtaaggcaccatagagaaagtatcttaggtcttttgttttttcagactgtggcatcatcagcttttctccaaagtgctggctgcctctcacaacatcactgcagtgtgtgttgtcttgctggcagagtctttccatttctctttggggtgggaatggaggcaggaagatattcttttctagcacattt

SEQ ID NO: 132355 - DNA, 601 bp, Human
cacttaaggaaaatagaaaagaacctacatgaatatcggggcaggttccccaatagagcagcgtactattttgctcagtgggggacactgtaggtcatagagtccatcttggatgggtatcaacttgaagttagtgtctgcctgcctgcctgtctctcatatgtttgttcggggggcctatctgtatatatacttttgtcttatttgaagattccagtttttttcatagagaggcagtaaaagatgcccaaggatgttctgactccctttcaacttatccttgtaaggcaccatagagaargtatcttaggtcttttgttttttcagactgtggcatcatcagcttttctccaaagtgctggctgcctctcacaacatcactgcagtgtgtgttgtcttgctggcagagtctttccatttctctttggggtgggaatggaggcaggaagatattcttttctagcacatttggcaaggggagttcaattcaaaactctaaggaattggtttttcaaatctgtgccacctttgttctttttttaaaaaaaggacatttaatatttctcaagtgcaaacttctcattctggctgctatttattt

SEQ ID NO: 132356 - DNA, 601 bp, Human
gggaatggaggcaggaagatattcttttctagcacatttggcaaggggagttcaattcaaaactctaaggaattggtttttcaaatctgtgccacctttgttctttttttaaaaaaaggacatttaatatttctcaagtgcaaacttctcattctggctgctatttattttcttcattctctaaatttattctgtcagcgtttctgaagctgcctctgctggttgccaggcagtggctttactccttttggagtaaagatgaatctgaccccagggtaggatcaaaatctgtaccagtagrtcccagttctggctttttgagctaatatagtcaatctaatttcccttgcatgtgatagctattaaaacattttaagactgtgaacatgcttatttgagaccggaagagactgggtcacagaggaagaaggaggcaattacagagtgggagtgggcaggctttggtggtttggagactttgggagacatgaataatataagggattggtggaaaagagggagggagcagggtagagacaagaacctttggtcagcttgtattttttagggtcagtattctctggcaataatctctccagct

SEQ ID NO: 132357 - DNA, 601 bp, Human
taatttcccttgcatgtgatagctattaaaacattttaagactgtgaacatgcttatttgagaccggaagagactgggtcacagaggaagaaggaggcaattacagagtgggagtgggcaggctttggtggtttggagactttgggagacatgaataatataagggattggtggaaaagagggagggagcagggtagagacaagaacctttggtcagcttgtattttttagggtcagtattctctggcaataatctctccagcttctttggaacgaaaacatgaatagtgtattagattaraaatcacaggactcccaggctagcattaattctccattcaaccctgcctctttcctaccatgatggacaaggcaaggagatgagggacagaatgctttctcctccgcctctcactgttcctgtgattttcagattgtactattagcagagttctgcagacactataacagcgaatactgatgatcttctataaatgtatgtggaattctatttgatgattcttgtttaacgccacagaaattttggataggatacaagaagattacccatgatgtggcaaatgagaccagttgggatagc

SEQ ID NO: 132358 - DNA, 601 bp, Human
ctgtgaacatgcttatttgagaccggaagagactgggtcacagaggaagaaggaggcaattacagagtgggagtgggcaggctttggtggtttggagactttgggagacatgaataatataagggattggtggaaaagagggagggagcagggtagagacaagaacctttggtcagcttgtattttttagggtcagtattctctggcaataatctctccagcttctttggaacgaaaacatgaatagtgtattagattaaaaatcacaggactcccaggctagcattaattctccattcarccctgcctctttcctaccatgatggacaaggcaaggagatgagggacagaatgctttctcctccgcctctcactgttcctgtgattttcagattgtactattagcagagttctgcagacactataacagcgaatactgatgatcttctataaatgtatgtggaattctatttgatgattcttgtttaacgccacagaaattttggataggatacaagaagattacccatgatgtggcaaatgagaccagttgggatagctacaaagcagagactctgacttctgtatactgcacaggaaa

SEQ ID NO: 132359 - DNA, 601 bp, Human
gtgtcagctttgttctttggatttgcattgcatgacccgtaataccaggtggaggaaaccatgttgaatttctctgggggccactgctcagcagttgtcaatctttaagtgcttaaaaatgtctagcattcttcctttccagagggcatcctgtgtttacacatttacgccgtcaaaatcaagcctagtggatagaggagttgtagaacagggcagacagaatcaaatcaggcctggtgtagaggtgtaccttgggaaatacctccagttgttttcagacacttgcaaatatgtgtaaatrataagttttatcagatagctttttattttaatattttgggaaatgggataacacaaccttttcttgtgaatatcttttgttcttttaatagaatgtgaaatcattacactctaagtagcaagacaagaatatcatgtaaacatgttctggaagatctgggctttaattttgttgtgattagtgtatttcagagagtgaacatgtttggaagagtattgaaaatactctcctgggttgtgccggtgttcatgggttggacaagctcacctttgacaggcaggcttggatgctgctgatgga

SEQ ID NO: 132360 - DNA, 601 bp, Human
caaatatcctgacttgatccttattctatacatgtcaaaaatacttacatgtaacccataagcgtgtaaaatattgtatcttaataaaagaaaaaaaaatgtatatgtatattttaagaatcagtagtgccttgaaggataaatattctaataggtaggcagtggttaactgcaagtgatctgattggtggtctggatcagaaaattggaatttcaaattagagaatatgtttctgacttgacatcataagcatagatgtctttaaaatgcttttaatattcacaggcatttggggaagartgagctagattcttttttccctcatctagcttagatatttctacatttgctatcctcagtacatcatatctcagtagctcttcccccggcttgagttgtcctggaaaggtgcagacctcatgagaggtggaggatggcagggaaataaccaggtcatctcaggggtctgcagaagggtaacatctaattgagttctgagaccacacgtgaactctgcctcaggacattgcagcccttgtcctggccacacactttattgcatgtgagtgccccacactacccaaccagctcaaccagctt

SEQ ID NO: 132361 - DNA, 601 bp, Human
ggttaactgcaagtgatctgattggtggtctggatcagaaaattggaatttcaaattagagaatatgtttctgacttgacatcataagcatagatgtctttaaaatgcttttaatattcacaggcatttggggaagaatgagctagattcttttttccctcatctagcttagatatttctacatttgctatcctcagtacatcatatctcagtagctcttcccccggcttgagttgtcctggaaaggtgcagacctcatgagaggtggaggatggcagggaaataaccaggtcatctcagrggtctgcagaagggtaacatctaattgagttctgagaccacacgtgaactctgcctcaggacattgcagcccttgtcctggccacacactttattgcatgtgagtgccccacactacccaaccagctcaaccagcttcactctgcctcacgagaaagctcttattttacctgtgccaaagtaaaaaaggttgaagtttgccaagtggaaaggaaaagacagacaacacattaagtgattttttaaaaaaaatttttatatattccttctggaaactgtttttctgtttgacttgatgaaa

SEQ ID NO: 132362 - DNA, 601 bp, Human
gcgatttgacttccttgggtgttaggtcttcctcaaggtaagcgtagttttcttactgcttgtatggtggccatgacacttatgactgtcagcactacatgtttatgtgttcatatttttcacatactttcaattcttggagtttagggattgtattaatcttgtataccatagacacctgaacataagctaaatgtctactagcacacagtaaagatttgaatatgttattttgaaataatgaatcagtgccctaaaacaaaggtggtcattgttaaggatgatctggagaggcctgggygaaggataccaccctgggcccattccaggttagtgacatgaagagaccagttgatattgtcagtgtctttctcctttgatgctctatagattgagttgagaacatagattgttgattgcggattaggaaaaataggaggtcaaggggattaagacagcatcagttttcatgaagttcaaggtagttggagaggtgggttaagctgaggaataccagtctagagtgattcacagtagcttctagaacaaaacacttttgcaaaacaagacaggtggaattaaagtgggggcagaaattgaa

SEQ ID NO: 132363 - DNA, 601 bp, Human
gattgagttgagaacatagattgttgattgcggattaggaaaaataggaggtcaaggggattaagacagcatcagttttcatgaagttcaaggtagttggagaggtgggttaagctgaggaataccagtctagagtgattcacagtagcttctagaacaaaacacttttgcaaaacaagacaggtggaattaaagtgggggcagaaattgaacaggagagaaatttcatgctctacgttcttggtgtgaccgtgctaattgtgtggcttttgtgggttggatcgcatccttgaaaagataygttgagttgttgagtcctaaacccccctgcacagtatcttagaatgtgacctggtttggaaatagaatcatggcagcttagttaagatgagttcataagttgaggctttcatgcaatgattgatgttcttctgaaagaagagatgcacacatatagggagatcaccatgcgatgatggaggctgagatggaagttagctgcagctgtgtactaaggaattggcagccagtcaccagaagtggggaagagactaggaaaagatccttcctacaggtttcagagggagtgtggctaccttga

SEQ ID NO: 132364 - DNA, 601 bp, Human
ggaaacaaccctcagtggtttgttccattcttatctgtccttgaaaatagttgagaacaaacgaagacttgggactgactgccttggatgtggtctggtttgccctgtaactgacaagagtgatgggtccccgtcgagtgacggcgttggactagaacccaggctgagagagcactgcggtccttggctgatgcactgaagaaaaacgcgtcagatagaaacaaaattactgtgtatccatttctgtgcataactatagtggaagaaaagcaaaatttaaaaaaaacacaccaaaaacccygcgatcaccattctctgtaattcagactcttttttgtagtaagaagtgccatgcagctttcatgaagttgctggtatctgttagccgcactccattgccatggcccatcttcttgaccttccactcttattgtgggtttccctgttaatcggatcgtgcctcccccctcctctgcaaacaccttatagttttgagagatgataatcaggcataaaatccttcccctgagtctgagtctgggacttcagtcaccttccagcctaagaggctggagcagcctggcatgctccccggcagctg

SEQ ID NO: 132365 - DNA, 601 bp, Human
tgctgatattacaatttgaggttattttagtaatggtgtataggatgaaatagaccaggaaacaacttggaaggaggggcctcacgttagcacattgcccttagacattaagcctgtagcagctgcaacatccaaggtgaggttgtggttgagactgtagtgagcgatttgtatgcagttcctacatcaccactgtccctgtggactgcagttggtcctcttgcttgttagtgttctagacacataagtttcttaaaatgcgtgatttcgtagtagagtcttataattctactagattttrtgtgtagttttatgtgtgtggactaatacttctgtgggtttcagtctacacatttgtattttattcttgtcattagagttctgaaatgatggttggcacgaatgaattctcatctcaactgaagtgccaggatgcccttgctttcctttaaccagtagggagaggtaggagccgtgcggaattacaaatggtggcttctgtgaaagcctgttcaagtgttgttcagagtttcaacaacaacaagaaaatgctatccaagccatcatttccttttttttttttttattatgagtctctagt

SEQ ID NO: 132366 - DNA, 601 bp, Human
tgaaggctgataagccatagttggatgtgacagccttagacacagcccctgcccaggcctcacactcagttactgagcccagtcccctttgcttctgtaaaggcttcagtcctgctgctccctccgtccaggccgattagatatatgggtgttggcatagtctctgaactggactccctgtttcccatctttaccttttttatgtcattcttccattcggtaaagatttgaatatactttgcaagccaggctgtgccctcggccctgaatatacaattgtgaaagagtcagccaggaaatmctggcccctgcagctgattctctagtggggagggtggacagtgagcaaaatgtgtcagtaaaagatgtagaagacggacatggtacatgccccaagggaaataaaggaggaaagggaaataaggagtttgcatggggaagtgtaattttaaatgggggcattcaggagggcctccctaagaagccacattgaggtggggtgagctgcatggaaatctgggagaatggatgcaagggagcagcaggtcagcctattagaagaaaagcagaaagctagttggggctctggcaccagaggagg

SEQ ID NO: 132367 - DNA, 601 bp, Human
aaatcctggcccctgcagctgattctctagtggggagggtggacagtgagcaaaatgtgtcagtaaaagatgtagaagacggacatggtacatgccccaagggaaataaaggaggaaagggaaataaggagtttgcatggggaagtgtaattttaaatgggggcattcaggagggcctccctaagaagccacattgaggtggggtgagctgcatggaaatctgggagaatggatgcaagggagcagcaggtcagcctattagaagaaaagcagaaagctagttggggctctggcaccagasgaggtcagaggggtgctgggcctcgctggccatcagaaggcacttggttcttattcagatggagaccagaagctttggaggactttgaatgtagtgacaggacctgccttccatggtaacagggtttctctgctgggtggaggcccagggacagttcaggaggctgctctgatggtccaggtgagggagggtgaccctagcagtggccaggtgagatatggtcagggtctagatgcatttcagaggcacaggtggcattgtttgctgattgattgaatatatggggtatgacagaaagga

SEQ ID NO: 132368 - DNA, 601 bp, Human
ggaaagggaaataaggagtttgcatggggaagtgtaattttaaatgggggcattcaggagggcctccctaagaagccacattgaggtggggtgagctgcatggaaatctgggagaatggatgcaagggagcagcaggtcagcctattagaagaaaagcagaaagctagttggggctctggcaccagaggaggtcagaggggtgctgggcctcgctggccatcagaaggcacttggttcttattcagatggagaccagaagctttggaggactttgaatgtagtgacaggacctgccttccwtggtaacagggtttctctgctgggtggaggcccagggacagttcaggaggctgctctgatggtccaggtgagggagggtgaccctagcagtggccaggtgagatatggtcagggtctagatgcatttcagaggcacaggtggcattgtttgctgattgattgaatatatggggtatgacagaaaggaagaagaatgattctgatatccttggtgtgagtacctggaagcatggagctgtcctggactgaaagagacagaagtgatcactgctgtgtttctctgggtggtgttccataact

SEQ ID NO: 132369 - DNA, 601 bp, Human
tgtatttcagtgttaacatctgtctccatgaccttccctccttgccagtctgtgtaaaataaagaatggtgaggagagccccaacctgccccaaagcccaccctcacgcaccctagttcgttacgggttctacacagccggaagcctttcggccaggtgtgtgtgtcagggagaagataagacttcttcctcactgtatctgcagtgctgaggccaccgtggaaatgagatgttttctacattttttgcttatttttttcacttactgatttttaaagtttatgtataatagagtgcgccwctgccattaccaactggagactctcatgtagaaagtatttccaattttaaatgtggtaacggtgtcctatgtgagcatgagatattttcctgatatagcagaggatttgtagacagctgttcttttctctcatataactctgtctgtactccccagcgcctgctgattcagggagccctaagaaggtcctgctggcagggctttcaagaaccacgccctgtgggctaacctgcagcctgggagcctgtgggggacagcccagcttcggccctttctgtctggtgcctttgcttcagcagg

SEQ ID NO: 132370 - DNA, 601 bp, Human
tgtgttcatacattggaatactgcttggcaacagaaataataaagtattgacatgtgcattaatattagatgaatctgaaagcatcaggctaggtgaataggccaaacagaagagactgcaaactatgattctgtttatataacattctagaagaggccaaactgtagtaaaaagaggtagatgaaaggtcagcagggcctggagtgagggaagggacttgtctgcagcatggaaggagggaactttggggatgatgaaagtgttctgtatcttgattgtggccggggttacctgactctrtacctttggcaaaacttgctgctgaatcctacgcttaaaatgggtcagctttattgtatgtcagttaataaagctgattaacaaaagagtatttctgtagaggcttacatgctagtgtgaatgtgtgaattcaataaattgggttggcttattctgagaaggataaaagttttttgtttttcgttttttggaaatagaaacattttgtgggaggtagggatggccagtgtagagaaatatgtcatggggtaagtgggaaaagataacctgagggtaccagactggcacctgggtgcttgc

SEQ ID NO: 132371 - DNA, 601 bp, Human
atggaaggagggaactttggggatgatgaaagtgttctgtatcttgattgtggccggggttacctgactctgtacctttggcaaaacttgctgctgaatcctacgcttaaaatgggtcagctttattgtatgtcagttaataaagctgattaacaaaagagtatttctgtagaggcttacatgctagtgtgaatgtgtgaattcaataaattgggttggcttattctgagaaggataaaagttttttgtttttcgttttttggaaatagaaacattttgtgggaggtagggatggccagtrtagagaaatatgtcatggggtaagtgggaaaagataacctgagggtaccagactggcacctgggtgcttgcaggtgagaagccaaacatctcttgaaaatgtttgcttaatgcctgtgagatatcatcctgtcttcctttgaattattagtattataggtagtccttgaaatgttatacatttaacagaaatttctcttatctacttatggactttaaatttagggatattcctagattggaagaaggcaatattcagagcaaaaaggtacaagctttacttgccaccagcagctgccag

SEQ ID NO: 132372 - DNA, 601 bp, Human
ggcttattctgagaaggataaaagttttttgtttttcgttttttggaaatagaaacattttgtgggaggtagggatggccagtgtagagaaatatgtcatggggtaagtgggaaaagataacctgagggtaccagactggcacctgggtgcttgcaggtgagaagccaaacatctcttgaaaatgtttgcttaatgcctgtgagatatcatcctgtcttcctttgaattattagtattataggtagtccttgaaatgttatacatttaacagaaatttctcttatctacttatggactttraatttagggatattcctagattggaagaaggcaatattcagagcaaaaaggtacaagctttacttgccaccagcagctgccagagtggaggccttatgtaattacttcggcttcagccttggcagcttttgttagcccaaagtggatttgctatatttgtgctttgaattttaccgtttacactcattaagttctataaatacaaaagcatggagagcattagtgctgtcaagaaagaggtgtgattatgttggaaatgaacatgatagtaaaaagaatatgaaagtggcagggaaatgg

SEQ ID NO: 132373 - DNA, 601 bp, Human
cttgccaccagcagctgccagagtggaggccttatgtaattacttcggcttcagccttggcagcttttgttagcccaaagtggatttgctatatttgtgctttgaattttaccgtttacactcattaagttctataaatacaaaagcatggagagcattagtgctgtcaagaaagaggtgtgattatgttggaaatgaacatgatagtaaaaagaatatgaaagtggcagggaaatggtgactgcagctgcactgggtgtgagaggctgggcagggaacgatctgaagaatgggggagggygatggtgagaaaagacacagctgatggtcgacaggggacaggagaaagagattcacggaggggaagaaaaagcattgaatgtgtgggataaagaaagagcattatcattagctactcactagcccaattaatgcaggagaagggagtctgctctggaactcgaaggctaagcatggtgtggttgaagtgctgctagtgaaacctgaaccatctgctttgggcatggtcagctctgagcccactggaatttgcaggacatcaaagtgagggctgcagcagctgctgctccatggcatctag

SEQ ID NO: 132374 - DNA, 601 bp, Human
ctgctgctccatggcatctaggaaatccctcgtggccctgccgagctgacggaggaagagggctcctacccgtgcagatttcagtggtgctggaaccattcatttttgaagagagactcttgccatctgcaaatcggtagaaatgcatccaggttctagaagttttcatctctcctggcttgtttattaactccaaagtgattaacagtggaaccaccttttgaatcctgggtactcctaggttgagcagggctgcacttccaccgtctttcagggttcaccagatgaaactctgaggatsctctatgaatcagcagatacacaacatctcctgagattataaggtggtactgtctgtggtgattacttaattttaatttataaactgggaatgcaaaggccatgctgaccttgctaagaaatgtgaagttcacaggagaacaaaactggggaaaaaggtaggggacagtcgtcagtagcagtcactcactttcgacattaaattatgcgtttgtttaattgtgaaggaaaatacaattgtagaacatgcaccaaaagctagaaatatacagtttaatgttaacacctaaaagcaaaatac

SEQ ID NO: 132375 - DNA, 601 bp, Human
acccgtgcagatttcagtggtgctggaaccattcatttttgaagagagactcttgccatctgcaaatcggtagaaatgcatccaggttctagaagttttcatctctcctggcttgtttattaactccaaagtgattaacagtggaaccaccttttgaatcctgggtactcctaggttgagcagggctgcacttccaccgtctttcagggttcaccagatgaaactctgaggatcctctatgaatcagcagatacacaacatctcctgagattataaggtggtactgtctgtggtgattacytaattttaatttataaactgggaatgcaaaggccatgctgaccttgctaagaaatgtgaagttcacaggagaacaaaactggggaaaaaggtaggggacagtcgtcagtagcagtcactcactttcgacattaaattatgcgtttgtttaattgtgaaggaaaatacaattgtagaacatgcaccaaaagctagaaatatacagtttaatgttaacacctaaaagcaaaatactaattaaagattttggaatattttttatctttctgggtatgaaacctccagccctgactttttatgc

SEQ ID NO: 132376 - DNA, 601 bp, Human
ggctttttattaaaataagagactgtagtataaattttagcaactggactaaataggcattaactggccctgggatccaaccataatttgtaacatcgttcctctgggaaaatggattctaagtgcccaataactaccttacaaatagactcttgaatcatagtccatttgagaataaggaactgtttgtgatagtaataccttcaattggctcgcttgagaactgcacagaagggacctatgttccaccacatgtgtgtggtgaacccagctcgtctgggtttgatcaaagattattgcygagtgggcatggaaagtgcaggaattaaactcaaagtagaggctggagacacgtcaagggtggcgttagaaggatggacctggagggctcttagtggtaggaagaggatttcaatcccagaggcaaaggagtgtatctgagcagatgaagggcagggagaagagaatggaagagtaagcaggattgagattgagaaccagccattttcaagcaaaatgtaactcaaagtgtaccagtaaggctgaatagcccaccaagaggtcagagagagacatccctcagatctctctgtctctctct

SEQ ID NO: 132377 - DNA, 601 bp, Human
gctcactaaagcctccaattcctgggttcaagcgatctttgcacctcacccttctgagtagctgggactacaggcatgcaccatcatgcctggccaattatgtgcctatatgtccctttttttctagggacagagtctcactctgttgtttaggctggtcttgaactcctggcctcaggtgatcctccctctttggcaaaagtgctgggattacaggcatgagccaccatgactggcttctttgtttttaataaaagtccatttaacttttatgcatagaacattattctattaatgtttygtctattgcaggcatacctcagagatattgcagatttgggaccagtccatagcaataaagcaaatactgtaataaagcaagtcacactatctttttttttttttggttttccagtgcatataaaagttatgtttacacggtactgtactctattaagtgtgcaacagcatcacatctttaaaaaacccaatgtgtgtgccttaatttaaaaatactttttactaaaatacactaacaatcgcctaagccttcagcaagtcataatctttttgttggtggagggtcttgccatgacattca

SEQ ID NO: 132378 - DNA, 601 bp, Human
gccaattatgtgcctatatgtccctttttttctagggacagagtctcactctgttgtttaggctggtcttgaactcctggcctcaggtgatcctccctctttggcaaaagtgctgggattacaggcatgagccaccatgactggcttctttgtttttaataaaagtccatttaacttttatgcatagaacattattctattaatgtttcgtctattgcaggcatacctcagagatattgcagatttgggaccagtccatagcaataaagcaaatactgtaataaagcaagtcacactatctttttttttttttggttttccagtgcatataaaagttatgtttacacggtactgtactctattaagtgtgcaacagcatcacatctttaaaaaacccaatgtgtgtgccttaatttaaaaatactttttactaaaatacactaacaatcgcctaagccttcagcaagtcataatctttttgttggtggagggtcttgccatgacattcatggctgctggctgatcaaggtggtggttgctgaaggttggggtggttttggcaatttctcaaaataagacaacaataaagtttgctgcatct

SEQ ID NO: 132379 - DNA, 601 bp, Human
actggcttctttgtttttaataaaagtccatttaacttttatgcatagaacattattctattaatgtttcgtctattgcaggcatacctcagagatattgcagatttgggaccagtccatagcaataaagcaaatactgtaataaagcaagtcacactatctttttttttttttggttttccagtgcatataaaagttatgtttacacggtactgtactctattaagtgtgcaacagcatcacatctttaaaaaacccaatgtgtgtgccttaatttaaaaatactttttactaaaatacrctaacaatcgcctaagccttcagcaagtcataatctttttgttggtggagggtcttgccatgacattcatggctgctggctgatcaaggtggtggttgctgaaggttggggtggttttggcaatttctcaaaataagacaacaataaagtttgctgcatctgttgactctacttttcacaaaagatttatccatggcatgtgatgctgtttgatagcatttacccacagtagaacttccttcaaaattggaatcaattatcccaaacactgctgctgctttatcaactaagtttatgtca

SEQ ID NO: 132380 - DNA, 601 bp, Human
cggtactgtactctattaagtgtgcaacagcatcacatctttaaaaaacccaatgtgtgtgccttaatttaaaaatactttttactaaaatacactaacaatcgcctaagccttcagcaagtcataatctttttgttggtggagggtcttgccatgacattcatggctgctggctgatcaaggtggtggttgctgaaggttggggtggttttggcaatttctcaaaataagacaacaataaagtttgctgcatctgttgactctacttttcacaaaagatttatccatggcatgtgatgcygtttgatagcatttacccacagtagaacttccttcaaaattggaatcaattatcccaaacactgctgctgctttatcaactaagtttatgtcatgttctaaatcctttgttgtcatttcaagaatgttcacggcgtgttcaccaggtgtagattccacctcaagaaaccactttctttgcccatccataagaagcaactcctcgtttattcaagtttgatcatgagattgcagcacattgtcgcatcttcaggcttcacttctaattctagttctcccgttgcttctaccacatcttcag

SEQ ID NO: 132381 - DNA, 601 bp, Human
acaatcgcctaagccttcagcaagtcataatctttttgttggtggagggtcttgccatgacattcatggctgctggctgatcaaggtggtggttgctgaaggttggggtggttttggcaatttctcaaaataagacaacaataaagtttgctgcatctgttgactctacttttcacaaaagatttatccatggcatgtgatgctgtttgatagcatttacccacagtagaacttccttcaaaattggaatcaattatcccaaacactgctgctgctttatcaactaagtttatgtcatgtkctaaatcctttgttgtcatttcaagaatgttcacggcgtgttcaccaggtgtagattccacctcaagaaaccactttctttgcccatccataagaagcaactcctcgtttattcaagtttgatcatgagattgcagcacattgtcgcatcttcaggcttcacttctaattctagttctcccgttgcttctaccacatcttcagttacttcctccactgaagtctcaaacttttcaaagttatgcatgagggttgaaatcaacttcttccaaactcctcttcatgttgatcttttgacctc

SEQ ID NO: 132382 - DNA, 601 bp, Human
atcaattatcccaaacactgctgctgctttatcaactaagtttatgtcatgttctaaatcctttgttgtcatttcaagaatgttcacggcgtgttcaccaggtgtagattccacctcaagaaaccactttctttgcccatccataagaagcaactcctcgtttattcaagtttgatcatgagattgcagcacattgtcgcatcttcaggcttcacttctaattctagttctcccgttgcttctaccacatcttcagttacttcctccactgaagtctcaaacttttcaaagttatgcatgagggttgaaatcaacttcttccaaactcctcttcatgttgatcttttgacctcctcccatgaatcataggtgttcttagtgacatctaaaatggtgaatccttgctgaaaggttttcaatttactttgcccagacccatcagaggaattgctgtctatggtagtatgaaatctatttcttaaataataagacttaaactctaaatgactccttgatccatgggctgcagaatggatattagataaacatgcatgaaaacaacattcattcatcaacgatgtctctatcagagctttgggtg

SEQ ID NO: 132383 - DNA, 601 bp, Human
gcaactcctcgtttattcaagtttgatcatgagattgcagcacattgtcgcatcttcaggcttcacttctaattctagttctcccgttgcttctaccacatcttcagttacttcctccactgaagtctcaaacttttcaaagttatgcatgagggttgaaatcaacttcttccaaactcctcttcatgttgatcttttgacctcctcccatgaatcataggtgttcttagtgacatctaaaatggtgaatccttgctgaaaggttttcaatttactttgcccagacccatcagaggaattrctgtctatggtagtatgaaatctatttcttaaataataagacttaaactctaaatgactccttgatccatgggctgcagaatggatattagataaacatgcatgaaaacaacattcattcatcaacgatgtctctatcagagctttgggtggcccagtgcattgttagtgagcagtaatattttgaaaggagtcttttgttctgagcagtaggtcttaacagtgggcttaatgttcggtaaaccattctataaacagatgtggtgttagccaggctttgtttttccatttctaagaattg

SEQ ID NO: 132384 - DNA, 601 bp, Human
actcctcgtttattcaagtttgatcatgagattgcagcacattgtcgcatcttcaggcttcacttctaattctagttctcccgttgcttctaccacatcttcagttacttcctccactgaagtctcaaacttttcaaagttatgcatgagggttgaaatcaacttcttccaaactcctcttcatgttgatcttttgacctcctcccatgaatcataggtgttcttagtgacatctaaaatggtgaatccttgctgaaaggttttcaatttactttgcccagacccatcagaggaattgctrtctatggtagtatgaaatctatttcttaaataataagacttaaactctaaatgactccttgatccatgggctgcagaatggatattagataaacatgcatgaaaacaacattcattcatcaacgatgtctctatcagagctttgggtggcccagtgcattgttagtgagcagtaatattttgaaaggagtcttttgttctgagcagtaggtcttaacagtgggcttaatgttcggtaaaccattctataaacagatgtggtgttagccaggctttgtttttccatttctaagaattgatt

SEQ ID NO: 132385 - DNA, 601 bp, Human
cagatataatcatgagaaagaagtttaaaatattgcaagaattaccaaaatgtgacacagaggcacgaagtgagccggtgctgttggataaatggtgctgatcgacttgcttgactcagggttgctagaaatcttcaatttgtaagaaatgcaattgtctttgaagcacaataaagtgaagcacaataaaatgaggtgtgcctgtattacattaacaaagaaggcattgctaatgatggcatgtattcactgcctgaagtagaagagatgtgtattttccttgatagggaaaattctttttttgttgttgttgttgttgttgtttttgagacggagcctcactctgtcatccaagctggaatgcagtggtgcaatctcggctcactgcaacctccacctcccaggttcaattgattctcctgcctcagactcctgagtagctgggattacaggtgcgtgccaccacagcccgactaatttttgtatttttagtacagatgggttttcgtcatgttggccaggctagtcttgaattcttgacctcaagtgatccacctgcctcggcctcccagagtgctgggattataggcgtgagccactg

SEQ ID NO: 132386 - DNA, 601 bp, Human
gtttatctatctttttcttttgtgcttttggtgtcatagctaatgagctctctttttaaagtagctgatcctgtgctttctttcctgggttctatttgagcagtttagattagggctatgcaaatggaaaacaggatggaaagaatggtggggaaatacttttattcataaatttccctttgtttctacattgtaaagctgctgagtaggtgggtacctgattttatgaatttctccacactggaggttgttactgctctacctcagagccgtgagtcatgggagtcagccacttctgccygccactgccctgttgatcaaggggtcatccccctgactcgctggtggacaaaaacaagtaacaacgtggaaaagtctggtaaactgtaacccaatgcaaacaccctaaaaccttataagtttttaagagggaaatcaaaatgagtccgttggattctcaggggagatccaggaatgcctgtaagggtttacaggaacatgttcttttcttgccaggtgcttgatactaaaacacacacacacacacacacacacacacacacacacacacacacttttttccccttcttgctgtgactgc

SEQ ID NO: 132387 - DNA, 601 bp, Human
ctaatgagctctctttttaaagtagctgatcctgtgctttctttcctgggttctatttgagcagtttagattagggctatgcaaatggaaaacaggatggaaagaatggtggggaaatacttttattcataaatttccctttgtttctacattgtaaagctgctgagtaggtgggtacctgattttatgaatttctccacactggaggttgttactgctctacctcagagccgtgagtcatgggagtcagccacttctgcctgccactgccctgttgatcaaggggtcatccccctgactygctggtggacaaaaacaagtaacaacgtggaaaagtctggtaaactgtaacccaatgcaaacaccctaaaaccttataagtttttaagagggaaatcaaaatgagtccgttggattctcaggggagatccaggaatgcctgtaagggtttacaggaacatgttcttttcttgccaggtgcttgatactaaaacacacacacacacacacacacacacacacacacacacacacacttttttccccttcttgctgtgactgcttcacagtgctttgtgtgtctcataggccatatacttga

SEQ ID NO: 132388 - DNA, 601 bp, Human
tgttacagtctacaaaatggaagcattaattgaaaaagggaatttaggatagtgcatcattttcctgctcttggagacatttcttggctgatctcatacttaagattttaaaaaaatcaacatgtacttaaaaaaaagaaaaaagcacttgtacacttcagatgtacttactattcattgaaaatttaaacttaagctaaatttaatatgtggcttcaaacataaagttgaccttaattttcacttttcatcttcaaaatataatagttgtgagagttacctatttctctaataatgaaaraagtaattttttttcagaaaataactggtctatgaaatcatgaagcatgttcctatcaatattgattcagaaattggtgatgttgtatagaaataaatacctttaaactaaaacagtactttaggcagcaaaaagaagggaatgcaagaatttattaaatattttgctgaaattagaatcaaacaatttgctaattatgcatttctgtacccgaatattttccatatggttaaaatcctagagagggcatatatagtcagcactccagtataatttactttgtatctggcaggggtgttg

SEQ ID NO: 132389 - DNA, 601 bp, Human
caaacaatttgctaattatgcatttctgtacccgaatattttccatatggttaaaatcctagagagggcatatatagtcagcactccagtataatttactttgtatctggcaggggtgttgccatgtaattagttgaagtgtaaactggtccagtccaaggtttttattgtgggcttgcaagtattgtgacatttacattgcaaattcctagtgtcatggatgaataaggagaggagacgtggcctttggtgtagaagtgcaaatagtgaataagagactatgttattgtatttgcctctrttcctttgcatctcacatacatcccaattccttgaaacccagcccttagtgaagaaggcatagctgggtctccatctggccacatgcagcagactcccttttgtgcttgattttcagatcctttcagcatctggtgttgagggctcttcccttgaggggttctctttttcttctgtggcacctttctcttctccttaagttatctgtctcctttatgggctttctggctgcctgtgaagtgttgttttcccaaggttttacctctggtcctatcgtattcccactccacatctccccgtg

SEQ ID NO: 132390 - DNA, 601 bp, Human
ctattcctttgcatctcacatacatcccaattccttgaaacccagcccttagtgaagaaggcatagctgggtctccatctggccacatgcagcagactcccttttgtgcttgattttcagatcctttcagcatctggtgttgagggctcttcccttgaggggttctctttttcttctgtggcacctttctcttctccttaagttatctgtctcctttatgggctttctggctgcctgtgaagtgttgttttcccaaggttttacctctggtcctatcgtattcccactccacatctccccrtgtgccttccatttaatgtgtcggatggcctcattcatcttatacattagtgacttctcacaacaccagcttcatatggaatcatctggagaacttttttgttgttgtttttgtttgtttgttttgagacagagactcgctctgttgccaggctggagtgcagtggcgctatctcagcccactgcaacctctacctcccaggttcaagcaattctcctgcctcggcctcccaaatagctgggactacaggcgcacaccactatgcccaactaatttttgtatttttagtagagacaggat

SEQ ID NO: 132391 - DNA, 601 bp, Human
tgtttgttttgagacagagactcgctctgttgccaggctggagtgcagtggcgctatctcagcccactgcaacctctacctcccaggttcaagcaattctcctgcctcggcctcccaaatagctgggactacaggcgcacaccactatgcccaactaatttttgtatttttagtagagacaggatttcaccatgttggccaggatggtctcgatctcttgaccttgtgatctgcccacctcggcctcccaaagtgatgggattacaggcatgagccactgcacctggctgagaactttttraaaacatattttcctcaaaaagctaaatctggaaagtaccatatgacccagaaattgcactcttaggtaggtatacacccaaaagaattaaaaacaggcactcaaacaaatacttgtatgtgcatgtccataatgttcatagcagcacggcccacagtagcctcaaattggaaaacaacccacatatgaatccatacggtggaatattattgagccataaaaaaaaataaagtagtgacatgtgctacaatgtggatgcagcttgaaaacaggctgaatgaaagaagccagtcacaaaag

SEQ ID NO: 132392 - DNA, 601 bp, Human
gcccaactaatttttgtatttttagtagagacaggatttcaccatgttggccaggatggtctcgatctcttgaccttgtgatctgcccacctcggcctcccaaagtgatgggattacaggcatgagccactgcacctggctgagaactttttaaaaacatattttcctcaaaaagctaaatctggaaagtaccatatgacccagaaattgcactcttaggtaggtatacacccaaaagaattaaaaacaggcactcaaacaaatacttgtatgtgcatgtccataatgttcatagcagcayggcccacagtagcctcaaattggaaaacaacccacatatgaatccatacggtggaatattattgagccataaaaaaaaataaagtagtgacatgtgctacaatgtggatgcagcttgaaaacaggctgaatgaaagaagccagtcacaaaagaccacatattatatgattccattcctatcatatactcagaataggcaaatccacagagccaggaagcaggctagtggttgccagcggttgggaggaggaagaatggccagtgactgctcagtgggcatgggatttccttttgaggatg

SEQ ID NO: 132393 - DNA, 601 bp, Human
cccaggcccttcctcagagcaataaaatcagaactctagaaattctacaaactccccgtggcacctctcttctccttagttacctgttgattctaaacagcagtcagggttgagaagacaacttctgccatctgcttgtccagcgtggcccctcacttcagctccagtttctgtacatccaaccacatctaggacttttttttttttttttgaggcagtcttgctctgtcacctagtctggagtgcagtgccatgaacacaaacacagctcactgcagccttgacctcctgggttcaagcratcttcctgttcagtctcccaaatagctgggactagcatgccactatgcctggctaatttttaaaatttttttatagagatggaggcttgctatgttgcccaggctgctctcaaactcctggcctcaagttatcctcctgcttcctcctcccaaagtgctgagattacaggcatgagccacagtgccagggccttttgacagcattagcaagcatggttttatatctaggggacctttagagagattaaaccatataagcacattattaaattgaggtcagacattaaaatctcttaatt

SEQ ID NO: 132394 - DNA, 601 bp, Human
taactgtaagagtgatttatattttttgtaaaaaattagaaaatacagacaaacaagaagaaagaaaatggcattcacaatccccccaactagggattagcactgttgacaattggttgtgaagtcttgatctccttctgtgaaaacacttttcattggacgaagggttacaccttttacaatatgcaaagttaaaggttatacacagtttctatgtcaaatttgttttttaaaagcataatggtgttctgttatatgaaaacacagcaattaatttattcctaattgatggatagtcagkttaacaatgttttttacatgaatagttgcaaagacacttgatgatgtccataaaacaataatggattcaaggataagcaacatagaaacttgcaaaagggcttgtagccttagactcagaaagtaagatgaattggcttagagtcagagagagatgactagtagcttagtccctgctgggacaaacatattctcctctgtttagtaagcatagtatggattccaagccccagtttggggtttgttagcctcactaagaaaggggagcagtttagaggttattttgtgaaagtatgtatat

SEQ ID NO: 132395 - DNA, 601 bp, Human
tgattacagcaattttatttggttctaaatggcttcattgttattttattaaggatgagagcgctcagatgtaatagttcttcagcaccatcttggaaaaaaaatttctcaaagcccaaagcttaaacactgtttttccacccacagatcttaccataatttctctagaataaaactagactgatgcagattttgtagtatattaaaaatagctcacgtgaatcattgtagaggccagaatatgtagagacttgagtattaatctaaagtaggaaaaggaaaccatttctaaataattatktacagcttaggaaaaaaaacaagctttttgaaattaaagctaattttgatgatagcacatttagaaatggagggcaattctcatcttaaatacctattgcagcaaataatttatatgaattactctataagatcaatttctaactgttagggatttctgacgttttgattcccctctaactaaaagttatatatcatcactatctgggtgttactatttcaggtgagaaattttttaaaaagtagcgtatcaactttgtttcttatgtcctggactaataaaacaatttggtggggagca

SEQ ID NO: 132396 - DNA, 601 bp, Human
tggataacatgttgagaatacttgccaaggggcatttaataatgaggattgatctataataatatgctgtgtaattgggaacacatctctttggagtttttttggcttataaaattattaccatatcattttgcttatatagtagacctacttttcctaatggttctgaaacctgatttacatggcacaagttcccctccactgagtaccttcacactagtgtttgtttgcagaagctcagatgcaaactgaacagtgggagtaatgaagccctttcctcttttggcagtagtctaagaaytatggtaatagggtctgtgtgatctcccatccatccgctctgcagctttcaacacatggggacccttgtgagacaccagaagagctcacagacacatgacttttcaagacttttcctgtgtttctttttttcctttcccctttttcatgaatgattacttcatcagtgcatgtcatttttgacaatactgcttgccaaatgaaacagggtgatacgaggtcacactgtggcctaaaattctgaagtagaagctcataatatttggcatctttcctactagaaaaacaaaccagaaaagaa

SEQ ID NO: 132397 - DNA, 601 bp, Human
atctctttggagtttttttggcttataaaattattaccatatcattttgcttatatagtagacctacttttcctaatggttctgaaacctgatttacatggcacaagttcccctccactgagtaccttcacactagtgtttgtttgcagaagctcagatgcaaactgaacagtgggagtaatgaagccctttcctcttttggcagtagtctaagaactatggtaatagggtctgtgtgatctcccatccatccgctctgcagctttcaacacatggggacccttgtgagacaccagaagasctcacagacacatgacttttcaagacttttcctgtgtttctttttttcctttcccctttttcatgaatgattacttcatcagtgcatgtcatttttgacaatactgcttgccaaatgaaacagggtgatacgaggtcacactgtggcctaaaattctgaagtagaagctcataatatttggcatctttcctactagaaaaacaaaccagaaaagaaaatcaagaacagagcttaattaaacatgtggaatatgtcatgaatatttatgtccccaagtcttgccttgtgatggtatttgta

SEQ ID NO: 132398 - DNA, 601 bp, Human
tgtgtcatgttaactttcatcaggaaaaaatttcacttctgacaacactgacacctttctgattgaaagtatgcaaaatagctcttacgttaattggtcccaaagaaaattatgttatccattttcctgtctatacatctgacactttccctcatctgtcacctcctgaattatcaatgctttcccttgcctgattttgacagccagtattctgcctatgactttaaaaaccataaaaaaaaaactccatcctgggagctttactgtcctccagtttgaataggaagccccaagattacartcagcaaggtgtagccacatctactactatgccacatctagactgcagtttctctattttaagcctctcccattgtttcttactcgttgaactttagagaggaaacaaatgacaaagaggaatgtttatacttttttaatatttagtcttatttagggtcacaagtaaattttgtcagcaggagctaggtcagactgacagagctaactaaagttgccaaattttgggagcctgtgcttggtttgagttttatgattggtgatgtctgcgccttatgaccattgtcatctgcagagcttt

SEQ ID NO: 132399 - DNA, 601 bp, Human
aatgacaaagaggaatgtttatacttttttaatatttagtcttatttagggtcacaagtaaattttgtcagcaggagctaggtcagactgacagagctaactaaagttgccaaattttgggagcctgtgcttggtttgagttttatgattggtgatgtctgcgccttatgaccattgtcatctgcagagctttgctgggtcagcagagtctgagagggtctgttgaatgatttggtttctgttgtttcttgttaaccagttaactgagctctgtgagagtcccagggctgaattgtcgccrgtggtttagtttctgacaggcctgtaagtgagagaggcagacagacagagagacagacagacaccccctccccaaccgtcccatcaaattcttgacacctgggtcatctgagcaaaacagagcatgcatttttttctcttactaagcaagtattcatagtggcgtcctttcaccacttggacacaccaatcattaaagaccaaagtaaatacaccaagttgaagataatcctttcacaaatatacaagtgccaagttaaaactgcctgtcaatcatttgtgcatttttccttactcttgt

SEQ ID NO: 132400 - DNA, 601 bp, Human
aagttgccaaattttgggagcctgtgcttggtttgagttttatgattggtgatgtctgcgccttatgaccattgtcatctgcagagctttgctgggtcagcagagtctgagagggtctgttgaatgatttggtttctgttgtttcttgttaaccagttaactgagctctgtgagagtcccagggctgaattgtcgccagtggtttagtttctgacaggcctgtaagtgagagaggcagacagacagagagacagacagacaccccctccccaaccgtcccatcaaattcttgacacctggrtcatctgagcaaaacagagcatgcatttttttctcttactaagcaagtattcatagtggcgtcctttcaccacttggacacaccaatcattaaagaccaaagtaaatacaccaagttgaagataatcctttcacaaatatacaagtgccaagttaaaactgcctgtcaatcatttgtgcatttttccttactcttgtctgttttaatggatgggtgtggtatgaagatattagagcttgagaaattaggattcctgtgttatcacaattattttgcctctttacagatgattgaacctta

SEQ ID NO: 132401 - DNA, 601 bp, Human
tttctgtggtcatatttgtgtttcctttatttgaaatctgctgccaagagtcttcaggataactcatcgctgggtgtcttgcatttctacatttctacttcagaatgtctcaagctcaagatttctttggtttagtttcacatgtgtttagataatgttgtggagaaggaggagacttttattttttttaatttttaattttaaagtatggatacgtactaattgtacatatttatgggataaatgtgatgttttgatacaggcatacaatatgtaatgatcagatcagggtaattggggygttatcacctcaagcatttatcttttcttgagtgttaggaacattccaactccgctgttttaattattttgaaatatacaataaattattgttaactataggtgtcctgttgtgctactgagcatcagatcttattccttttatcttactgtatgtttgtacccgttagccaacccctctgtatctcccatcctcaccactgttcccagcctctggtacccagcattctacttaggagaggacttttagacatcttataggtctccgtaagatctattttgtatttgatcctaatatttt

SEQ ID NO: 132402 - DNA, 601 bp, Human
cccagagtgctgggattacaggcgtgagctaccgcgcctggccagtcctgtaggtattaatgaacagtttcaggatttgaactctggagtccatgctgagagactattctaaagataatggtatggaattaaagtattttgagcagagtagcagagctagatcacaggctgggcatggtgactcatttctgtaatcccagcattttgggaggctgaggcgaaaaggttgtgtgaggccaggaattctaaaccagcctgggcaacacagtgagaccacatctctatatttaaaaaaaaaaawttttttttaaagcaaacagagccttaggagaaggcaacactatggaggtcaagttagagttcatatgcaaggtagaggcccgtgtaatacttcaatttagcacatgttagacttccactagggtcacaagtctctggcacatagtaggtgttagaaagaaaagttggactgaatttccagattctctggaatggactatgatccagatttatagtcatttaagagttagaatctgtaattcttagtgactgactgaatgtacttggggatggtgagatggggtagagatgaagcactgct

SEQ ID NO: 132403 - DNA, 601 bp, Human
ccagagtgctgggattacaggcgtgagctaccgcgcctggccagtcctgtaggtattaatgaacagtttcaggatttgaactctggagtccatgctgagagactattctaaagataatggtatggaattaaagtattttgagcagagtagcagagctagatcacaggctgggcatggtgactcatttctgtaatcccagcattttgggaggctgaggcgaaaaggttgtgtgaggccaggaattctaaaccagcctgggcaacacagtgagaccacatctctatatttaaaaaaaaaaaattttttttaaagcaaacagagccttaggagaaggcaacactatggaggtcaagttagagttcatatgcaaggtagaggcccgtgtaatacttcaatttagcacatgttagacttccactagggtcacaagtctctggcacatagtaggtgttagaaagaaaagttggactgaatttccagattctctggaatggactatgatccagatttatagtcatttaagagttagaatctgtaattcttagtgactgactgaatgtacttggggatggtgagatggggtagagatgaagcactgctg

SEQ ID NO: 132404 - DNA, 601 bp, Human
ctgaggcgaaaaggttgtgtgaggccaggaattctaaaccagcctgggcaacacagtgagaccacatctctatatttaaaaaaaaaaaattttttttaaagcaaacagagccttaggagaaggcaacactatggaggtcaagttagagttcatatgcaaggtagaggcccgtgtaatacttcaatttagcacatgttagacttccactagggtcacaagtctctggcacatagtaggtgttagaaagaaaagttggactgaatttccagattctctggaatggactatgatccagatttayagtcatttaagagttagaatctgtaattcttagtgactgactgaatgtacttggggatggtgagatggggtagagatgaagcactgctgtaagagagctcatgtcagagggggtcctggaggaggagttcatttccagcattgtgagatgtttagaattaccaccagctgctgggtgttcacttctggtgcaggtaggattctgccaagcccatattctcccagttacaggctatcaatctatctgaagctagaaaaaaaatgcctccttatttatttattttgtatctagcatttacag

SEQ ID NO: 132405 - DNA, 601 bp, Human
gaattctaaaccagcctgggcaacacagtgagaccacatctctatatttaaaaaaaaaaaattttttttaaagcaaacagagccttaggagaaggcaacactatggaggtcaagttagagttcatatgcaaggtagaggcccgtgtaatacttcaatttagcacatgttagacttccactagggtcacaagtctctggcacatagtaggtgttagaaagaaaagttggactgaatttccagattctctggaatggactatgatccagatttatagtcatttaagagttagaatctgtaatwcttagtgactgactgaatgtacttggggatggtgagatggggtagagatgaagcactgctgtaagagagctcatgtcagagggggtcctggaggaggagttcatttccagcattgtgagatgtttagaattaccaccagctgctgggtgttcacttctggtgcaggtaggattctgccaagcccatattctcccagttacaggctatcaatctatctgaagctagaaaaaaaatgcctccttatttatttattttgtatctagcatttacagaatgcccatttctggttagtcaccatag

SEQ ID NO: 132406 - DNA, 601 bp, Human
gttagtcaccatagtgtacagggctataggatgaaaaggagagagaaaccatgagtcaaggatacagtctcactcctgtatcaagttactttgcttcaaccagatgtatttattagactgctctttgacttttggcttaatgggtcaggggtgtccacagagttccccattagaaaggaattcttctacctatctctcagtctgcacagtaccatgagggtcttcatcttccaggtgtggaggtggcttatgtcagttagtgctgctgcccactagaaaccctggagcctggaagatgagscttgtaggaaatacctctttctaggtgcacactcaggactacgagaaatgttgaggaaggtgaaggattctcccataactcagtcctcctgggcaggtgactggcggggccagactttgagcatccttgctgaataataagcctgtttggtatgaaatccatgtgctactgatagcagggtaatcctgtggatttgctgaaaccataagggactagatgatacataaaaaggatatcagtgattccacgagtgtgtaacacgagacaaaagacataataaaagccaacctaatactaagc

SEQ ID NO: 132407 - DNA, 601 bp, Human
tgtatccaagttagcatgtactgagtgcagggtgctcttaagatctctgcttggacactagaaatagaaaaaaatatgtatgaagaagtttggataaatgcttcatttgaaagttatataccttagtatttgctttcccattctcatgccacttatgaagggtgaagttggcttcattgacagctaatactgttgaagtctattgtaaaatcagttcattaggttagtgtctattgagcaactactatgtgtatgtgttgtgttgggagtagtgcaagatgaggctggaggagaaaactgkggccgaatcacccaggtctgcaagtctcattggaacttggacttgctcctcagtgcaatgtgaaacctttgaaaaattttagcaaaggaatgatgtggtcagatttgtatttttaaaataacagctttattgaaatattagcataccatgtaattcacacatttgaagtatacaattcaatcaaattagtatactcatacagcagtataactatcactactacattccattttagaacatttcatcatccccaaaaagaaaccctgtaccaattagtcattcccaatgtctctccagttc

SEQ ID NO: 132408 - DNA, 601 bp, Human
ttgttgcttatggggtcatatctaagaagccattgtctaatctgagatcatgaagatttactcctatgttttcccttacaagttttatagcttggctcttacctgtagtctttcatctccttttagttagtttttgtatatgttacaagataaaggtccagtttcatgcttttgcacatggatattcagtttttccagcaccatttgttgaagagacagtcttttcctttttgagtggtcttggccagatgtatatttttaaaagatcactgtcagcagggtgtgaagggtttaaaggagkagcgatgagaatagaagtggggagatcaatttgaaaaatatttatgtagctcttattacgtgtaaaacattgttccaggcactggaactatgatcataaacaagtcagacatagccctggcctcatggagcttacattctggcactgaggatgagggatacaaacctaacaggaaagaggaaaaagaagcaaatgcagtgatgacaagttgtgagagaagaaacagtgatgtgcagtgtataagttataggactactgaatatataaagcatgaattgcttatttagttttttcctttaa

SEQ ID NO: 132409 - DNA, 601 bp, Human
ttattttgctgccattctattgtgtctagagaagtatccagggagagggttgtttgtttttacttgatgaggtgcagaagttgggactgtactgaaaaacagaatgctaaagagccagctccaatctaggaaacatcctccaagagcaccccctgagacagagtgtgaatcacagaaaggaaattagatttttttagccccaaataagaaagattaaaacaccagtaaattgttttacattgattttactaaggttagttagaagtaaaggcttacaaacacgtactgtttatttagtgayagatgaaacttagaggcgtttcttctgttgtaattggttggctctttgcattgattagaactaggtagacaagttggtacaaaaatggcaggagtggaagggaatgggcccctgttgatgtgtaagaacatacgcgtgcatgtggggacaccagtggcattttctgcatgtttcggggtttcagaagacttgccttgttctgcacctctaaattagacctactgtgaaaaacttacaggtcagtttctgggagtgcttttcttcctggactttcccaggtgagcacttagatcctgtgaa

SEQ ID NO: 132410 - DNA, 601 bp, Human
agagtgtgaatcacagaaaggaaattagatttttttagccccaaataagaaagattaaaacaccagtaaattgttttacattgattttactaaggttagttagaagtaaaggcttacaaacacgtactgtttatttagtgatagatgaaacttagaggcgtttcttctgttgtaattggttggctctttgcattgattagaactaggtagacaagttggtacaaaaatggcaggagtggaagggaatgggcccctgttgatgtgtaagaacatacgcgtgcatgtggggacaccagtggcrttttctgcatgtttcggggtttcagaagacttgccttgttctgcacctctaaattagacctactgtgaaaaacttacaggtcagtttctgggagtgcttttcttcctggactttcccaggtgagcacttagatcctgtgaatccatctccgtgtcggaaacttccgtgatccggctctatgctttaattttgaatgtcttgctatttcatttctttgaaaataaagcagttccacaacattacagccctgtgctgtctactcattctcctttggggattgcttgttttaattgattgatt

SEQ ID NO: 132411 - DNA, 601 bp, Human
aaaggaaattagatttttttagccccaaataagaaagattaaaacaccagtaaattgttttacattgattttactaaggttagttagaagtaaaggcttacaaacacgtactgtttatttagtgatagatgaaacttagaggcgtttcttctgttgtaattggttggctctttgcattgattagaactaggtagacaagttggtacaaaaatggcaggagtggaagggaatgggcccctgttgatgtgtaagaacatacgcgtgcatgtggggacaccagtggcattttctgcatgtttcrgggtttcagaagacttgccttgttctgcacctctaaattagacctactgtgaaaaacttacaggtcagtttctgggagtgcttttcttcctggactttcccaggtgagcacttagatcctgtgaatccatctccgtgtcggaaacttccgtgatccggctctatgctttaattttgaatgtcttgctatttcatttctttgaaaataaagcagttccacaacattacagccctgtgctgtctactcattctcctttggggattgcttgttttaattgattgattcacagaggagaaagaa

SEQ ID NO: 132412 - DNA, 601 bp, Human
attaagtgggtagagggatggtgtggtccagacatcagcttgctggcctgactggcaggcgagctgtgcccagagctggcatcgctgtggggcccccatggtggcccctgtagcccatgcttggaggcaatgtaaggatggggctctggtggggcctctggtggctcctgtgtcctgtgcttggagacagtggtatgaggacaggtttcctcatgtagcatcccctctgtgctggtgtctgggtcttgggggtcatcctggaggcacagctcagaggctattcttcaagtctctctcctgrttttataagctccgaattcttgtataaagttaccttctagttaaaatacccagcatgatttctgttatctgcacatgacctccgataaatgtatactttttcttttttttttttttttttgagaaggaatctcactctgtcgcccaggctggactgcagtggtgcaatctcggctcactgcaagctccacctcccaggttcatgccattctcctgcctcagcctgtagctgggactacaggtgcccaccaccatgccaggctaattttttatatttttagtagagacggggtttcaccgt

SEQ ID NO: 132413 - DNA, 601 bp, Human
tgttagttgtctattttgacttttgtctgtgtgtaccaaaaatgcatataacttataaaagccacaataaaataagtatttttttctaattccctggctaagacactcagtcttttcaagatccctgtgtacctaagatcatatcctcctttctatcccacaaaggtaactaattttattaattttatcattcacttgtgtttcttcatagtttctataatgaatcaaattgcttatttgctccataatcaagtacatgaaatttgaatggaattgtagtctattattttctgcattatgrgttattttgttcaaggttacttgagtttactccgtgttaattcctgtaggtggagtgtattcattctcactgctacataaagttccattgtatgaattttacctcaacttactttattattctcctggtgatagacatttggcttcttgccagatttcaagtgttacatatgatgtggctacaaaaatagtaaatgtcttgggcaaatttgtttttggacataatacttgggagtagaattgcttagtagtggggagtgggcatttttaacttcactaaataatgcaaacttatattctt

SEQ ID NO: 132414 - DNA, 601 bp, Human
tctcaccctctggggcactccctccacgtaacccccgagactgcagctggaatgagttttacttccatgacgagctgactttaggaaagggagattatctgagcaggcctgacctatcacatgagccgtttaaatctgggtggagagaacagagataggggaagccagggagatttcaaataggagtaggatttgatggaccgtggctggtttgaagatggaggagaatgcgtggccaggaagtaggtaacctctaggtgctgggagtggcccccaaatggcatccagcatgaaaatgggkccctcagtcctacagctctaaggaactgaattctgtcacagccatgtgagtttggaagaggatcttgagctccagatgagaacacagcctggctgataccttgattttacacttgggagaccctgagaagaaaaccagttataatttgtcatgcagcaatagaaaactaatgcattcatgtggcatctgggagggctctgtgcccatgatcaggaacttccagaaggtaattgggcataaatacccagcactccagagaaagattcagcctggggatggattcaccatcactgtcactaa

SEQ ID NO: 132415 - DNA, 601 bp, Human
agtttctcttaatcattttgccttttacttcctgtcctctgtgagcacgtgtctgtactgttaagtacaaatggacccagaggtttcaggcaaagcctgagtgaggcgctgcatgcctgtcttgcaggtcagggctaggaatggtgacagggctaggaattgaccattgctccattaaagtggaccaaagtggaatctgagtccttttcaggccctaggttcagtctgtgctgactctgaccctctgagatgactattcccaaacctgagggaccgaagatcagcatcaaggacaacagayaggggtgctggggtgcagatgtaagtgagctgggtcttctggagcgctggtcactgcatgctgtgggtataaaatggctgtctagtggaggcagccaggctgctgggaatgactccaggtagaccagacacatgattcttctgtgccttcaacccgatgctttcaagtggcgtgccttagctgtggacattctgaccctgccttgttgaatgctttttgtatttttgctcagagagagaaatcagagtgatttcttttttgtcttatagatcaatcttgtagcttttaaggcagctctcc

SEQ ID NO: 132416 - DNA, 601 bp, Human
ttcaagccagatatgcttaaatcctttcatttcctcaagtatgacaaagcactgggaatatactcccctttgtaatttcctaccgatttgccctagttatgaatggaacattaactctgcgaaatctacatatggaaaacgaccccagatgaaaatcttaaactggccatatccctaactctggagtccaagccctgtgctctggtcctggcactgtggctcaccaggtagtcacgtgaccctactcacctgtgcaaatgcccccacgcttctcagatcccaagctcaagggggcgttgargatcaggtcacccacaagttcccttcctgccctcagcttgcacgtggctcatctgtcaaggaaccacatactgtgtcagattttgttaaagcaaaaaccggtttttatagtctttataaaatgtaaaaacttggaataaatgtaacaatatctaaattcctggtgtgaatgaacagcagctgtagtgacaaagggaacaggtcttgaagtgaaacctgcctggcttggaattctgcctctgccacttaccagctttagtccttgttgaagaaattagctggaatcaggagttttctcatg

SEQ ID NO: 132417 - DNA, 601 bp, Human
ggggcgttgaggatcaggtcacccacaagttcccttcctgccctcagcttgcacgtggctcatctgtcaaggaaccacatactgtgtcagattttgttaaagcaaaaaccggtttttatagtctttataaaatgtaaaaacttggaataaatgtaacaatatctaaattcctggtgtgaatgaacagcagctgtagtgacaaagggaacaggtcttgaagtgaaacctgcctggcttggaattctgcctctgccacttaccagctttagtccttgttgaagaaattagctggaatcaggasttttctcatgggtgaagtgaggatacctcatggagaagtctatgcaaaagtaaggttctcagcacaatacccggctaataatattacctgcttagagagtgggggtaacagcaggtgcaatgtcatgtctgctgttttagctacaccaagctccatccacatcttgagttgatgccgtgaataaaggtcatattacttttcagtattactggggatatttgatccatgtgatgggcagataaaatgtctctgtcttagagaaaaaatggactttttaggtagccagcattgcaatgtact

SEQ ID NO: 132418 - DNA, 601 bp, Human
cctctctcctttcttgtgcaagatttcagtcagtttactgaattgcctttacatggctatgaccttgaattgcttctgttagttcccctgtgctcttccacattttttcattttaggactacaggctaagcatacttagttattaccttgtaatacacaatcaagataacctggccttggtttctgtgactgtatctcagcctccctgtcctctgtctcgcagagaactagggaaggatggaaagtgactaaaggtatggaatgcctgaggcatggccaggccaggtactgtggcacataytttcgtatgttgtctcatttaaccctgattcataccttttaggacaggtcatgatattcccatttaactgcgctttaaagaagttgaatgtccactgggtcacacttggagggtttaagatctggatttgggtctgagtccaaccacgatgtcatttatatggactgtgtcgcgacacgtgtgtctttttcctggtttggtgttgttattcccctggcaaggtgtgcatgaagtcggtcctgccctacacctgttggcttgttttgtttgacttgtgtttacactcctttttaagatgac

SEQ ID NO: 132419 - DNA, 601 bp, Human
tttaagatctggatttgggtctgagtccaaccacgatgtcatttatatggactgtgtcgcgacacgtgtgtctttttcctggtttggtgttgttattcccctggcaaggtgtgcatgaagtcggtcctgccctacacctgttggcttgttttgtttgacttgtgtttacactcctttttaagatgactttgttaaactgaaaaaaaaaagctgaaatgttgatcaggtagcagatttgcaggagacctaggtactcatcactctagcacttcctaaactgtagttaaagaaacattgttcrggatgctaagtgtaacgtgggggaaaaaaatagctctctgtgcaaataaatttgtataattgttaaatgtgattgctttccctctgagtctttaatctgataatgtgcattctgccagaagggaatgtagtatactgcacctccccagcttgtttttgttcacatctaacttaatttattagaaagcagcctggcgcagttgtgcatgcctgtaatcccaggactttggaggccgaggtgggcagattgcttgaacccaggagtttgagaccagcgtgaacaatatggtgtaaccccatc

SEQ ID NO: 132420 - DNA, 601 bp, Human
gatttgggtctgagtccaaccacgatgtcatttatatggactgtgtcgcgacacgtgtgtctttttcctggtttggtgttgttattcccctggcaaggtgtgcatgaagtcggtcctgccctacacctgttggcttgttttgtttgacttgtgtttacactcctttttaagatgactttgttaaactgaaaaaaaaaagctgaaatgttgatcaggtagcagatttgcaggagacctaggtactcatcactctagcacttcctaaactgtagttaaagaaacattgttcgggatgctaagkgtaacgtgggggaaaaaaatagctctctgtgcaaataaatttgtataattgttaaatgtgattgctttccctctgagtctttaatctgataatgtgcattctgccagaagggaatgtagtatactgcacctccccagcttgtttttgttcacatctaacttaatttattagaaagcagcctggcgcagttgtgcatgcctgtaatcccaggactttggaggccgaggtgggcagattgcttgaacccaggagtttgagaccagcgtgaacaatatggtgtaaccccatctctacaaaaaa

SEQ ID NO: 132421 - DNA, 601 bp, Human
aaaatagctctctgtgcaaataaatttgtataattgttaaatgtgattgctttccctctgagtctttaatctgataatgtgcattctgccagaagggaatgtagtatactgcacctccccagcttgtttttgttcacatctaacttaatttattagaaagcagcctggcgcagttgtgcatgcctgtaatcccaggactttggaggccgaggtgggcagattgcttgaacccaggagtttgagaccagcgtgaacaatatggtgtaaccccatctctacaaaaaatacaaaaaattaaccrggcatggtgccgtgtgcctgtggttccagctactctggaggctcagttgggaggattgcctgaactcaggtggttgaggctgcaagtgagccgtgatcatgccactgcactcccgcctgagtgacagagtgagaccctgtctcaacaacaacaacaacaaaattattagaaagcaaaagtctctttaagacaggtatgtcttcaactctatcaagttggcttttgttttgaagaacaaaagggaatcatggcttggcagtttcagctatgtgtggggactactttctattacactggtcc

SEQ ID NO: 132422 - DNA, 601 bp, Human
aatacaaaaaattaaccaggcatggtgccgtgtgcctgtggttccagctactctggaggctcagttgggaggattgcctgaactcaggtggttgaggctgcaagtgagccgtgatcatgccactgcactcccgcctgagtgacagagtgagaccctgtctcaacaacaacaacaacaaaattattagaaagcaaaagtctctttaagacaggtatgtcttcaactctatcaagttggcttttgttttgaagaacaaaagggaatcatggcttggcagtttcagctatgtgtggggactacyttctattacactggtcctgcttttacctctggtgtctaaaatgtaataaatatgtgaactagagctcatagggtagcttcaactctgcttagagtttatagcttcaagtggcatgatatctgtcacactcacaagtagtatccattgctgatttctctttgtggttgagcttctttattttattctatattcttactttataatttttcatgtataatagaccaaatgtgattgccataaagaaggccaaatgtagaatccatgcccagtttgcttattctggaaaagcttactatgtaa

SEQ ID NO: 132423 - DNA, 601 bp, Human
tcttagatttttattattgtttgattttttttaaggaaggaataggccaggcatgagtggctcacacctgtaatcctagcactttgggaggccaagacaggagaattacttgagaccaggagttggagaccagcctgggaaacaaagtgagacctgtctctacaaaaactcaaaaaattagccaggttggcggcacatacctgtggtcccagccgcacgagagactgagacaggaggatcacttgaacctgggttgttgaagctgtagtgagccatgttcctcccactacactccagccargtcgcaaaaaagaaggagaggggaggaaaagaaaagaaaggagaaagaaagagagagagagggaaagggaaaagaaaagagagagagagagagaaataaaagaaagaaagagaaagaaggaaggaaagaaagaaaagaccggaaggagagagaaagagagaaagagaaagaagaaagaaggaaagagagagagaggaaggaaggaaggaaggaagcgggaggaagaaaaagaaagaaagagagagagaaagaaagaaaagaccggaaggagagagaaagagagaaagggaaagaagaaag

SEQ ID NO: 132424 - DNA, 601 bp, Human
tttttttaaggaaggaataggccaggcatgagtggctcacacctgtaatcctagcactttgggaggccaagacaggagaattacttgagaccaggagttggagaccagcctgggaaacaaagtgagacctgtctctacaaaaactcaaaaaattagccaggttggcggcacatacctgtggtcccagccgcacgagagactgagacaggaggatcacttgaacctgggttgttgaagctgtagtgagccatgttcctcccactacactccagccaggtcgcaaaaaagaaggagaggggargaaaagaaaagaaaggagaaagaaagagagagagagggaaagggaaaagaaaagagagagagagagagaaataaaagaaagaaagagaaagaaggaaggaaagaaagaaaagaccggaaggagagagaaagagagaaagagaaagaagaaagaaggaaagagagagagaggaaggaaggaaggaaggaagcgggaggaagaaaaagaaagaaagagagagagaaagaaagaaaagaccggaaggagagagaaagagagaaagggaaagaagaaagaaggaaagagagagaggaaggaagg

SEQ ID NO: 132425 - DNA, 601 bp, Human
ctccggggtccctgaattgtgagttttccctcacagcctctccacattctctgtgctgttcacctcccacccactgctctgtcttccctgtgttagtgaaaaatcaagcttttccctccctagcccagagagctgagcttttccctgctttactactgtgtttaggaaaaggaggcagctttttcctaaaaagcagtgtttggaagttggaggcacgtatgatgctttctgggctgttatctccaatatccttgctagatgagcagcctcgcatgttgggaaagaatctgtaccagaattyggaatatggggcttgtggccacgtagcaatgaggtcactgaccagctacaatccctggagcaaaccattcacactgcagtcctctgtttcctgctggtgatattcgaggtagtggccatgtgagctccaagctatgatttgttgttgttctgaaattctatgtattatttaaattataatacctcagataaataaatgaaacatctcctgaatttattcttaatatgtaattcatggccaagaatattaactgatgaagtgaatcatttaaagaaggactttgtaatttttctgtgggat

SEQ ID NO: 132426 - DNA, 601 bp, Human
attataatacctcagataaataaatgaaacatctcctgaatttattcttaatatgtaattcatggccaagaatattaactgatgaagtgaatcatttaaagaaggactttgtaatttttctgtgggattgtatttcaccagaagtgcttcagttccgttgagtcctgtgtgatgtacttcagcttgtctgtgagctgagctggtctaacacgctaagtgataacagaatggattctgtgttttatgagtcagtcagccagatctcaaagggataacaattaggaaaaatatatataatttwtcccagtaaaagaactagcctattgctgaaaaaaagttgtaccctgtattattgctttttttttgtcccacaggtgtgaataaacctggaaagcataaacatttggaagttattgaaatttattgaaaatatagtacaaaactcccacccttcctttgtttccacccaaaatgtagaattattatagttggctgcagtttttcttatatctcagtggtgtaattttcccacaagtaagaaaactgaatgggtagtatctaagaataagaagctattaaatagcaattttacatgccttta

SEQ ID NO: 132427 - DNA, 601 bp, Human
atatctcagtggtgtaattttcccacaagtaagaaaactgaatgggtagtatctaagaataagaagctattaaatagcaattttacatgcctttatgatgaaatactacagaagatgggaactgtgtgtcgtgaagtcatggaagtcttcaatgactaataaggaaataatctggctgacagcaggtgttctgattaacagagaagttatttcatagcataataaagaatggcatgaagaattatattgtcaaaaaaacctagccagatttttttgagcaaagaggggtatttccaccccygactgcccactgtaagaataagagacgcttattgtaggattgggaaacagtgaaggaaatagaaaccgctaatggtatcactctcctaaggggactactgttatttcctcttaggcactttgtgttcgcatatacatacacaggcatgcccatacctgtgtgtgcatgcgtgcttcatttttcatggtgtgctctgtgtacattttttgcaaggtccaataggccataaatgacaaaaagatactgggaacctgtcattagcactctaaagttgtattctttccaccaggaacctttgcc

SEQ ID NO: 132428 - DNA, 601 bp, Human
ggtagtatctaagaataagaagctattaaatagcaattttacatgcctttatgatgaaatactacagaagatgggaactgtgtgtcgtgaagtcatggaagtcttcaatgactaataaggaaataatctggctgacagcaggtgttctgattaacagagaagttatttcatagcataataaagaatggcatgaagaattatattgtcaaaaaaacctagccagatttttttgagcaaagaggggtatttccacccctgactgcccactgtaagaataagagacgcttattgtaggattggraaacagtgaaggaaatagaaaccgctaatggtatcactctcctaaggggactactgttatttcctcttaggcactttgtgttcgcatatacatacacaggcatgcccatacctgtgtgtgcatgcgtgcttcatttttcatggtgtgctctgtgtacattttttgcaaggtccaataggccataaatgacaaaaagatactgggaacctgtcattagcactctaaagttgtattctttccaccaggaacctttgccttttaattttagtcatttataatttattctgctcttcatgcttt

SEQ ID NO: 132429 - DNA, 601 bp, Human
aaaaacctagccagatttttttgagcaaagaggggtatttccacccctgactgcccactgtaagaataagagacgcttattgtaggattgggaaacagtgaaggaaatagaaaccgctaatggtatcactctcctaaggggactactgttatttcctcttaggcactttgtgttcgcatatacatacacaggcatgcccatacctgtgtgtgcatgcgtgcttcatttttcatggtgtgctctgtgtacattttttgcaaggtccaataggccataaatgacaaaaagatactgggaacccgtcattagcactctaaagttgtattctttccaccaggaacctttgccttttaattttagtcatttataatttattctgctcttcatgctttgtcggccctctcacatactggattttaatagtttttccaaagcaggtggtatacagaagttgaaaacattgtatcacttaatctattttatacatgggcccatattaaaaagcaaaaaagtcattcatggtctcaggaagtatcttgagaattcatcagttccatctcctttcctcaaatacaactgctcagatcctctgaaactaagg

SEQ ID NO: 132430 - DNA, 601 bp, Human
tttcatggtgtgctctgtgtacattttttgcaaggtccaataggccataaatgacaaaaagatactgggaacctgtcattagcactctaaagttgtattctttccaccaggaacctttgccttttaattttagtcatttataatttattctgctcttcatgctttgtcggccctctcacatactggattttaatagtttttccaaagcaggtggtatacagaagttgaaaacattgtatcacttaatctattttatacatgggcccatattaaaaagcaaaaaagtcattcatggtctcargaagtatcttgagaattcatcagttccatctcctttcctcaaatacaactgctcagatcctctgaaactaaggacctcctgaacacaaaattataaaccacaaatagtgtttaacaccctttgatgtcagcaccttttttcttctgcctaacttcagtaccttatggcacagcttaaccccatttccttttgatttttgttcgttggcgatgaggaacagctggttacctcttttgtaaaaatgaccttttcccaatatacaaacaagatcaaattaccctttaactttctcttcatgtt

SEQ ID NO: 132431 - DNA, 601 bp, Human
tagcctaggagcaataggctgtaccatatagcctaggtgtgtagtaggttataccatctgggtttgtgtaagtgcattctatgacgtttgcacaatgacagatttctcagattgcatccccttcattatgtgatgcgtgactacattccaagggtgaaaagatggccgctcaagaaaaggctggagaggcagtgggttaagataaggaaaaatttagaaagtaggaggaagattgaacttactttgtcacaaatttatgtggtcacagaaggcactactgcaatgaaccctgtgttcctgrgtaggaatcatgtattaactgaacgcgacatgaggttgaaatgattatttgtaaactgttgactgtcagacgtttcagaggggcctgtgaggtatagaggttggcatgattcgttggagacataaatacaagtgtgactttggacacaagtctgaatgaagggtcagtgtaacttttctgtaaaggatcatttcataaatattttaggctttgtggtctctctgcatctgaattctgctattgctgcacagaagttcccatggacagtacatgaatgaatgaatgtggctctgttccaat

SEQ ID NO: 132432 - DNA, 601 bp, Human
agcctaggtgtgtagtaggttataccatctgggtttgtgtaagtgcattctatgacgtttgcacaatgacagatttctcagattgcatccccttcattatgtgatgcgtgactacattccaagggtgaaaagatggccgctcaagaaaaggctggagaggcagtgggttaagataaggaaaaatttagaaagtaggaggaagattgaacttactttgtcacaaatttatgtggtcacagaaggcactactgcaatgaaccctgtgttcctgggtaggaatcatgtattaactgaacgcgayatgaggttgaaatgattatttgtaaactgttgactgtcagacgtttcagaggggcctgtgaggtatagaggttggcatgattcgttggagacataaatacaagtgtgactttggacacaagtctgaatgaagggtcagtgtaacttttctgtaaaggatcatttcataaatattttaggctttgtggtctctctgcatctgaattctgctattgctgcacagaagttcccatggacagtacatgaatgaatgaatgtggctctgttccaataaaactttatttaaagaaatggacggtgg

SEQ ID NO: 132433 - DNA, 601 bp, Human
gtgatgcgtgactacattccaagggtgaaaagatggccgctcaagaaaaggctggagaggcagtgggttaagataaggaaaaatttagaaagtaggaggaagattgaacttactttgtcacaaatttatgtggtcacagaaggcactactgcaatgaaccctgtgttcctgggtaggaatcatgtattaactgaacgcgacatgaggttgaaatgattatttgtaaactgttgactgtcagacgtttcagaggggcctgtgaggtatagaggttggcatgattcgttggagacataaatasaagtgtgactttggacacaagtctgaatgaagggtcagtgtaacttttctgtaaaggatcatttcataaatattttaggctttgtggtctctctgcatctgaattctgctattgctgcacagaagttcccatggacagtacatgaatgaatgaatgtggctctgttccaataaaactttatttaaagaaatggacggtgggctggatttgacccggggcaatagttttttgatccctggtctagatgattatcaacaggcgggctctagttgatcatgggagtgtgtgagggggtgtcct

SEQ ID NO: 132434 - DNA, 601 bp, Human
tctgcatctgaattctgctattgctgcacagaagttcccatggacagtacatgaatgaatgaatgtggctctgttccaataaaactttatttaaagaaatggacggtgggctggatttgacccggggcaatagttttttgatccctggtctagatgattatcaacaggcgggctctagttgatcatgggagtgtgtgagggggtgtcctgtgtgaatatgtccagacaggcaccccagggaatataaccagcgattgtagagtacaacaaaccagcaaagaaaaatgagataactatcgaytggggaaagactaaagtgggagagttttcagtgttagggagggtgcatgtgttgaagtcaactgtcacagacataacctgagtgcagagatgataacccacagtgcttgtgggatttgtgtgttaggaggggagttttagtggagggtggggcagaaggaattttaagagtgaacaagaggcaagaagtgaagacaggagttctaggccgtgtttcctgtgtgttgtcccattcagagatcataactctgcaagggaagaaggcagctatatttacttcacttttaaatatgaggaaacg

SEQ ID NO: 132435 - DNA, 601 bp, Human
gatccccagttgagttcacaggtaaaagccacccttatagaagaatccaaaacagactctgtttttgcaaattatcgctttcttttctgtgtgtgtgagacagggtcacactctatcacccaggctggagtgcagtggcacgatcatggctcactggagccttgacctccaggctcaagcagtcctcctacctcagccttcggagtagctgggaccacaggcaaatgccaccacgcctggcttttttatttttattttattattttattttatgtttttgagacggagtctcactctgtckcccaggctggagtgcagtagcgcgatctcagttcactgcaagctccacctcccaggttcatgccattcttctgcctcagcctcccgagtagctgggacttcaggcgcctggccaccatgcctgactaatttttttgtatttttagcagagacggggtttcaccgtgttagccaggatggtctcgatctcctgacctcgtgatccgcccctctcggcctcccaaagtgctgggattacaggcgtgagccaccacacccagccaaactatcactttcagttacagagatcagacaacatttt

SEQ ID NO: 132436 - DNA, 601 bp, Human
ataaattcaacttgtcttggagaagagccacacagatggaaaatagtggaaagacagttaaaaaaaaaagcttaacataaatggcaaggtaaccacttgtagctttatgttatgaggattggtatgatgtatcctattttatttaaagaggaataaacttaaacttcatgttgatgaagttggcagatgatcctgaatcaggggagatatcaaaaatctggaaggacagaaatattataatctccttcaggagattaaaagtataggcaggaaataacaaaatgagatacagcttggaaartgcacactaatgcggctgggaaaaaataatgtaaaatgcagaacctaagtgaacagaagaaatgtgcaccaaaatgccaaaggcaagcaatatttggatgtatacattgcacaacagtccaccacagtgggctgaccattaggggccacctacattgctcatcctcaatagagaaagagggctgggcgcagtggctcacgcctgtaatcccagcactttgggaggccgagacgggcggatcacaaggtcaggagatcgagaccatcctggctaacacggtgaaaccccatctctattcca

SEQ ID NO: 132437 - DNA, 601 bp, Human
attggttgagttgcttaaattggttggagcttaaaggatgttcagctgataggagttcctagcatgtaaatgaatattaaggtctgactgggttagtgtgtcagctaatttgaagtgttgatgagtgataggaaatttcacataattatgttgtagagacctttagcgtgttatctcaaaaggctgaaaaatgtgagaacctcagacaacttggtgagccaatggaagccaatcatttaaacaggcgtctttagataagactctgcttattcaactttcttaaatatggctacggtattayagataaagctatgtgagtaaccagacatttaaaaacacatattgtttttaagaactatataagaaaataagtatttttcagaaagtgtatgagttctcaaatttagttttatcggaaaaatctttgtttgagaaaattaatttaaaaatcatcaccaattctcaaaaatcatggaaattttgatgagcactggatataagtcctgcattctaaggaagctaagttggaagtcagattgttgcctcatttcttaagacatcgggactgatgatctccctggatagtaattagctgttaatg

SEQ ID NO: 132438 - DNA, 601 bp, Human
taaagtcattaactatcttatattgtgggtctggtttagtaatttttacaaactaacatcttccagtgtgtgccttgatcttgtaggagggaagatattgaaattcagcgtgaattttctttggcaattgcccgattctttttcatttttctgtttataaaccaatttgagtgcagtggattttacttacttaatcctgaaactgtatgcagcatatcttttcttctttggcggctgcttcactgctgttgaaatcagctctcatgcctgcacatggcatctggctcactcaccacccccycgtgtgtatgtgcgcccttctctgtgagccggtggctcagctgcccacaaatgcaagtctgtgggtcagagatggtactgagaagtggaaaactgtgcgtgtgtttgcacatttcatttagactgtacttcccttagtcctttcaaaagaactaaagcggggggaggggagaacttaatttttatacagattgttctgtattttcacaatgagatcatttcagttacatcagtgataaaaataattaggaagtaatagtgggctgataattagattgggagcaacaagatggtgttattg

SEQ ID NO: 132439 - DNA, 601 bp, Human
tatattgtgggtctggtttagtaatttttacaaactaacatcttccagtgtgtgccttgatcttgtaggagggaagatattgaaattcagcgtgaattttctttggcaattgcccgattctttttcatttttctgtttataaaccaatttgagtgcagtggattttacttacttaatcctgaaactgtatgcagcatatcttttcttctttggcggctgcttcactgctgttgaaatcagctctcatgcctgcacatggcatctggctcactcaccacccccccgtgtgtatgtgcgcccytctctgtgagccggtggctcagctgcccacaaatgcaagtctgtgggtcagagatggtactgagaagtggaaaactgtgcgtgtgtttgcacatttcatttagactgtacttcccttagtcctttcaaaagaactaaagcggggggaggggagaacttaatttttatacagattgttctgtattttcacaatgagatcatttcagttacatcagtgataaaaataattaggaagtaatagtgggctgataattagattgggagcaacaagatggtgttattgatcctagcccagctgtgt

SEQ ID NO: 132440 - DNA, 601 bp, Human
ctttggcggctgcttcactgctgttgaaatcagctctcatgcctgcacatggcatctggctcactcaccacccccccgtgtgtatgtgcgcccttctctgtgagccggtggctcagctgcccacaaatgcaagtctgtgggtcagagatggtactgagaagtggaaaactgtgcgtgtgtttgcacatttcatttagactgtacttcccttagtcctttcaaaagaactaaagcggggggaggggagaacttaatttttatacagattgttctgtattttcacaatgagatcatttcagtyacatcagtgataaaaataattaggaagtaatagtgggctgataattagattgggagcaacaagatggtgttattgatcctagcccagctgtgtccttattatgagatgttggttagaattctcaatagccactggggtgataggaacctgcctcagacagtgtttgtaataaaaacttgctacaaggcatgttgtgaaattaaaatgcattcatctagagagaaatcctggagtttcttatcgttgctaattagaaacaggttgtattttcagaggaaaggaccttaaatgtattttccg

SEQ ID NO: 132441 - DNA, 601 bp, Human
cctcaagtgatccacccgcctcggcctcccaaagtgctgggattacaggtgtgagccactgcttggggcctggcttttctgactcggcttaggaatttggaggatgtggctgggatgctcatggcatagaactcagcttgctccttgttttcctgaagctgacatgacaagccccatgcgttatgccgtgagcgtttgatgtcaatgggaagtggcgtgctcagtgacaggagccagcctagactgtaaagtcaacttacaatgaacttatctttatttatgtcctgttttggttccaacractggacatggacatttgatttggcatcattttcagtattatctcatgaggactcttggaatatttcatttgcttggtctacatctatctaggctctggactatgtatccactctatgatcaaacttggaattttcctgatgcctggggatgggctggagtgtttacaagtggagtaaatatgaattcagccaagatataattgatacaaagagagggtagtatttaaggattgagatgacacttgtatgaatgaaataaaggccaggattggtttctagtgccaatagaactttgattg

SEQ ID NO: 132442 - DNA, 601 bp, Human
gctcatggcatagaactcagcttgctccttgttttcctgaagctgacatgacaagccccatgcgttatgccgtgagcgtttgatgtcaatgggaagtggcgtgctcagtgacaggagccagcctagactgtaaagtcaacttacaatgaacttatctttatttatgtcctgttttggttccaacgactggacatggacatttgatttggcatcattttcagtattatctcatgaggactcttggaatatttcatttgcttggtctacatctatctaggctctggactatgtatccactctrtgatcaaacttggaattttcctgatgcctggggatgggctggagtgtttacaagtggagtaaatatgaattcagccaagatataattgatacaaagagagggtagtatttaaggattgagatgacacttgtatgaatgaaataaaggccaggattggtttctagtgccaatagaactttgattgcttattctttaagtaagattacttttaagcaagcaaacaaaaaccacctgagttttttgaatcatcctctagttcagtttcttaggaatgcagtgccaaaaatggtattttagtaa

SEQ ID NO: 132443 - DNA, 601 bp, Human
tgtcctgttttggttccaacgactggacatggacatttgatttggcatcattttcagtattatctcatgaggactcttggaatatttcatttgcttggtctacatctatctaggctctggactatgtatccactctatgatcaaacttggaattttcctgatgcctggggatgggctggagtgtttacaagtggagtaaatatgaattcagccaagatataattgatacaaagagagggtagtatttaaggattgagatgacacttgtatgaatgaaataaaggccaggattggtttctartgccaatagaactttgattgcttattctttaagtaagattacttttaagcaagcaaacaaaaaccacctgagttttttgaatcatcctctagttcagtttcttaggaatgcagtgccaaaaatggtattttagtaaaagagaaactgtgtcaggatacatcactctgaatgtgacagcatgctaggcaggaggctgactacatcctatcatgttgatggtttatattgttttcaccacactccagatgcctggagctgtgggctgacttctcgttgatctgcagtgagcctctgtaaaaa

SEQ ID NO: 132444 - DNA, 601 bp, Human
aattttcctgatgcctggggatgggctggagtgtttacaagtggagtaaatatgaattcagccaagatataattgatacaaagagagggtagtatttaaggattgagatgacacttgtatgaatgaaataaaggccaggattggtttctagtgccaatagaactttgattgcttattctttaagtaagattacttttaagcaagcaaacaaaaaccacctgagttttttgaatcatcctctagttcagtttcttaggaatgcagtgccaaaaatggtattttagtaaaagagaaactgtgycaggatacatcactctgaatgtgacagcatgctaggcaggaggctgactacatcctatcatgttgatggtttatattgttttcaccacactccagatgcctggagctgtgggctgacttctcgttgatctgcagtgagcctctgtaaaaatgttctttaatacccaagagataccctgttgcaaataatacttttcagaaaagtctttaaaattcaggtaaaggcaattcattcatatgagttgtttctccagctgaaattggcattctcaatgatgttctcaatgaactgatgataaag

SEQ ID NO: 132445 - DNA, 601 bp, Human
cttattctttaagtaagattacttttaagcaagcaaacaaaaaccacctgagttttttgaatcatcctctagttcagtttcttaggaatgcagtgccaaaaatggtattttagtaaaagagaaactgtgtcaggatacatcactctgaatgtgacagcatgctaggcaggaggctgactacatcctatcatgttgatggtttatattgttttcaccacactccagatgcctggagctgtgggctgacttctcgttgatctgcagtgagcctctgtaaaaatgttctttaatacccaagagrtaccctgttgcaaataatacttttcagaaaagtctttaaaattcaggtaaaggcaattcattcatatgagttgtttctccagctgaaattggcattctcaatgatgttctcaatgaactgatgataaagccaactcaagacctcccacccccaaaaaactcccaaacgcccaaaactgtcgtgaaaagaaggaagtcttgttcatggctctcaggatgtctgtaggaatttgcacactgacatgaacttaaagcaggacagatggatggcaagggctgtgcatctcattggatatttaac

SEQ ID NO: 132446 - DNA, 601 bp, Human
cagcatgctaggcaggaggctgactacatcctatcatgttgatggtttatattgttttcaccacactccagatgcctggagctgtgggctgacttctcgttgatctgcagtgagcctctgtaaaaatgttctttaatacccaagagataccctgttgcaaataatacttttcagaaaagtctttaaaattcaggtaaaggcaattcattcatatgagttgtttctccagctgaaattggcattctcaatgatgttctcaatgaactgatgataaagccaactcaagacctcccacccccaraaaactcccaaacgcccaaaactgtcgtgaaaagaaggaagtcttgttcatggctctcaggatgtctgtaggaatttgcacactgacatgaacttaaagcaggacagatggatggcaagggctgtgcatctcattggatatttaacttgggaaatgagaacagtgagtctagcacgtaggcaaataaagttctgcagaatgaagctgattaaagaatttgaatttgaacctggaaggacttctatggtcctttctatgtatgtaatggtgtttttgtaggtaaatatttgaggttactct

SEQ ID NO: 132447 - DNA, 601 bp, Human
ataaagccaactcaagacctcccacccccaaaaaactcccaaacgcccaaaactgtcgtgaaaagaaggaagtcttgttcatggctctcaggatgtctgtaggaatttgcacactgacatgaacttaaagcaggacagatggatggcaagggctgtgcatctcattggatatttaacttgggaaatgagaacagtgagtctagcacgtaggcaaataaagttctgcagaatgaagctgattaaagaatttgaatttgaacctggaaggacttctatggtcctttctatgtatgtaatggtrtttttgtaggtaaatatttgaggttactctgtatagtaggttcaaatgtttgtgaaattgccttagagttagaaaacaattaacccaggttgagtctattatgtttcctgctcatttgtgggaaagctggtgatcccacactgaaaggaaactggaccagcaccttctcttccctggacggacgttattcatgccccagcagcaataacaatgcctcgtctcaagagctaaaaatctgttgattccagctgaagtgtttagagaaaagtgcattgaagactgaaccatataaacaggtca

SEQ ID NO: 132448 - DNA, 601 bp, Human
gactgaaccatataaacaggtcagagtgaaagccaatttttataaccagagtcaaaatcagtgtggaataattcataggtcattcttaattttatgttaaacattgtgctagattatctccatctttttggcccgtgctttcaaaatatccccatgatcaaagcttcttagataggatatgtttccctccattgtggggaaacacagagcctatggtcgttctgtcctgcgagcctctgcttcctctgcaaagtgagagctccttttccttgtgtttcctgacctcatccaagggtttttwaattattttctaagggagggtgtcactgtctttggaaagatctaaaatagcaaatttttgttttcctgtatacatataagaaaactggaaggagggatcagtagaaacttaggtctaccttagctacaattcatttatttattcagtagcaataatagaggattcgtgcctgttagagccatagcgcttgagcaggcaaacaggcctcatctgccgtgctccttgggctctcatcttcataaggaggacagtattgtgggaaggttagtagcgaagtcagttttcagtgtcgcatttcca

SEQ ID NO: 132449 - DNA, 601 bp, Human
tcgttctgtcctgcgagcctctgcttcctctgcaaagtgagagctccttttccttgtgtttcctgacctcatccaagggtttttaaattattttctaagggagggtgtcactgtctttggaaagatctaaaatagcaaatttttgttttcctgtatacatataagaaaactggaaggagggatcagtagaaacttaggtctaccttagctacaattcatttatttattcagtagcaataatagaggattcgtgcctgttagagccatagcgcttgagcaggcaaacaggcctcatctgccrtgctccttgggctctcatcttcataaggaggacagtattgtgggaaggttagtagcgaagtcagttttcagtgtcgcatttccaaatttttgtggtctttccacataagagtttgaaaatataaagggcttcaattcgaactgtttggcagatgtagcaaaaggtatcctgtgggtccttttattcatgtttgtttcatgtcttccacatacctgataactcttacagaacagtacgtgctggagtggaggaggtaagctcagtcatggaggaggggttagacacgtggaggtgtgctta

SEQ ID NO: 132450 - DNA, 601 bp, Human
tcctgacctcatccaagggtttttaaattattttctaagggagggtgtcactgtctttggaaagatctaaaatagcaaatttttgttttcctgtatacatataagaaaactggaaggagggatcagtagaaacttaggtctaccttagctacaattcatttatttattcagtagcaataatagaggattcgtgcctgttagagccatagcgcttgagcaggcaaacaggcctcatctgccgtgctccttgggctctcatcttcataaggaggacagtattgtgggaaggttagtagcgaaktcagttttcagtgtcgcatttccaaatttttgtggtctttccacataagagtttgaaaatataaagggcttcaattcgaactgtttggcagatgtagcaaaaggtatcctgtgggtccttttattcatgtttgtttcatgtcttccacatacctgataactcttacagaacagtacgtgctggagtggaggaggtaagctcagtcatggaggaggggttagacacgtggaggtgtgcttaagtagaccaaaagctctgcaaggggtttagcatcgcctggggatacaatgcgtggggagg

SEQ ID NO: 132451 - DNA, 601 bp, Human
agcgatcttcctgcctcagcctcctgagtagctgggactacaggcgtgattgccatgactggctaattttaaaattttctgtagagacaaggtctcgctatgttgcccaggctggtcttgaacttttgggctcaagcagtcctcccacctaagcccaggagtttggcctcccaaagtgctgggattaagcctggcctgaattgtatttacactgcttttaataacttatttgctttttctttacaaaagtaatctatgttaataatataagcagaaataataaaatgaaggaataatacasccaaatcagagataaccactttctaaatcattttctcctgaagttttatcactgcatgtatatgtatgtatacatctagtatgtgtctaaaattggatgctactgttacgtgtactgttgtaatttgctttcttcattcaacaataggtagtgagggccaggcacagtggctcaggctcatgcctataatcccagcactttggggggccaaggcaagagagtaccaatgggcatatatattggtgcagtcctacgtaaaggcaatctgaatacaaattttacatgtgcataacttctgaa

SEQ ID NO: 132452 - DNA, 601 bp, Human
tgtatgtatacatctagtatgtgtctaaaattggatgctactgttacgtgtactgttgtaatttgctttcttcattcaacaataggtagtgagggccaggcacagtggctcaggctcatgcctataatcccagcactttggggggccaaggcaagagagtaccaatgggcatatatattggtgcagtcctacgtaaaggcaatctgaatacaaattttacatgtgcataacttctgaataggcagcttggctatttatcctaagaaatttatcctaagaggccaggcgcagtggctcacgyctgtaatcccaacactttgggaggctgaggcaggtggatcacttggggtcaggagttcaagaccagcctggccaatgtggtgaaaccccatctctactacaaatacaaaaattagccaggagtggtggcatacccctgtagtcctagctacttgggggactgaggcaggagaatcgcttgaacccgggaaaaggttgcagtgagccgagatcatactcttgcactccagccggggcgacagagtgagactctaaaaaaaaagaaagaaatttatcttaagaaagtaaatggataaataga

SEQ ID NO: 132453 - DNA, 601 bp, Human
gtgctaacacttacagggtgtggttccacagctgccctttggctcgacccacaatcctttatacagccatttctagcttatttccagcccccagctcagtgctgactcatgtgaatgttggccagacgctctggcttgtgtggttattggcttcctctccctttgttgcatacagtcctctgtttgcctttctacagagtacagcaatgcatagctgcaaatttgagaatctcattctagtgcggtaggtcagtccacaaatactctctgagtgccagctccatgccagctattgagatgracaccaccaggactatgctgggaaaacagcaaacatggtgctggtattgcagggagatcacagagggaaaattatcctcaacctggagggatggcttcttagctcaatgatgtcctttcccagcttctctcttggagatattttgtctttggaactggcagccacatgacagccatgtgttgctccctgattgtggaagggtctcagtatcctgagtgcttggggtgcacccaaaagacaaacaccacttatgtcaaaacgcaggccccagagttaaggaaaagtctgtttctatcacta

SEQ ID NO: 132454 - DNA, 601 bp, Human
cttgcacttagcatggtgtctgtgtgacttagtcaatgagccgttaggcactgcagataccgtttgttcagtcaagatggatagccctgccttatcactgcgtaacgccttggaggccataggctatctctgcacatctcccttaattgcctggtgtatttatgtgggttgactagtttgttgccatctgcatagctgggttgtttaatatatttttctttgttctgctaatgacctgagcttcattacatgctgataaagaatcctaaaatgtacatagaaaactgacgaagaacgaactggccctggccctgaacagaacaggcatgccactatgccggctgcccagactcagcatttgtcgttacaggaaggaatggctttctgtttgcattttaggaaaacttcaccttttaaacatttcaaatggaaaaaaaagtatgcgatttttttttttgaggttttactgatatgagctacaaatagcttcttggaagccagtcagaactctcttttcaataatgttgaaacattttcctttgactggaaattaataccttcaatttagaagaactctagttagaagtttatagcacaaata

SEQ ID NO: 132455 - DNA, 601 bp, Human
ttgcctggtgtatttatgtgggttgactagtttgttgccatctgcatagctgggttgtttaatatatttttctttgttctgctaatgacctgagcttcattacatgctgataaagaatcctaaaatgtacatagaaaactgacgaagaacgaactggccctggccctgaacagaacaggcatgccactatgccggctgcccagactcagcatttgtcgttacaggaaggaatggctttctgtttgcattttaggaaaacttcaccttttaaacatttcaaatggaaaaaaaagtatgcgatttttttttttgaggttttactgatatgagctacaaatagcttcttggaagccagtcagaactctcttttcaataatgttgaaacattttcctttgactggaaattaataccttcaatttagaagaactctagttagaagtttatagcacaaatatagccccatgtaactaagggaatcttggagaattttctgatgtcaaaaaacagagcggtgttagctcattttaaaaaattgttctagtcaaatataaagcaaaaaatcccatttttaatttaatttttataatatttaagaatcat

SEQ ID NO: 132456 - DNA, 601 bp, Human
cagcactagctctcagcctggatggtgtcctcacagaggcagggggatggtgctccaggatagcatgcagcagcagctcctactccaggtgtagcagccaggataggttttttcacctttcatccatctttatcatttattcagttttcatggttatcttgtgaagcagatggcaatggcggtgtccccatattataagcagaaaactgtgaattggaggattaggtaactgttggattctttttttttttttttttgagacagggtcttgctctttcgtccaggctggagtgaagtggtrtggttgtggctcctctgctggattcttacagtgttgggagcggaagctgtggtacctgtgttctgtctcccacccacggcccagttgctcagcagaattatgtgaaagcttccaaatgtgtgttttgaagaaatcaaagaatgtaacagagtaggtgagggtgtggagcctggagcaagaagacacttgcttgtgtttagtcttgtcttggccacttcttaggttgtgacctcgggcatactgtgtcaatctttctgagctgggttttctcacctgtaaaatggagagaataacagcacc

SEQ ID NO: 132457 - DNA, 601 bp, Human
aaaactttaagaaaggggataagattcagtgtttcttgtaattgttaactgtcactatggaaattttgtatgtatcttatgctatggaaattcaagcttagctagaaaacatttttactagaaagaacctgtggtattgtctaggccagtgctggtgacttgagtatggtccagagacaagcagcagcggcagcagccgggagcttgttagaaatgcgcattcacaggcccagcccaggctttctgatcagaggctgtaccttgacaatccctctgggtgattccgatgctcacttaaagytggaaactcattgatctaggacagtggttttcaaacttccttttagtcataaggactgctacatgtaataaagatgttttcaaatccagatagtgaaagaattttgtgagtctggttaattaatatgtgttttgggtctctagggggttcctgggtggagttccttgtaacccctctggctcaagtgagctcagtgtacaaatctacaatcgagatccagcccctctttgacaaccaggcaggtaagatcggaggaggtaaagaatctgcttaggtttgttcagatgatattgcaagatc

SEQ ID NO: 132458 - DNA, 601 bp, Human
aaaaaatttctgctgcagcatccccagggcacctgcacacccagttgggaaccacaagtctgatggcatgcattactcagaggtgtccagtcttgttttgtttttccaacagttaagatgtttcacataatcctatgctaggtggagtgtgagatgcaattgttttatacttgctagtcaacacagtggtttcacattaatacatcacaaccatcccatgaggtggctggttctcattttcctgatcccactcatgaaaagcaggggctcatggacttcctttccctgcttaaatggtcartgtgtggtgcacaggaaaatgtcatactcaggcctttaactgtggctcccaggttgttttctccaactatatttgatctgtggttctgtggagtttcaaaacaaaatgggaaatcacttttgtgtagccagttacagttgtggactgcctctgccaaaaagatcagcccttggctttaagtagcagttgcacaaactaggcgggaatagatacagcttaatatcccttcatgttaaaattgcttatgtggagttgactagaggcttcattgataagcagtgttaaagctccagtaacttt

SEQ ID NO: 132459 - DNA, 601 bp, Human
tttgtcactgagcaaaggctttttacatggttctacattcagtttgctgtctcgccaaatgcatttctttctcaagttggtagaatgagatgtcaggtagcacttcagttttctgtttggaacaggtatctttgtgggtagagaccatctaggagctgttgaagttcttactgggcaaatctttgagtgtccattctagctgatgcgtgaagtccatatgtgggcgtggccagtagacctctgtgaaatccagaaaaatcttttactttgtgtttattctgtgtgtgtggtggcgtggggsgggggtggtgggggggcaagtgctgtttaagtgatccaaaagcttacctgtaaatcccgcaaatcaagcatcagcttaccaattcagaatgtagagtcactcagtcctgagatgctagtctttgcttcgtgttgctgtgttttgtggtctacactctgaataagcacttcattatcatgaatacccctctgctttagaccccacagatttatactggctcctcttcccagacgacttgaggacttaggaaagcttggccgccatcttggattccttgtggaaagaacccttcctatgcag

SEQ ID NO: 132460 - DNA, 601 bp, Human
gagatgtcaggtagcacttcagttttctgtttggaacaggtatctttgtgggtagagaccatctaggagctgttgaagttcttactgggcaaatctttgagtgtccattctagctgatgcgtgaagtccatatgtgggcgtggccagtagacctctgtgaaatccagaaaaatcttttactttgtgtttattctgtgtgtgtggtggcgtggggggggggtggtgggggggcaagtgctgtttaagtgatccaaaagcttacctgtaaatcccgcaaatcaagcatcagcttaccaattcrgaatgtagagtcactcagtcctgagatgctagtctttgcttcgtgttgctgtgttttgtggtctacactctgaataagcacttcattatcatgaatacccctctgctttagaccccacagatttatactggctcctcttcccagacgacttgaggacttaggaaagcttggccgccatcttggattccttgtggaaagaacccttcctatgcaggggctgatcttcttgccccctttagggctgtgcttctgcatggctcaacaaggggagacttccactccctgactcccatcctagat

SEQ ID NO: 132461 - DNA, 601 bp, Human
aggaccacccctgtgaggtgaattgccaagagcacgagctgggtttgggccataatgaccccatggtcagtagcaatcagcctcctgcagttaggccaagttcagtccagcggaggctgatccgagcctcgcatgccagggctcctgatgtgctgtactgcactggtggcctgaggatgaaagaaaggtccactccgtaatgatagcccaaaggtgaaggaagatagccaatttcctaacccgtagggtgcatatctgagaccacctttgcaaaattatgactgagacagtggaagagatstaacttaaccgactccatcttgcttctaacctccaagctgtccttgttcatttctgggcgtaagctgaactaactttgagagaaactcagtttatactttatagtttaaacaaagatggtaacagccctttcccaaagcagacctccttgcctggggactagactaacattagccacaggatttgaaatatggcttaggagtcatgcagctggaggctacgagattctgaccttcttaaactgctcctaagatcagtgcttgagatattttgcagaccctgcacttgatggatcagctgg

SEQ ID NO: 132462 - DNA, 601 bp, Human
gagtcaaatgctttgaggcctgtgggactcgcacttcctgtagtctgtcagcaactatagatgttatacaccccagcattattaaatacttgagttataacatcatatggctggaagggatcttaagaggtttcctaggagttccaggcaaatatttgtctgtctttttctttaaaatgtctagggaagggagatcccatgacctgctttactggaactgcataggaataggatgtgttatccagagcaattgctctcttcaaattaaaagtgtcaaagaagggtggagcagggagcgagkctttaaaacgccattgggggttttcttgcccctccagcatcatagtcacttctgccaaaggaactgatgcagcccacatgtttctgtgcaccctcatttctcctgtccatggtcctattgccgattaggtggggatgctgttacttcagggcaggttcctgctaacctcataacctttgcaccaaccaacatgctgcctctaccttagtcaccatgccagaaaagccacagcttgatgaatttctttgcctctcttgaaatggtaaacatctctggttgtttatcgccttgggctttatc

SEQ ID NO: 132463 - DNA, 601 bp, Human
ggttttcttgcccctccagcatcatagtcacttctgccaaaggaactgatgcagcccacatgtttctgtgcaccctcatttctcctgtccatggtcctattgccgattaggtggggatgctgttacttcagggcaggttcctgctaacctcataacctttgcaccaaccaacatgctgcctctaccttagtcaccatgccagaaaagccacagcttgatgaatttctttgcctctcttgaaatggtaaacatctctggttgtttatcgccttgggctttatctgttcattttaatgtggakgcattttttttattacgcttcggaggaagtaccctcagggttattatactcagaaagaaaaaaatgttagctcaaagacttaccttgggaaagttacgaagtgggcaaagctctggttctatttcttccctgcctaccttgtgcttttatgcacatgggcagcccaagaccgagcgccgtcctttttcagctgccttgtcctgagcaaccttgctgccgtcgctgagtcatggtgctcccctagcccttggctttccattctcctcgggagaatcattcctgccccctgccctcctaatg

SEQ ID NO: 132464 - DNA, 601 bp, Human
catgggcagcccaagaccgagcgccgtcctttttcagctgccttgtcctgagcaaccttgctgccgtcgctgagtcatggtgctcccctagcccttggctttccattctcctcgggagaatcattcctgccccctgccctcctaatgttttcagaacgacctcatgatgacagcattttgatttagaatatacatttttttttcctgaaaacaaatcactgtagtgctcaagttgaggcattcaggatgactcaagcagatgttttctgtgcccattgaagtttaacatcagggggtcccsgtcaaatacaaacttcctttttatttgtttagctagttattttatgatttcccattcccctttggaatccttaatgagcctttatggggagttttatttttccatgtgcacctacttctgccacttcgaagcgatgatttagattccgaatgcgtggtgagccccgcgccttcccctcacctcctggaagaacatgctgagctgggactccacctaggatggagtcctttctttagtgctaatggagattattatgcagtttcctcctgaaaattttttgtttaagtattgtattttcag

SEQ ID NO: 132465 - DNA, 601 bp, Human
cccattcccctttggaatccttaatgagcctttatggggagttttatttttccatgtgcacctacttctgccacttcgaagcgatgatttagattccgaatgcgtggtgagccccgcgccttcccctcacctcctggaagaacatgctgagctgggactccacctaggatggagtcctttctttagtgctaatggagattattatgcagtttcctcctgaaaattttttgtttaagtattgtattttcagtctggtcatttcttttctattgagagttacatttaattaattaattaattwatttatttatttatttattattttttttattcagagtttcactcatgttgcccaggctggagtgcagtggctggatctcggctcactgcagcctccgcctccgcctcctgggttcaagtgattgtcctgcctcagcctcctgagtagctgggattacaggcacccaacaccacgtctgactactttttggatttttagcagagacggcgtttcaccacgttggccagactggtcttgaactcctggccttaggtgatctgcccgccttggcctcccaaagtgctgggattacaggtgtga

SEQ ID NO: 132466 - DNA, 601 bp, Human
cattcccctttggaatccttaatgagcctttatggggagttttatttttccatgtgcacctacttctgccacttcgaagcgatgatttagattccgaatgcgtggtgagccccgcgccttcccctcacctcctggaagaacatgctgagctgggactccacctaggatggagtcctttctttagtgctaatggagattattatgcagtttcctcctgaaaattttttgtttaagtattgtattttcagtctggtcatttcttttctattgagagttacatttaattaattaattaattaatttatttatttatttattattttttttattcagagtttcactcatgttgcccaggctggagtgcagtggctggatctcggctcactgcagcctccgcctccgcctcctgggttcaagtgattgtcctgcctcagcctcctgagtagctgggattacaggcacccaacaccacgtctgactactttttggatttttagcagagacggcgtttcaccacgttggccagactggtcttgaactcctggccttaggtgatctgcccgccttggcctcccaaagtgctgggattacaggtgtgagc

SEQ ID NO: 132467 - DNA, 601 bp, Human
attcccctttggaatccttaatgagcctttatggggagttttatttttccatgtgcacctacttctgccacttcgaagcgatgatttagattccgaatgcgtggtgagccccgcgccttcccctcacctcctggaagaacatgctgagctgggactccacctaggatggagtcctttctttagtgctaatggagattattatgcagtttcctcctgaaaattttttgtttaagtattgtattttcagtctggtcatttcttttctattgagagttacatttaattaattaattaattaatatatttatttatttattattttttttattcagagtttcactcatgttgcccaggctggagtgcagtggctggatctcggctcactgcagcctccgcctccgcctcctgggttcaagtgattgtcctgcctcagcctcctgagtagctgggattacaggcacccaacaccacgtctgactactttttggatttttagcagagacggcgtttcaccacgttggccagactggtcttgaactcctggccttaggtgatctgcccgccttggcctcccaaagtgctgggattacaggtgtgagcc

SEQ ID NO: 132468 - DNA, 601 bp, Human
ttcccctttggaatccttaatgagcctttatggggagttttatttttccatgtgcacctacttctgccacttcgaagcgatgatttagattccgaatgcgtggtgagccccgcgccttcccctcacctcctggaagaacatgctgagctgggactccacctaggatggagtcctttctttagtgctaatggagattattatgcagtttcctcctgaaaattttttgtttaagtattgtattttcagtctggtcatttcttttctattgagagttacatttaattaattaattaattaattwatttatttatttattattttttttattcagagtttcactcatgttgcccaggctggagtgcagtggctggatctcggctcactgcagcctccgcctccgcctcctgggttcaagtgattgtcctgcctcagcctcctgagtagctgggattacaggcacccaacaccacgtctgactactttttggatttttagcagagacggcgtttcaccacgttggccagactggtcttgaactcctggccttaggtgatctgcccgccttggcctcccaaagtgctgggattacaggtgtgagcca

SEQ ID NO: 132469 - DNA, 601 bp, Human
tcccctttggaatccttaatgagcctttatggggagttttatttttccatgtgcacctacttctgccacttcgaagcgatgatttagattccgaatgcgtggtgagccccgcgccttcccctcacctcctggaagaacatgctgagctgggactccacctaggatggagtcctttctttagtgctaatggagattattatgcagtttcctcctgaaaattttttgtttaagtattgtattttcagtctggtcatttcttttctattgagagttacatttaattaattaattaattaatttatttatttatttattattttttttattcagagtttcactcatgttgcccaggctggagtgcagtggctggatctcggctcactgcagcctccgcctccgcctcctgggttcaagtgattgtcctgcctcagcctcctgagtagctgggattacaggcacccaacaccacgtctgactactttttggatttttagcagagacggcgtttcaccacgttggccagactggtcttgaactcctggccttaggtgatctgcccgccttggcctcccaaagtgctgggattacaggtgtgagccac

SEQ ID NO: 132470 - DNA, 601 bp, Human
cagctgagagttacgtttaatttccaaagtcatctgaaattaataagaagtatataactgcaaaagaatttctaatgtcctgggcattctcaatacagcctgcttgtctctcctagtagtgtaataggtttcaagcttgtggacttactgacactctgacttagaacaggaggcattaaggttttcatgcaagggaactaagagggaactcaaatccagtgtaaggcatatcaaatgtgtagaaacgtgatgtaaacagggttgcagctaacggcacatttatgccagagcaggacaccaygcaccagaccagagaaactcgtttccctccctccagcgcaaggtttacactttttgggacctttatgaaacggcacacagaaggcaaagccaggctaaggggtggctgaggagatacgatctgagtggtgtccagagaccccctcccccagtgaggattcctgaatgttactggattatctatggctccaactcaaaccacaggagccatcacatcactcccagcttgggacccaccagcagcccctgactgcatagcactctggccagaggggctctgtactggttggaggcaaaaaag

SEQ ID NO: 132471 - DNA, 601 bp, Human
cacttcatgtttgctattagtgggattacagccctgctataaagggggtggcttttgaggccatcatgactaatcgtttccaactatgtttgtctatggaggaaggcaatgttaattatggtgttttaatgcttcattctactatgggttattttatatctgatttcttgactcttagtaaaaataataagcaaggaagaaatcaactttttctgatgtaagctctgacaatactgggttcaaataactattaataacaagtgccttgctaaggtagctgtaactaactacttctttaccyggttgtctaatctttcctactcaatcattcaggtcaaacatataagttcatgtcacacatctggtaactaaactactaaagagtgatttccccaagttgtgcaggttgttcatggcccaagacaaccgggccaaaagagtaaatgaagcagaaacataacctgtgctacttcattcatctcttcagctgcccggagcccaactggaaacagcaatgcatttttctaagttgcacaagggccagcctattcgccaagacgtgtgcacttgcagagaggatgcctcttctagttcacacaaa

SEQ ID NO: 132472 - DNA, 601 bp, Human
aaatacacatgtgtgcatgcacacacacattttatggccttagccattattatgaggatcattataggacttgaattgccaataaagattgtagggaagaactgtaagcctgtgatgtaatgcagtctactcacttggcatactaacctataaaagtggatttttctgtgtaaggaacacatggatgtattcatgttgctatatggaacactaactgaaagttccctccactctcgcccccaaacctccttccgtattatctgtcctgacctttttctctgtaggtatggagatatttatrtatacaaacaaatcaaggattttagataaatgccatcatgctgtgcagagccttctgcaactcatttcacctgacagtgtattctggagaccattcccagttactatgtatagacccagggcatgccatttcacaggggggtttcctgcaatctattcagccattccctgcactgataaacattccacttctctccagtttcaacccccaaaagccttgtggaataacagctttctcactagcccataaatattccacccaaatgatattgatctaattagaccatttttaccacagttc

SEQ ID NO: 132473 - DNA, 601 bp, Human
ttgtaatcagtgttactcaagtatgattgatgtacagcaagataaacactttttaagtgttccattctatgaattaaaactgggtttttatcattagaaacacactgaggattttgtctgtctcccatagacggtgaccagaatgtctcagagagctctggagacaaacagatggtggtgatggttgcacaaggctgggcactggaactgcagtgcaagtgtgaacatgggaccacacacttaaaaatggctatggtggcagactttgttatctatattgtacaatcattttaagatgctaaaaaaaaaaaaaagagaaaaatgtcacaaacacttggctgctttcatcgccttgagagagacaaaaatgtataaggacagattgtatgctttggcgagcttattgaaggtttgaaaaacaaattttacccatagttttgttttgcattaaactaattaaatgctatgtttcatggtcgtggccagatggaccatatttctcagaaggtaaaatcctgttgttgtctagaatgctcagagcttcagagccttgcagggcagccagctgggagtggggttggggtgggtggggcaggggggc

SEQ ID NO: 132474 - DNA, 601 bp, Human
gaagtcttgactgacctctgtgtggtatctcctaaggagagggattgaataagttctttaaagctcctacactatttaacaaactatgagttagttgttcagggttttcttaatagagtacagtttcaaagcacagcagcatcagcattttaagcatgtattaggtggcatatgcatttgtttgtggactttctgaacctctgggaaaaggttatttggaatagataacatttttagtggccataaaattcaaatagaaaaataatagggacattacttgaacttaacctatatttcgaamaattatcatagggatctcttgtaaactttggtataacataaggaagatatgccaaattatttttgaaatagagatgagtctgaaatcataatggtgattagttggtggttcctaatacaaagaataaccataacatatgtatattgatgtgaaaaagtggatattatatacagcttggagtctacttatttttggcaacacatacaagaaattttagtgttttcttgggggtgattaaactgataggggataaaggccaggaaatgagatgcatatttagcaggaaggtctggaaatact

SEQ ID NO: 132475 - DNA, 601 bp, Human
actatcactgaaatagaaatagatattctaagaccacagcaatttggggaccaaatgaaactgaaccgcagaatttagttgacagctgtttaaaaatttgtcaatatctgacaagcctaaaacaagcaaacaaacctttattatactgcagcagagattcccaacctttctggcaccagacactggtttcagggaagacagtttttccacagagggcatggctttgggatgattcaagcacagtacatttatcattagatcctcataaggagcgtgcaaactagatcccttgcatgcgtgytttacaatagggttcatactcctgtgagaatctaatgctgccactgatctgacaggaggcggagcttaggcaatattgcccgctagccctccgctcacctcctgctatgtggtcgggtttgcaacagccaccgaccagcaccagtccagtccgtggcccaggggttggggatccctgtactacaggatatgagaaaaggccttactggcagtttgttttctgtgtcttcgaattctcacgcctgtaatcccagcactttgggaggccgaggtgggtggatcacgaggtcaggagatcgag

SEQ ID NO: 132476 - DNA, 601 bp, Human
gaatctaatgctgccactgatctgacaggaggcggagcttaggcaatattgcccgctagccctccgctcacctcctgctatgtggtcgggtttgcaacagccaccgaccagcaccagtccagtccgtggcccaggggttggggatccctgtactacaggatatgagaaaaggccttactggcagtttgttttctgtgtcttcgaattctcacgcctgtaatcccagcactttgggaggccgaggtgggtggatcacgaggtcaggagatcgagaccatcctggctaacatggtgaaacccygtctctactaaaaaaacacaaaaaattagctgggcatggtggcaggtgcctgtagtcccagctactcgggaggctgaggcaggagaatgacgtgaacctgggaggcggaacttgcagtgagcggaagccgagatcgtgccactgcactccagcctgggtgacagagtgagactgcgtctcaaaaaaaaaagtgaaatgaattatggttcatgtataaattgccattttaatccaaaacgttttcagtagatgaatactttgattttttaaaattgttttgcaaacatatatttccttttg

SEQ ID NO: 132477 - DNA, 601 bp, Human
gcataggtttcccatggttggggagtcctggaagtccagctttggggtctgggaaccagggaaccagggatcagaaagtcactggactccagggactatatcatagtttaaagaagggcttgagtaaaatgtgaccagaatagcattgacagtaatcaagcaagacgatggtagaagacggaggagttggcctggtgaccaatgcctgccagccctttctgcgcagaagaaatgccaggacccacagacatggctttccctggaaccactcctctgttggtggtctcactggtgcctgccrctagcagagagcagcatggttacaggtgaggccccgcacccaggccagctgtgggacctagtttccagctcaagccgtgaaaacttggctgcacctcctgacccatctcagcctcattatcctttcctgtaaagtgaggaaaatagaagtacatacatcaaaaagtttatgagggtgaagtaaaatcatacaggacaacctttagcaaagtgccgaccacagagtgagccttcctctttgccatttgcagtattttaaggtatttaacatcgatagaccatacaattatggcattgttaa

SEQ ID NO: 132478 - DNA, 601 bp, Human
tgagcccaggagtttgagaccagcctgggaaacatggcaaaaccctgtctctatagaaaaaaaaaaaagtccaaaaattagctgggcatggtggtgcatgcccatagtcccagccacttgggaggctgaggtgggaggatcgcttgagcctgagaggttgaggtgtggtgagctgtgattgcaacattgtactccagcctgggcaacaaagtgagaccttgtctcaaaaaaaaaaaaaaaataagcaaagaacataaacagacacttttcaaaagaagacatacacagtggccaacaagcwtacaaaataaagctcaacatcacagatcattagagaaatgaaaaatcaaaatgacagtgaaataccatctgacaccagtcagaatggctattattaaaaagtcaaaaaataacagatgttggcgaggtggtggagaaaaaggaatgcttatacactgttggtgggagtgtaattagttcaaccattgtggaaaaacagtgtgatgatttcccaaagacctaaaaacagaaccaccatttggccaaccaatcccattactggatggatacatacccaaaggaatataaatcattctgttat

SEQ ID NO: 132479 - DNA, 601 bp, Human
gatggagctggaggccattatcgttggcaaactaacataggaacagaaaactaaataccacatgttctcagttagcaggagctaaatgataagaacatacagacacaaagaagggaataacacacactggggcctattggagggtggaggatgggagtagggagaggatcaggaaaaataactaatgggtactaggcttaatacctgggtgatataatctgtacaacaaaccaccatgacacaagtttacctatgtaacaaacctgcacatgtatccccgaacttaaacacacacacacayacacacacacacacacacacacacacacacacactccagctactcctactaagcagtccactctgcctggaagttgctggaaggactccatgcgaaagtggtttctctcctcccagaacatgattttactggtttctttcaaagcctattcatcatcctcccttcaggacactcttaaaatttgccttctgtggagctctttaccataagaacaagcaacaatgacatgttccagcccattagtgttaatatttgttgatccgaagatggaaaatacattttactagacccttgtttcct

SEQ ID NO: 132480 - DNA, 601 bp, Human
tatcaggctttctcaggggagacttagtgttttttttatctttactggaaaaaactgttgttggtaatagcaaagacattttgtgttagccattaacgagatagcagagaaatcctttgctatctaatatgtcacggtgaaggccactggtatgagcttatgttgaaattcaggatttttctgatgtcatgagtgtactcaggtgaccacattttgaatctttttacttttaaaaacaattccccaccccagttctttagctgagattgtcatttgaagacgtgtgccctgttcatccagytgcacatgaccagaaggccctggagaatggtttaagccattttgaagagcacagacatgggggagaaggaggtaatcgtcatcaatacatcatccctacctctttcaaacttctgtatatttttcgtacttggttggtttgtttttgagatggggagaagacagagggaggacagaggctctcaaggagtttgtgagtttagagctggcctgatggccatgagcagcatgttttccatcttgaagaaagaagaggtgggaattcagaatggtgcagctgccttggtaaaaccttacggtg

SEQ ID NO: 132481 - DNA, 601 bp, Human
agaacagtgtagttcccatggtagtggaccgtattatattttatttagttcttctatattacttggttttttttaaatctgtgtttggctatttaaaagtttatactttgatcaaatgaataatatctagtatttgatagcacaaccaggtgactatagtcaacagtaatttattgtacatttaaaaataactaaaacagccaggcgccatggctcatgcctataatcccaacactttgggaggctgaggcgggcagatcacctgaggtcaggagtttgagaccagcctggccaacatgggaaccccatctctactaaaaatacaaaaattagctgggcatggtggcacacacctgtaatcccagctgctcgggaggctgaggcaggagaatcgcttgaacccaggagacagaggttgcagtgagccaagatcgcaccattgcactccagcccgggtgacaagagcaaaactccatctcaaaaaataaataaatagctaaaacagtagaattggattgtgtataacacaaagaaaggataaattcttgaggtgatggatacgctatttaccctgaggtaaaatacctatttcaaaatatct

SEQ ID NO: 132482 - DNA, 601 bp, Human
aatgagcttccagactgaaatcagaccaagtttgtttcatttgcactataagaaatggtagttattcttctgtgaagacatatatagaatgagcagtgatgcatataactgaaaatccctcagggaagcatttgttatttgtgaaaagtgtcatctcgttctctaagaacttcctcagctttttctgtttgtttaggggagggcacaggaacatgatggcatggtgttacatttggtgatttggtgcacacaactgtctgtggtcatgcactttgatgtaactcttgtccaactggcctayccaaagtacagatatatcttcttatagatggcttttaaaaaaaagtaaaaagcccatcctcaatagataaaaactattgcaaacaattttaaatccttaataagaaaataatttcaaattgctgtgcattgacagtatttgaaggaggtggggatgttataagggatggtttttagaaagaaagagctgagagacatgaattttgcagtgcagagaacatgagctttagattcaagctccagttgaatgatctttctgtacttcagagtcataattataaaataagatttagttgacctc

SEQ ID NO: 132483 - DNA, 601 bp, Human
ggcagttaaatgatgcaggggaggcaaagctttacctctatcctcttagggtcctggctgggcctgagaattaaatggacatgacaaattaagccaggcacagtaatcccagctactagggaggctgaggcaggaggattgcttgaggccaggagtttgagaccagcctgggcaacatagtgagacccccatctctaagaaaaaaaaaattgacagaacaaattaacaggagaaaagcacaccaatttatttaatataagttttatgtggcacgggagccctcaaaggaaaataaagattaaaaaaaaaacacagtcagttatttttatatattgaattggacaaacaaagataagttgtaaaatgcgataaggccagcaggcttggcctagggtaggtaattattggagaaggaactaggatgataagggttagttaacaacctttgtgcagatttcccttggattcaaccttctatccttgatgataagaatgctactttccttttggggtaggaaggacatctttcacatgggagtttcacctcctgcctttaagaaacagaacgaaggtcacagtgatcttcttgtgcctgctgttt

SEQ ID NO: 132484 - DNA, 601 bp, Human
gaattaaatggacatgacaaattaagccaggcacagtaatcccagctactagggaggctgaggcaggaggattgcttgaggccaggagtttgagaccagcctgggcaacatagtgagacccccatctctaagaaaaaaaaaattgacagaacaaattaacaggagaaaagcacaccaatttatttaatataagttttatgtggcacgggagccctcaaaggaaaataaagattaaaaaaaaaacacagtcagttatttttatatattgaattggacaaacaaagataagttgtaaaatgcrataaggccagcaggcttggcctagggtaggtaattattggagaaggaactaggatgataagggttagttaacaacctttgtgcagatttcccttggattcaaccttctatccttgatgataagaatgctactttccttttggggtaggaaggacatctttcacatgggagtttcacctcctgcctttaagaaacagaacgaaggtcacagtgatcttcttgtgcctgctgttttttaggttcccttaaatcaaaacagccaatatgccagaacatcatatttttaactcctttggtggca

SEQ ID NO: 132485 - DNA, 601 bp, Human
tctctttcaacccagcagagcaaaatagtaactctacttcatgaaaacaaaattggctgtttccaatagagcactcagatcttcaggaaaatgtagcatatttcctaaaggaggttaaaggtgaatgaaacctttgctggtggttccatatattctaccataatcgtaataacaacagcagctcacatttattgggccttttaatgtaccgtccattgctttaagtgttttacacatactgtattcacttatttaatgtccaccaactcctaagtccctgttagatgatcttcattttacrtgaggaagccaaggcacccagaggtgcgatgtaacttgtccacactcaaacagcagcaaagctggcatttaaaccagacatgctgattttagaacactaactgcatatgctgcatctataatgagtaaaaatctataacaggtaaaaatgtacaatggagaatggtgggaaccagtaccaggaacctgtgcagacctggtcagagcaggaaaggaaataaacacagttacatgattataaaacaacaaattggataataagatcagtcctgaaaagtcaaccaaaagatgctcacgccag

SEQ ID NO: 132486 - DNA, 601 bp, Human
ccataggaaggagatttgctgaactgagaaagtgaacatttcacaagaagtacatatgtctccatgctaagaagtaactccctgggcgatcgccgtcatgctgagtgtttccatctccaagccctgctgcagcctgcctccttgtctccacccatgcctggaaaacctaaccctcataaaagtctcagtaagcaacagtgagaataactgtaaggtgttacaggagagatggttttggcagccaaaaagggcttatgatcctaagatccaccttaaaagtgttctgttgcccagttctgtrttaattctgagcagaggcagcagaaagcatctttcagggtcgagaatttctgagatcttgaccgtcaggaaaaggatgcttccaggcagccgtggaaactgaaatccgagccctaatcttgctcagagctgctgaggtctgtttgtaggaaaacatcgggttattgtctgaataacatacatccaagttacaacgggaaaagaaatctgccttatggaaagagaatgaacatttgctgggtagagtttatgcctgcctagatgctccacctccaggctctaggtactctacttcggagtg

SEQ ID NO: 132487 - DNA, 601 bp, Human
tgctaagaagtaactccctgggcgatcgccgtcatgctgagtgtttccatctccaagccctgctgcagcctgcctccttgtctccacccatgcctggaaaacctaaccctcataaaagtctcagtaagcaacagtgagaataactgtaaggtgttacaggagagatggttttggcagccaaaaagggcttatgatcctaagatccaccttaaaagtgttctgttgcccagttctgtattaattctgagcagaggcagcagaaagcatctttcagggtcgagaatttctgagatcttgaccrtcaggaaaaggatgcttccaggcagccgtggaaactgaaatccgagccctaatcttgctcagagctgctgaggtctgtttgtaggaaaacatcgggttattgtctgaataacatacatccaagttacaacgggaaaagaaatctgccttatggaaagagaatgaacatttgctgggtagagtttatgcctgcctagatgctccacctccaggctctaggtactctacttcggagtgcagtctgcgctccctcttctgggatggctgcggagcccagggcatctctctctaaggctttcaa

SEQ ID NO: 132488 - DNA, 601 bp, Human
tggatattaatttagcaatagataagtctgaaaatagacttaccttcaatttcatcataaaagtcaacctcccacctaacacgttgaaactcctgtggttgtgaaagaagaaaaatgaagttccacttccctttcattccatgagccccttcagtggttactgcctcactagaggtgcaagttactagaaccgcagaatataaactgttacataaaatgatgaaatatgcgcacagaaaataagggagctttttaaaataaaaactaatttgtatgctttggaaagactcaaaggtgagtgtttttttttttaagctaattagatatgggtaagacaactgtgaaaaactggagaattttttttttaaaggcgtgaaggatgtacactcaaattgccttgtaatttttcctttacttaaaaccctgaaaccggacattttctaactgaaatcacattgacactctgtggtatctatgtgtgatggagaatatggagccaggagagcagttcttggatacagaaccacattttggttgaatgactttatgtttatgtattcgtagttaaatgcaatatgtatgtggtcaggtttcatggctt

SEQ ID NO: 132489 - DNA, 601 bp, Human
gtatgtataagaaagtaaaaaaaatgcaaacactttaatctcaaataacagtatgcagtgctctaatgtaatatcttctactctgaagggcaggtcataagagcaggctcctggtgatgagatgggagatcattcttcatttgttggaagatcaactttatttcatgccctagaaatgcttgctttacaaagaaacatacgtagggcagcatgtatcctgaggtttccaaaagagaaaagatttgttcacaggggtaagttgaggaggcgggagaacagctctcaaatccacctccctgcygataagacttaggaatatttttgggttaggaagtaacaggttcatttgtgcaagcgtatttggggttcttggcacttcatatgacatatatacagaagatggcagctttagcatgatctgtgggtggagttttttggccctctggcttcaaaaggccacctctcaggcatttgcgcaggcccacttgaagggttggtggtctcagctggtttgaagtgaacagcagctggcccaagtttctgaaaaacagctgaagccaacattaccaggaatgtcatctgtaatgcagccagtaatggt

SEQ ID NO: 132490 - DNA, 601 bp, Human
tagccctgtgtgataagagaaaactattttatcaaatggcaatgaagtagcaagaggctattacaaatgaaacaattttactttcctcaaactttgctgagtgtactgagtgaaaaaagataaatctaaatgagaccatagcagggataattaaaggtcatttgaaacttcttggtatacctctagatatacttctcagaagttaagaaagtaaatgattcttgtgactaattaacaactattttcactagtcagtggtttctgtttctttgctttttagaaaatttagaaaacgacctartcacaatgtcagcagatagaagatttcaaataactttgcaatacagcaccatattatttttggcatacggttcagaagaaatctaaagtattgatggctcttgctgtaatgaagctttacattctttttaatgtgtgaactattaatagatttctcaggactgagatctatagaaatgagtaataggaatagaaattaaaacaaaattaagtaagatttccatttaccatttctgtgaagtataacaagtgatcaataaaataaacaaaactacattaaattatggtaaaactatatgtg

SEQ ID NO: 132491 - DNA, 601 bp, Human
ctgtgtgataagagaaaactattttatcaaatggcaatgaagtagcaagaggctattacaaatgaaacaattttactttcctcaaactttgctgagtgtactgagtgaaaaaagataaatctaaatgagaccatagcagggataattaaaggtcatttgaaacttcttggtatacctctagatatacttctcagaagttaagaaagtaaatgattcttgtgactaattaacaactattttcactagtcagtggtttctgtttctttgctttttagaaaatttagaaaacgacctaatcacratgtcagcagatagaagatttcaaataactttgcaatacagcaccatattatttttggcatacggttcagaagaaatctaaagtattgatggctcttgctgtaatgaagctttacattctttttaatgtgtgaactattaatagatttctcaggactgagatctatagaaatgagtaataggaatagaaattaaaacaaaattaagtaagatttccatttaccatttctgtgaagtataacaagtgatcaataaaataaacaaaactacattaaattatggtaaaactatatgtgtcaag

SEQ ID NO: 132492 - DNA, 601 bp, Human
tcctttcaacgaatgaggctaggaaaactggatatccagatgcaaaataatgaagttggacccttacttaacaccatatgaaaaagataattcaggacagatgcagtggctcacacctgtaattccagcactttgggaggccagggcaggtggatcacttgagccaaggaatttgcgaccagtctgggcaacgtggtgaaatcccatctctaccaaataaaaatacaaaaattagccagttgtagtggcgcattcctgtagtcccagctactcatggggatgaggcgggtgctgaggtggraggatcacctgagtcctggggaggctgaggctgcagtaggccgtgattataccactgcattccagcctgggcggcagagtgagaccttgtttcaaaaaaaaaaaaattaactccaaatgaatcaaagacctaaacataagacctaaaacaataaaactcttagaagaagacataaggggacagtttcatgacattgaatttggcagtgtttacttgaacaccaaaaatataggcaacaacaccaaaaaatagacaaattggacttcatcaaaattcaacatttttgcccttcaaaagatt

SEQ ID NO: 132493 - DNA, 601 bp, Human
aaatacaaaaattagccagttgtagtggcgcattcctgtagtcccagctactcatggggatgaggcgggtgctgaggtgggaggatcacctgagtcctggggaggctgaggctgcagtaggccgtgattataccactgcattccagcctgggcggcagagtgagaccttgtttcaaaaaaaaaaaaattaactccaaatgaatcaaagacctaaacataagacctaaaacaataaaactcttagaagaagacataaggggacagtttcatgacattgaatttggcagtgtttacttgaacrccaaaaatataggcaacaacaccaaaaaatagacaaattggacttcatcaaaattcaacatttttgcccttcaaaagattctatcaacagagtgaaaaggcagcctatggaatgggagaaaatatttgcaaatcatatatccgataagagattaatatccaaaatatctgaagaactcctaaacacaacagcaaaaaaccaattcaaaaatgggcgaaagacttgagtagacatttctccaaagaagatatgcaaatatccaataagcaatgaaaaggtgctcagcatcactgatgatta

SEQ ID NO: 132494 - DNA, 601 bp, Human
gctacaacatggatgaataaaactttatgttaagaaatataagctacacagacaaggacaaatattgcatgatttcatagaggcaaaacagggactgtggggagaggagagttgcttaatactcattaatatagagtttaatggtttaattaataccattaatacagaatttcagtttggagtgatgaaaaagtcctggagatggatgatggtgatgggtacacatcaaggtaaatgtttttaataccactgaactgcacacttgaaaacagttaaaatggtgaattttatgttctgtatrttttaccataccaaaaaggacataaaacatattgagatagtttttgagatttgtagatacatggatctttagatttctcttagggaatgtgtgcacagctgctcatgtatttggagaattcatgtctagtgtccttcacggtctgaatccagccctcttctctcacttcattttccttgttccagccacctggcagctcacacctgctaggcttttgtacaagttgttctctctactttcagtgccccttctccccgcacccagttgctgaatggaatctgatacttcaagacccagccc

SEQ ID NO: 132495 - DNA, 601 bp, Human
ctgtggggagaggagagttgcttaatactcattaatatagagtttaatggtttaattaataccattaatacagaatttcagtttggagtgatgaaaaagtcctggagatggatgatggtgatgggtacacatcaaggtaaatgtttttaataccactgaactgcacacttgaaaacagttaaaatggtgaattttatgttctgtatattttaccataccaaaaaggacataaaacatattgagatagtttttgagatttgtagatacatggatctttagatttctcttagggaatgtgtgyacagctgctcatgtatttggagaattcatgtctagtgtccttcacggtctgaatccagccctcttctctcacttcattttccttgttccagccacctggcagctcacacctgctaggcttttgtacaagttgttctctctactttcagtgccccttctccccgcacccagttgctgaatggaatctgatacttcaagacccagcccaagtggccaccacatttggaaaagttgtgctcactcctccagacgtaacctgtttcttcctctcctgtgttcccaaagaacttttctgcacttc

SEQ ID NO: 132496 - DNA, 601 bp, Human
taataccattaatacagaatttcagtttggagtgatgaaaaagtcctggagatggatgatggtgatgggtacacatcaaggtaaatgtttttaataccactgaactgcacacttgaaaacagttaaaatggtgaattttatgttctgtatattttaccataccaaaaaggacataaaacatattgagatagtttttgagatttgtagatacatggatctttagatttctcttagggaatgtgtgcacagctgctcatgtatttggagaattcatgtctagtgtccttcacggtctgaatcyagccctcttctctcacttcattttccttgttccagccacctggcagctcacacctgctaggcttttgtacaagttgttctctctactttcagtgccccttctccccgcacccagttgctgaatggaatctgatacttcaagacccagcccaagtggccaccacatttggaaaagttgtgctcactcctccagacgtaacctgtttcttcctctcctgtgttcccaaagaacttttctgcacttcagatacgtcccatgcctgtccccaaacagagtgaattgttggacagagatggtgtc

SEQ ID NO: 132497 - DNA, 601 bp, Human
actgttccaacaccaggaggttggaaacagctgtgtcattaatgaacgacagcagatcctaaccagtgacctccagatgaaaggctcattatttccttactggtctcaagagctattcagtcccctagcaagccagctcagaatttggactgaagagtctaagccttgaactataaaaaaaatttacgaagtccttgacacaatttggagcgattatgttctattgtgccaagaatttcttattaaaaatcaatttaattgtgcataccccatctggtcggtattatggtcttttatgggsgggggggggaaacacgattttgtgtttacctgatgttccatagagtaagcatgtagttttgcagaaacagagacattttataacgctgagaaatgagtaattaaagaaaatttttaaatgtttaccagacttctttttactaacttttgtgactttgagctataagattcaactttcttgcgttagttgggattttaacggaaaagaaaatgccagactaaagtaaaaaatgtatgtgtgtacctcatctgctacatttatttccatgtaataatttctattttatactctcgagattaa

SEQ ID NO: 132498 - DNA, 601 bp, Human
atattgagtggaatcaatataatctctgagcacatggggtagccagataacaatacaataaaaattacagaatgtggcaagctcgaagagaaaaatgagtgcggtgtggtgataaagacaagcaagttctcttcttctacataattctttgaagttgaagtgatgcttatttgttacactgataataaaaatgtataaggaaaaaataacttgccctcttctggctccatgtctgctcaggaatcaatagaaacagtttggccaaccattcatacttttctttgcactcatacaaatgtaggtaaacatacagcatttttgttgtggtttttacaaaaaaaaaatggattctgtgcattgctctgtaactttgttggtttgccttgaaaagtccttagaagtgttattagtatgtgatgtttgctgctggcattttacctacccaagactcagtcagcaatagaaaactctccaaagattttatagatgaggccctgtcattatcacggtatcctctctggtctccatttaattctggccactccatcccataatttattgaacagaaaaagattctctagggtgtcttactactactact

SEQ ID NO: 132499 - DNA, 601 bp, Human
ccattagtccaagagtaaaatttagtggctataagcaagccaccatccaagtaactgcacgtcaaatgggggacggacagtctgtttgtattgaaggctctgcgtttagtgtacacagctgggaacttgtggcccaccaaaaatgacatttatatttaggaattgggtggtgctgtctttttggtgtatgaattaacatttgtatatgacttactagtgtgaaagtctgattttataatgtgtcagagagccatcgtttacctgtctcatgaataaataaaataaaagctaagtacgtttstataaatatttaaaaatacactgccttctcatacttttcccatttcacctatggaaaccttgccaaaatgaaatcaaatttgagcgtttcaatgtaagggaaaaccagctcatggattttaaaattaagaagtggatttttttgtttgttttgtttatgttggctttgggtttgtttttttttttctctaccaagtaaatagtttcgatgaaataaacaggtccaatcatctaatgatggattatttgaatgcagattgaaattgaattgaaaatgttgagaatgagcttgtttatgctt

SEQ ID NO: 132500 - DNA, 601 bp, Human
tttgtgtacatgtttaataaaaatgagatttcctgtgtttctaagccttttcttccccctgtgatcacactccatatactctttgcccatttttctagcagcttgtagggttctttctgtctgatttgtaagaactttttatatattgaagaaattgggcctttgttttcatagatattccaaatatgtgtgtactattcatttaatatcagttttctttcaactttgttaatatttgtatttatagaaattagtttcaaatttgtccctcatttctaagtttaatgtcttacaggagtcmtgtttcacatagagcaaaataatggttttcatgttttcttccaatgctttcagagttttgttttttgtgcttaaatattcaaggcatctgaaattcatttgagtatatagagactgaaatactacatattcttttccaaatactatggtaatttatcatgtgataagggacatttcaaacaagtgggataaagatgacttattaaacaaatgctgttgacataattgctgatatttaggtgcaaaataataaagctgggtccgtacttggtgcctgcaaggaaccaacagaaggccactg

SEQ ID NO: 132501 - DNA, 601 bp, Human
gttttgtttcctaggatgaaggatcccctctctactggctgattagggtatttcagaaaattttcttctgttatatctttgaacatttttttaacttctattttcctctttttttaaaatacatctttttgggaattttttgcttatctttaaagtcttctgacctttgctgagaattgtgttctcaagctttactacctatctctacgtgtggtttcagcagtgtcagttcttttttttgaggcagagtcttgctctgtcacccaggctggggtgcagtggtgcaatcttggctctatgmaacctccacctcccaggttcaagtgattctcctgcctcagccttttgaggagctgggattacaggtgtgcaccaccacgcctggctaatgtttgtatttttagtagacatgggttttcaccatgttggaccaggctggtctcaaactcctgaccttaggtgatccaccctccttggcctcccaaagtgctgggattacagacatgagtcactgaaccctgctagcagtgtcaattctggctttcatttctctttagggtagcttcagtttgtaacaatgacctcttcctatttgtctctt

SEQ ID NO: 132502 - DNA, 601 bp, Human
aatcttgctcttgtcgcccaggctggagtgcagtggcactatcttggctcactgcaacctccacctcccaggttcaagcgattctcctgcctcagacccccccgagtagctgggattacaggtgcgtgccaccacaccccgctaatttttgtattttcagtagagatggggtttcaccacgttggccaggctggtctcaaactcctgtcctcaggtgatccgccaacctcggcttcccagagtgctgggattacaggcatgagccaccacgcccggtctctgacagtgttttatcccttgycatgtacactaattatatcctggcacttggctctgtagttgtttttatatcagtcttgcctaatcggttagaatcatagactacttgaaggcatgaataacagcccacattttatctatttatttatacatctctcattacttcaaaaaatgatttgaacatgtttcttttatatgattgtgttttgaccttggtcaaggtggtagacatctgattaaggagggtcaataatttatgaactcagaacacacagaacagaggactttttgttgttgtttttaatttatgatttatatctct

SEQ ID NO: 132503 - DNA, 601 bp, Human
aacatggatttaatactattatctaattcatcttaatccatattccagttttgctattcttgctccaataatgccctatttagcaacttttccagtccaggatcattctagagactgcctgcaagagaacatttgtgatgtggaaggcatttgctagtgatcctcctcttctgggctgggttctccgctgtcattttcttcatgcagtatttctctcctgctttttcttctaaatgtactctttgtttgattccgcaagtcagctaaagtagcaagtcgttgttcctcaaactaattttcttttttttttttttttgagatggagtctagctctgttgcccgggctggagtgcagtggtgcaatctcagctcactgcaagttccacctcccgggttcacgccattctcctgcctcagcctcccaagtagctgggattacagtcgcccgccaccgcgcccggctaatttttgtatttttagtagagatgaggtttcactgtgttagccaggatggtctcaatctcctgaactcgtgttccacccgccttggcctcccaaagttctgggattacaggcatgagccaccacactcagcctctca

SEQ ID NO: 132504 - DNA, 601 bp, Human
attcttgctccaataatgccctatttagcaacttttccagtccaggatcattctagagactgcctgcaagagaacatttgtgatgtggaaggcatttgctagtgatcctcctcttctgggctgggttctccgctgtcattttcttcatgcagtatttctctcctgctttttcttctaaatgtactctttgtttgattccgcaagtcagctaaagtagcaagtcgttgttcctcaaactaattttcttttttttttttttttgagatggagtctagctctgttgcccgggctggagtgcagkggtgcaatctcagctcactgcaagttccacctcccgggttcacgccattctcctgcctcagcctcccaagtagctgggattacagtcgcccgccaccgcgcccggctaatttttgtatttttagtagagatgaggtttcactgtgttagccaggatggtctcaatctcctgaactcgtgttccacccgccttggcctcccaaagttctgggattacaggcatgagccaccacactcagcctctcaaactaattttcataacaagttaatagcattaaaacagacttgaggccgggcgtgt

SEQ ID NO: 132505 - DNA, 601 bp, Human
gacaggagaattgcttgaacccgggaggcggaggttgcagtaagctgagatcacaccactgcactctagcctgggcaacagagcaagactctgtctcaaaaacaacaataacaacaagaaacaggcttcttcctaagtaatgaatgaatgctgtcccagaagattttcattatatccatagtcaaatttctttatttttttttattttttttgagacggagtttcactcctgttgcccaggctggagtgcaatggcgcaatcttggctcactgcaacctctgcctcccgggttcaagcgaytctcctgcctcagcctcccgagtagccaggattacaggtgcgcaccaccacgcctggcaaattttctgtatttttaatagagacggggtttcaccatggccaggctggtcttgaactcctgacctcaggtgatctgcctgcctcggccccccagagtgctggaattacaggcgtgagccactgtgcctggctcattttgttttgtgggtagaatgagactaaaaataccacgaaggaccaatgctgctaggatcaaatggatttcagctaaattttatgtcttttataatgcagagaaca

SEQ ID NO: 132506 - DNA, 601 bp, Human
tattttttttgagacggagtttcactcctgttgcccaggctggagtgcaatggcgcaatcttggctcactgcaacctctgcctcccgggttcaagcgattctcctgcctcagcctcccgagtagccaggattacaggtgcgcaccaccacgcctggcaaattttctgtatttttaatagagacggggtttcaccatggccaggctggtcttgaactcctgacctcaggtgatctgcctgcctcggccccccagagtgctggaattacaggcgtgagccactgtgcctggctcattttgttytgtgggtagaatgagactaaaaataccacgaaggaccaatgctgctaggatcaaatggatttcagctaaattttatgtcttttataatgcagagaacactctagtattatttgaccacttgcagaaaatgaatcctgttgtcaagccagcatcgtttgaggaagaaaactgtaggccagtctcacttataaacataaatacaaaaattctacgtaaaatattggcaaatggagtccaataatatattaaaagaaaaagtatgtgacaaagtaagatttattttggggatacaggagtctt

SEQ ID NO: 132507 - DNA, 601 bp, Human
actcctgacctcaggtgatctgcctgcctcggccccccagagtgctggaattacaggcgtgagccactgtgcctggctcattttgttttgtgggtagaatgagactaaaaataccacgaaggaccaatgctgctaggatcaaatggatttcagctaaattttatgtcttttataatgcagagaacactctagtattatttgaccacttgcagaaaatgaatcctgttgtcaagccagcatcgtttgaggaagaaaactgtaggccagtctcacttataaacataaatacaaaaattctacttaaaatattggcaaatggagtccaataatatattaaaagaaaaagtatgtgacaaagtaagatttattttggggatacaggagtcttgaaattaaatatctttctaaatatcactatatcaagaaaataagaaaaacatgatcccatcagcagatgctacaaaaacgtttgaagcaattcagctgccattcccaaaataagaactctaaataaaatagaaacagaaaaaagccatttaaccagaattcagaccatttacaaaaaccagtagcatgctgcccaaaatggtaaaattctgaa

SEQ ID NO: 132508 - DNA, 601 bp, Human
gaccatttacaaaaaccagtagcatgctgcccaaaatggtaaaattctgaaacggtttcatttaaaataagaaattaatcaagatgcctgccatcactatataattcattgttttcatgttttcggcaactgcaaagaagattacaaatattgggaaaacagtgaacaatttctgtacgtatacacatatgctcacagaaatatggtaatgtaaatatgttcatatatgattgtgtatctagaaaacaaaagaaaaaacagtagataaatactcgaattataagagaatttgataaagtgwccagataaatgataaatatatttttaaaatcaatagcctttttctagcctagcaataaacagcttttttttttctctagcagtggacacctagaaatgcaaaggaagtacgaattctttcaaaaaagcaattaaaattatacattgcataggaaaaatgtttacagtacctacatttttaaaagtcttattgaacaaatggaaaagcatactattttcttgtatgggaagacttagtatcataaaagattcaactcttctaaaattaatataaatatatatgattccacatagactcaat

SEQ ID NO: 132509 - DNA, 601 bp, Human
ttatgaaacaaattatgatccctaacgtgtgtgtgtgtgtgtgtgtgtagtatggtataggcagagtggaaaatatgtaggcatgctgggcttcattatagcatggtgatgaagggcaggggagaatctgaagatgggtagaaggagaagctcaagtttaaaaaaagaaaaagactgccacgtaaacagcaggcatgacatcacatgtacacatggatgcagagcaatggaggtgagagtatgtactaagaaagtgtgcatggctcctggcttctggtagaagctctgtccagctataaarcaaacaatttttgttgttgtgaggaaagtgagtgcaacaagtcccctgtggatttctccttgaagtctttgtagcacattgaaatcccagggctgctttccattctgctgtggactgaaggaagagtgtgagagttttactgactctactcaccacacatctgattgcctgctcccaatagacttgggaacagcttcctctggccatatactccatctccaaatagctagtgtgagttcagaattctcgtacagacacacgtccaattcccacaggcctgagagcttgctgggtttgtgg

SEQ ID NO: 132510 - DNA, 601 bp, Human
aaacaaattatgatccctaacgtgtgtgtgtgtgtgtgtgtgtagtatggtataggcagagtggaaaatatgtaggcatgctgggcttcattatagcatggtgatgaagggcaggggagaatctgaagatgggtagaaggagaagctcaagtttaaaaaaagaaaaagactgccacgtaaacagcaggcatgacatcacatgtacacatggatgcagagcaatggaggtgagagtatgtactaagaaagtgtgcatggctcctggcttctggtagaagctctgtccagctataaaacaaamaatttttgttgttgtgaggaaagtgagtgcaacaagtcccctgtggatttctccttgaagtctttgtagcacattgaaatcccagggctgctttccattctgctgtggactgaaggaagagtgtgagagttttactgactctactcaccacacatctgattgcctgctcccaatagacttgggaacagcttcctctggccatatactccatctccaaatagctagtgtgagttcagaattctcgtacagacacacgtccaattcccacaggcctgagagcttgctgggtttgtgggtggg

SEQ ID NO: 132511 - DNA, 601 bp, Human
agggctgcttttaatggctcattgttctccctgcagattttcaccgctttgccgcccttcactctgggaatctttgagaggtcttgcactcaggagagcatgctcaggtttccccagctctacaaaatcacccagaatggcgaaggcttcaacacaaaggtaaacagagtgtgatctcagaactgtcacctcagaaaggcgtggctgtttgattctagtcatctgcctaggagatagttgaagcttgagaaagaacatttgagaagtgctgaaaacatgatccactcaccccaccaccacacacacacacacacacacacacacacacacacacacacacacacgccacaaacccagtgaattcaagacgccttctcaggtgacgggtccatgctgtgtgggctgcaacctccagtcccagcatgctgactccttcccgcttctccccgtcagcccctgacatcagtgtgggcagcagttcccacagcccaggttcaggatccgctgtcagagatcccccttgcgtggtcctgcagccccatgtggaggcctgttggcagcttacctagctgttgctgggtttgtcatttgaaataaaatg

SEQ ID NO: 132512 - DNA, 601 bp, Human
ggaatctttgagaggtcttgcactcaggagagcatgctcaggtttccccagctctacaaaatcacccagaatggcgaaggcttcaacacaaaggtaaacagagtgtgatctcagaactgtcacctcagaaaggcgtggctgtttgattctagtcatctgcctaggagatagttgaagcttgagaaagaacatttgagaagtgctgaaaacatgatccactcaccccaccaccacacacacacacacacacacacacacacacacacacacacacacacgccacaaacccagtgaattcaasacgccttctcaggtgacgggtccatgctgtgtgggctgcaacctccagtcccagcatgctgactccttcccgcttctccccgtcagcccctgacatcagtgtgggcagcagttcccacagcccaggttcaggatccgctgtcagagatcccccttgcgtggtcctgcagccccatgtggaggcctgttggcagcttacctagctgttgctgggtttgtcatttgaaataaaatgtgtctttagctagtgcgtaaaattgactagatatgaactcagggatcacatgagttgcaggggatt

SEQ ID NO: 132513 - DNA, 601 bp, Human
gtcttgcactcaggagagcatgctcaggtttccccagctctacaaaatcacccagaatggcgaaggcttcaacacaaaggtaaacagagtgtgatctcagaactgtcacctcagaaaggcgtggctgtttgattctagtcatctgcctaggagatagttgaagcttgagaaagaacatttgagaagtgctgaaaacatgatccactcaccccaccaccacacacacacacacacacacacacacacacacacacacacacacacgccacaaacccagtgaattcaagacgccttctcaggygacgggtccatgctgtgtgggctgcaacctccagtcccagcatgctgactccttcccgcttctccccgtcagcccctgacatcagtgtgggcagcagttcccacagcccaggttcaggatccgctgtcagagatcccccttgcgtggtcctgcagccccatgtggaggcctgttggcagcttacctagctgttgctgggtttgtcatttgaaataaaatgtgtctttagctagtgcgtaaaattgactagatatgaactcagggatcacatgagttgcaggggatttggttttgtttttc

SEQ ID NO: 132514 - DNA, 601 bp, Human
cacacacacacacacacacacacacacacacacacacacacacgccacaaacccagtgaattcaagacgccttctcaggtgacgggtccatgctgtgtgggctgcaacctccagtcccagcatgctgactccttcccgcttctccccgtcagcccctgacatcagtgtgggcagcagttcccacagcccaggttcaggatccgctgtcagagatcccccttgcgtggtcctgcagccccatgtggaggcctgttggcagcttacctagctgttgctgggtttgtcatttgaaataaaatgygtctttagctagtgcgtaaaattgactagatatgaactcagggatcacatgagttgcaggggatttggttttgtttttctggaccagagaatcagaaaggaaccaaaaaaaaataaaaaaaagaaagatataggtgatcctgacaaacccgcgccaaagctgggtggggtgttaaaggggtcgtgcagtctcagacagcagaggggtctgccacacagatgtcatttgcggctgaatgtggcagagtgcttgggtgaccccatccaaagaaaagggagatgtgtgcctgggcacagaggg

SEQ ID NO: 132515 - DNA, 601 bp, Human
agtgagccaagatcgtgccactgcactccagcctgggccaaaaagcaaaactctgtcaaaaaaaaaaagaaagaaagaaaaagaaaagaaaaggaaagaaggaaggaaggaagggagggaaaggaagaaggaaggaaggaaggaaggttggaaggaaagaaggagggaaagagaagaaagaaggaaagaaactgggacttaactgtttaggcattgaagggtcagtgtagaatttagatctagaattttatgatcagggcaatttgggaaaataaacctgtcatgtcttgtaaggtgagcrgtagaaagaaaactactggcagagattccaggggacaacttagggagggttaaacccaggaatgggatagtgtttggagagggtgttttgaaaggagcttctttgtttgctgagattgtggtgtatctacaaggtaagaggctctctgagggcacagtgaatatagatatcagcaagccaggcactgcctctcctgccctctggaggcttccctcttgaaagaggagtagggggtggtcacatgggacaagggagatgtggggcatggttgggagaaggaacattcctggccaggacctt

SEQ ID NO: 132516 - DNA, 601 bp, Human
aaacctcaaactgtaaggtgatggtatacaacatagggcctctgggaggtgattaggtcgtgagggcggatctctcaggaatgggattagtgtacctataaaaaggaccctagagagctcatttgccccttccactatgtgggaatatagctagaagacatcacctatgaggaatgggccctcacctgacaccacaactgccacttccttgatcttggacttcgcaggctccagaactataagaaatgaatttccaggggttataatccatgcagtttatagtattttgttatagtcagcsgaaagaactaagacactccctctcctcctttccctatccttctggaagtatcaatcaaaacacatctctacatatttctagcatcccccttgtagtggacaaccacccctagtcaagacgactacagcatagagaggaggtaggggctggaaaagggaacaaatacttgagagaggatctgatcactaacacctggcggagggggggactttttctcagggcagggttggaggtaggagagttttgtgatgagatttgcctgtaaagaagattaagactgctctgtagagaaacacatag

SEQ ID NO: 132517 - DNA, 601 bp, Human
ttccaggggttataatccatgcagtttatagtattttgttatagtcagccgaaagaactaagacactccctctcctcctttccctatccttctggaagtatcaatcaaaacacatctctacatatttctagcatcccccttgtagtggacaaccacccctagtcaagacgactacagcatagagaggaggtaggggctggaaaagggaacaaatacttgagagaggatctgatcactaacacctggcggagggggggactttttctcagggcagggttggaggtaggagagttttgtgatragatttgcctgtaaagaagattaagactgctctgtagagaaacacataggatctggcaagagtatgccaggaccatgcggttgcacaggacctgagccactgaggccatgggaattattttagtgggactgggggtggcagggatttttttggtagggatgggagtggcagggataaagactgtaagcaccagaggaccaggatatgtcagctgactggaggacttgtttatgtgtgctgatttgctgtcctgagtacaagtgaattcttattacacttttttttttttgagacagagtc

SEQ ID NO: 132518 - DNA, 601 bp, Human
gggttataatccatgcagtttatagtattttgttatagtcagccgaaagaactaagacactccctctcctcctttccctatccttctggaagtatcaatcaaaacacatctctacatatttctagcatcccccttgtagtggacaaccacccctagtcaagacgactacagcatagagaggaggtaggggctggaaaagggaacaaatacttgagagaggatctgatcactaacacctggcggagggggggactttttctcagggcagggttggaggtaggagagttttgtgatgagattwgcctgtaaagaagattaagactgctctgtagagaaacacataggatctggcaagagtatgccaggaccatgcggttgcacaggacctgagccactgaggccatgggaattattttagtgggactgggggtggcagggatttttttggtagggatgggagtggcagggataaagactgtaagcaccagaggaccaggatatgtcagctgactggaggacttgtttatgtgtgctgatttgctgtcctgagtacaagtgaattcttattacacttttttttttttgagacagagtcccattc

SEQ ID NO: 132519 - DNA, 601 bp, Human
tggaagtatcaatcaaaacacatctctacatatttctagcatcccccttgtagtggacaaccacccctagtcaagacgactacagcatagagaggaggtaggggctggaaaagggaacaaatacttgagagaggatctgatcactaacacctggcggagggggggactttttctcagggcagggttggaggtaggagagttttgtgatgagatttgcctgtaaagaagattaagactgctctgtagagaaacacataggatctggcaagagtatgccaggaccatgcggttgcacaggacytgagccactgaggccatgggaattattttagtgggactgggggtggcagggatttttttggtagggatgggagtggcagggataaagactgtaagcaccagaggaccaggatatgtcagctgactggaggacttgtttatgtgtgctgatttgctgtcctgagtacaagtgaattcttattacacttttttttttttgagacagagtcccattctgtctcccaggctggagtgcaggagcacgatctcggctcactgaaatctccacctcccatgttcaagtgattctcctgcctcagcc

SEQ ID NO: 132520 - DNA, 601 bp, Human
tctcaggggcttaacccagtaaagagttatttctcacccatgtccctatccagtggagaagtgcattgttcgcgggtgtgttgagtatgtttttcttattttccatattcctgatgcactggcattaggggccttgattccggagacactgtcctcccagggctagctaattcctgaagttagcaaatgcctcccctgcctgcatgcctttgacatacaaatcaaccaagcccgagcccacacccccagccacctcctttatcaaactctcacccactgagcaggtgttccctttgcccarcagcaccccagggccaggtacccaacaactagggaccatccttacagccctgagcctgccagaattactcccattatacaatcctaagtgtcctcagtcagcatacctaccctgcctcacctgttcctccctgtaagaaccccagtagaggcctgggccatgctcagcgtctctccaacctcctgagctccgtggcgctacctggcatggccttgccaggcatgctgtgcctcctgcttctagcatctgtgagtacgaacttctgcctccatgacaatcattccatgtctgcctgtctta

SEQ ID NO: 132521 - DNA, 601 bp, Human
tttgtttattgtgtgtatatccataaaatatgaaacatgttctatgtcctccctattaaacaaatactttgtatgttttagtccctgactcaaccagattggaaatattggtattagaagaaaattcaaaaagttgtcaaaccatagctacaaattttgactttcagcttagtctcccatgcctgctaacccttttgtctgatcagagttttctctagggccccttagggctaatgtaggtgggacttcaagcacatagatcattgctcttctcaattcagatggattaatgagcagatgrgttgagatggagatgaggaaagacatcctaagctatgttgaggagggagaagatctgagactcaagtttctgctgttaaatccatgaggctgatttagcagctaagaatacaggccttagccttttagagttccctatctgataggagccttagagataactcagttgtcatcatttgcatctgatataaaaatctccattttatgggtggagaattgagactcaaaacctaaacttttaaaaaatgaaataatggcagagctggaacagagagcagggctgttattgggttttgtaact

SEQ ID NO: 132522 - DNA, 601 bp, Human
tactgtctgtctctgtagatgtgcccatttctggacattccatagagatggaatatgtggcctttggtgtctggcttcttcacttagcataaggttttcaaggttcatccatgttgtagcatgtatcagtacttcattcctttttattgcctaataatggtgttctatcatattgatataccacattttaccatttcacagtggatggacatttgggttataaataggctattgtgaataatgaataatgctattcattattttaagctattatgaataattataataatggtgctatagyttttaagtacaaggctttgtgggtttcattcatatgttttcatttctcttggatgtgtacctaggagtacaatggctaggtcacatggtaactgtacataacgctctgaggaactgcctcacagttttccagggtttgcaccgttttactttcccaccagcagtgtatgaaagatctaatttctccacatcttgttattgtctgtttttctgtaggcaccccggtgggtgttaagtggtatctcattgtggttttgattttatatttctttgatggctaatgatgttttgctgttcttca

SEQ ID NO: 132523 - DNA, 601 bp, Human
gaagtttgtattgtattttattttaattaatttaaatgtaaacaactaaatgcagctggtgattaccatattgggctgcacagttataacacgactagtatcatcctcttagatagactgctacagtcatttctaagctggctttgcatttattattatcctatttatggttatctatggtccattctcccataaaagctggactattcctttaagaatgtaacttattccatttcattcccagctctgaatcttccagtggttacctattacaattaacaaagaaatccaagctctttgytgtggtccacatttgtctgcccctttgactgtctgccttctccttttccttctcccagtgcctgcagccccactggtcttcgtaatgatccttgagctcatcaagtgctgtctgcattcagactctgcacagtttctctcctctgtctggaacactcaccctgtagatccccatttaactctctccctcgtaccattcagatctgctcaaatgtcacctcctcagaaagattgttccagagctccctatctaaaatagccatgctattactctaccttatagctcctgtgttttattctt

SEQ ID NO: 132524 - DNA, 601 bp, Human
caggcatttaaaagtgttgcacctgttagtaaaacagtcttaaggccagttcctgaaaagtgaactcctacaattttgagtaactatttgctaatacatcagcatgttgccttcttgggattaattcagcctttcttttacttttttaacttgctcccttccttcccttttaatgaagtcatgcctaagctccagtctgtccttgtcccctctcccctaagctttgagaccgttcctttttaagtcagtggccatgtctcgccccgttctcccgatataactcttactttacccagcagcrgggcctccgtttagtgcagcccgtgatgttgctttcctggttcatcttcccttatccacagatttacctggctggaatcgggagactgtgtgtgcccaggggctggattcggagacccatgcttctgcagttccacttatgactccatcattatgctgttttaggaaaataaatagatattgattctctaataagagtgggattgttcaacaagcattgggaaaatctgcgagcccagatatgtatgtatagcagctactggttggaaatttgaacacaagcatccttatctacccagcc

SEQ ID NO: 132525 - DNA, 601 bp, Human
tgtgcccaggggctggattcggagacccatgcttctgcagttccacttatgactccatcattatgctgttttaggaaaataaatagatattgattctctaataagagtgggattgttcaacaagcattgggaaaatctgcgagcccagatatgtatgtatagcagctactggttggaaatttgaacacaagcatccttatctacccagcctgcgggccacagaccagaactgagtataaaaaaagaataaaaccaaatgccacatgttgtctcttataagtcagaactcaacattgagtayacatgaacataaagaagagaacaatagatgccggagaacttgacaagagagggagagaggaaaggcttgaaaaactacccattgggatgccaggcacggtggctcacgcctgtaatcccagcactttgggagcctgaggcgggtggatcatgaggtcaggagttcgagaccagcctggttaagatggtaaaaccctgtctctactaaaaatacaaaaattagccaggcatggtggcgggcacctgtaatcccagctacttgggaggctgaggcagagaattgcttgaatccaggaggcgg

SEQ ID NO: 132526 - DNA, 601 bp, Human
ctgcgcatgtaccccaaaatctaaaacaaaagttggaagaagttgaaagaaataagaataaaggaaggttggcagtgtcatccaaggaaactaagcctgatattaaaataggctctgaccactcaggataaaaaacagacttctctgtgcaggtgtagcggagatgatgaaacaactctattagcattctgccttagtggttgttatagtcatagccatccttgaaaagaaaaaaaaaaaaaggaaaatataggaaaactgaggcttaaaatccttcttctattttctaaacttctgtcaytggagtgcttgcgttcccccaggtgatagactccggaagctcatacagttgcagatgagaacatgagtaataaatacccccaaaattctttccaagttcagtcatgatgaattggtttaatatgcatgtagttatctttttattggtccataattccaatttagcaaaatgtaaagatgaatcataaagaatacctggaaaaagccccaacattgatggcacttaataaagatagatgagtatgttcttactcctttttttaaaacaaactggacaaagataaattttaatgtttacaaa

SEQ ID NO: 132527 - DNA, 601 bp, Human
gccatccttgaaaagaaaaaaaaaaaaaggaaaatataggaaaactgaggcttaaaatccttcttctattttctaaacttctgtcattggagtgcttgcgttcccccaggtgatagactccggaagctcatacagttgcagatgagaacatgagtaataaatacccccaaaattctttccaagttcagtcatgatgaattggtttaatatgcatgtagttatctttttattggtccataattccaatttagcaaaatgtaaagatgaatcataaagaatacctggaaaaagccccaacatygatggcacttaataaagatagatgagtatgttcttactcctttttttaaaacaaactggacaaagataaattttaatgtttacaaaaatgtaaatttcagtgcagatcaagcgtttggttggttggttggttggaagcttgactttatttgcttcatttggagagaatataagatgaaaaagttcatcattagaaagagaagtaagcattagagtcacaggatgggattttgaaatactctgtgagttgattgatgttcctaaagttccctgtttaatgctctgagttaaataggtggcc

SEQ ID NO: 132528 - DNA, 601 bp, Human
aacattgatggcacttaataaagatagatgagtatgttcttactcctttttttaaaacaaactggacaaagataaattttaatgtttacaaaaatgtaaatttcagtgcagatcaagcgtttggttggttggttggttggaagcttgactttatttgcttcatttggagagaatataagatgaaaaagttcatcattagaaagagaagtaagcattagagtcacaggatgggattttgaaatactctgtgagttgattgatgttcctaaagttccctgtttaatgctctgagttaaatagrtggccatgctcagcttcttggatgttaatagtaacttctttgtttttcagatactgtgttgacaagtggtcatgctaccgactatttatttgttggaaatattgtttacacagtaagtttatctctgtttattaagccattcttaaacagcttatgtgtggcttgcacttctctaaacccttaaaaagggccttcctcattattattatttatttcaaatcttcaaaatgtattttatatatccttcaaagttcagaatggttgtgaaatgcttacatcatcgtttctgaaggttatgcc

SEQ ID NO: 132529 - DNA, 601 bp, Human
ccatatctaggccagtgtgcacactgggccaaaggggcagctgttttcaagggtgtgcactgagtagatgatgtttgcaccgatgttcccgcccacatttgcaggatgcttgtgcaggggcacagaacccagggtgggatgggaactgtgggtcaggctttcattggtgttcctgccccaggatacatactttagggccaggcctgttcatggcacacctggctgctatctctgctttacttactctgtagaaatgagcaaaacctcctgggtctatccaagtctggaccatgtctagcarctgtttctcgtgagatagcccagggtagcattacttgccatttcacctggtagctctgtcagctaatagcccaggtcgtctgagacctccactgagtgtgggtgctgagcaggacggacctgtcctataggagtgggcttgcatgtcctctagtgcatctttgctttctgtgaggaaagaggacaaacatataacatgcttttcagtttttttccaaatccagacagtagaggaaattagagggcgttcagtgaacccagaagattgttgtgtagcaaaatgagcattttccaacaaaga

SEQ ID NO: 132530 - DNA, 601 bp, Human
gtcgtctgagacctccactgagtgtgggtgctgagcaggacggacctgtcctataggagtgggcttgcatgtcctctagtgcatctttgctttctgtgaggaaagaggacaaacatataacatgcttttcagtttttttccaaatccagacagtagaggaaattagagggcgttcagtgaacccagaagattgttgtgtagcaaaatgagcattttccaacaaagatattttgtgtttaaataaatcagttctattttaaagcaatgtgattgatccccacaaaaagcaaaccaagaaaaktatccactacaagacaacgatccattggtaaggcattggtgcttagaatatctgctttgtgttctcttccttctggttcaggatggatctgctgtgatgaatatttcatttggggaattttgtggtgatggacaatagatggggcctcagccaatggccatagacagtgttctaaattagagagtgacagctgacaggacggggtcgcttggcatgtgactgacagacaaagcccattcctttgaaagctcctcctgagtcctaaacagagagctgtgccagggaaccacatgtacttca

SEQ ID NO: 132531 - DNA, 601 bp, Human
attagttttttagataacattccagaaaacactgaatgagcatatcttaaggttactggaattaatctttaatgcaatattgaatagactcggtccagttttcctcaagtatcgtattttagaaacccgtggcatggctggtgaggagcggtcagcctcgtcaaggaggaagtcctatcagcagagattcacctttcggtttggaataacatcgtgacatctttttgtacagttttcttgagtattgaaattggcccaattattcattgaagtccaattcacattctggcttttcaactcrtacattttgtggaatagtgagactcatttgcaagaagtaacacactgtgtttctggatgacattctcatctgaatgcaaagcacaatgagcgaagttaagacagtaccgacttcctggcttctgctgcacctgtgactgttgtcgcctgcaccccagggtcccccatccgtgtgcatttccttcctagaaggctcccaacaccagtccctttctgaggcaatccctagaaccaaaaacaaaactatagcaacaacaacaaaagcactttgggaggcctgggtgggcggatcacaagttca

SEQ ID NO: 132532 - DNA, 601 bp, Human
atggctggtgaggagcggtcagcctcgtcaaggaggaagtcctatcagcagagattcacctttcggtttggaataacatcgtgacatctttttgtacagttttcttgagtattgaaattggcccaattattcattgaagtccaattcacattctggcttttcaactcgtacattttgtggaatagtgagactcatttgcaagaagtaacacactgtgtttctggatgacattctcatctgaatgcaaagcacaatgagcgaagttaagacagtaccgacttcctggcttctgctgcacctrtgactgttgtcgcctgcaccccagggtcccccatccgtgtgcatttccttcctagaaggctcccaacaccagtccctttctgaggcaatccctagaaccaaaaacaaaactatagcaacaacaacaaaagcactttgggaggcctgggtgggcggatcacaagttcaggagatagagaccactctggctaacacagtgaaaccccgtctctactaaaaatagaaaaaattatccaggcatggtggcgggcgcctgtagtcccagctactcggaaggctgaggcaggtgaatggcatgaac

SEQ ID NO: 132533 - DNA, 601 bp, Human
agtgagactcatttgcaagaagtaacacactgtgtttctggatgacattctcatctgaatgcaaagcacaatgagcgaagttaagacagtaccgacttcctggcttctgctgcacctgtgactgttgtcgcctgcaccccagggtcccccatccgtgtgcatttccttcctagaaggctcccaacaccagtccctttctgaggcaatccctagaaccaaaaacaaaactatagcaacaacaacaaaagcactttgggaggcctgggtgggcggatcacaagttcaggagatagagaccacyctggctaacacagtgaaaccccgtctctactaaaaatagaaaaaattatccaggcatggtggcgggcgcctgtagtcccagctactcggaaggctgaggcaggtgaatggcatgaacccaggaggcggagcttgcagtgagccgagatcgcgccactgcactccagcctgggcgacacagcgagactccgtctcaaaaaaaaaaaaaaaaaaaaaaaccttttaattggtaataaagaaaaatcagaaacattcagttgagcagtgctagctaagtgagttctcacagcctgtaaatatt

SEQ ID NO: 132534 - DNA, 601 bp, Human
tgactatggaaagcagctacagtgatgatgaaccaggtgtttgagaaatgttgctcaattctccttaacgttttgcttttaataaattttatctgaagtgacttaccccgcaatgcaatagaatttttaaaatatgaatgttgagttagaaggaataagcagactttgtgtttgagctgcaatcttctgtccacgagcccaatcttttttaaagtaaagcaggtttcaaacaacaggatttattttttacgttcattatagaaagccctcatttttttagtccttgtcctcccttcccccrtatacaatttcctccattttggcagtttattttctttttggcctctcatttcaaggatgctgtgtgttaattagaggccccgcggctttgattgagtggtttttttttttcttcagaggttttgttgtggtgttggcatttgtcattcattctgatgttaatttttaaaatatctgtcagcaaattaaagtacacattacatgctgattttgtttgtttgtaatatttatgctcagtggtcacagtgtacgtctgatgtggttttgaacttttcctttcttgaaacatgtggaaatgtgt

SEQ ID NO: 132535 - DNA, 601 bp, Human
cagtggcgcaatctcagctcactgcaagctccgcctcccaggttcacaccattctcctgcctcagcctcccgagtagctgggactacaggcgcccaccaccacacctggctaattttttgtatatttagtttcaccgtgttagccaggatgttgttgatctcctgacctcatgatccacccccatcagcctcccaaagtgctgggattacaggcgtgagccaccgcacccagcctttaccccataagtatctcttaaatatatctgtttccacccagtttcatcccatccagttagtttgygcagcatcatttcttgcgtggacaattgcagtagtctcatgactagttcttagcatctgatctgcctggacccattcctctaccggagccagagtgatcttgccaaatgtaagtctgatgtcattgttccctggcttcctgttgccctcaggataaagcctggggacatttacctggcccctgaggccctgcgaggcttaccactgctccctttatgctctccctcacctcatccacactggtggcttcccacttcctggtgtgaggagcgagctcctacagggcgtttgtgcctgctcc

SEQ ID NO: 132536 - DNA, 601 bp, Human
tgctgggattacaggcgtgagccaccgcacccagcctttaccccataagtatctcttaaatatatctgtttccacccagtttcatcccatccagttagtttgcgcagcatcatttcttgcgtggacaattgcagtagtctcatgactagttcttagcatctgatctgcctggacccattcctctaccggagccagagtgatcttgccaaatgtaagtctgatgtcattgttccctggcttcctgttgccctcaggataaagcctggggacatttacctggcccctgaggccctgcgaggcytaccactgctccctttatgctctccctcacctcatccacactggtggcttcccacttcctggtgtgaggagcgagctcctacagggcgtttgtgcctgctcctctcacttcctgactgcactggtctccgcctcctaccaagttaatgcttacacgatgtttagatctcagatgcttgatcacttcccaagggaagcctttcctcacatcctggacctacgtgctcctattgtatgttctcttaacacagtttacctttcgcttgttgtataatactcaccacaactaaaactctacata

SEQ ID NO: 132537 - DNA, 601 bp, Human
atgtcattgttccctggcttcctgttgccctcaggataaagcctggggacatttacctggcccctgaggccctgcgaggcttaccactgctccctttatgctctccctcacctcatccacactggtggcttcccacttcctggtgtgaggagcgagctcctacagggcgtttgtgcctgctcctctcacttcctgactgcactggtctccgcctcctaccaagttaatgcttacacgatgtttagatctcagatgcttgatcacttcccaagggaagcctttcctcacatcctggacctaygtgctcctattgtatgttctcttaacacagtttacctttcgcttgttgtataatactcaccacaactaaaactctacatactaatgtatgaggtgtcatctcacacccattgggatggccactcttagaaacacaagaacagaaaacagaaaataagtagttggtgaggatgtggagagatcgaaacgcttgtgacctgtcaatggaagtgcaaaatggtgcagctaatatggaaaacagcacggaggtggctcaagaaattaaaaatagaactaccatataatttggttaccccacttc

SEQ ID NO: 132538 - DNA, 601 bp, Human
aagatacatggatgaacaaaatacaatatatacacacaatgggatgttattcaacctcacaaaagaaggaaatcctgtcaccattctacaacatggttaaagttgaggacattatgtaaagtgaaatattctaacatggttaattaagaattgaggacattatgcaaagtgaataagccagtcacaaaaggcaaatactctatggttctgcttgtatatagtgagtactcgtagagacaggaagtgccatggcagttgccggggctgggggaggggaaatgaagagctgctgtttaatagccagagttgcagttttgccacatgaaaacgttttagagagccgttgcacaacagtgtgacttcggttaaccatactgaactttccttaaaatggctaagatagtaaatcttaagtttttatcacaattttaaaaatgtacgtttgtgtgatttactgattcatatcagcttctctctgtaaactggaagctctgtgagtgaagtgaatattctcaaatatatccttagtacctagtacccatctttttttggtattcagtaaatatttaaatgaaggaattcataacattgaacaacctct

SEQ ID NO: 132539 - DNA, 601 bp, Human
ctagagttaggagttgtccagaaagttacagtttgggtccagatggtctacagagctcacctctttgtttttaaaaattcgatagggtgaaatgagcttccaacacttaaagctccaatcatggaacatctgactcataaagcgatgtttgaagctgtattttttgtgacttctccatgttgttttactttgtttcattgagttgtttatattcattcgtgttgtatgtctcttgccttctttaagttagttcttagttgtctttccttttgatgtccttggcaccgacctggtcctcccsccgaccccacaattctgtttccagttcagtagtagttacttaagggtgtctcctcccatgttccttagagcaagtgcctttctaaactttcatactagccatgtggcataagtgtctgtttagtttatctttcccaatttttgcctagagactcctcttaagctgtttactgccaaaatcaccattgcagttaattctaaagccattgtataagcccccaagcccttcagacatgtcaaggaaagtagctgtgttcattaaggacaatacttagtgctttcaattgctgacaaagggaac

SEQ ID NO: 132540 - DNA, 601 bp, Human
tgttttatcagcaaggtctttatgacctgtattttgtgccaaccttgtatctcatcctgtgacttagaatgccttaattgtctgggaatgcaagcccagtaggtctcagcttcattttacccagcccctattcaagatggagttgctgtggttcaaacgcctctgacaaccagtacctcaggctctcaactctctgaagcacagttcctgccttcccatcgccccagcaccttccactcactctgtctccactcacgtccatcaccacttccccaggcacaggagcttaaaaccatcagcygccttcccactctctctccctcatccctcacatccagagcagggtcatgagtgttcactcctgcagctgtgtcgtttgtgtgtcccagcatttatagcattctaccaccggtctccttgcagatcaccatgcgatttgctcccagagggcacaagccatgtgcacacatacttggtctatggggcatgtggacggggcaggagagcagagggcatttggctctgaggacaagaatttaagtcaactcaaagaatcaggactttgtgtatcttcttttgttgtggtttattcccacaaaag

SEQ ID NO: 132541 - DNA, 601 bp, Human
tttcactcctgcctcctgaacctccacctttgggagggtcagtggcccttagcaaaccaggacaagttggagttacatgggtctctgttcccttctccatcacagcagctttgggaaggattcaacaagtttatgtcagtccttggggattggggatgatggctgcacagtgttggaggaaggaaatcatgtcgggacctcattccctgccactcaccacccacacgccccactcccaagtattcaagggccaatttgtttgtggataaagcagatcccccgcttctgctcccacttctcrcgggtgccttctagcttcctttgctcattagcaggctcttagaaggcaggctgcagaaggaggcaagagatcactccaaaatcagaagtgctttggctggcacttcccagcagcttccttgggaagatagaggatgttgtgatcgcctggtctgggacagtgatgagctttctccctcctgatcctctgtcagatgcaggcagtccccgctgctctgagctcttcaactgttactctaaccttggcctgagactctcctaagcatgctttgaaaagtaaaattcgtgagaatggggccca

SEQ ID NO: 132542 - DNA, 601 bp, Human
ttctctaatgtctcttttcctgaccctggccctctctccttcttttggggtggctggcatgcttctcacagaggccatcgtaaaggctggggaggagggctggagcctgctggggtaatagtgcctgtcctgcccagctcatctgcagagcccccggggttggcgactgcagcagtctcagcacatcagtcccgaaccagagaaattgcagtgtcctgctgtttttcattatgctattttcttcctatttattctatggtcttgtttctcttagaattaaacaatcagaaactgatatgargggaattcaatcagagcagggtatttgtggagccagggcatttctcctctttgacacagccacatggcttgttttcatgcattactccttaataatgtgtttatttatctagactcacacgattctctcttgccctgggtaatccactattaaccgttaataaccaggatccctagtgaaggaagggatttttcaaagaaaagcaaagggaattgcaggtttgaaattctagagagaatttcggtgggggtgagaatacaccctcactgaagagaatgtgggaaaataactgagagtgct

SEQ ID NO: 132543 - DNA, 601 bp, Human
tgtatttttggtagagacggggtttcaccaggttggccaggctggtctcgaactccctgacctcaggtgatctgcctaccttggcctcccaaagtgctgcgattacaggtgcgagccactgtgcccggccagatctgagccatttgatccctgccttcatccctattaactgataatttatctattcattagggggctctgtgaggtgggttctgactgatgttggaggggatgcgctataattcctgcctctgcatttaagtgtatgagtgtttcaccagggatgtccaaactgtcccaytttgggtaaaggacaaaaagcaggccaaacaagattttcttttgtctgacacaatttaaaaaaatattgcaaggtaaaatatttaacagaatgattgtactgggttggtagtgtgtgcgtgtgtgtggtttgcttgattttgaggcttcataatcttttaaaaagatggagatgtatgaccttcaaagcctttttctttttttttttttggagatggagtctggctctgttgcccaggctggagtgcaggggcgcgatcttggctcactgcaagctccacctcccattctcctgcctcag

SEQ ID NO: 132544 - DNA, 601 bp, Human
catttgatccctgccttcatccctattaactgataatttatctattcattagggggctctgtgaggtgggttctgactgatgttggaggggatgcgctataattcctgcctctgcatttaagtgtatgagtgtttcaccagggatgtccaaactgtcccactttgggtaaaggacaaaaagcaggccaaacaagattttcttttgtctgacacaatttaaaaaaatattgcaaggtaaaatatttaacagaatgattgtactgggttggtagtgtgtgcgtgtgtgtggtttgcttgattytgaggcttcataatcttttaaaaagatggagatgtatgaccttcaaagcctttttctttttttttttttggagatggagtctggctctgttgcccaggctggagtgcaggggcgcgatcttggctcactgcaagctccacctcccattctcctgcctcagcctcccgagtaactgggactacaggcgcccgccaccacacctggctaatcttttgtacttttttagtagaggtgaggtttcactgtgttagccaggatggtcttgatctcctgacctcatgatccacccgcctcagcctc

SEQ ID NO: 132545 - DNA, 601 bp, Human
aggggatgcgctataattcctgcctctgcatttaagtgtatgagtgtttcaccagggatgtccaaactgtcccactttgggtaaaggacaaaaagcaggccaaacaagattttcttttgtctgacacaatttaaaaaaatattgcaaggtaaaatatttaacagaatgattgtactgggttggtagtgtgtgcgtgtgtgtggtttgcttgattttgaggcttcataatcttttaaaaagatggagatgtatgaccttcaaagcctttttctttttttttttttggagatggagtctggcyctgttgcccaggctggagtgcaggggcgcgatcttggctcactgcaagctccacctcccattctcctgcctcagcctcccgagtaactgggactacaggcgcccgccaccacacctggctaatcttttgtacttttttagtagaggtgaggtttcactgtgttagccaggatggtcttgatctcctgacctcatgatccacccgcctcagcctccaaagtgctgggattacaggcgtgagccactgcgcctggcacctttttctcatttttattagtaggtagtgtcagcttgggttctt

SEQ ID NO: 132546 - DNA, 601 bp, Human
aagattttcttttgtctgacacaatttaaaaaaatattgcaaggtaaaatatttaacagaatgattgtactgggttggtagtgtgtgcgtgtgtgtggtttgcttgattttgaggcttcataatcttttaaaaagatggagatgtatgaccttcaaagcctttttctttttttttttttggagatggagtctggctctgttgcccaggctggagtgcaggggcgcgatcttggctcactgcaagctccacctcccattctcctgcctcagcctcccgagtaactgggactacaggcgcccsccaccacacctggctaatcttttgtacttttttagtagaggtgaggtttcactgtgttagccaggatggtcttgatctcctgacctcatgatccacccgcctcagcctccaaagtgctgggattacaggcgtgagccactgcgcctggcacctttttctcatttttattagtaggtagtgtcagcttgggttcttactgtgcacagcctatcttggcacagggtggcatctctttagttatgagacattcaatttggctttatgggtggaatttacttgatgcctatgaaaaataagtta

SEQ ID NO: 132547 - DNA, 601 bp, Human
taaaatatttaacagaatgattgtactgggttggtagtgtgtgcgtgtgtgtggtttgcttgattttgaggcttcataatcttttaaaaagatggagatgtatgaccttcaaagcctttttctttttttttttttggagatggagtctggctctgttgcccaggctggagtgcaggggcgcgatcttggctcactgcaagctccacctcccattctcctgcctcagcctcccgagtaactgggactacaggcgcccgccaccacacctggctaatcttttgtacttttttagtagaggtgrggtttcactgtgttagccaggatggtcttgatctcctgacctcatgatccacccgcctcagcctccaaagtgctgggattacaggcgtgagccactgcgcctggcacctttttctcatttttattagtaggtagtgtcagcttgggttcttactgtgcacagcctatcttggcacagggtggcatctctttagttatgagacattcaatttggctttatgggtggaatttacttgatgcctatgaaaaataagttaaaaggcaatggaaacaacaaatggaaacatttctctctctctct

SEQ ID NO: 132548 - DNA, 601 bp, Human
aaaagatggagatgtatgaccttcaaagcctttttctttttttttttttggagatggagtctggctctgttgcccaggctggagtgcaggggcgcgatcttggctcactgcaagctccacctcccattctcctgcctcagcctcccgagtaactgggactacaggcgcccgccaccacacctggctaatcttttgtacttttttagtagaggtgaggtttcactgtgttagccaggatggtcttgatctcctgacctcatgatccacccgcctcagcctccaaagtgctgggattacaggygtgagccactgcgcctggcacctttttctcatttttattagtaggtagtgtcagcttgggttcttactgtgcacagcctatcttggcacagggtggcatctctttagttatgagacattcaatttggctttatgggtggaatttacttgatgcctatgaaaaataagttaaaaggcaatggaaacaacaaatggaaacatttctctctctctctgtctctctgtctctctctctctctctctctctctccttccacctgtgttatgcagatgtactgggaatgaaaaataagtcaaaagg

SEQ ID NO: 132549 - DNA, 601 bp, Human
gactacaggcgcccgccaccacacctggctaatcttttgtacttttttagtagaggtgaggtttcactgtgttagccaggatggtcttgatctcctgacctcatgatccacccgcctcagcctccaaagtgctgggattacaggcgtgagccactgcgcctggcacctttttctcatttttattagtaggtagtgtcagcttgggttcttactgtgcacagcctatcttggcacagggtggcatctctttagttatgagacattcaatttggctttatgggtggaatttacttgatgcctrtgaaaaataagttaaaaggcaatggaaacaacaaatggaaacatttctctctctctctgtctctctgtctctctctctctctctctctctctccttccacctgtgttatgcagatgtactgggaatgaaaaataagtcaaaaggcaatggaaacaacaaatggaaacacctctctctctctctctctctccctcctcctctccttcccctttcttccacctgtgtcatgcaggtgtactgggacacagcatacagtgcgatgctctcctttgtgcctgggagatgctccctccatccccc

SEQ ID NO: 132550 - DNA, 601 bp, Human
aagtctgcagaggttattgctgtcttttgtttgtctgtgccctgcccccagaggtggagcctacagaggcaggcaggcctccttgagctgtggtgggctccacccagttccagcttcccagctggccaccttgtttacctactcaagcctgagcaatggtgggcgcccctccaccagcctcgctgccgccttgcagtttgatctcagactactgtactagcaatgaacgaggctccgtgggcatagaaccctccgagctaggtgccggatataatctcctggtgtgccatttgtgaagccygttggaaaagcgcagtattagggtgggagtgacccgattttccaggtgctgtttgtcacccctttctttgactaggaaagggaattccctgaccccttgcgcttcccgggtgaggttatgccttgccctgcttcagctcacgcatggtgccctgcacccactgtcttgcacccactgtccggcactcccctgtgagatgaacccagtacctcagttggaaatgcagaaatcacccgtcttctgtgtcgctcactctgggaactgtagactggagctgttcctattcggccatgttggctc

SEQ ID NO: 132551 - DNA, 601 bp, Human
gtggtgggctccacccagttccagcttcccagctggccaccttgtttacctactcaagcctgagcaatggtgggcgcccctccaccagcctcgctgccgccttgcagtttgatctcagactactgtactagcaatgaacgaggctccgtgggcatagaaccctccgagctaggtgccggatataatctcctggtgtgccatttgtgaagcccgttggaaaagcgcagtattagggtgggagtgacccgattttccaggtgctgtttgtcacccctttctttgactaggaaagggaattccytgaccccttgcgcttcccgggtgaggttatgccttgccctgcttcagctcacgcatggtgccctgcacccactgtcttgcacccactgtccggcactcccctgtgagatgaacccagtacctcagttggaaatgcagaaatcacccgtcttctgtgtcgctcactctgggaactgtagactggagctgttcctattcggccatgttggctccaccccaagtccagagaagcttattgctggcgagcgtggaaacatgcatgcatgggtttctgtctgagtgctggagctctgtagagcaa

SEQ ID NO: 132552 - DNA, 601 bp, Human
gctgccgccttgcagtttgatctcagactactgtactagcaatgaacgaggctccgtgggcatagaaccctccgagctaggtgccggatataatctcctggtgtgccatttgtgaagcccgttggaaaagcgcagtattagggtgggagtgacccgattttccaggtgctgtttgtcacccctttctttgactaggaaagggaattccctgaccccttgcgcttcccgggtgaggttatgccttgccctgcttcagctcacgcatggtgccctgcacccactgtcttgcacccactgtccrgcactcccctgtgagatgaacccagtacctcagttggaaatgcagaaatcacccgtcttctgtgtcgctcactctgggaactgtagactggagctgttcctattcggccatgttggctccaccccaagtccagagaagcttattgctggcgagcgtggaaacatgcatgcatgggtttctgtctgagtgctggagctctgtagagcaagggcagcttgggatggcctgccagtatgccctggcaattctgtgttacaggtgctgtcctttctgctccttgtggtgtgacatgccacaact

SEQ ID NO: 132553 - DNA, 601 bp, Human
tgaccccttgcgcttcccgggtgaggttatgccttgccctgcttcagctcacgcatggtgccctgcacccactgtcttgcacccactgtccggcactcccctgtgagatgaacccagtacctcagttggaaatgcagaaatcacccgtcttctgtgtcgctcactctgggaactgtagactggagctgttcctattcggccatgttggctccaccccaagtccagagaagcttattgctggcgagcgtggaaacatgcatgcatgggtttctgtctgagtgctggagctctgtagagcaarggcagcttgggatggcctgccagtatgccctggcaattctgtgttacaggtgctgtcctttctgctccttgtggtgtgacatgccacaactcatttaaccccctgcctgggtatgtctgacaaattgagaatatagaacctgatttatctagagttttgccagataatgcatacgggtgtctggtatactctcctgaaaatatactatggttatacagagaattacaatagcaagtgactgggtacttcctgcagatggcagggataatagaggcctcccaggagggccactatctcgac

SEQ ID NO: 132554 - DNA, 601 bp, Human
aggtctttgtaaaggacagagcaagaaacttgattttcctgcagatgggatggagagtctttggagagctttaataggaaaatgacatgctctgatgtctatttccaaagctcaccctgcctctctatggggaaaaaataggtggtacaggggaaagagtggaggcagggagtccagctgggtgatggggacttggagttgggagtcaggtggacatgaggcacacagctgtgttcgaggatgctgggacctgcccagggactggagtagaagctgtcaactgaagaataaccaggatcakacatttggaagagctttatttctcataaagggttatagcctgcaggctggccattcctcctgctgggaggcagagctgagagggagggaggataagacaggaatttatgctgaaatttctgggtggctggaaatacatatttaatgagctataggaggagtcatgaatatttatgagaggagaaacatgtacaggcacaattgagttccatgcctcttcatggattacatgttcaaaaaatggcagtgttagcatgatctgaggtggagttttcagccctctgacatgaaaaggtgcagt

SEQ ID NO: 132555 - DNA, 601 bp, Human
gcctgcaggctggccattcctcctgctgggaggcagagctgagagggagggaggataagacaggaatttatgctgaaatttctgggtggctggaaatacatatttaatgagctataggaggagtcatgaatatttatgagaggagaaacatgtacaggcacaattgagttccatgcctcttcatggattacatgttcaaaaaatggcagtgttagcatgatctgaggtggagttttcagccctctgacatgaaaaggtgcagtggaggacaccagaacctcactgcatcctctgagagtcrgccaaaacgtgtcccaaggtggtcgtcagtgtttacgaagggatgtgttgtgagacaggtgagctgtcacgtggaagaagtgaagagggaggggcatctggtcgcagtttcagatgattggctaaggtgataaaggaatgagttgtccatttctcattttccagagctgatttctgcttactccttagaaagagttttggctaaaggttaataaggaaggggcacactgaggcgtgttcaaccttatgtctgatgtggtcaaaaactccgtttttaaggtttctccaaggtctccttggc

SEQ ID NO: 132556 - DNA, 601 bp, Human
cacatggaagcagcaggaacacccctgagcatcttcatggagtttggatcaagatggaagaaaagcccatgcgttgtctaaggctgcctcatctcagaagccaatgggcggtgtaattagtgctgaaaggtgggctgggggatgactgcattgctctagcaaggaaggaggagcagggagctgaagggagacaggtggaggaggccaagcaactggctaagcccatgagggctaagggaggcctaaaatgcgggacattggagaggaaatgttctggaagcttctacaggcaaactgcatkgtactggaaggggccgatgaatagtgctgggtcaagggtttttaagtggaattgagaataagggaagcagaaaggtggtttgaagaggcgaaaaaaggaaaatggactgaaccgaaagggccttgggagtgttatgggattggagaacttttcctaaataatttaggagctccagtagaatttatgtttatgtgaaagaaaaaaaaaaaaccacatgttacttagaattgggaagttttgtgcacccatgtctaggaattaaattttatatgaattcatatattatatattatatataca

SEQ ID NO: 132557 - DNA, 601 bp, Human
ttaagtagcctcatagttatagaaaaggataacaaaaaaattttttggcaatctagtggaataggggtatggggtttaaaaaggacaatgaaaaagttcactgagcaggaaaggaatggaagattgctcaacagatctacaggaaaccattcccccgccatcacctctgcatttcaaaaagcaaatgcaattccggtcagaagacattgtctacttcggagtgatatgcttataatctatctgtgtgtgttttttaactcttacagtgaagcttcaattatatcttcttaaccccttcccmaagccttgggaaacactggacatttttctatataagcagattgggttatttgtccaaatgacgggtgtttttgaactaggacatctagcttctatccataggaaaccccatatctggtgggcaaagaatagagtataaatattatgtatctgatatttacactttgggccataagtgtttgaaacagttatatctattcatgtgaaatttctgttcacattatagcaacaacatcaatttaaaaaaaaaaaaacaaaaaagaattccccaagactgtccattctgcgtgtgtgtatgcac

SEQ ID NO: 132558 - DNA, 601 bp, Human
gctgaaaatactttctttccattctctgatgggtgagttgctcaaggataaagtttggattcaaatgtcagtgttatagttttccctaatgctctctctttttcctcacatctccccccggtaattaatggttgcttatataacacattgtgtgtcatatccatatcctacaccattggagttcctcattctctcatcagactctgagcacctgaaggataagaacatttcattgatttatcctcaacattcagcgaataatcacatatagttcttttaccctcagtgtctgccaaattgycaaatatggttgtttagtgtgccaaaacaaaagttatgttattgatgtgaggtatctctttatcaagtttttccgagtattcagtagtcagatacctgcatgcgcatggctgtaagcatgtgtacgccccacccccgccaccgccccgaggagaagagtgtgtgcccagcctgggcccttggtcctgaagggagagcacgtcacccattgtcatgttattatccattaacgtgacattgtatcttctctctacccagagacatcacccatcttctcctcattcctgaagacctaacttta

SEQ ID NO: 132559 - DNA, 601 bp, Human
ccgtctctaccaaaaatgcaaaaaactagccggcgtggtagtgcacacctgtagtcccagctactccggaggctgaggcaggagaatcacttgaacctgggaggcagaggctgcggtgagtaaccactgtgctacccgtgtggagatcgcgccactgcactccagcctgggcgacagagcgagactccatgtggagatcacgccactgcactccagcttgggcaacaaagcaagactccatgtggagatcacgccagtgcactccagcctggcaggagagcgagactccatctcaaaaataaataaaaaaataaaataaaaggagctaagttaaagttgaatgctcagttggataatcgtttactaacaattgataggagcttggcctctggtgagtttctagatgacagtggtcttagacctgtctctatcccttgctgttttcattcatacagtaaagaggtttattgactgagccactcaacaaccatttcgtaatatctatgatggggatacgttgatctttaagggtcctttcaactgtaaaacagcgttgatgacattttctgaagacaaacaaacactcaaaagccttacttct

SEQ ID NO: 132560 - DNA, 601 bp, Human
ctctaccaaaaatgcaaaaaactagccggcgtggtagtgcacacctgtagtcccagctactccggaggctgaggcaggagaatcacttgaacctgggaggcagaggctgcggtgagtaaccactgtgctacccgtgtggagatcgcgccactgcactccagcctgggcgacagagcgagactccatgtggagatcacgccactgcactccagcttgggcaacaaagcaagactccatgtggagatcacgccagtgcactccagcctggcaggagagcgagactccatctcaaaaataaataaaaaaataaaataaaaggagctaagttaaagttgaatgctcagttggataatcgtttactaacaattgataggagcttggcctctggtgagtttctagatgacagtggtcttagacctgtctctatcccttgctgttttcattcatacagtaaagaggtttattgactgagccactcaacaaccatttcgtaatatctatgatggggatacgttgatctttaagggtcctttcaactgtaaaacagcgttgatgacattttctgaagacaaacaaacactcaaaagccttacttcttaac

SEQ ID NO: 132561 - DNA, 601 bp, Human
taccaaaaatgcaaaaaactagccggcgtggtagtgcacacctgtagtcccagctactccggaggctgaggcaggagaatcacttgaacctgggaggcagaggctgcggtgagtaaccactgtgctacccgtgtggagatcgcgccactgcactccagcctgggcgacagagcgagactccatgtggagatcacgccactgcactccagcttgggcaacaaagcaagactccatgtggagatcacgccagtgcactccagcctggcaggagagcgagactccatctcaaaaataaataaataaataaaataaaaggagctaagttaaagttgaatgctcagttggataatcgtttactaacaattgataggagcttggcctctggtgagtttctagatgacagtggtcttagacctgtctctatcccttgctgttttcattcatacagtaaagaggtttattgactgagccactcaacaaccatttcgtaatatctatgatggggatacgttgatctttaagggtcctttcaactgtaaaacagcgttgatgacattttctgaagacaaacaaacactcaaaagccttacttcttaacagg

SEQ ID NO: 132562 - DNA, 601 bp, Human
tagataatgaattctcttttttaaacctgaactaagtaatacctggaaagtaagtgaaattcacatgtaaaggaatgtatatttttccagatatgaagctacccatcctttaatatgttcttttccaaaagtatacattgtcctttttactcaaaatgttcaggtaagcccacagttaagactcagacctgagggaagacaacatcagttcatctggggaaaatatagacaaggcctccgctaaagcatccagcatatggcagatgatgtcagccagggatagccacttacaacatttagrattggtgtgattcttatctgagcgtaccctctcctttataactgtattcagatctccacatctgagagactggagggatttgggttttgcatttttggtttcgggatgtgaaagaatgtatatctttctgctgaggagggctgtctgagctctgagtttgtagaaggtgctgcgaggtgggctgcgggagcctcaggattctctacccctcctccagctcctgccctaagagactacagtgtcactttaagggaagtttaccctccctcaacccacttccctacttccaggtcagccctt

SEQ ID NO: 132563 - DNA, 601 bp, Human
agttcgagaccagcctggtgaaaacctgtctctactaaaaatacaaaaaaattagccaggtgtggtggtgctcgcctatagttctggctactcgggaggctgaggtgggagaatctcctgagcctgggaggtcgaggctgcagtgagccaagatcatgccactgcactccagcttgggcaacagggtgagattctgtctcaaaacataaaccacaaaacaaaacaaaagcagagggcagaaactgtatcttccttccttgtagcctgagaagccatacagtcctcttttcctcactcccaytgcgttgtaaaagcaatgactcaggaatgagatcttagcaaaatttaacagtgaggctaaaagacttttcctacaaaacagtatgctaatattagagtacatatcatggactctttttcctcaaattatctgaaaaattatcagacatcagaaaaactgagttgaggccaggcgcggtggctcacacctgtaatcccagcaatttgggaggctgaggcgggtggatcacgaggtcagaagttcaagaccagcctggccaggttggtgaaaccctgtctctgctaaaaatacaaaaaaaaa

SEQ ID NO: 132564 - DNA, 601 bp, Human
tgggcaacagggtgagattctgtctcaaaacataaaccacaaaacaaaacaaaagcagagggcagaaactgtatcttccttccttgtagcctgagaagccatacagtcctcttttcctcactcccactgcgttgtaaaagcaatgactcaggaatgagatcttagcaaaatttaacagtgaggctaaaagacttttcctacaaaacagtatgctaatattagagtacatatcatggactctttttcctcaaattatctgaaaaattatcagacatcagaaaaactgagttgaggccaggcrcggtggctcacacctgtaatcccagcaatttgggaggctgaggcgggtggatcacgaggtcagaagttcaagaccagcctggccaggttggtgaaaccctgtctctgctaaaaatacaaaaaaaaaaaaatagccaggtgtggtggcgggcacctgtagtcctagatacttgggaggctgaggcaggaaaattgcttgaacctgggaggcggaggttgcagtgagccaagattgcaccattgcactccagcctggcaacagagctagactctgtctcaaaaaaaaaaaaaaaaagaaaaa

SEQ ID NO: 132565 - DNA, 601 bp, Human
actctttttcctcaaattatctgaaaaattatcagacatcagaaaaactgagttgaggccaggcgcggtggctcacacctgtaatcccagcaatttgggaggctgaggcgggtggatcacgaggtcagaagttcaagaccagcctggccaggttggtgaaaccctgtctctgctaaaaatacaaaaaaaaaaaaatagccaggtgtggtggcgggcacctgtagtcctagatacttgggaggctgaggcaggaaaattgcttgaacctgggaggcggaggttgcagtgagccaagattgcrccattgcactccagcctggcaacagagctagactctgtctcaaaaaaaaaaaaaaaaagaaaaaaactgagttgaagttcatattttgttctacgtgtaatttatttacttgtgaaatcttgtactgtcatgaaagacttaggtctaaagctgaatatgctattttgattgattaggtgatatgttgtagaaccgtataatatttatggtttgaagtatagtttatggtatttatttgatcgaatgtgtattaaagtgaaaagtatattgaaatattaatatagttctaaaccagattaa

SEQ ID NO: 132566 - DNA, 601 bp, Human
cacactatggaattgcaacaatttgcagagatgacagaaagggacatctgtttccagtcagtgggcagggagttggtttcccgtaggcagctgcctgcaccttctgtagaaggccaccaagtgctcagaggttatacactcgcattcccggagctcttcggagagcacaaggcaggagggtcagtgacgttctcgcattctttttctggctggccattagaattagtaggccacatctaatacgtccacacaggtccagatatcctacacaggggtgtgggttcccaaagaaggggggatyggtaggccctacacatttgttgctcatctgtttgcatctcaggcaactgtgagctggctgggcttcctgactgtgacagacacaaattctaatccttgtagcctcattcctgcaattgtacccagacccttgcctgctaggaagcccaggagatgccttctcttacagggaaccagtcttggaccctgcgccatgttgatccagaactgatgtggactcttttccgttgattttcaatgtgaagggaaagggacaagtggggttaaatagaaccagacctggccaccctgtttactttag

SEQ ID NO: 132567 - DNA, 601 bp, Human
tccaaataaggtcatattcagagatactaagggctagggcttcaacatttgattggggggggaatacttaatgtataatgatatttttttcattgaggtatgatatggtttggctgtgtccccacccaaatctcaccttgaattgtagttcccataatccccatgtgtcatgggaggacccggtgggaggtaattgaatcatgggggtaggtttttcccatgctgttctcataatagtgaataagtctcacaatatctgatggttttaaaaagggtagctcccctgcacacactctcttgmctgctgccacgtaagacatgcctttgctcctcctttgccttctgccatgattgtgaggctcctcagccatgcgtaactgtgagtccgttaaacctctttttctttatagattaaccagtctcagatacgtctttattagcagcatgagaacagactaatgctaggtgttctgggttccttctgtataaaattctcagtaataactaaccagataaaagactgaattgcctttttcttttttttaataagtgatgtggtacttttattccctgaaaaaaatcctctctcagctgggtttgt

SEQ ID NO: 132568 - DNA, 601 bp, Human
tcctgatcactctccactcctcccctacctaccatcaactcccagagcactgactgtaacttttatgccatttatcattcatttaatatatttgttttccaatacatggacggggactctggggagcaggaactgggtctcccttatagtccatggtatctgctgcatggaatactgtgtctggcatgtaataggtgttcaatggctgttttgctaaatgaatgaatgaaacatgcaacagatcatggggatttggggatcatgtccccaaaataagcttaaaatttgaaaataaaaataratgatttattaccagtcacaaaaaacttaaattttaaattatcgtaggctaggcatagtgattcacgcctgtaatctcagcactttgggaggccaaggctggaggatcatgtgaggccaggagtttgagaccagcctgggcaatatagcaagagcccatctctacagaaattctacaatttttaaaaattttaaattattgcagagctctcggaaatgtttgaaagcatgaacaaatagattgaaaatgacttggtagtgacttctattggtgcccagagagccctgggagggccacagg

SEQ ID NO: 132569 - DNA, 601 bp, Human
tgctaaatgaatgaatgaaacatgcaacagatcatggggatttggggatcatgtccccaaaataagcttaaaatttgaaaataaaaataaatgatttattaccagtcacaaaaaacttaaattttaaattatcgtaggctaggcatagtgattcacgcctgtaatctcagcactttgggaggccaaggctggaggatcatgtgaggccaggagtttgagaccagcctgggcaatatagcaagagcccatctctacagaaattctacaatttttaaaaattttaaattattgcagagctctyggaaatgtttgaaagcatgaacaaatagattgaaaatgacttggtagtgacttctattggtgcccagagagccctgggagggccacaggcagataagcaaggcactttccctgcatcctgctgtgcctcccgctccttctccttgccactctctcctgtgtgattgttttgtgtttgatttgcctcctacccagtcttcattcattcaccttcttccctttcctgtagctcacatgcatggtttgtcctgatacgagcacacaaacactagctggatattgccctccgtgctgcacggcg

SEQ ID NO: 132570 - DNA, 601 bp, Human
cctgtctctaaaaaaaacccaaaatccaaaccttgcctaatcctgtgactacttgtacatttttaattcccctatccccatgggcttttccctaatgtcactgaacttcccgaacgtgaactcccaaaatgctttaaatgactgtgctctgttgctccacggttctctccagcttgtaggtagggcagccccacgtgctcctgtgctgccccacgtgcctttgctccttgcacaacgtggggcttttctctcatgggtcatgagggtctttctagtctctgagacccataggtctttgccwgtctgccccttagcctgcctgcagcatttaatgctgttctcctctccctccacgctgacactctcccctcacttctgcactgcacctggaatgatcttttaacaatgtgaatcaaaccatgttccttctctctttcaaaccctttaatgatgtagaattatacttagaacccagatacctgctaacaagtcccagtctggcctggccctgtcctgttagcttccccgtaaagcactatctgcccacctccgcccccatcccccaccccgcccagttcctcctgtgcattaggccttgcac

SEQ ID NO: 132571 - DNA, 601 bp, Human
ctgtgctctgttgctccacggttctctccagcttgtaggtagggcagccccacgtgctcctgtgctgccccacgtgcctttgctccttgcacaacgtggggcttttctctcatgggtcatgagggtctttctagtctctgagacccataggtctttgccagtctgccccttagcctgcctgcagcatttaatgctgttctcctctccctccacgctgacactctcccctcacttctgcactgcacctggaatgatcttttaacaatgtgaatcaaaccatgttccttctctctttcaaacsctttaatgatgtagaattatacttagaacccagatacctgctaacaagtcccagtctggcctggccctgtcctgttagcttccccgtaaagcactatctgcccacctccgcccccatcccccaccccgcccagttcctcctgtgcattaggccttgcactcagggcctttgtgtgggctattgcctctgtgtgcagctccccaaactctcttgccaatttctgcaccttctgggggactcagctcaaatactacctcgtgagggaatccctaagccctctctgcaatggcatcaaaatgc

SEQ ID NO: 132572 - DNA, 601 bp, Human
tgaaaatccaaaatctgaagtgcccccagatcagaaactttctgagacctgacaggacgccacgggtggacaattccacacctgggctgatgtgctgagtcgcagccaaaacacagatgcatagaacacggttcatttaacgtccctaagggaaaaagaaaatcaccttcaggttatgtctgtgaggtatatatgaaatgtaaatgaatttcgtgtttagacctgggtcctatctccaggatacctcatgatgtatatgcaattattccaaaattcaagaaaatctgagctccaaaatacytctggccccaagcttttcaattaagggatattcaacctgtatattgctttatcttcattatggctcctgtcctatgctaagcagttcgaatgtaagatgccacagaagtgactgtgccccatgggctctggtgtcatcccccacccccctcgactgacgagtgcagaaccttgtttgacaggcatgctggataagcagtgggctgtgatggtgggtgctctgcccgtcgtgaggctgagagcactgaacagtctgcaatacctgaaccaaatggaagtaaattagaaggagcttgagctg

SEQ ID NO: 132573 - DNA, 601 bp, Human
ctccaaaatacctctggccccaagcttttcaattaagggatattcaacctgtatattgctttatcttcattatggctcctgtcctatgctaagcagttcgaatgtaagatgccacagaagtgactgtgccccatgggctctggtgtcatcccccacccccctcgactgacgagtgcagaaccttgtttgacaggcatgctggataagcagtgggctgtgatggtgggtgctctgcccgtcgtgaggctgagagcactgaacagtctgcaatacctgaaccaaatggaagtaaattagaagsagcttgagctgggggaagaatcttgaagcccgtggccaacgttgaaaagagccttcatcagagtgtgaagtggcatccaagacagggaaaagccagggccaggtgcggtggctcacacctataatcccagcactttgggaggccgaggcgggcgtttcacctgaagtcaggagttcgagaccagcctggccaacatggagaaacccccgtctctactaaaaatacaaaaattagctgggtgtggtggcgggtgcctgtaatctcagctacttgggaggccgaggcaggagaatcacttga

SEQ ID NO: 132574 - DNA, 601 bp, Human
gactgtgccccatgggctctggtgtcatcccccacccccctcgactgacgagtgcagaaccttgtttgacaggcatgctggataagcagtgggctgtgatggtgggtgctctgcccgtcgtgaggctgagagcactgaacagtctgcaatacctgaaccaaatggaagtaaattagaaggagcttgagctgggggaagaatcttgaagcccgtggccaacgttgaaaagagccttcatcagagtgtgaagtggcatccaagacagggaaaagccagggccaggtgcggtggctcacacctrtaatcccagcactttgggaggccgaggcgggcgtttcacctgaagtcaggagttcgagaccagcctggccaacatggagaaacccccgtctctactaaaaatacaaaaattagctgggtgtggtggcgggtgcctgtaatctcagctacttgggaggccgaggcaggagaatcacttgaaccagggaggtgtaggttgcagcaagccgagatcacgccattggactccagcctgggtgacaagagtgaaactccatctcaaaaaaaaaaaaaagaaagaaagaaaggggaaagctggaga

SEQ ID NO: 132575 - DNA, 601 bp, Human
aggcgggcgtttcacctgaagtcaggagttcgagaccagcctggccaacatggagaaacccccgtctctactaaaaatacaaaaattagctgggtgtggtggcgggtgcctgtaatctcagctacttgggaggccgaggcaggagaatcacttgaaccagggaggtgtaggttgcagcaagccgagatcacgccattggactccagcctgggtgacaagagtgaaactccatctcaaaaaaaaaaaaaagaaagaaagaaaggggaaagctggagagttgaggtttggggacctgttatawacttacccacacagtgatggatgctccccgtacagtagaaaaaatgtagcacggaagcacgtcagcttagctggctgagcagatgttgtgctgaatgtggatctcagaggggaacagaaaggaaaaaggcctctggtgtggtcctcagaaaacagcacctacctccagtctcttgggattagccagagaagaaacgccagggagcattttgcttggggattccttggtgtctgttttgtcgcagcttcccgcaagaaagaacccttttcatcacttgagtaaccattgccccctccccac

SEQ ID NO: 132576 - DNA, 601 bp, Human
aaaaaaaaaaagaaagaaagaaaggggaaagctggagagttgaggtttggggacctgttataaacttacccacacagtgatggatgctccccgtacagtagaaaaaatgtagcacggaagcacgtcagcttagctggctgagcagatgttgtgctgaatgtggatctcagaggggaacagaaaggaaaaaggcctctggtgtggtcctcagaaaacagcacctacctccagtctcttgggattagccagagaagaaacgccagggagcattttgcttggggattccttggtgtctgttttktcgcagcttcccgcaagaaagaacccttttcatcacttgagtaaccattgccccctccccacaaaggaaaataaacaggaaaatttccctctggggtggctctcgagcatcagctgtagctgctgtagcaaaagatcaaacccaaatacttgcaccttgtggtcattggcatcaaaggctgcaggttttctttccacctaattttaatatgcttgtgagccttgggaggcttaattaaaactgcaggggagccaaagtaagcacacaaaggaactgttttgatgcttcaaaaacccaagc

SEQ ID NO: 132577 - DNA, 601 bp, Human
tcagctgcttcttctacagatgccagataacatggcagggccagctcagtttcccatcttaattttctgcctcgcttggcggggatgttcttggattcccttcctattttccctgatggttttggctatgcaggatagcctggcagttctgagcacaggatctctaagctagaccgcttctgtctgcttggccccagacatatcacctaatctctttatgcctcttaataccatctgcaaaatgaaattcaagatcacagggtttcctctgttaattcagtttcttttttttctttttaawttcatgttaaagtgcttagcacaatgcctggctcaggatgagtgttgagtaaatgacagcagtgatcgtgattacactaggacgtaggtaggtgcctatcagtcaggtgtagccagtggttatgggaagactgggagggtgcacacctaggccttcccaagggcatgggggtagacccagcttcagtgctgcactcaagcccagtctaaggcagcctcaaaggccacgtgacagatactcacacaagctgaagttggtggagtgtctgtccacgggactggcttacccagagtacatttc

SEQ ID NO: 132578 - DNA, 601 bp, Human
cttggccccagacatatcacctaatctctttatgcctcttaataccatctgcaaaatgaaattcaagatcacagggtttcctctgttaattcagtttcttttttttctttttaaattcatgttaaagtgcttagcacaatgcctggctcaggatgagtgttgagtaaatgacagcagtgatcgtgattacactaggacgtaggtaggtgcctatcagtcaggtgtagccagtggttatgggaagactgggagggtgcacacctaggccttcccaagggcatgggggtagacccagcttcartgctgcactcaagcccagtctaaggcagcctcaaaggccacgtgacagatactcacacaagctgaagttggtggagtgtctgtccacgggactggcttacccagagtacatttcaagtgacaaggactcttgcagtgagcttggctgcagctaatttgtcattacatcatgaaactctccctctgaaaatggaactcagagtccaattcacagaggaatttattgccaagatcacagccacagcaagacctggaggcaggcagctctgtctcttggggctgagtcagtctgggctgatgg

SEQ ID NO: 132579 - DNA, 601 bp, Human
gaagggaaataatcccaatcccacaagttttcatctgacttctaatctaggagttcattagtgggatcatggcacgtaagcatccgagtagaatcctctgattaattaattccatgaggaatcatcggaagacagtttgcagagcagagggaggctgactgcccccgtgggaaaactcttttaaggttgggcccaattttccccaatatgacacaggactctttcttcctggtctgttctggttgtcctggagtttctttgtcaagctgctccactgatggtattgtctacacctcagctmcctgtccaagacactctcagaggtctgaggcgtggaactctgtgggctatgaaagggttttactttttgctgaaccacccacctacagccctccgcttattgaagcagcagaaagctcaccagaggtggcttcttgtttccttcagtgtttccaagttactctgtagacttagtgaacctaagctttgcactcctcatagctgtgtatgagtctttttctgcgataagcatagaaatgtttcatctcaggagaaagcaagttggtaataaggaaaacaaagcaactgacaatagttgatt

SEQ ID NO: 132580 - DNA, 601 bp, Human
gaagacagttctatataagcaaaagaaatacctcggggcctttaacaattaaaaggaacaaagacaggcgggagcggtggctcacacctgtaatcccagcactttgggaggctgaggctggcggatcacgaggtcaggaaatcaagaccatcctggttaacacggtgaaaccctgtctctactaaaaatacaaaaaattagccaggcatggtggcaggcgcctgtagtcctagctacttgggaggctgaggcaggagaatggcatgaacccgggaggcggagcttgtagtgagccgagatsgcaacactgcactccagcctgggggacagagcgagactccgtctcaaaaaaaaaaaaaaaaaaaaaaagaccaaagacataggaaaggaggtctagatgatttttatgaagagtatatatcaaatattatttatatattaatccagctttaagatgggaaaatgctataaacgtgggaagttctccatagaagaatcagtcaaaagtattcctgtttgctcatgtctaagaattctgaaactagggaaactgtattgaaaagataaattgaaatatattggaacgggaaatgtagctaaa

SEQ ID NO: 132581 - DNA, 601 bp, Human
gacagttctatataagcaaaagaaatacctcggggcctttaacaattaaaaggaacaaagacaggcgggagcggtggctcacacctgtaatcccagcactttgggaggctgaggctggcggatcacgaggtcaggaaatcaagaccatcctggttaacacggtgaaaccctgtctctactaaaaatacaaaaaattagccaggcatggtggcaggcgcctgtagtcctagctacttgggaggctgaggcaggagaatggcatgaacccgggaggcggagcttgtagtgagccgagatggcracactgcactccagcctgggggacagagcgagactccgtctcaaaaaaaaaaaaaaaaaaaaaaagaccaaagacataggaaaggaggtctagatgatttttatgaagagtatatatcaaatattatttatatattaatccagctttaagatgggaaaatgctataaacgtgggaagttctccatagaagaatcagtcaaaagtattcctgtttgctcatgtctaagaattctgaaactagggaaactgtattgaaaagataaattgaaatatattggaacgggaaatgtagctaaagtg

SEQ ID NO: 132582 - DNA, 601 bp, Human
acagttctatataagcaaaagaaatacctcggggcctttaacaattaaaaggaacaaagacaggcgggagcggtggctcacacctgtaatcccagcactttgggaggctgaggctggcggatcacgaggtcaggaaatcaagaccatcctggttaacacggtgaaaccctgtctctactaaaaatacaaaaaattagccaggcatggtggcaggcgcctgtagtcctagctacttgggaggctgaggcaggagaatggcatgaacccgggaggcggagcttgtagtgagccgagatggcamcactgcactccagcctgggggacagagcgagactccgtctcaaaaaaaaaaaaaaaaaaaaaaagaccaaagacataggaaaggaggtctagatgatttttatgaagagtatatatcaaatattatttatatattaatccagctttaagatgggaaaatgctataaacgtgggaagttctccatagaagaatcagtcaaaagtattcctgtttgctcatgtctaagaattctgaaactagggaaactgtattgaaaagataaattgaaatatattggaacgggaaatgtagctaaagtgt

SEQ ID NO: 132583 - DNA, 601 bp, Human
tctctactaaaaatacaaaaaattagccaggcatggtggcaggcgcctgtagtcctagctacttgggaggctgaggcaggagaatggcatgaacccgggaggcggagcttgtagtgagccgagatggcaacactgcactccagcctgggggacagagcgagactccgtctcaaaaaaaaaaaaaaaaaaaaaaagaccaaagacataggaaaggaggtctagatgatttttatgaagagtatatatcaaatattatttatatattaatccagctttaagatgggaaaatgctataaacgtrggaagttctccatagaagaatcagtcaaaagtattcctgtttgctcatgtctaagaattctgaaactagggaaactgtattgaaaagataaattgaaatatattggaacgggaaatgtagctaaagtgtttccattagggtacaatgagaaaaactggatctgttttatgtaaattttcaacagtgacctggttaaaaaaaaaaaaaaagttgaagtacattaattaaatttacagagccagaaaaggtgaagacccaggaggttaaacatagaaaatacagatggactgaaagagatga

SEQ ID NO: 132584 - DNA, 601 bp, Human
tagaagaatcagtcaaaagtattcctgtttgctcatgtctaagaattctgaaactagggaaactgtattgaaaagataaattgaaatatattggaacgggaaatgtagctaaagtgtttccattagggtacaatgagaaaaactggatctgttttatgtaaattttcaacagtgacctggttaaaaaaaaaaaaaaagttgaagtacattaattaaatttacagagccagaaaaggtgaagacccaggaggttaaacatagaaaatacagatggactgaaagagatgagaggaaacggacrgacttttacagcatgatattcagcttggaaatatgcgggagaatacgacagggaataccagccaaaagtcagatagctagtttaaagaaaaagttaataaaacgttgaagtctgaaaaactgtacagaccaaagccaggaaattacaaagttatggatcccgcagtaactgtaaattaaccccattgcacatatgtagtatttcacattaccgtctgtggtgttaactttcatgcctaaacatgcatgtgtgtgtgtgtttcacctgaattatggttgtaaagggaacaaaggtgctaac

SEQ ID NO: 132585 - DNA, 601 bp, Human
ctgcaccactttccctcttgaggttttacatttcaagaccttctccctcctgcccgcttcctgctgccttcccgtcctctgggcaggccccaccggcctttcctccacactgactcatgcatattaccgcccccggttcccctccctcactgtcctcccagaatttccttcaccttcacagcacaggtcccactgacgaggacttcatggagggctggctgttcttcttcctccacctcctagcatagctgtcacccaggttctggtcacaagcctttgcccaccgtgtgctcctttcctytgtgatcacatgcatctccatgggttcacccctcagcaggtgcaggcggccctccccacagaggactagcctggcctctgagagaggctgagagcttgggctctagggccttgttggatgctggctctgccacgatcctggccaagctccgtgacccatcgtgcctgagtgacctcacctgtgagaggagaatcaacagcaacgtgggttgtcaggagggtgagctgagctgattcacagagagggctgggcacgtgccatggtgtgcggtagcagagtccacgtggctctttcctcact

SEQ ID NO: 132586 - DNA, 601 bp, Human
agatccacggagcctcagagccgctagttccacctcccccgagtactgctcctgcttccctgggggacacttccccctcccatctggctcttgcttgacttgtcccctccactacttcaggggcctcctcctatgcctcccagatcctgtctgcccttcagttgctctcatagctgctgccttggtgactgttccctgtttgaaacgatcccatggctttctgttgtgtcctgaaggaaatctgagctcctcagttcagcagccctctttcctcacaggcttccctcccctccatgcatgscctaaacccaagcacactgttctcctgcaggaagcacctctgtaggaggcagcgtgtctggccgtcttctggctgcaatgctcttcttacctgcgctgaaatggatcctcaatgaaccccacacaggcgtctcttccagaacccgtgtgactctgctctgccctagaagtatctcctcacccgtcccatcctgaccaattgctgcttgaggacaaccactgtccctcttgttccccatatagtcctggcagcagcacacactgaatccaactgtggtgacttcatgcctgtgtccattct

SEQ ID NO: 132587 - DNA, 601 bp, Human
ctgccttggtgactgttccctgtttgaaacgatcccatggctttctgttgtgtcctgaaggaaatctgagctcctcagttcagcagccctctttcctcacaggcttccctcccctccatgcatggcctaaacccaagcacactgttctcctgcaggaagcacctctgtaggaggcagcgtgtctggccgtcttctggctgcaatgctcttcttacctgcgctgaaatggatcctcaatgaaccccacacaggcgtctcttccagaacccgtgtgactctgctctgccctagaagtatctcstcacccgtcccatcctgaccaattgctgcttgaggacaaccactgtccctcttgttccccatatagtcctggcagcagcacacactgaatccaactgtggtgacttcatgcctgtgtccattctttaaaccagcatctcaggcctcacaccaagcaccagggcagagagtggaatgtatcaaaattgtggcaaattttgcaccaagagacaaaagtccaggaattaaataagtggcctattcaaatattaacatgccatttgcttcatatctttttgaaaataaataaaatgctgaccac

SEQ ID NO: 132588 - DNA, 601 bp, Human
cagaaatgccatagtgaacactcctgaacatatctatttgtggacatgaatgaatttcccaagagggcataatctggaatgaaatgcacattgcaaatttctcagtctgtggcttttctctaactttttttatggtgtcttttagtacaaaagttttccattgttaatgtaggcaagcttatcgattttctttttttttgagatgaagtctcgctcttgtaccctaggctggagtgcagtggcatgatcttggctcactgccacatctgcctcccgggctcaagcgattctcctgcctcarcctctcgagtagctgggattacaggtgcgtaccaccacacccagctaattttttgtgttttaagtacagatggggtttcaccatgttggccaggctggtctcaaatccctgtcctcgggtgatccacgcacctcggcctcccgaagtgctgggattacaggcgtgagccaccgtgcccagccaacttatcgattttctttcatggtttctgctgtttgtatgttctctaaaaactaatcaaggtcataaagatgttctcctatgttttcttctaaaaatgttgaatgcttttcactgtga

SEQ ID NO: 132589 - DNA, 601 bp, Human
ggagaatcacttgaagccgggaggcagaagttgcagtgagccgagactgcaccactgcactccagcctgggcaacattcgtctcaaaaaaaaagaaaagaatacaggcctgtagaaggattgcttaagcccaggagttctgtagtgtgtcataccagtagggaatctgcactaatttggcatcaatatggtgacctcctgggagcaggggaccaccaggttgcctaaggagtgatgaacaagcccaggtcagaaacaggtcaggtcaaaactactgtgctgatcagtagtggactcacaamggtgaatagccactgccctccagcctgggcagcataatgtgagtgtatttatcgctaataaaaaaattatttaaaaaatatgtatctctgacaccatgggacaggcactgactcttgaattggagagacctggattcaaatcctgaggtagtctcttactgtatgaccttggactgtccattcaactcctgaactttatttcctttatctgtaaaatgggaataattagtatctcccctacaagggtttttgaaataatgtatataggcatacccaggaaagaagggtttgatagaagag

SEQ ID NO: 132590 - DNA, 601 bp, Human
ctgcactccagcctgggcaacattcgtctcaaaaaaaaagaaaagaatacaggcctgtagaaggattgcttaagcccaggagttctgtagtgtgtcataccagtagggaatctgcactaatttggcatcaatatggtgacctcctgggagcaggggaccaccaggttgcctaaggagtgatgaacaagcccaggtcagaaacaggtcaggtcaaaactactgtgctgatcagtagtggactcacaacggtgaatagccactgccctccagcctgggcagcataatgtgagtgtatttatcrctaataaaaaaattatttaaaaaatatgtatctctgacaccatgggacaggcactgactcttgaattggagagacctggattcaaatcctgaggtagtctcttactgtatgaccttggactgtccattcaactcctgaactttatttcctttatctgtaaaatgggaataattagtatctcccctacaagggtttttgaaataatgtatataggcatacccaggaaagaagggtttgatagaagagaggggagcctgaaaccaagacctgcctctcacttatgcctgaggccagtgtgtc

SEQ ID NO: 132591 - DNA, 601 bp, Human
ccatgtccccacggggacatctctctcctcctgagagtctctctcatacatctcaaatctgagatacagattgagaaacaccccaggaaatccactgcatggaaggcaaaacaaccttgagccacagcagtgaccacaagcaagagaagcctggctatgagcacagtcatgatgtagttcaaggttggggaattcaaggcctccatgtccatcccaacatcttcagctcctcctcacgtcgccagtggatgtcctctgcaagctgatataaattattttcaaacccagatatacattcctracttaattccactctcctcaaactcgcccacggaatgcctctaacagaggggagcgagggcacaccctgggaggcccgagtatgtatcctgtggcattacatctcaaaaatgatatttactcaaagatgctagttttaggtaaaaataaattattcaaatgtattgtgaaaatgttattggttttttgtttgtttgttttgtttttttgagacagagtcttactctgttgcccaggctggagggcagtggcacgatcttggctcactgcaatctctgcctcctgggttggagcaattctc

SEQ ID NO: 132592 - DNA, 601 bp, Human
gtgaaagaagccagattcaacagaactgtactctgtcatttcattcatatgaagtttgagaacaggcaaaacttagctatagtgatagcaggcagggcaggaactgcctattgagggtggagattgaatgaaaaaggcacgggagggctttctgggataatggaaatgttctatattttgttttgggtggtaggtagacaggtgtagacagttgtgttaatggctgaagatctgtgcattttagcatatttaaattataacccccaggaagcattgcctcatcttcctgggggatgtatawgcttgttaagagcatactgggggtgcttttgagaaccccttaccatgttattatgttaatgaaccaccactaatttttgtggtttcaaaatagcaaggttcattgataaaactcccttgtgccttggtgacaaaaaacactgataccgcccactgtcaaagtaagtgtgtttgttatttttgtttttaatgacactaaatttgtaggaatgatatttttaggtggttgctcaatctcacccgccatcagttgcaggtgacagggatgttaagttggcagatttttgtgctagaagctgtg

SEQ ID NO: 132593 - DNA, 601 bp, Human
ctttctgggataatggaaatgttctatattttgttttgggtggtaggtagacaggtgtagacagttgtgttaatggctgaagatctgtgcattttagcatatttaaattataacccccaggaagcattgcctcatcttcctgggggatgtatatgcttgttaagagcatactgggggtgcttttgagaaccccttaccatgttattatgttaatgaaccaccactaatttttgtggtttcaaaatagcaaggttcattgataaaactcccttgtgccttggtgacaaaaaacactgatacmgcccactgtcaaagtaagtgtgtttgttatttttgtttttaatgacactaaatttgtaggaatgatatttttaggtggttgctcaatctcacccgccatcagttgcaggtgacagggatgttaagttggcagatttttgtgctagaagctgtgggtttacatctcctttgtgcaggtgtcctagacataccagtggcttgttatttaaacatcgggatcgggtgtgtgggtggtttttaagttatagtagggatgcaggtgctgtgggatcgcttcattgtttaacaattcctttgcatt

SEQ ID NO: 132594 - DNA, 601 bp, Human
tttctgggataatggaaatgttctatattttgttttgggtggtaggtagacaggtgtagacagttgtgttaatggctgaagatctgtgcattttagcatatttaaattataacccccaggaagcattgcctcatcttcctgggggatgtatatgcttgttaagagcatactgggggtgcttttgagaaccccttaccatgttattatgttaatgaaccaccactaatttttgtggtttcaaaatagcaaggttcattgataaaactcccttgtgccttggtgacaaaaaacactgataccrcccactgtcaaagtaagtgtgtttgttatttttgtttttaatgacactaaatttgtaggaatgatatttttaggtggttgctcaatctcacccgccatcagttgcaggtgacagggatgttaagttggcagatttttgtgctagaagctgtgggtttacatctcctttgtgcaggtgtcctagacataccagtggcttgttatttaaacatcgggatcgggtgtgtgggtggtttttaagttatagtagggatgcaggtgctgtgggatcgcttcattgtttaacaattcctttgcattc

SEQ ID NO: 132595 - DNA, 601 bp, Human
aatttgaagttggcactggtgttgctgggccaaccagcatcttgaggactcaactctctggctgcaggtgctgtggggaaggggcagacttaaattttcttctgtaaaatggggacgggggggattaaataaaatgctttatgggaagttctggcacagagtgacgcacgaagaaatttgagcttccttctcctcacaggtgaactgttgctgctccacctttattacatcttttcaaatccacgccacattggggaacacaaactgaccttatgtagccctggttactccagcctttttaaaaaaaaaaaaaaaaaaaaaaaagcaagggaaataggcaagacggccaaataggaacagctccagtctgtagctcccagggagatcaaggcagacagcgagtgatttctgcatttccagctgaggaacctggttcatctcactgggactggttagatagtgggtgcagcccacggagggcaagccgaagcagggtggggcgttgcctcacccgggaagcacaggggattgaggaactccctcccctagccgagggaagccgtgagggactgtgctgtaaggaaccatgcattccgtccca

SEQ ID NO: 132596 - DNA, 601 bp, Human
atccacgccacattggggaacacaaactgaccttatgtagccctggttactccagcctttttaaaaaaaaaaaaaaaaaaaaaaaagcaagggaaataggcaagacggccaaataggaacagctccagtctgtagctcccagggagatcaaggcagacagcgagtgatttctgcatttccagctgaggaacctggttcatctcactgggactggttagatagtgggtgcagcccacggagggcaagccgaagcagggtggggcgttgcctcacccgggaagcacaggggattgaggaactycctcccctagccgagggaagccgtgagggactgtgctgtaaggaaccatgcattccgtcccagatactatgcttttcccatggtcttcgcaaactgcagaccaggagattccctccggtgcctacatcaccagggccctgggtttcaagcacaaaactgcatggctgtttcagcagacaccgagctagctgcaggagtttttttttttcataccccagtggcacctggaatgccagcaagacagaaccgttcacttccctggaaagggggctgaagccagggagccaagtagtctagctc

SEQ ID NO: 132597 - DNA, 601 bp, Human
ttctagtttgtcaccacattcgtggacagctagtcctggggcactggggtgcatatgattagtggcatggctgaagctaatgcattcacaaatcctgatccgcaggtgcatgggtgtcccttgttaatgcgcctagtctgacccagggcagtgctgcacagctcattggctttacagtcagacaaacctccaatcctgtgtctggctctcaccagcttgtgtcctaatgaatcaataattctacccacctgacgctcactttcctgtaatttactgcagtgagttcctaggcatatggcaygtaaatggtcagtagatcaccttagaaggatttcagactctgggtctcagtccatctgtgaaaattaggatggtaggaacctctctgagatacacctttaaaattagttatgtgtgtcacattcacagctcctagttttgaagaccagcaacagaacaatactttcaagtcttcatataacctttattaatttaggacaggcttcatattttcaacaagagaattcaaagttcattttccttttttccctcagcaactaaagttctgagtttcataatctgtttcttattgatacataat

SEQ ID NO: 132598 - DNA, 601 bp, Human
tttcataatctgtttcttattgatacataatattttacatatttacagggtacatttgagttacaatctattttaaatgatacattatgtaaagtcactgtgttcttaaataaatacacatagtgaatgatcctgcatgtatccccacaagtacagcttgaacaagtccatcttccaggggccaagcaccacctcaggcatctgtagcatgagcaaaacccaaggtcccctctggagaccctgtttaccctgcaggcaggacaacaggagctggaaggagcaggctgatccaatccctttgttgtggttttcttggttggggagagagagttgagttttgccaaaatacatgtgttctgtagaagaaacaggaaatggagatacacaaagagatatgacaatacaaatcaccagttgggccacccagatcctggtttccatataccgttccatgcattgttcctgagcatgtaagcatgcccacacttgaaggaggcactctcaagtccatcggggcctgggacaccccactgtttttgaagtcctggaatgtttttgtaaaggtaaggaaataccaaaacgagactacaaaaatgatggt

SEQ ID NO: 132599 - DNA, 601 bp, Human
taagttctcttttcaactcacctaacatctaacttggccctgcagctctgatccccaaaaccctctctacctgttccctcccaagctatccctgaccagcatgccaggaacaaggaagtcttgaaagctgcactccttgctgctctcccctgtcctttatccttccacttggaatctctgtccttctacccatctctagctactgaaatcgtgttcatgtttccaggcacatctcatactctgtcgtctttaagaagtcttcccagaaaccccatcgtttatattcgtgatatataccatattccactgtgtaatgtagattgcaccagagagtatttaatctcctgaaggcaaggactataacctattcatcttcctttcctgggtggggagaaccaccatgccttgtaccaagtagcgatgacatgggtcctggctccatgaatgaacgggcattgagagaaaaggagctgatgatgagtgaatggaggagcctagtgaggcaacgtttactcctcagtgaagcagtgttggtgactccaacagctctctttaggaaggatttaagacaacatcctgttcggaaggggcttgaagcact

SEQ ID NO: 132600 - DNA, 601 bp, Human
ggaggtgcccgcagggcaagcaaggaaggctaagggtcgtcactctgcagcaggagcactcggccacccagcacctggcaccacgggcccagaactcagcttttccggggagccaacagcatctcagctctgggctgagccagaaaggcccctgctgaattccagaggtgctttctaaaatggatttttgtcttgttttatttaggggagcagggaaaatagcatatattggctgtgagctggaatatttgtccgaagcacatatatgctcaatttgtaatatctatttaatatctaaacyaccctcacccctctcctcaaaaacaagacatttttcagtttattggtgcattttccctttgatcgtgaggcccatattatgtctcatattatgctccaaacccgaagtatttgtttttgaggcaagtaaattcggaggcttctcacaaaaagagaatgcctattgtgaatcagttacctctgagaagctacagtgcttcactgagatttctctttctgaactgcagctttagaaaacgctgttggcttcttcttcccatgcactgaacaaaaatattaatcctgcttgtcccgaaccacc

SEQ ID NO: 132601 - DNA, 601 bp, Human
aacccatttgcttttatctagctgtatctcctgtattttactgtacatcaacaatacagtccccgattccagaatgacttcatttccttattataatcccagataggcagttaaatggaaagaagaggtaatgagcaatttctatacacaaatgggccttgatttcttttaactttctaactaaactaatttcttttgcagcacgttacatttacacttccatccaggtttagaattatatgtttccttttgacttgctgttcttgcatacaaaagaagagtccagggaaagagtttcagaaaaaaaaaaaaaaaaggatggaaagttcaagatccttaaacagtctatttcttttaaaagtctctgagaacctggagacacccttaggtatatctgaagacccacagacaactttcacactcttgagtcagtagccagcaccccaactctgtcccttctgtggtcatccagcctctcgatgtggggttagatgaagcaagccctggaccactgggcaataagccatttacagataagggacttactctgtcaaagctatgactcagaacacgccaaacgccagctcctggtaagacctaa

SEQ ID NO: 132602 - DNA, 601 bp, Human
cgcacaatgcctgggagcactgacatgctcagaccattgccctctgaggccatgttgtgattgagtaaaaaccagcagcttccacagtgggttggattctgacctaagctgtaggttcccagtggccaaccttcctattccagcctcccacttaggaaccccctttcctcccagcctgggaaataacaatggggtctgttctacccctgtgcaggggaaaggggagagggagagagagggagggtgatggtggagagagggatcctggaagaaccagcgatgctgctcatccttcaggagyagccaggctgttctaggacccatgcaagcccatggctcagggcaggcggggcaggcactcggtggctttgttgtcagtctaaccccagaagcccaggagataaaagaccacttttggggccccacatgttacataataatgaacggggtacattttaacatcgtttttgactctcctttccagcaaactgttagatatttgctcatttcttgtttaaattaaaattccacaggctctgctttgaactgcagtattttatcaatcctgagtctcaggacactgtttgatggaattaagtaa

SEQ ID NO: 132603 - DNA, 601 bp, Human
acagtgtctcagtgctaatactccattatagattaactcggagtgtcgggagatggctcacattatcttaacaggctttctttccttgaaggtggagggtgggtgaggtggtacaggattctgcaggaagagcccacatcttcagaatgttcccatgacaccgttttcatttctgggcaaaggtgctcagtttttgttctcattctgtctttgggtcctggtacatagcaggatcctcacatgtatttatatttaaattaaaccgatgcaaagcttttcagtctggtgtgttactaatttwtgagccttttccctttgcagtttttttctcttatataacctatatctggttaaatgtcttttcacctagactgtttccaactagtagctagattgtttccaactggtagctcacttttagcttagtttagttttcattttataaagactctgagattggccaattatttgagcattgtgaggtattcatcttagtgtcctcagtaaaagggtagagggaactcttcctaccattcaagaagagtgagctgtccaggctgcgggttatttcataagttgtattaatgtcactgaggcctgc

SEQ ID NO: 132604 - DNA, 601 bp, Human
aaaatctatctgtggccactcacttttacagatacaatataaaccgatgacggcgtgtaagatgacagacttttgttccttaattttttttggaatgagataagtggttgccctgtaatattttaggtacaatggcaagcaagaaaaaaaagggggaatatatttgttgaaaacatctagtttttgagttatgcatagcctgaataaacaaggagagcttgttctatttctagatcacctttcactctgttcatcccagttggtgggagtggggtggggtggggtgagcccagggctgatwttctccattgtcaagggtaaacagacccggttgctgcccctgcctttgccaggaaggcagtggattatcttccccttaagtgctttccctgggtgtagcttacgctgtgactttggtgaaggtagctgtgtggctggtcttaaaccttctggcgagccgtcgcctcgtctcccttcggttttgtgttctgtgaacatctgtgcgtggccctgtgacccggggtaatctggacggcccatcaccgccagggaattcaggagggaaacctgactcttgctctgcggcttccatttcatccag

SEQ ID NO: 132605 - DNA, 601 bp, Human
gctctgcggcttccatttcatccaggctgcctctaaacaggcagggccctggtcacagccttggacaggtggcctgggatcctaatggagctctctctgccgaaaaataggaacagagcctgaaccacagcagcaagatttcagacaaaccaaagattgttcctccactccaggcagtgctctcgagtgctcctttgaaaaccagtcgtattaaaaaaatgaaacaacacaaactcccgaatgcattctgagtgagtactcaactcaaaaatacctgtcatgctttgatctttaacggaartcctttgatctttaaaacagtgttgaaaaaactgtttagtatcatcacacctctaagtcaaaatcagtcccactgccaggctgagcatgtcgctgagccagcctgaggcaggagggatgcaggccttttgcaccggactccaacaatgactgcgtcacttcaggaaatcggttttttcacagtactggccgttggcagtgcacatgtggtgcatctcccttttgcttttgtcccacctctcccacactttcctcctaaaatacctattattggctttttttccagccaaaaggataggaa

SEQ ID NO: 132606 - DNA, 601 bp, Human
caaactcccgaatgcattctgagtgagtactcaactcaaaaatacctgtcatgctttgatctttaacggaaatcctttgatctttaaaacagtgttgaaaaaactgtttagtatcatcacacctctaagtcaaaatcagtcccactgccaggctgagcatgtcgctgagccagcctgaggcaggagggatgcaggccttttgcaccggactccaacaatgactgcgtcacttcaggaaatcggttttttcacagtactggccgttggcagtgcacatgtggtgcatctcccttttgctttygtcccacctctcccacactttcctcctaaaatacctattattggctttttttccagccaaaaggataggaaattagggcatcctttcagcaaacctctccaggccaggtggcaaatgtctgcttccagcacctggttgagatttattttccttccagctgcattttttttcctcagctctgtcatgaagcagagaagcgagtgcagacggcggagacagatgacctgagctgggctctagcttagctgtgtggccttggctgggttattaacttctctgaacttcagttttctcatcata

SEQ ID NO: 132607 - DNA, 601 bp, Human
gcaaatgtctgcttccagcacctggttgagatttattttccttccagctgcattttttttcctcagctctgtcatgaagcagagaagcgagtgcagacggcggagacagatgacctgagctgggctctagcttagctgtgtggccttggctgggttattaacttctctgaacttcagttttctcatcatacattcgctttgaggtttaaataaataatgcagattaaatctatagcctatgtagatgttcaggaagcgtcccctaactgaaaagctgcataacaagtacatttcactggcygtgtttaccatctaacatgtaagcctggggaagatgtgaatgcagcaggctctccgagttgcatcgtcggggtgtgccccctagtctgaggtaaaagggagaaatctaacagaatcccagggacatgggagtggtgtggacgaatggccgtagtgaatgttggatgggggtgtggtggggactgtagtgagttctgaatcttggtggtctcctcaagacagcctttggattacagcttcaaggagctcctctttgtgaagaggacagtgtacccagtccaggctgtcccttctgccccag

SEQ ID NO: 132608 - DNA, 601 bp, Human
gttgcactgtgtcccaagcactgggccacacgtgggctactcaggggcagcaggacaggccttgtcctgggaacaaatgccgtccacctcaggacacactctctgatgtcaccaacttccctgctgtgctgatggcagcctgagcttcccttaaaacactcattttaaaagttttattttcgaccggttgcggtggctcacgcctgtaatcccagcactttgggaggccaaggcgggcaggtcacgaggtcaggagatggagaccatccatcctggctaacacagtgaaatcccgtctctwctaaaaatacaaaaaaaaaaattagccgggtgtggtggcgggcacctgtagtcccagctactcaggaggctgaggcaggagaatggcgtgaacccgagaggcggagcttgcggtgagccgagatcgcgccactgcactccagcctgggggacagagtgagactccatctcgaaaaaaaaaaaagaagttttattttcattattcaaatattcaagcatacatagtagtagggagatgagcacaataagctcttatgaaatcattgcccaggtccaatcattatcaagattcggccagaac

SEQ ID NO: 132609 - DNA, 601 bp, Human
tcccaagcactgggccacacgtgggctactcaggggcagcaggacaggccttgtcctgggaacaaatgccgtccacctcaggacacactctctgatgtcaccaacttccctgctgtgctgatggcagcctgagcttcccttaaaacactcattttaaaagttttattttcgaccggttgcggtggctcacgcctgtaatcccagcactttgggaggccaaggcgggcaggtcacgaggtcaggagatggagaccatccatcctggctaacacagtgaaatcccgtctctactaaaaatacaaaaaaaaaaattagccgggtgtggtggcgggcacctgtagtcccagctactcaggaggctgaggcaggagaatggcgtgaacccgagaggcggagcttgcggtgagccgagatcgcgccactgcactccagcctgggggacagagtgagactccatctcgaaaaaaaaaaaagaagttttattttcattattcaaatattcaagcatacatagtagtagggagatgagcacaataagctcttatgaaatcattgcccaggtccaatcattatcaagattcggccagaactgcttcatctc

SEQ ID NO: 132610 - DNA, 601 bp, Human
ctactcaggggcagcaggacaggccttgtcctgggaacaaatgccgtccacctcaggacacactctctgatgtcaccaacttccctgctgtgctgatggcagcctgagcttcccttaaaacactcattttaaaagttttattttcgaccggttgcggtggctcacgcctgtaatcccagcactttgggaggccaaggcgggcaggtcacgaggtcaggagatggagaccatccatcctggctaacacagtgaaatcccgtctctactaaaaatacaaaaaaaaaaattagccgggtgtggkggcgggcacctgtagtcccagctactcaggaggctgaggcaggagaatggcgtgaacccgagaggcggagcttgcggtgagccgagatcgcgccactgcactccagcctgggggacagagtgagactccatctcgaaaaaaaaaaaagaagttttattttcattattcaaatattcaagcatacatagtagtagggagatgagcacaataagctcttatgaaatcattgcccaggtccaatcattatcaagattcggccagaactgcttcatctcaccccttctgctcagagtctttctt

SEQ ID NO: 132611 - DNA, 601 bp, Human
ttttaggattgattgatttgtgttaggatctgggcaaggttcacacatagcatttggtttctgtgttcctcaagttcctctgaatctggagaactttctcttgtttttttgttttgttttgttttgtttttaagatacagagtcccattatgttgcccaagctgggcttgacttctgggctcactccatcttcctgcctcagcctcccaagtagctgggattacagggatgtgccgccatgctgagacctgtcttcctggtttttaatgccatggacttattcattatgctccactttatwtttttatcataacactgatccccacatgcagcaaatgaaagtttcctcatgtgcagaaaaggcgatgaggcctcagagagatggagtcacgtctgctcagtgtcacccaactaaagagaggcaaacctgcatcttcttacttcaggcctctttccaccaagccaagatgtggagagccacccaaatgcttgcatttgcaattacatctttattagagagactggaaagccacggagcccccagagagaccaggaggggtgcttaccttctagcatggtctgatgaaaagggtcacagtct

SEQ ID NO: 132612 - DNA, 601 bp, Human
aacctgcatcttcttacttcaggcctctttccaccaagccaagatgtggagagccacccaaatgcttgcatttgcaattacatctttattagagagactggaaagccacggagcccccagagagaccaggaggggtgcttaccttctagcatggtctgatgaaaagggtcacagtctgctgtctggtgaagctgcgtgcaaaatccaaggaagctagagaattgtagttgcatgttgttgtcttttagatccctacatgtaggaagaacttggaccaagcagagaaatcataccctccccscaagaaatgctgaagccaaaccagcggacaaattcagagcaaataaagggaaaagagtgtgtgaaagcggctcattttgtttgtttgtttgtttgttttttgagacagaatcttgctctatcgcccaggctggagtgcagtggtgcgacctcagctcgctgcaacctctgcctcccaggttcaagcaattctctgcctcagcctcctgagtagctgggattacaggcacccgccaccatgcccagctaatttttgtatttttagtagagacggggtttcaccatcttggccaggctggtc

SEQ ID NO: 132613 - DNA, 601 bp, Human
agccacccaaatgcttgcatttgcaattacatctttattagagagactggaaagccacggagcccccagagagaccaggaggggtgcttaccttctagcatggtctgatgaaaagggtcacagtctgctgtctggtgaagctgcgtgcaaaatccaaggaagctagagaattgtagttgcatgttgttgtcttttagatccctacatgtaggaagaacttggaccaagcagagaaatcataccctccccccaagaaatgctgaagccaaaccagcggacaaattcagagcaaataaagggwaaagagtgtgtgaaagcggctcattttgtttgtttgtttgtttgttttttgagacagaatcttgctctatcgcccaggctggagtgcagtggtgcgacctcagctcgctgcaacctctgcctcccaggttcaagcaattctctgcctcagcctcctgagtagctgggattacaggcacccgccaccatgcccagctaatttttgtatttttagtagagacggggtttcaccatcttggccaggctggtcttgaactcctgaccttgtgatccacccccacccccaccccccttccctgcc

SEQ ID NO: 132614 - DNA, 601 bp, Human
actaaaaataattgattctctgttattttaggaatgttgaattccaagagcctgttgttgttgttgttgttgttattgttcttatggaccgatgtttaataattagaaaatttttaaattaaataccagatgtcatttattattaagcatcttgttcacctttaaaacggtgctgtggctgtatcagaaatctaatcaggagcttagctacttgcccagtgctgcgatgaagaagtgcagcatctttagaaaatgcctggagagaaaatgggaagaagtgtcctcttgatggagggaggtragtgtggagagaccatcagtgttagcggtttgctagtaacacggcctcaggctgtatttccaggatgacttgagtacatttccttttttgaattatgacttaaattagttccatgtcaactttctctatttgccaacaagactttttttcaagaaccatttttactgatgaatttattctcagttccaaacaaaactagtgtggacagctagctcactgtatccctttttaagtagtgatgaaatattttaatctttttggggaggatagttttatttaacccacttgagcagcaataga

SEQ ID NO: 132615 - DNA, 601 bp, Human
cggtggctcacgcctgtaatcccagcattttgggaggctgaggcgggcggatcacgaggtcaggaattcgagaccatcctggcaaacacgttaaaacccgtctctactaaaaatacaaaaaattagccgggcttggtggcgggcgcctgtagtcccagctacttgagaggctgaggcaggagaatgacgtgaacccgggaggcggagcttggagtgagccgagatcgcgccactgcactccagcctgggcgacagagcgagactacggctcaaaaaaaaaagcctcaggagaaatgctggwtgttttttattcatatttgatggctgcttttgcacactacagcacagagcatgtcctcccaggcccctgacgtggtctctgtcactagactagtgactagtctctgtcactagtggtctctgtcaccatttatgtatacactagttctgtaaagccagcacttggaaagccagtcaaggtccagttaggtcacgggtgaatgacatcattggccttgtggttgagaggaacttggagaatatgtaaaagttatcaccaagagatggtcattgtagcaggaatcactgcatttagcaatag

SEQ ID NO: 132616 - DNA, 601 bp, Human
ggctgaggcaggaggatcacctgagtccaggagtttgaggctgcagtgagccgtgattacagcgtgtgaacagacactgcactccagcctgggcaacatagcaagacctggtttctaaaaataaagaaaaagttaagtgaaacctcaatactgtatataaaaatacacaaaatatttattagtatgaatttatgatatgtgttcaaattaagacatttattgttctaaagtcaattggcgttagcaatgagttgatttttcaaaacgacaaaaattagaagtgagtgttatggaagacagwttgctttatatcatctctatatctagtttacttttgttttgttttgggttgtgttgagaaaagccttgagggataaagattagttgccaagtttgtgttttcatactttgccttgtgacctcagactttctcatttttgttcttgattatatttaactgttgcttaagtatacaagtcatacaaagaaggaaccaacagtttgtgtacacactgtctctgaaatcaaaatagcatcatgtgataattgatctcttgttatgtgactgacataatataacagtcacatgttccacacagac

SEQ ID NO: 132617 - DNA, 601 bp, Human
ttttgggttgtgttgagaaaagccttgagggataaagattagttgccaagtttgtgttttcatactttgccttgtgacctcagactttctcatttttgttcttgattatatttaactgttgcttaagtatacaagtcatacaaagaaggaaccaacagtttgtgtacacactgtctctgaaatcaaaatagcatcatgtgataattgatctcttgttatgtgactgacataatataacagtcacatgttccacacagacaggaacatggatcaggtaatgcactttgtgagaataggctarttgccagtattattttatgtgaatggacacgtaagaatgcttgtttgaaaaatagcaatatgtaattacaattactaattactaatcagtgacctatttgtaaaatcaaaaataagaacttttatttaatctgagatcctgacagaagcaagttaacttgaaaatatctctggatttcaatatattaagattttatatgtattatatgaaacaattcgtatgttcttatactaattaaatattttttaaaaatattcaatgtataaaaaatgcaatttaaaaacgagtggctgaaagaat

SEQ ID NO: 132618 - DNA, 601 bp, Human
ttgtgagaataggctagttgccagtattattttatgtgaatggacacgtaagaatgcttgtttgaaaaatagcaatatgtaattacaattactaattactaatcagtgacctatttgtaaaatcaaaaataagaacttttatttaatctgagatcctgacagaagcaagttaacttgaaaatatctctggatttcaatatattaagattttatatgtattatatgaaacaattcgtatgttcttatactaattaaatattttttaaaaatattcaatgtataaaaaatgcaatttaaaaaygagtggctgaaagaatagtaaacagcactgtaatcctaaaagcttgtgttaactttacatttcaatttagtcacaaaatacagatggatacattcctgaaaaaatgtgaagtctttagtaagaatagacatttttgagagagtaaggcacatttaattatttaatattatacatttagtttaggaacataaaatgaataatttaaaattttaatgattttaaaggtataatttaagagttgtacatgtgctcactgaatttactgataaatacaacttttcattactagtggaatcaaaa

SEQ ID NO: 132619 - DNA, 601 bp, Human
tgaaaagtttggtgtgatgggagctgagagtccagaaaggtgctaagagggtaggttggagctgggcccagtggctcatgcctgtaattccagcactttgggagatgaaggcaggtggatcgcttgaggtcaggagttcgagaccagcctggccaacgtggtgaaaccccacctctactaaaaatacaaaaattagccaagtgtggtggtgcacacctgtaatcccagctacttgggaggctaaggcacgagaatcgcttgatcccgggaggtagaggttgcagtaaaccaagattgtgtmctctagccttgccgacagagtgagactttgtctcaaaaaaaaaaaacaaacaaaaacaacaaacaaaaacgaaacaaaacaaaaaaacaaagaggttaggttggataagtaagtgaaggccaaatcataagacctgtgatgaagttggggctgtattctgtaagccacgaagagtcatcaaaagcctcacttgtgagaactagttattgaatgagatcctgtgagtagagaatttatcaagatctcggcagcatgaccacgcagaaacaaacagaaacaaaggaatgtgtcaccaggatt

SEQ ID NO: 132620 - DNA, 601 bp, Human
aagtttggtgtgatgggagctgagagtccagaaaggtgctaagagggtaggttggagctgggcccagtggctcatgcctgtaattccagcactttgggagatgaaggcaggtggatcgcttgaggtcaggagttcgagaccagcctggccaacgtggtgaaaccccacctctactaaaaatacaaaaattagccaagtgtggtggtgcacacctgtaatcccagctacttgggaggctaaggcacgagaatcgcttgatcccgggaggtagaggttgcagtaaaccaagattgtgtcctcyagccttgccgacagagtgagactttgtctcaaaaaaaaaaaacaaacaaaaacaacaaacaaaaacgaaacaaaacaaaaaaacaaagaggttaggttggataagtaagtgaaggccaaatcataagacctgtgatgaagttggggctgtattctgtaagccacgaagagtcatcaaaagcctcacttgtgagaactagttattgaatgagatcctgtgagtagagaatttatcaagatctcggcagcatgaccacgcagaaacaaacagaaacaaaggaatgtgtcaccaggattcctc

SEQ ID NO: 132621 - DNA, 601 bp, Human
ggagctgggcccagtggctcatgcctgtaattccagcactttgggagatgaaggcaggtggatcgcttgaggtcaggagttcgagaccagcctggccaacgtggtgaaaccccacctctactaaaaatacaaaaattagccaagtgtggtggtgcacacctgtaatcccagctacttgggaggctaaggcacgagaatcgcttgatcccgggaggtagaggttgcagtaaaccaagattgtgtcctctagccttgccgacagagtgagactttgtctcaaaaaaaaaaaacaaacaaaaamaacaaacaaaaacgaaacaaaacaaaaaaacaaagaggttaggttggataagtaagtgaaggccaaatcataagacctgtgatgaagttggggctgtattctgtaagccacgaagagtcatcaaaagcctcacttgtgagaactagttattgaatgagatcctgtgagtagagaatttatcaagatctcggcagcatgaccacgcagaaacaaacagaaacaaaggaatgtgtcaccaggattcctctctcatgcagggctgtgttaggacacacatacttcatttgagattgtttggaa

SEQ ID NO: 132622 - DNA, 601 bp, Human
ctcaaaaaaaaaaaacaaacaaaaacaacaaacaaaaacgaaacaaaacaaaaaaacaaagaggttaggttggataagtaagtgaaggccaaatcataagacctgtgatgaagttggggctgtattctgtaagccacgaagagtcatcaaaagcctcacttgtgagaactagttattgaatgagatcctgtgagtagagaatttatcaagatctcggcagcatgaccacgcagaaacaaacagaaacaaaggaatgtgtcaccaggattcctctctcatgcagggctgtgttaggacacayatacttcatttgagattgtttggaaagtcacctctcacccccactctagaacaacttacattagagaaacgttttcttacagtggcctcacacacacccttttgaggagaaatgaaaagctgtagtttaacaaccgccttacacgtaagaacgaaggaaccaaatgtgcaaatttagaatgacattgcattgggctgaccataaagtaccctccatccccagggcactgctaatgcggagaacgtggtttgtcatacaagacctactgggtagctgtttatttagtagaaatagtgtatg

SEQ ID NO: 132623 - DNA, 601 bp, Human
cccttggatttcttcgtgtggctgatttgcagatccattagttacattcacctttggctaaaggctatgggatagttgatttactttggatgatgcagtatttttcaagagaagttttcatatatttagcccaactgcttcgccacaagaaacaaagtcgtaagtatctatacaggtttacagaaaatgaaattttagctccagctacaaagcggctcagccagttcatggagacttgtcacaggttggtgactgagaagggtccacctgaaacacttgcatgtccaggtccagctgagcrtgcatgccagcctcagccgctggggtccctgtctggtcctgcagcatcacgtggctcagatggcatcttcgctgtgagtgcgaagacgctgggcaccagcacctgcacaggcagatggtgaaaggcccccaactctctggtaatgaggatggcagccatatgctttctcatgcatccagctcagcctccaacctacaataccataatgatgacatgtgggaaagtctaggtcccatgccacatcccagttaaaatgcatgcactggaaaagggaggggaactcagctgcacacacattac

SEQ ID NO: 132624 - DNA, 601 bp, Human
tgtgtttttaacaaagcacctcccttagagcgggttttagaaagtcagcaggccagcgcctcccttccccttccaggaagaagcagaatctcagacatggtttcagggaggtgctcccaggagcctctggcaggagaaaggccttgtggccttgccatttccatctttgtctttgcgtttatacgttggcccagcctacattgactctttcatcgcttcacttcttcagtccttcaacaaatagtttttgagcatccactgtgcaccaggcactgttttgggtgccaagcatgtaactgtaaaaaaaaaaaaaaaaaaaaaagcaaaattcctgccctcatagaacttacattctaatgaggaacacagacagtacacacaaactatgtcgtgaaaagtgtggcatggaaaaccaagctagatgtgggtgcagacagtgatgaggggagggtttctgggaagctggtctgggaagtctggtctgagtgaactgagggagagagacttgtccacgggaagaacatcccaggccaagggaaagcatatgcaaaggccctgaggtgggaaaccagagtgatccaggaacttgcaaggatggcca

SEQ ID NO: 132625 - DNA, 601 bp, Human
ttggtgacacccaggccttttcaacccgtggcacggcattttgcttggggtctctccaggtcagccaggtgccctgctaatttatctgttcctagcagccccgtgactccaacctgaccttttcataggcttgccgacaggaccacggagctcagccttgcaagtcgtggaatgaggtgatggtttccatatgtgctggggctgtcattcaaattctttgcctgctcagctaatgaggtcagaacggctctgcctgaggtggacagcctctccctcgggtagtgtgcctgcaggagatacrggaggaagtctccccacccgctttaaaggaagcttggcgagatagcattgcttagcactgttcacaaaaggataactgcagaaaaacatgaaataaaagggaatagaagggaagagacagactgacttttttaatttaaactttttatttggagataattgtggcttcataggcagttgtaaaaaataatagaaagctcgcatataccctttactcagtttccttaaatggtaacatcttacaaaactgtagtacagtatcacaaccaggaaactgacactgacacagtcaacacaaaac

SEQ ID NO: 132626 - DNA, 601 bp, Human
ttggaaaacctactgtgtcctgagctcaatgctgggcgttatggatagacacgagacaaatggtgaaggattgagttgtggagacacaacataagaagagagtcgcaccacaaatcagttaatacaaagcacacatgcaattttacatattgaaccgtgtcctctgttttcagcccaggataggtactgtgaaaaacataacaaaaagtgtaagacttggttccggctgaatgaaccctctagttgaacacacagatggtgtgctggtgttttccagggatcactaggcacagtgctgctwctcagtctaccagctctccatgggtttctacaagctgagtccaaagttgcatctcagctttgacctctctctggtcccctgtcttctgaacacctcagaggcgctcacaggccccacatctgaaactggattcattgctgttcctgctgaacctttttctcctcctgtgtttgcatctggatggtcagcaaagggccatccattgttcaggacccagcttcagtgctgattctctctgccctgctccaagttcttcactcctccacgtcacctctcctgagcctagcacaatctctgtaa

SEQ ID NO: 132627 - DNA, 601 bp, Human
ccccatatgtgtgacgcagtccttcccacttcctttcccccacctccctgccctacagcccctggcaaacacgagcctgttttcagtctttacatatttgcctattttggacatttcatataatcatgtaatacacagcctttgaggttgggcttctttcacttagcataatattttcagtctttatccctgaagtatgtatccatctgtaccatatttctttatatggctgaataattctccattgtatgcatagaccacatttgcttacacatttgtcagttggtggacatttgggtcrtttctacttttggcttttgtgaataacgcagctagggatattgtactggtatctgtctgagtccattttccattcatttgggtatattcttaggaatggaattggtgagtgatgagataattctgtgtctaacttaccaaggaacagtggctgcaccattttacatctcaccaagtaatgtgcaagagttccagtttctccatatcctctccaacacttattttctgagttattttggttttggggtttttttaatagccatcctagtatgtgtgaagtgctatctcatggtagttttga

SEQ ID NO: 132628 - DNA, 601 bp, Human
tttgcctattttggacatttcatataatcatgtaatacacagcctttgaggttgggcttctttcacttagcataatattttcagtctttatccctgaagtatgtatccatctgtaccatatttctttatatggctgaataattctccattgtatgcatagaccacatttgcttacacatttgtcagttggtggacatttgggtcatttctacttttggcttttgtgaataacgcagctagggatattgtactggtatctgtctgagtccattttccattcatttgggtatattcttaggartggaattggtgagtgatgagataattctgtgtctaacttaccaaggaacagtggctgcaccattttacatctcaccaagtaatgtgcaagagttccagtttctccatatcctctccaacacttattttctgagttattttggttttggggtttttttaatagccatcctagtatgtgtgaagtgctatctcatggtagttttgatttgcatttccctaatgactaatgatactgattatcttcatgtgctttttggctattgtgtattttctttgaataagggtctattgaagtcctttg

SEQ ID NO: 132629 - DNA, 601 bp, Human
gcataatattttcagtctttatccctgaagtatgtatccatctgtaccatatttctttatatggctgaataattctccattgtatgcatagaccacatttgcttacacatttgtcagttggtggacatttgggtcatttctacttttggcttttgtgaataacgcagctagggatattgtactggtatctgtctgagtccattttccattcatttgggtatattcttaggaatggaattggtgagtgatgagataattctgtgtctaacttaccaaggaacagtggctgcaccattttacwtctcaccaagtaatgtgcaagagttccagtttctccatatcctctccaacacttattttctgagttattttggttttggggtttttttaatagccatcctagtatgtgtgaagtgctatctcatggtagttttgatttgcatttccctaatgactaatgatactgattatcttcatgtgctttttggctattgtgtattttctttgaataagggtctattgaagtcctttgcccattttttaatcaagttgtttgtttttttgcttttgagttgtaggtgttctttatatattctggata

SEQ ID NO: 132630 - DNA, 601 bp, Human
atatgtaacaaacctgcaggctgtgcacatgtaccctagaacttaaagtattaaaaaaaaaaaaaaaactcactccttttgtctaattgaaattttgtaccctttgaccaacagctcgtcattccctcactcctccactctcaaccccagcctctggtaaccatcattgtactttctacttctatgagttcaactttttaagattccatatataaatgagatcatgcagcacttgtcttactgtgcccggtttatttcatttagcatagtgtcctcttggtttatccatgttatagcaaaygataggatgtcctttttaaggctgaatagtattccactgtgtgtgtgtgtgtgtgtgtgtgtgtgtgtgtgtgtgtgtgtgtatgtaccacagtttcttcatccactcattcattgatggacacctaggttgatttcctatcatggctattatgaataatgctggagtgaacagaggagtgcagatatcccttcagcatactgatttccactcctttggattatatacccagaagtgagattgctggatcatatgatagttctatttttaattttttggaggaacttccactgttttcca

SEQ ID NO: 132631 - DNA, 601 bp, Human
aaaaaaaaaaaaaaactcactccttttgtctaattgaaattttgtaccctttgaccaacagctcgtcattccctcactcctccactctcaaccccagcctctggtaaccatcattgtactttctacttctatgagttcaactttttaagattccatatataaatgagatcatgcagcacttgtcttactgtgcccggtttatttcatttagcatagtgtcctcttggtttatccatgttatagcaaacgataggatgtcctttttaaggctgaatagtattccactgtgtgtgtgtgtgtgtgtgtgtgtgtgtgtgtgtgtgtgtgtgtatgtaccacagtttcttcatccactcattcattgatggacacctaggttgatttcctatcatggctattatgaataatgctggagtgaacagaggagtgcagatatcccttcagcatactgatttccactcctttggattatatacccagaagtgagattgctggatcatatgatagttctatttttaattttttggaggaacttccactgttttccatagtagctatactaatttgtattcccatcaacagtgtacaggggttccttttt

SEQ ID NO: 132632 - DNA, 601 bp, Human
ttgaaatgatcatgtgatattttttcctacattctattaatgcggtatattatattgcttgatttttatatgttgaaccacccttgcattccagggataaatctcatttggtcatagtatataattttttaaatatactaaacttagtttgctagtattttgttaatttagtattcatatactgaatttagtttgctagaatttagtattttaaagagattctctctttaaaaaaaaaaaaggaaaacatagatctaaattgctttttctgtgccaatctgtactcctcttttcttctcaytatttcagaattaaccaaagtaaatattttgttgtgttttgttcaccttttttactttgtttttgtgaacagatagcttccaaaccatatatagatgatataatattgtaaatggtaaatgttatcctttcttacccatttcaatcttgagcttttccaacattattgttcatgagaaattttagttacaactattcacaatggtctcctttcctccaaagaagagaagggtaaattggaaaaataatgttccttgacatttcaacattggagtgcatggagaaatcagtgcttcctaca

SEQ ID NO: 132633 - DNA, 601 bp, Human
ctctggttcctgttttatgacctctaaagctttgtcatatcctttgctgttttaaaagtttcagaaaaggttgttcctaaggatagcaagactctgcaaagaatagttctgtgatcttgttctgtagacatggtgttttccagtagttggttcagtgaaataacagattatttatagaaaccaggtggagtcaatatgatggactgagctaactcagaaaagatccttccaaacacacatacatgttaggtgaaatataaacaaaggcaggctctcaaaacataactaagctcaaaagaaygagaaataaatccagataccaaaaacagaggcatcaaagccagcagggttagaggaggtgaagccaaggaggctgcatgggagtatcagaccatgcaaagggctcagaggcagaggtttcatgggttaatgcagggagagaacagcttagtcccatgtgagatataacagaaccctatgcataaagttgcaaattttgtagggatgccattttagtgaaacagaaactagaaaaatttttctccttagattgacagagaagcaatgagtcatcctgtgtgcccagggaaatagatgaaag

SEQ ID NO: 132634 - DNA, 601 bp, Human
ttcctgttttatgacctctaaagctttgtcatatcctttgctgttttaaaagtttcagaaaaggttgttcctaaggatagcaagactctgcaaagaatagttctgtgatcttgttctgtagacatggtgttttccagtagttggttcagtgaaataacagattatttatagaaaccaggtggagtcaatatgatggactgagctaactcagaaaagatccttccaaacacacatacatgttaggtgaaatataaacaaaggcaggctctcaaaacataactaagctcaaaagaacgagaartaaatccagataccaaaaacagaggcatcaaagccagcagggttagaggaggtgaagccaaggaggctgcatgggagtatcagaccatgcaaagggctcagaggcagaggtttcatgggttaatgcagggagagaacagcttagtcccatgtgagatataacagaaccctatgcataaagttgcaaattttgtagggatgccattttagtgaaacagaaactagaaaaatttttctccttagattgacagagaagcaatgagtcatcctgtgtgcccagggaaatagatgaaagaaagaa

SEQ ID NO: 132635 - DNA, 601 bp, Human
gaagtagagagtccttctgtactaaggataggaaaattagcttcccactagctggaattgcaaggaaagtctgaaagattctataaaatagtgatgaaagaagatacagatatcaaaaagcaagagaagggtagtatgtaagaacaggtggatttggaagaaaaataaaacatatagacatgaaaagtccagtgatttaaattaaaacatattagaaaattttaaagtagtttagataaagctgaagggagaaggggaatgaaaaacatgggagagattgagggatgtggaagatagaatsagatcaatatggagatactgtagatagaagctccaggagaaggtaaaatagagaacggaggggaggcaggaatctcagtgttttctgtaagtgaagatccacaaacattcaagctgttgtagctttccagacctgagcagctgaacaggatataaaaacaaacctataaccagtcatactaaatattgtcatgaaactacagcccatcaaagacaaagggaattattgtaaaagcaaccagaaggaaaagacagattccctgcaaaaaatggcaaactgagtagccttcagtgctgaaga

SEQ ID NO: 132636 - DNA, 601 bp, Human
tgcacattggctatatggtctacttttagggggatggagctcaggatggagtcaagttagccttggatggaggcctgggtggtcattgagcagggacttctagggtcccaaataactgaggtggtggatggcaggcctgggccatgggagggtgtacctccttggctgtggacccctcacagtgtgtggaggaagggctgcggcacagagtgggtccctctgaagcaagaagtcacatttttaaataatatctcattataggctgagcacagtggctcatgcctgtaatgccagcactttyggaggctgaagtgggcggatcacctgaggtcaggagttcaagaccagtctggccaacacggcaaaaccccatcgctactaaaaatacaaaaattagccaggcctggtggcaagtgcctgtaatcccagctactcaggaggctgaggcaggagaatcgcttgaacctagtaggcagaggctgcagtgagccgagattgcgccactgcactccagcctgggcaacaagcaagactctgtctcaaaaacaaaaagaaaaaaattaattataaaaaaagaagacagagaaaagcattcaccact

SEQ ID NO: 132637 - DNA, 601 bp, Human
gccttggatggaggcctgggtggtcattgagcagggacttctagggtcccaaataactgaggtggtggatggcaggcctgggccatgggagggtgtacctccttggctgtggacccctcacagtgtgtggaggaagggctgcggcacagagtgggtccctctgaagcaagaagtcacatttttaaataatatctcattataggctgagcacagtggctcatgcctgtaatgccagcactttcggaggctgaagtgggcggatcacctgaggtcaggagttcaagaccagtctggccaacayggcaaaaccccatcgctactaaaaatacaaaaattagccaggcctggtggcaagtgcctgtaatcccagctactcaggaggctgaggcaggagaatcgcttgaacctagtaggcagaggctgcagtgagccgagattgcgccactgcactccagcctgggcaacaagcaagactctgtctcaaaaacaaaaagaaaaaaattaattataaaaaaagaagacagagaaaagcattcaccactctaggcggcatctaggcggcgtctgccagcacaggagccctgccagcaaagccccatct

SEQ ID NO: 132638 - DNA, 601 bp, Human
ggaaagacgtctcctcttggactgcagtaaaaatgcttcataaagggcagcttgtacaggattggggatgagagtgtgtgtgccacacggtgccagagggaggcaggaggctggggcagctcctccaaagctgggcaacggaggtttccttgtccctgctgctaatctctgattaagcaacttggtgaaaatccaaaagctcttaggagaacaggagtggtggcatttgctcttcggtgcttggaagcagatcatgtgaaaactctaaagccctgagaatcaaagcacagccacctacctrgtcaggaagttcaagtgcactaggtgtgggcccaaggctggcacaagcatatccgcccccaagggagctcccctccaggctgatgctgccttcaggctcagacacccacctgctcctgtacccagctgtctgagggctcacaatggtctgggagctgcttcactgtggctaccatgtggtgggaatttttggtttgtaggttttgttttgctagaaatggaggtgagcaagtagacaaaagccccctgtggaagattcctctctgttctgttctcttctgttctgttcaccctggctcag

SEQ ID NO: 132639 - DNA, 601 bp, Human
ttttgttttgctagaaatggaggtgagcaagtagacaaaagccccctgtggaagattcctctctgttctgttctcttctgttctgttcaccctggctcagcttgtatcaccttctctcccgcccactgtctcttcctcctgtggcctcactggtctgggccctcctccctgctgctcagcccatgtcctcagtcaactctcaggccacctctgcagacaagcccttgcctcccccgataacccccctgagcctttgggattctcaggcagtggccagaaggcatgctctctggaagagccrggaagccagcccaggaccgggactctcagttatgggaacacacagagtaagaaaacagcctgagtgtcttcttttaaagtctcctcctcttctccatcccacgaggactcttctgtcttgttactgtatgtcttgatactctagaaatttcctttttaagccagatgcctcaggaaattaacaggcagtccaggaactgattcatgggcacccttttcgacttcttttctccttttaaagagtatgacagtgaactcacagctcccctgataagttgtacgcatgcatggatggaattca

SEQ ID NO: 132640 - DNA, 601 bp, Human
ccagcccaggaccgggactctcagttatgggaacacacagagtaagaaaacagcctgagtgtcttcttttaaagtctcctcctcttctccatcccacgaggactcttctgtcttgttactgtatgtcttgatactctagaaatttcctttttaagccagatgcctcaggaaattaacaggcagtccaggaactgattcatgggcacccttttcgacttcttttctccttttaaagagtatgacagtgaactcacagctcccctgataagttgtacgcatgcatggatggaattcaagattrtcaggtttttttattgtgttgtcttttggccagaatgtctaattgagctgtgggacttttccagacccctgacacagaagggttagccaatggagagcaggccttataaatgtctttctgtgggaagggccagttggaagaaaagccccactctgggcttgtgaacactaaagctggttctcagctctagagtgtggaccctgggtttgcttcccaactctgccactcacgaggtctgtgaccttgggcaggtcacaaaaatctctgtgcctcagttttctcatctgtgaagtgggagga

SEQ ID NO: 132641 - DNA, 601 bp, Human
aagggccagttggaagaaaagccccactctgggcttgtgaacactaaagctggttctcagctctagagtgtggaccctgggtttgcttcccaactctgccactcacgaggtctgtgaccttgggcaggtcacaaaaatctctgtgcctcagttttctcatctgtgaagtgggaggagtataatcccctatctcatagggtttctgggaggattaaatgagctttattttatagcacagtgtcttagacacatggcatttaatgagtcttggctattatttattttattaatagtatatgarctgattgtgtaagaatagtctttgtatggccacaggtccaatcaatcactaaattccttttgagtttattgtgtaacctttttctttacatggaaacaaccctactttgattacttattaccagtccagatcagtctgatttaaaaacagggctgggtgtggtggctcaggcctgtaatcccagcactttgggaggccaaggtggacagattgcttgaggtcaggagtttgagaccagcctggccaacatggtgaaaccccgtctctactaaaaatacaaaaaaaaatagctgggcgtgg

SEQ ID NO: 132642 - DNA, 601 bp, Human
gtgcattttgccagcttgcactattagtgttgtgtgtgtgtttccctggcatgtttacagcttcataaattagctggctgccctacagcatcaggcagacaggagtgttttttcttaattggcagtgggaaagtggagtcggggaccagtgacccactgtgtgtgattcccacactgagctcagccgcagccccctagaaataggaaacctaccctcagaggctttcccttcccagcatcagcagctagaaccatgggaccccagttagcctgcacacggccgccacggcccctctatggycacaggtttcttcatctcaagcctccacctatccaaggctaaggaggccagatgtcgcactcacccgcacgctgccaaaaaaaagcagcttattttaaacctagtgtgctcccccaattctcctgttaaccagtttctcctgtgtgcttcactttcagatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttg

SEQ ID NO: 132643 - DNA, 601 bp, Human
gcagatgttttagtctcagtagtccttcactgttagctttggttgtaattagcaaacatttgggaaaataatctgaatcagatttgaatttaacacgaaaagcagtgggaggaaaaccaaagctacagaactgaatcaacagtacatttttcaagggaatctttattatcttgcaagaacagagcagaacgggaaggctcctgcagagcaggtgtgcactgagtcttggagggcgtcattcacttccgtgtgccatgcactgtgcaggaaatggggtcagagaaatgagtgctatgggagrgtcactactctcacagagctcacagggaagggagataatacagcatgcaattgccacagtttgaagagtggctttatctgaaaagtacaagatgtagtgaaggcaaataatacagtaatcttattctgaagctcaggaaagacttcccagcagaagtaatgccaagactgaagcctgaggaatctgacaaatgaagagcatgaggcaggtaagggaacatcagcacctgtgtttggtgggaaggggcacgctggagagtaagtttaagacagagagaggaaagagctggaagcaagagag

SEQ ID NO: 132644 - DNA, 601 bp, Human
gatgtatttggatggagaggaaggaaaagaaagacaatggagataagggaagaatggaggtgtatggacaagggagacatccaagagatgtccagcgggcaggcaggtgcagaacccaagtaaaggcagggaactggggcagtttgcagaggaaatgctttagtggagaagtaggtaggtaaatctgaagacacttcttaagccgtacatttgggaaatcaagtgaagctggactccctctctctctcagtctctctgctctacactggtgcctgaggaattgatgaataataatccttaytccctgtaggactgctacactggaaaagacggatgtgggcctctaggactgagtagggccaccttcctgggtggccacacgggagcatctcaggcctcagagagatggcaacaaaggttaaaaccaattgcgatttcagagatatgtggttagaaaccaggcttcagagatgacatttacattgtaatgtaacataagccaagcaggaaataataatatctgcagatcattgtttacccagcagaagttttaagttaaaagtaggcattcctgggccatatttatgagctttaaggtaac

SEQ ID NO: 132645 - DNA, 601 bp, Human
tttctcaggaaccaagaaaattcttcccttagagaatatatagcataagaaattctccagccctttcaatcaaataaagttatcagttggaataaaactctcttagcatgtcttgggctatagtatagggcattgtactatatttattaataaggcacaaatgaatgctatgaagttccaacagaaaattaatttttatatgtattcaaagtagggttgccagatttagcaaataaaactacaagagccccatgaaatctgaatttcagataaataacaaatattcatttggtataaataygtcccatgcaatatttagtattgacttgtgctaacgaaattattcattgtttatctgaaattcaaatttaacttggcttaagtatttttcttgcaaccctggcaaaatgcctcctccaggcaacccagaatctatctggagataatcactaagtctataacaggccaagcttcaaggagttaagaagttatcagtgaggaatttggattaacacctgataagtaatgttcatttgatagtgaattgaaatagtgcatttaaggatcctccctgagaaggattttatgccataaaaatata

SEQ ID NO: 132646 - DNA, 601 bp, Human
acaaaaaaaattttttaaatataatttatacagtatatcagatatgtgctatgtcaaaaaataaagcaggagaaagggacagagagtgcttgggagggtggggaatacaagttgcccttttaaacagagtgatcagggaatgtctctcgaggacatttgcatcaggatttttgcagggatcaaattaggtaactgcacagcgctggggatgcagtaagtactcaaaaaggcaactaacgatggagttcataactttcgcagcctggctgacaactggggctgatttaaatatatacctatracccgctttttaacccatgccattgtcaccaacccacgtcctttctgaggcagaatctgttttcagaatgaggcttgtctgctttctccactgagagccattaaccttctcgggtttgcttctgccttcaagaccatcctattccttcccatagaccatattccgtctgtatcttcttcccctgcacagatgtgcattctccaccccactcactgtcctcagttaaatgtaactctttccccactcactcaccctctgtatcccctgccctctcctccaaatcacactaattttttaaag

SEQ ID NO: 132647 - DNA, 601 bp, Human
atatgtaaattccatcctaccatctattcattaagaagacatgcattgaaagggttggattagatgagcactaaagactcttccagctctaatgctttgatgctaaggaaagctgagctttctttaaagcttccttaatgtgctgcacagtgaggggctgaaatccaggacccctaaggcagatcaggtcagtctggcatcacacagcctgagctggggatccctgggcctcgggttccttaaaaacatataaaatgagaataatgattcctgtcttttcattcctgctttttaatctgayaaatatttatcaattgcctacttatcaggcactgtgctgagaatacaaaggttaaaaaaaacaccttgctctcattgagcatgaattctgctgggaggagggagacaaaaaaaattttttaaatataatttatacagtatatcagatatgtgctatgtcaaaaaataaagcaggagaaagggacagagagtgcttgggagggtggggaatacaagttgcccttttaaacagagtgatcagggaatgtctctcgaggacatttgcatcaggatttttgcagggatcaaattaggtaactgc

SEQ ID NO: 132648 - DNA, 601 bp, Human
ttcatcagagctaattccaggcaagccattttttaagaattcctcccaacttctatcccatattcaacctttctcatgtaatcatctaaatagtctcagcaatagaaagcattagagaaatgtaacatataaaagtgttttatccagttttcttaattctctcttcacttgacaaatgcaaatatacataaataggtgctgtctggatgaggaatacatgcacacatgaatatgagtgtgtgcgtgcaagaattccacaggcggtcatttatgaacatagaaaggtaaaggcaagaaaggytttaaaagctttaaatgaaagctggctaaagaagagaggggcagcaaaagatcaatgaacaaaacacccaataaagaaagagacagaaaagaataaagaaagaaagagggtggggtgtggagcagtaatgaatgagggaaagaaaaggcctgggcattgagggaagctgtaggcagcccccggccggctgctgctgctggaagctggacaagagggaacagatttcagcagcgggaagccctaatctgtcagcagcagttccttcatgtgtgaccagccagctcagcttggagactggtg

SEQ ID NO: 132649 - DNA, 601 bp, Human
ctggagtgcagtggcatgatcatggctcactgcagcctctatcttcctgggcccaagtgattctcacctaagcttcccaggttgctgggactacaggtgcatgccaccatgcctggctaatttaatatttctgtattttataaagacggggtttttgccatgttgcccaagctggtctcaagtgatctacctgcctcagcctcccaaagtgctgaaattacaggtgtgagccacctcactcaggcaatctcagtttatctaaaaattggaggcaatcatatccctgtacaatacttttaarcttaaattatgctatataaagcccttggcacatagtattcactcaataatcttttttaaaaataaattttctaaattgctgaagcttagtattttaaagtacaggctttttcttgattataggaagcattttaatggaaaatttcagaaaggcattacagagttctctgactttttatacctaagataatcgatataatttaagctcttattgatgacttaacaatgactatgcttttttgctatacagggatttttatgcagggtatatgctttctggggcgtagatgacatttctccc

SEQ ID NO: 132650 - DNA, 601 bp, Human
tcttaatctttctggatctcagggggtttggggttttttgttgttgctttcgttttatttttttgagacagggtcttgctctttcacccaggctggagtgcagtggcatgatcatggctcactgcagcctctatcttcctgggcccaagtgattctcacctaagcttcccaggttgctgggactacaggtgcatgccaccatgcctggctaatttaatatttctgtattttataaagacggggtttttgccatgttgcccaagctggtctcaagtgatctacctgcctcagcctcccaaartgctgaaattacaggtgtgagccacctcactcaggcaatctcagtttatctaaaaattggaggcaatcatatccctgtacaatacttttaaacttaaattatgctatataaagcccttggcacatagtattcactcaataatcttttttaaaaataaattttctaaattgctgaagcttagtattttaaagtacaggctttttcttgattataggaagcattttaatggaaaatttcagaaaggcattacagagttctctgactttttatacctaagataatcgatataatttaagctct

SEQ ID NO: 132651 - DNA, 601 bp, Human
tgggattacaggcatccgccaccacgcccggctaatttttttgtatttttagtagagacagggtttcactatcttgcccaggctgttcttgaactcctgacctcatgatccacccaccttggcctcccaaagtgctgggattacaggcgtgagccaccgcgcccagacaggaaactctttattaccaaaccaccctgtcccacaggttaatgatatgtttatatacatgtgagtcattcctaattcactcaacctctttagcaaaggacatagaaagatggataacctggggcaaagtacrcctggaattcataaaaatttgagtttgaaacacaaagtaagcaaaagtcttaatctttctggatctcagggggtttggggttttttgttgttgctttcgttttatttttttgagacagggtcttgctctttcacccaggctggagtgcagtggcatgatcatggctcactgcagcctctatcttcctgggcccaagtgattctcacctaagcttcccaggttgctgggactacaggtgcatgccaccatgcctggctaatttaatatttctgtattttataaagacggggtttttgccat

SEQ ID NO: 132652 - DNA, 601 bp, Human
tctagtctttagggcaagaaatagcagagaatccaagaaagtaaactatttatttattttattttattttattgcgatggagtctcactctgtgagtgcagtggtgtgatctcagctcactgcaacctccacctcccgggttcaagcaattctctgcctcagcctcccaagtagctgggattacaggcatccgccaccacgcccggctaatttttttgtatttttagtagagacagggtttcactatcttgcccaggctgttcttgaactcctgacctcatgatccacccaccttggcctyccaaagtgctgggattacaggcgtgagccaccgcgcccagacaggaaactctttattaccaaaccaccctgtcccacaggttaatgatatgtttatatacatgtgagtcattcctaattcactcaacctctttagcaaaggacatagaaagatggataacctggggcaaagtacgcctggaattcataaaaatttgagtttgaaacacaaagtaagcaaaagtcttaatctttctggatctcagggggtttggggttttttgttgttgctttcgttttatttttttgagacagggtcttg

SEQ ID NO: 132653 - DNA, 601 bp, Human
caattaataaatgcttcttaatagttattagttcttccctcatattacacttatggggaagagactccagaaagctcatataatatcttttttttttcttttttttgagatggagtctctctctattgcccaggctggagtgcagtggcgctatctcggctcactgcaagctccacctcccaggttcacaccattctcctgcctcagcctcctgagtagctgggactacaggcacctgacaccacccctggctaattttttgtatttttagtagagacagggtttcactgtgttagccagkatggcctcaatctcctgaccttgtgatctgcctgcctcagcctcccaaaatgctgggattacaggcttgaaccactgtgtccggctgaaagttcatataatatcttaaatgtgaaatctgaagtttggcgaacaggcactctagattgatttcttcctgctcattccacaaaactcaagtccgatgaccttaaggacgtgatacaaaatggtgtctgttcatccaggcacctttgtgataaatgctagagagataggtggatgagtggaagaaagggattgaagccaatgataaaaatta

SEQ ID NO: 132654 - DNA, 601 bp, Human
cgggccaatcatgcctgtaatcccagcactttgggaggccaaggcgggtggatcacctgaggtcaggagttcaagaccatcctggctaacatggtgaaaccccatttctactaaaaatgcaaaaaattagccgggcgtggtggtgcgtgcctgtagcgcctataatcccagctacttgggaggctgaggcaggagaatagcttggacctgggaggcagaggttacaatgagcagagattgcaccattgcactccagcttgggcaacaagagagaaactccatctcaaaaaaaaaaaaaaaaagaagaagaaaaagaacatgcaacatacaatataataaattccttgtcaagcccaaaagaggaacatgcattatgtggcaattaataaatgcttcttaatagttattagttcttccctcatattacacttatggggaagagactccagaaagctcatataatatcttttttttttcttttttttgagatggagtctctctctattgcccaggctggagtgcagtggcgctatctcggctcactgcaagctccacctcccaggttcacaccattctcctgcctcagcctcctgagtagctg

SEQ ID NO: 132655 - DNA, 601 bp, Human
atgcaatgtagtagctacatctcatttcacccatccttaacctcaaatgcagaactcagtattgctttgtgtgtcggtgatatgaaatccagaaaaacgtctatttactttcaaataaaaaaaaagccagctaaacacataatctcacttacaatatcagtcattgttcatatggaaaacaaggatttagctgcctacgtaagatatttgcaatcaaaccttgagaagccaggtcaatattagaacatgcaatatatggccgggccaatcatgcctgtaatcccagcactttgggaggccraggcgggtggatcacctgaggtcaggagttcaagaccatcctggctaacatggtgaaaccccatttctactaaaaatgcaaaaaattagccgggcgtggtggtgcgtgcctgtagcgcctataatcccagctacttgggaggctgaggcaggagaatagcttggacctgggaggcagaggttacaatgagcagagattgcaccattgcactccagcttgggcaacaagagagaaactccatctcaaaaaaaaaaaaaaaaagaagaagaaaaagaacatgcaacatacaatataataaat

SEQ ID NO: 132656 - DNA, 601 bp, Human
aatgacaaccaaggaaaggaaacccctgtcaagtgcaaggaacattaataatggacacagactcttgcccactaaaattcccaggtcttaaattgtttgaggatgcaatgtagtagctacatctcatttcacccatccttaacctcaaatgcagaactcagtattgctttgtgtgtcggtgatatgaaatccagaaaaacgtctatttactttcaaataaaaaaaaagccagctaaacacataatctcacttacaatatcagtcattgttcatatggaaaacaaggatttagctgcctacrtaagatatttgcaatcaaaccttgagaagccaggtcaatattagaacatgcaatatatggccgggccaatcatgcctgtaatcccagcactttgggaggccaaggcgggtggatcacctgaggtcaggagttcaagaccatcctggctaacatggtgaaaccccatttctactaaaaatgcaaaaaattagccgggcgtggtggtgcgtgcctgtagcgcctataatcccagctacttgggaggctgaggcaggagaatagcttggacctgggaggcagaggttacaatgagcagagatt

SEQ ID NO: 132657 - DNA, 601 bp, Human
gccaggatgaaatgaggttgacatcacttcaggcaagatggaaacaatgacaaccaaggaaaggaaacccctgtcaagtgcaaggaacattaataatggacacagactcttgcccactaaaattcccaggtcttaaattgtttgaggatgcaatgtagtagctacatctcatttcacccatccttaacctcaaatgcagaactcagtattgctttgtgtgtcggtgatatgaaatccagaaaaacgtctatttactttcaaataaaaaaaaagccagctaaacacataatctcacttacamtatcagtcattgttcatatggaaaacaaggatttagctgcctacgtaagatatttgcaatcaaaccttgagaagccaggtcaatattagaacatgcaatatatggccgggccaatcatgcctgtaatcccagcactttgggaggccaaggcgggtggatcacctgaggtcaggagttcaagaccatcctggctaacatggtgaaaccccatttctactaaaaatgcaaaaaattagccgggcgtggtggtgcgtgcctgtagcgcctataatcccagctacttgggaggctgaggcagga

SEQ ID NO: 132658 - DNA, 601 bp, Human
caggtggccactgaactcctggatgtaccctcagctcctctgctcctccaggacagcatatggcatttctaggtcacccttaaagtatggcagccagtgcagtcaggcactctgggcagattaactatggtgcctcttcctctccctttctggttctcaagacaacaccaaatagccaggatgaaatgaggttgacatcacttcaggcaagatggaaacaatgacaaccaaggaaaggaaacccctgtcaagtgcaaggaacattaataatggacacagactcttgcccactaaaattcccaggtcttaaattgtttgaggatgcaatgtagtagctacatctcatttcacccatccttaacctcaaatgcagaactcagtattgctttgtgtgtcggtgatatgaaatccagaaaaacgtctatttactttcaaataaaaaaaaagccagctaaacacataatctcacttacaatatcagtcattgttcatatggaaaacaaggatttagctgcctacgtaagatatttgcaatcaaaccttgagaagccaggtcaatattagaacatgcaatatatggccgggccaatcatgcctgtaa

SEQ ID NO: 132659 - DNA, 601 bp, Human
taaacaggtggccactgaactcctggatgtaccctcagctcctctgctcctccaggacagcatatggcatttctaggtcacccttaaagtatggcagccagtgcagtcaggcactctgggcagattaactatggtgcctcttcctctccctttctggttctcaagacaacaccaaatagccaggatgaaatgaggttgacatcacttcaggcaagatggaaacaatgacaaccaaggaaaggaaacccctgtcaagtgcaaggaacattaataatggacacagactcttgcccactaaaagtcccaggtcttaaattgtttgaggatgcaatgtagtagctacatctcatttcacccatccttaacctcaaatgcagaactcagtattgctttgtgtgtcggtgatatgaaatccagaaaaacgtctatttactttcaaataaaaaaaaagccagctaaacacataatctcacttacaatatcagtcattgttcatatggaaaacaaggatttagctgcctacgtaagatatttgcaatcaaaccttgagaagccaggtcaatattagaacatgcaatatatggccgggccaatcatgcct

SEQ ID NO: 132660 - DNA, 601 bp, Human
gacagcccagaattgggtaattaaactaactgggtaggttagggttcactgaggcaaggagaatataaaataaatcttttcaatcaaagaaaataaaatctggcctatttatttctctttatcaagtgaatcaaaagcttggctaaatgaaaacctaaaaccaatctaaaagaggatggctcctggtgttgtatacatccatgcaagaggtaggcttgcgtagaggctcttaatcttcactccccctctgagacattgttggctgctgtataatattgtggtataaatgaggccagcgttstggattaaaatctcttcaagcctcttcattgatcacagggttggaaagaaacatagaagttcaatacctcatataatcaaaaaatcaaaaaactttggaatcagaaggaacgtagggctcacgtcttctaaattctttctttccaagtaagcatctcttgtaagacattattttacagagaagaaaaccaatcaaagtctgaaaaggtaaaatgacttgcctgcctaaggtaacacagcaaattagtgacaaagctgggaaaagaaccatgctctcttgcttcttgccactataccatac

SEQ ID NO: 132661 - DNA, 601 bp, Human
actgttggaaacataagaaccgcccccagaaacaaaatgccagcatctctgggcaaaaaatctaaattgtcagcacatgtatctttgctctgagaaatatacacctatttttttttttttttttaatttcaggatgattccccattccaacatcagtaaaacacttcagactgagagactcagataatttccttcctcctatcgtgaagcatccccaggccacttcctcactgttcctcataaaggtgccatccccaggctggggtcccttggcagggaaaattcaggaacaaggaattgytcagatttcatatagatttatgtcttataaaactataatggaagaaatccattcgtcttcaaaaaatgagaaaaagaaaatacaatttttaatgattacactttccaaatacaatgttttattcaattatcaataattaatgtcaatatgagcagggatagcccaataaaacaagcaaaattagatactaataaccaaacaagctgactgtgttttggtactctttgttccaggccccctgctaagcactttgtatacattcttatttaacgagcacaaatacagtacaaagcctttagt

SEQ ID NO: 132662 - DNA, 601 bp, Human
accaggagtagggtgggcgagacaaagaggaagccatatggggaggggggtgggaggataagggtgaggaggagagaacatggcatgcagtgggaacactgttggaaacataagaaccgcccccagaaacaaaatgccagcatctctgggcaaaaaatctaaattgtcagcacatgtatctttgctctgagaaatatacacctatttttttttttttttttaatttcaggatgattccccattccaacatcagtaaaacacttcagactgagagactcagataatttccttcctcctatcrtgaagcatccccaggccacttcctcactgttcctcataaaggtgccatccccaggctggggtcccttggcagggaaaattcaggaacaaggaattgctcagatttcatatagatttatgtcttataaaactataatggaagaaatccattcgtcttcaaaaaatgagaaaaagaaaatacaatttttaatgattacactttccaaatacaatgttttattcaattatcaataattaatgtcaatatgagcagggatagcccaataaaacaagcaaaattagatactaataaccaaacaag

SEQ ID NO: 132663 - DNA, 601 bp, Human
ggaggttaatgtagataagtccttgtgtaccgcactatcaatcataactctttatcacaaataatgcactgccattcccacagctgcacccagctgtttgggtcatctttagtcatgtccgaactcattctcagagtcctatcttccttctgtctctcccgtttttatgtagctctctgtctgtcttagcttttgtatgatgaagattttcaaggccaggttaagtcttgggctgggtgtagcctgttcatggagagacagtcttggaggcgggtggaaggaagagtcattagggagaaarcttggggaagatggaggcagagaatggagccaaatgaatcaccagaggaaagagaatcactggagaagtgcaacagaatatgtaggaaagactgtctcccagatatcttgctcattcgagaacttccagaaaagaaatagctgaaagagatggagaatgggtttgaggaaagtcatactctgttctgtgaaggattcattttgctgccgaaaggaaataactacaggagaagagagagacagaaagaaaccaggagtagggtgggcgagacaaagaggaagccatatggggaggggggtg

SEQ ID NO: 132664 - DNA, 601 bp, Human
gcagaaaccttggtcttttatttctgtatttacaaagccagtaacatggttggcactcaggaaatggtggttgaataatgaatgaatgcacgattttatgacctcctcagattgcaatcactttgctttcattcagcagcccacgactcagattcatgcactgagtagtcctcccagggttgtggttgggtaggactaactttggggtatgggaaccaataaacttttagggagaagaaaaagaatattgaaggctagaaatttttttcaaccagttttagagaaccactgtttagtagtkctttaatatttcatcatccagccaccaaaggatgcccacaactccctacacatcagaatattttccttatatatgttttaaaaataagaaatttgttttgtaggtaatctgatacctaaggagatacacagagagctgtagtttggggcttcagagacgatttttaagactggaagagagaaaggatggagaaaaaggccaaagaggggagatggcaattcacaccctctttgtgtgtgcttcaatatcaaagattccttaatggcaggaaccaggtgtaaacttgatagatctcccaca

SEQ ID NO: 132665 - DNA, 601 bp, Human
gtaaaactattaactaattagttatcggagcaatcctttcacagaacagttattatctccattttttcagatgaggaaactgaggctcaacaagattaaataactagtaatttaatcaagttgtgtaagaaatggaaagaactagagcaaccagaaagcggcagagctcaggatttgaatataggtaagaggctccaaattcttcactcttaaccctagggattgtctaacccattcccttcattttataaataaggagagtaagacacaaagaaactaagtgacatatgccacgacaagstagggtgtggactgccatgcaagtcttctgatttccagtttaatgtttttgttgctatacaacacagccttggttccagacaacagttctcatgtctagtctatgttttctggtggtttcccatgagttcttgaattgatctgaagatttacaatttcacaaaggatgttcattttatcaaggctgtatagaaaaagcacttgagattgtaacgatttacacctggtcatttggggctttagcattgggtgatccaaatgctagctcttccctcattagatgtgacacagcttgttcttt

SEQ ID NO: 132666 - DNA, 601 bp, Human
aaaagagcgagactctgtcaaaaaaaagaaagaaatatatatatatatttatatattataaatatatatataaatatataacatttactcaagccacatactatttctattaactttttcttcttttttataatttcatgtatttttttaaatttacttttttatttcaataggtttttggggaacacatggtatttggttacataaataagttatttagtagtgatttctgagattttggtgcacccatcacctgagcaatgtaccctgtacccaatgtgtagtcttttatccctcaccygcctccgaccctttccgcaagtccacaaaagtccattgtgtcattcttatgcctttgcatcctcatagcttagctcccacttataaataagaacataccgtttggttttccactcctgagtaaaactattaactaattagttatcggagcaatcctttcacagaacagttattatctccattttttcagatgaggaaactgaggctcaacaagattaaataactagtaatttaatcaagttgtgtaagaaatggaaagaactagagcaaccagaaagcggcagagctcaggatttgaata

SEQ ID NO: 132667 - DNA, 601 bp, Human
atggaaaggcccggccaattacaggtttgcagaaatcaggaagcacatgtaggagtgaactttgaggaagttagactggaggtagaatgggatagagaatttattggcacagcaacactttcttgtgaaatgatattcaaactccttgcagagatgcctataggcattcctaatatactcctgggttgatggcctaggggatgaggtgacaaatgatgggaagactttggcaaaatattgaaaaagagatcagaagattaagaaggtgggaatgttaaaatggaagtattaattttatgtragactgaaaattgattacctgactctgtcctaagatgcatttctgaaggctctcctaggatgcccttgtgggatccagcacctgtcactcacagggtttcagctcaatatggctcctatcattggctttacccccttccacattcactctcctactccctaatttctgctccctaagattgtttcccatataaactccttgcacaaaggctaagacaggctgcttctaagaagtagaaattctaggcaagctaaataatcctgggactgcacagggccctaccactacctccaaaaatta

SEQ ID NO: 132668 - DNA, 601 bp, Human
ctacaggccaataactagagccaggtcatagcacaactacagctggaaaatacagtccctagaagggatgaatatctaggaggaaatagtttacatactgaaggaattgcaatggaaaggcccggccaattacaggtttgcagaaatcaggaagcacatgtaggagtgaactttgaggaagttagactggaggtagaatgggatagagaatttattggcacagcaacactttcttgtgaaatgatattcaaactccttgcagagatgcctataggcattcctaatatactcctgggttgayggcctaggggatgaggtgacaaatgatgggaagactttggcaaaatattgaaaaagagatcagaagattaagaaggtgggaatgttaaaatggaagtattaattttatgtgagactgaaaattgattacctgactctgtcctaagatgcatttctgaaggctctcctaggatgcccttgtgggatccagcacctgtcactcacagggtttcagctcaatatggctcctatcattggctttacccccttccacattcactctcctactccctaatttctgctccctaagattgtttcccat

SEQ ID NO: 132669 - DNA, 601 bp, Human
agaccccactgctacaggtgagtgaagtagtattaattcctagtatgttcattctttagcatcacaaatactaacactcttacctgtggtggattgggataagctagtggtagagggtaacgtattgggttatgtggtggctctggtatttgaaaaatacatgagcagttggctggctttgtcaatacattttcaagtcttaaaaaaataaactggaagaatcaaatgaactgactatcaactcaggaaatcctgctgaaaatcagatccagaggaaaaaaactaatagtggcaatgctaycaaagagactaaatgcataaccttggaattcctcctttgtggaaattctaataggaaattccaataggaaaagaatgggacctggagacccacgtggtacacttaggaagacagtaagagaggattttcctgaaacctcttagaaggcaagaaaagctcctcccctcttgccaaaggaaataagtctgcctttaaaaacactgtaaagaacacatctgaagcaggtgcctctcattctgactcctgtcctcaatatgtgaccccatctctctgtagtccctacaggccaataactagagc

SEQ ID NO: 132670 - DNA, 601 bp, Human
tggtctctagtagaagcagggattcttcatccacagtagccagagtgtagacagagggcatgggtaccgatgcaggtaagctggtaactttggtagtataaaaatgagaaagttcctggcagaataactcaattttctcaatgaattatgaggcagacttagcagcaaagagtgctacttatagaaaagaggatatgtaataggttcagagtgacaagagagagtgcgaagttattttgaagtgggagaaagttaacatagtaaggaatgtagctggagtgctgggctgactcgagtgacratttgagatccgtggcttcatcatcatggttgtgtttttccagttcagaaaagaaactggagttgcttgattgcttccagacaagcaagaaatgagcagtttgtttaactgaggctattcatcaggcaccactgtgcaccacttcaaatcgtctcaccacacctgctcttccagggatggatttggtgatcacttctgctctggcttcagccaacttcacggagcacctcatctgtagctactgtccagctatagcttcttgccctggggtttctccttcactcgtgtccaggaagcagg

SEQ ID NO: 132671 - DNA, 601 bp, Human
tgaaaaggaaaaagcctgagatccaaaatttaagagttcaaaaaagcgaaattcaagatcttttgctttctcaaggactttgctatttgtaagaattggtctctagtagaagcagggattcttcatccacagtagccagagtgtagacagagggcatgggtaccgatgcaggtaagctggtaactttggtagtataaaaatgagaaagttcctggcagaataactcaattttctcaatgaattatgaggcagacttagcagcaaagagtgctacttatagaaaagaggatatgtaataggytcagagtgacaagagagagtgcgaagttattttgaagtgggagaaagttaacatagtaaggaatgtagctggagtgctgggctgactcgagtgacgatttgagatccgtggcttcatcatcatggttgtgtttttccagttcagaaaagaaactggagttgcttgattgcttccagacaagcaagaaatgagcagtttgtttaactgaggctattcatcaggcaccactgtgcaccacttcaaatcgtctcaccacacctgctcttccagggatggatttggtgatcacttctgctctgg

SEQ ID NO: 132672 - DNA, 601 bp, Human
agctatagacaactctttcaagatgttttgctattaagaggaacagaaaaacaaggaaataggcaaaagcagacgtgtggtcaaggatttcaggggttttttaatatatagaatgtactagaacttacttgtgggtacttgaaataatatagtggagaaggagaaatagcaaagtccttgaaaaggaaaaagcctgagatccaaaatttaagagttcaaaaaagcgaaattcaagatcttttgctttctcaaggactttgctatttgtaagaattggtctctagtagaagcagggattctycatccacagtagccagagtgtagacagagggcatgggtaccgatgcaggtaagctggtaactttggtagtataaaaatgagaaagttcctggcagaataactcaattttctcaatgaattatgaggcagacttagcagcaaagagtgctacttatagaaaagaggatatgtaataggttcagagtgacaagagagagtgcgaagttattttgaagtgggagaaagttaacatagtaaggaatgtagctggagtgctgggctgactcgagtgacgatttgagatccgtggcttcatcatca

SEQ ID NO: 132673 - DNA, 601 bp, Human
ccatttactgagttggggaagactagaaaaggagcaatttgaaaaaggaaaaaagttaccattttcaccatgctaagttttaggtgcctcacagacaccgttcggaaatgtttagtaggtaactagagagtctagtctagagttctgaggaatggtccaagttgtagatgtgtacctgagagtcattacctataaaggatatgtaaaagccatagaccagatgaagtcatctaggaaagttatgtaaattcaacaaataaataaataaataaaggagctcaagcagagccctttgggccgygaacatttagtggtgggtagaaaagaacagagatagcaaggaagattgaaaaactgtccaataagatgagagtaaaatcacaagagtgtagcttcgtgaatatcaagaaaatctttcagtaaggaatctgtcatttcatcgaatgctgcagaggggacaagatgatagtagactgactattggatttggtaacatagtgaccactggtgactttggcaagagccacaagaaccattccattaacacagtatgaatggacatctgaaagaaatgggttaaggagggtgaaagaggtgagga

SEQ ID NO: 132674 - DNA, 601 bp, Human
agacccttaaattttggagtttatatctcctttttacagttggtaaagctgaggtatggacagttttacacaagttaaatagctactaagtggttatgaatcccaggagacttgggattcataactaggtctggccgactctaaaatatactgcagctcagaaaacaggcaattctgggtaataaaaaaacaattctgatttaaaataaaagcaaggcaatgcagaataacaagaaaagatcattagaattaaatccagccccgcttggaatactatctctatcatcaacccttaaacaarttactttccattagccacagtttctcctctgttaaatggcctaagaactacccgacaacacagcagtatgaactagatatgataatctttgtgaatgtgcctaacccagtagcctatacaatagggctcctggcacagaatctgtaccgagtaggcattcagtaaatatttgttgaatgataatgcagtagacgcgcgagaacccacaagaactcacaaaatcataacagatggttgtcttatttttaaggattacctatcccttccccacccccagagatcacactacctataccttca

SEQ ID NO: 132675 - DNA, 601 bp, Human
gtccttctcattcacacctctgcctaaggtgactaccctgatgtgactaaatatgcaaggacttagttctttgacctaatgcaagaactatagaaaactactaaattttctgcaaacccagaaaataagaacggtcagttctcaacagaaggggaaatgagggaaaggttactagcatttcctatgtaataaatatgtttgcattgtatcatgccatacgcgtgtgtgtgtgtgtgtgtgtgtgtgtgtgtgtgtgtattcactcaatcattacagagacccttaaattttggagtttatrtctcctttttacagttggtaaagctgaggtatggacagttttacacaagttaaatagctactaagtggttatgaatcccaggagacttgggattcataactaggtctggccgactctaaaatatactgcagctcagaaaacaggcaattctgggtaataaaaaaacaattctgatttaaaataaaagcaaggcaatgcagaataacaagaaaagatcattagaattaaatccagccccgcttggaatactatctctatcatcaacccttaaacaaattactttccattagccacagtttc

SEQ ID NO: 132676 - DNA, 601 bp, Human
ccgttgagaagaaccctacctaaatgggccatgcatttcattgtcacagtggatgatggcaagtgaaatacgagattgatgtcgaatttttcaagaaagatggaagacagggatatggaatgaaggtgagaaagaaagaaggaaagaaatgctttcaatgaaagaaattcttctttcccacatttccagttgaaggattaatctgtcctctgagagttaatgtcatatgatgatctttaggaaaacacaaaatagagggcattttgcactgccaaatgttcctatcattccattcctgtcktgtccacatatagtagtgttagtttcataatctttggtctttgtgactgagaaagtccttctcattcacacctctgcctaaggtgactaccctgatgtgactaaatatgcaaggacttagttctttgacctaatgcaagaactatagaaaactactaaattttctgcaaacccagaaaataagaacggtcagttctcaacagaaggggaaatgagggaaaggttactagcatttcctatgtaataaatatgtttgcattgtatcatgccatacgcgtgtgtgtgtgtgtgtgtgtgtgtg

SEQ ID NO: 132677 - DNA, 601 bp, Human
accttatacagggtatttctgactttgaatatcttaccgttgagaagaaccctacctaaatgggccatgcatttcattgtcacagtggatgatggcaagtgaaatacgagattgatgtcgaatttttcaagaaagatggaagacagggatatggaatgaaggtgagaaagaaagaaggaaagaaatgctttcaatgaaagaaattcttctttcccacatttccagttgaaggattaatctgtcctctgagagttaatgtcatatgatgatctttaggaaaacacaaaatagagggcatttygcactgccaaatgttcctatcattccattcctgtcttgtccacatatagtagtgttagtttcataatctttggtctttgtgactgagaaagtccttctcattcacacctctgcctaaggtgactaccctgatgtgactaaatatgcaaggacttagttctttgacctaatgcaagaactatagaaaactactaaattttctgcaaacccagaaaataagaacggtcagttctcaacagaaggggaaatgagggaaaggttactagcatttcctatgtaataaatatgtttgcattgtatc

SEQ ID NO: 132678 - DNA, 601 bp, Human
aagtctcaatggatagttggtgacctaaacatcaccaggttgaaaactccttggggataagaatatccccaatttataatacctctgtatctacaacaaacttaatagtaagttctgcataaaacagcctcttaataaatgtccattgattaaatgcagaaatgggactagggtgatgcaataggaaataaatactgtgcaaatttagagacaggagagtatagtgtagggaggtgaagtcagaacagacttcacggaggatgacagacttaaataatatattgaaataaatggctgtgcwatgagccagtagtaatctaagcatctaaaatgaaaaagcactaagctctaagggtgtggagctatctcacagtggcaccttatacagggtatttctgactttgaatatcttaccgttgagaagaaccctacctaaatgggccatgcatttcattgtcacagtggatgatggcaagtgaaatacgagattgatgtcgaatttttcaagaaagatggaagacagggatatggaatgaaggtgagaaagaaagaaggaaagaaatgctttcaatgaaagaaattcttctttcccacatttcca

SEQ ID NO: 132679 - DNA, 601 bp, Human
ctgacagggtgaattattctgggaataattattatgtatgtattccttcattcacttttctgaagcctctccgttatcatcacccatatcatattcacttctcctagaatagtgcagacatggcagaaagtgaattccaggagtctggctagtaacattcaaattaaacttattgcaccattaggctgagaaatgtttttctttctggcaagaataaaatgataactataaaagttcttaacaatataaggtttttcaggaatagtcttgctctgaaggtaaaaagttgtctctgttcctractcttaggaaaagtaacatgcagtaaacacttagtaacattttgaatgaatgcatgcatgattggataaataaatggataaatatacaaaagagtgggtaagtgaataaatggctcattgaactatatctctctactttttagaatagttactgattgtgcaggtaaaaatcacatcgtaagaaatctggggcttatcctctgaaagaatgatctcagagaacctaaactctgatctttcaaatgagtattttaagattactgtacatgtgcttcagaagcttactgcaaaatataacc

SEQ ID NO: 132680 - DNA, 601 bp, Human
acctatattcatcccataaaagagcagccatgaaatacttccctagcgatgagccatcagtgttggtaagacgttcttaatagaacaagaagtcacatgaaccaatacgtcattccacatgtgaacaaaaattctacaagggaacaactcagaatctggttgttatttttgcctgttttttttcttgctatcagggtcactaatgcttaagaaaagtacgtagagagtggggcaaaagttgagacaataaagcttgcatatttagaaatctgtgtctacaagatgtttccttcttctgaayaaaagcttgccattattaccaaccacttagagcttttagtctgcctggctggagaacaatgcagagtgtttaagatgctctgttaccagtgttttgtaaagatttttttttcttactcctaaggactttgctcctttgtgaccttaagggtgtgtaattttcagtttctgtttagcatagacaagatgagtattgtttctagccctgtattctaaaagcaaaatccctaaaactccaattcagaaattaaatagatttctaaaaatgtaccctacatcactcaaccaaagtctgtctctc

SEQ ID NO: 132681 - DNA, 601 bp, Human
caagcataagatgagataccaaagaattaaaatataggcaggatagaagtaattttaaagagtgtaatacacaatcaacaagacatgaaacatttacagtacatttaagaaacgttaggtatttcttttaacatccttggttgaaaccattttaagttaacaacatgacttttttcccctactcttggtccacttgatgctctccttttatgctcctagcagacataattagcagacactgatgatgtcattccaccaaatctccattcctattagccctaataattttagcaagtgatcrtgaaagaacactgaccttagtggcttaagcctcccatattcaagaggtccccatcttacgaagacaggcagtatgactccctctaaagaggcaccaacttcttttcaaatgaatcacagaatctaattattctgaaaattatttaagcagaaatcagtacctatattcatcccataaaagagcagccatgaaatacttccctagcgatgagccatcagtgttggtaagacgttcttaatagaacaagaagtcacatgaaccaatacgtcattccacatgtgaacaaaaattctacaaggg

SEQ ID NO: 132682 - DNA, 601 bp, Human
cacttcaataaatattaccgagcataactatatacaacgcaaggtgctaagtgatgcaagaaatccaagatagatagcatttagtccctccttcaatatgcttaccaccaagcataagatgagataccaaagaattaaaatataggcaggatagaagtaattttaaagagtgtaatacacaatcaacaagacatgaaacatttacagtacatttaagaaacgttaggtatttcttttaacatccttggttgaaaccattttaagttaacaacatgacttttttcccctactcttggtccayttgatgctctccttttatgctcctagcagacataattagcagacactgatgatgtcattccaccaaatctccattcctattagccctaataattttagcaagtgatcatgaaagaacactgaccttagtggcttaagcctcccatattcaagaggtccccatcttacgaagacaggcagtatgactccctctaaagaggcaccaacttcttttcaaatgaatcacagaatctaattattctgaaaattatttaagcagaaatcagtacctatattcatcccataaaagagcagccatgaa

SEQ ID NO: 132683 - DNA, 601 bp, Human
tactgcaccagatccacgggtcactacctctgagcttctaaattctaataaccacaaccccagctctaaaacgaagtcccggcaggtattatttctcagcattcccttttcattcttccagctgtctgatttcctatattacattcccactgttgacaaacattcatatatttctggtgagaaagtaaaatgatactaccgctctgaaaaatggttggccatatctgataaggttaaacatgtacctatcctataaccaattattcagctcctgggtatatacccaagagaaataaaaacrtatgtccacaaaagcatataaacaaaaatgttcagagcatttttattcacaacagccaaaaactagaaacagcccaaatgttcatcaacagaaaacaataaattctgttatattcataaaatggtatattactcagctttaaaaaggagcatactgttgataaatgcaacaacatgagtgaatctcaaaacattatattgagcaaaggaagccagacatacagtaagatatattttatgactgaatttatatgaagttctaggtattgatgggatgtatctcaaaataataagagctatc

SEQ ID NO: 132684 - DNA, 601 bp, Human
catgtcggcttgtacaagaaaaaaacaattgacaggcccccaacattgtgatgacacaaatgttcaaattatctgaccaagattttaaagcagctattataaaaatactcaaacaagcaatcatgaacatgctttcaacaagttaaaatcgaaagcgtcagcaaagacacagaagatagaaagaagaaccaaacagaaattttagaaatgaaacaatataatggttaatataaaaaatacttgctggatggaactcagtgaccaaaatgttagtaatagaggaaagagtcagttaacttamaggtaacaagtatagctgagcagtaccttctccttgaggctctaagtactgcaccagatccacgggtcactacctctgagcttctaaattctaataaccacaaccccagctctaaaacgaagtcccggcaggtattatttctcagcattcccttttcattcttccagctgtctgatttcctatattacattcccactgttgacaaacattcatatatttctggtgagaaagtaaaatgatactaccgctctgaaaaatggttggccatatctgataaggttaaacatgtacctatcctat

SEQ ID NO: 132685 - DNA, 601 bp, Human
cataatatttaaaatatccaaaatacaatccaaaattactcagcatacaaagaaccataacatgtcggcttgtacaagaaaaaaacaattgacaggcccccaacattgtgatgacacaaatgttcaaattatctgaccaagattttaaagcagctattataaaaatactcaaacaagcaatcatgaacatgctttcaacaagttaaaatcgaaagcgtcagcaaagacacagaagatagaaagaagaaccaaacagaaattttagaaatgaaacaatataatggttaatataaaaaatacytgctggatggaactcagtgaccaaaatgttagtaatagaggaaagagtcagttaacttacaggtaacaagtatagctgagcagtaccttctccttgaggctctaagtactgcaccagatccacgggtcactacctctgagcttctaaattctaataaccacaaccccagctctaaaacgaagtcccggcaggtattatttctcagcattcccttttcattcttccagctgtctgatttcctatattacattcccactgttgacaaacattcatatatttctggtgagaaagtaaaatgat

SEQ ID NO: 132686 - DNA, 601 bp, Human
gaggttaatcaacttatccaaggtgacaggtatcggtaattctaactatcttcttgcagtactgttcagtgtacactagtgttttctttgtttattagctttttcattcattcgaaaatatttattgagtgcttccaatatttatttagttccagactctgttcccagtacctgggatacatagaacaaagatccttgcccttgtaaagcttaaattctaatggtggtaatagataataaatgagaaacccaggtttacataaataaagaagtgatttttctttcatcttgtgaagtatgycttcaaaatccaaacttactggttctggttccagataagatggagtgaacacatgccaatttttttctcctacttaacacaactatgaaaccttgataaaattcatggcacacctatctgaggtctctgagaataaaatatcaacaggcagattgagaagaacaccagaattcaaagtgtcaccaaactgagtggctttaaataaggctcagaaactcataacataatatttaaaatatccaaaatacaatccaaaattactcagcatacaaagaaccataacatgtcggcttgtacaag

SEQ ID NO: 132687 - DNA, 601 bp, Human
aaaatagaggtggactatttctgatttcatttatcatctgtttacataagaccaactgccccatgaaataagtctatcctttggttattcttgctccacattttaaaagttatctttattattttggcatttgaagaggagaggagacattgaatttgtggggttttttgagcacttatttatgctaaatactttacatatatcatttctttctataaaatatcattttcctattacatacaagaaaaaaactggtacatacacagagaggttaatcaacttatccaaggtgacaggtatyggtaattctaactatcttcttgcagtactgttcagtgtacactagtgttttctttgtttattagctttttcattcattcgaaaatatttattgagtgcttccaatatttatttagttccagactctgttcccagtacctgggatacatagaacaaagatccttgcccttgtaaagcttaaattctaatggtggtaatagataataaatgagaaacccaggtttacataaataaagaagtgatttttctttcatcttgtgaagtatgtcttcaaaatccaaacttactggttctggttcca

SEQ ID NO: 132688 - DNA, 601 bp, Human
accagtgaggccactctaacgtcaaagcctatgtatgaactccctttttccatacgaagatcatttttcttaatagagaagatgtaattaaaatagaggtggactatttctgatttcatttatcatctgtttacataagaccaactgccccatgaaataagtctatcctttggttattcttgctccacattttaaaagttatctttattattttggcatttgaagaggagaggagacattgaatttgtggggttttttgagcacttatttatgctaaatactttacatatatcatttcttyctataaaatatcattttcctattacatacaagaaaaaaactggtacatacacagagaggttaatcaacttatccaaggtgacaggtatcggtaattctaactatcttcttgcagtactgttcagtgtacactagtgttttctttgtttattagctttttcattcattcgaaaatatttattgagtgcttccaatatttatttagttccagactctgttcccagtacctgggatacatagaacaaagatccttgcccttgtaaagcttaaattctaatggtggtaatagataataaatgag

SEQ ID NO: 132689 - DNA, 601 bp, Human
cagatatacaaaacacggctgctttgtggacagtaaaattgaaaaaaaaatttaacttaaatttttgtaaatcctattggaatatttctattcaatgcctgaaaagaaggaatgaaagcaacaaatctctttgagaatttgtaacacgtaaaatatacagcaagtttactgggcaatcatggtgagagagacaggcacaggctcctaggtctcccacagagctcttgtagagagctgatctgctggacccaagctgaaggtctaagcaaggctagaagcctgatacatgtagagtttgtttaaggaacaggggagttacaggcaataaggcagagtgggctgtgactcagcaggtacagacttgtgttgaacttagtccagctatcccagaccaaaaggtgaacagcagcaaaactaataaaggttgtgaatttaccacttcccaatagaagtagttttggaaatgagctggcaattataagattctctttgaggctgggtaatgaggagaggctatgtcctctccttcccccacgcttcccgtaagttttattctgtcacacttaaaacaactttgtgggagtaggcattgttatttcca

SEQ ID NO: 132690 - DNA, 601 bp, Human
tgatattaatcactatatcttcttcctgaactcaatagctaaatgccaaagaattataaacagaggtagatactcatagagatgcccatttgctatacgtttatgtagtttccaaaagattaacattattttcttggggtctttggaatgttgtggttatctaaagaaaagttaaacagtgttatatcaataaacaactaaatcagggaaatcaatgcattttttgaacacttatcagatctcttgcaccagtgaacagcagttataaaatctgagattttcacttagcacctattcggtrcagggcttgagataggtggagaatgtgcagatatacaaaacacggctgctttgtggacagtaaaattgaaaaaaaaatttaacttaaatttttgtaaatcctattggaatatttctattcaatgcctgaaaagaaggaatgaaagcaacaaatctctttgagaatttgtaacacgtaaaatatacagcaagtttactgggcaatcatggtgagagagacaggcacaggctcctaggtctcccacagagctcttgtagagagctgatctgctggacccaagctgaaggtctaagcaaggct

SEQ ID NO: 132691 - DNA, 601 bp, Human
aaataaaataaagtatcttccagcaacctaaggagaactcaatcagcagagaaaataaaaaggtcaaagtagactcactatttaatcatattttccaggacaccgacatgcctcccatagatctaaagccccagctttatgccatgttgctgtatggacagcagtagtccccaaattaatctcacacatttcctcctgtagcctgaacatggaattcccaacctccccatgtctgaccatcaaagcgttaaccaccttgaaagcccaagctcagatgccacctgccctaggaagatttttygaatctcctaaactggaatgtcagaactgtgtgagtcctgtttgcctcagctccacacagctacagggacaaaacactcacaaagtaaatcggagcaggagacattttggcctgccttgttccaaggcatcttcccaggcccagagagcttccatggttctcttctttccctttgatgcaggctttcagacacagtctccttcctcctcctctcaggaacagccaccccatctattatcccttgtaaaaatctctttgcccaagcttggctatagagaggcaatgaggttttccaacccg

SEQ ID NO: 132692 - DNA, 601 bp, Human
gcaattgtttagtctagacagcaggcgcagaaaggtgacgagagtttggcttcacattaatgaagggttgttattagtgaggtagtaatcatttgctatccatgcccacagtagacaacacaggagcaaacaaattaaattacatcaggaaagatttcaattagacataaggaagaacctcccggctgattaattagtagaataaagtccttgagagagactgtcatcctcatctctggagtgcttcaaggaggcagtaaacaattctctaccttggcaggctttggtaatcatctagctrtgccaccaagacctctagaggtcccctccacctatttgatttgatgagtctcttacagtgcttattggtatctcatgggtcacagaaatacactggaactggcaaaacactgaggctcaataaggctggaaaacagcagggattagtgggagaattaaggactgaatagacataagaaatgccattcttcaatatgatcatattctaactctgttaagatcgaaagaaaaatgcataaactcatactttcccagtgggagactaaatggttagaaataaaataaagtatcttccagcaac

SEQ ID NO: 132693 - DNA, 601 bp, Human
cttccccacattgaaagtcattgatgagatctccaaagcagttactttgaatttagtctaaatttctctttactataataattatttttaaataatgtagagatactcaagagttcagagaactttaatcaagatggctaaagacattaaaataaaccctttgatgaacagtgcaagaaactgcaattgtttagtctagacagcaggcgcagaaaggtgacgagagtttggcttcacattaatgaagggttgttattagtgaggtagtaatcatttgctatccatgcccacagtagacaasacaggagcaaacaaattaaattacatcaggaaagatttcaattagacataaggaagaacctcccggctgattaattagtagaataaagtccttgagagagactgtcatcctcatctctggagtgcttcaaggaggcagtaaacaattctctaccttggcaggctttggtaatcatctagctatgccaccaagacctctagaggtcccctccacctatttgatttgatgagtctcttacagtgcttattggtatctcatgggtcacagaaatacactggaactggcaaaacactgaggctc

SEQ ID NO: 132694 - DNA, 601 bp, Human
tgtctaatgacctggctgtaacaccagtcatttttgttttcaccaaaaatagtccacaagcttccccacattgaaagtcattgatgagatctccaaagcagttactttgaatttagtctaaatttctctttactataataattatttttaaataatgtagagatactcaagagttcagagaactttaatcaagatggctaaagacattaaaataaaccctttgatgaacagtgcaagaaactgcaattgtttagtctagacagcaggcgcagaaaggtgacgagagtttggcttcacattmatgaagggttgttattagtgaggtagtaatcatttgctatccatgcccacagtagacaacacaggagcaaacaaattaaattacatcaggaaagatttcaattagacataaggaagaacctcccggctgattaattagtagaataaagtccttgagagagactgtcatcctcatctctggagtgcttcaaggaggcagtaaacaattctctaccttggcaggctttggtaatcatctagctatgccaccaagacctctagaggtcccctccacctatttgatttgatgagtctcttacag

SEQ ID NO: 132695 - DNA, 601 bp, Human
actatattttgaactttcatggcaggaggcacacaaatatacgttcataaggattcccaaaatgtgtttgtataccacaaagggattatgtctgttaacacattaatgaacaacaaaaaatgcactgtatcacccatggccctgtctaatgacctggctgtaacaccagtcatttttgttttcaccaaaaatagtccacaagcttccccacattgaaagtcattgatgagatctccaaagcagttactttgaatttagtctaaatttctctttactataataattatttttaaataatgtrgagatactcaagagttcagagaactttaatcaagatggctaaagacattaaaataaaccctttgatgaacagtgcaagaaactgcaattgtttagtctagacagcaggcgcagaaaggtgacgagagtttggcttcacattaatgaagggttgttattagtgaggtagtaatcatttgctatccatgcccacagtagacaacacaggagcaaacaaattaaattacatcaggaaagatttcaattagacataaggaagaacctcccggctgattaattagtagaataaagtccttgagag

SEQ ID NO: 132696 - DNA, 601 bp, Human
cataggaggtatttaacaaatgttgaatttgattcccctgctctcttgccttagcttttccctattacccattatctccctaacttctccataaaccacaaagccattttatgaggaaataaatgccatatgatctcacagttacttgtagtaatcatcatgtctattatttcaaattctctggacaaggcactctaagagacactagaggaaataatcccagatgatcagattagaaaggcatggatgatataaggcatagtgtcttgtattatctagatttataatttaaaagtatacyatattttgaactttcatggcaggaggcacacaaatatacgttcataaggattcccaaaatgtgtttgtataccacaaagggattatgtctgttaacacattaatgaacaacaaaaaatgcactgtatcacccatggccctgtctaatgacctggctgtaacaccagtcatttttgttttcaccaaaaatagtccacaagcttccccacattgaaagtcattgatgagatctccaaagcagttactttgaatttagtctaaatttctctttactataataattatttttaaataatgtaga

SEQ ID NO: 132697 - DNA, 601 bp, Human
cactgatacttttattcctcattttttactgagccctaatttggaggaatcggtttctttctgcctaaaatattaatgccccatgactgatttcagtggaatatcttcacaaccaatacatccttaggcagccccttctccaattcccaggtacctttgtgtcatcatataagcatacctggatttgacaatcctatccattcttttttccttcccccgataatgatttgctgtgcatactcattttcatatatccaccatccctagcaggtgctttacacataggaggtatttaacaaawgttgaatttgattcccctgctctcttgccttagcttttccctattacccattatctccctaacttctccataaaccacaaagccattttatgaggaaataaatgccatatgatctcacagttacttgtagtaatcatcatgtctattatttcaaattctctggacaaggcactctaagagacactagaggaaataatcccagatgatcagattagaaaggcatggatgatataaggcatagtgtcttgtattatctagatttataatttaaaagtatactatattttgaactttcatggc

SEQ ID NO: 132698 - DNA, 601 bp, Human
agatttcttctccccatggctgcatctatgttaaatgagataaaacagcatctgcctcacagcattgttgtgagagctaaacgaattaatacaggtaaaaggacttctaagtcctttgcctgaggcattgtcaaagctcaaaaatgttaaccattattataatgatttctcatttgtaaataaaacacatgtcactgatacttttattcctcattttttactgagccctaatttggaggaatcggtttctttctgcctaaaatattaatgccccatgactgatttcagtggaatatcttcrcaaccaatacatccttaggcagccccttctccaattcccaggtacctttgtgtcatcatataagcatacctggatttgacaatcctatccattcttttttccttcccccgataatgatttgctgtgcatactcattttcatatatccaccatccctagcaggtgctttacacataggaggtatttaacaaatgttgaatttgattcccctgctctcttgccttagcttttccctattacccattatctccctaacttctccataaaccacaaagccattttatgaggaaataaatgccat

SEQ ID NO: 132699 - DNA, 601 bp, Human
acccagcaccccatgtaattccatgagatttcttctccccatggctgcatctatgttaaatgagataaaacagcatctgcctcacagcattgttgtgagagctaaacgaattaatacaggtaaaaggacttctaagtcctttgcctgaggcattgtcaaagctcaaaaatgttaaccattattataatgatttctcatttgtaaataaaacacatgtcactgatacttttattcctcattttttactgagccctaatttggaggaatcggtttctttctgcctaaaatattaatgccccaygactgatttcagtggaatatcttcacaaccaatacatccttaggcagccccttctccaattcccaggtacctttgtgtcatcatataagcatacctggatttgacaatcctatccattcttttttccttcccccgataatgatttgctgtgcatactcattttcatatatccaccatccctagcaggtgctttacacataggaggtatttaacaaatgttgaatttgattcccctgctctcttgccttagcttttccctattacccattatctccctaacttctccataaaccacaaagc

SEQ ID NO: 132700 - DNA, 601 bp, Human
ggagaagggcatgggctgatgaaaggaagaaggatttgatccctgtgaaacacactgcttgaatggccaatccttgaacatgcattttacccagtatcttttaacgactcaaaccaaatcctgacacaccaacagatttctctaactctgcattcatctattttcagaatatgctgaaataacacccacagcattacagttcttcttggtcatcacaccatcccccagtgccatcccaatctctaggagacacccacatacccacctaatctagtgccccccaaatcctattggcaccatytccaagtgaactccttccttgccagttagacccagcaccccatgtaattccatgagatttcttctccccatggctgcatctatgttaaatgagataaaacagcatctgcctcacagcattgttgtgagagctaaacgaattaatacaggtaaaaggacttctaagtcctttgcctgaggcattgtcaaagctcaaaaatgttaaccattattataatgatttctcatttgtaaataaaacacatgtcactgatacttttattcctcattttttactgagccctaatttggaggaatcggt

SEQ ID NO: 132701 - DNA, 601 bp, Human
atgctcaagggtaggatgcatgaggaggacttagccagatgggggctacaccaccaccatgcagagccaatgccagggcttgcgggaaaactctcaatgagaaagggaaaggatggaggagaagggcatgggctgatgaaaggaagaaggatttgatccctgtgaaacacactgcttgaatggccaatccttgaacatgcattttacccagtatcttttaacgactcaaaccaaatcctgacacaccaacagatttctctaactctgcattcatctattttcagaatatgctgaaataacrcccacagcattacagttcttcttggtcatcacaccatcccccagtgccatcccaatctctaggagacacccacatacccacctaatctagtgccccccaaatcctattggcaccatctccaagtgaactccttccttgccagttagacccagcaccccatgtaattccatgagatttcttctccccatggctgcatctatgttaaatgagataaaacagcatctgcctcacagcattgttgtgagagctaaacgaattaatacaggtaaaaggacttctaagtcctttgcctgaggcatt

SEQ ID NO: 132702 - DNA, 601 bp, Human
cataatctttcattgaattattaaccaaaatttaatcaaccccctcttcatgaaaatttaggatgttttcaattcacaaaaactggataaccaccctcataggcatatctttgtgcaataaaccttttccttattttaagtaaggttgaccaccatgggatccttttaacttcaatccatttattcccaactgcctcttcccacttgggaaacataaaaatacatacagcaaatgtaatctcacatagtcactttcactcacaatgacatgcagattcaaactcaactcatacagaaatayacccagtatacagattcctcatacattcacttgtctctgtcatcaaaagagaggaagaggctaggataaggctatggctgcaagaagatagggacaggatagcagaggagttctgaagattggggagaaatgaaaattagtcagagatttatcagagagataagaaaatagtaatgtggtcatgaggctggcatctccagttatgagaagaaggtatcaaagtcatcaattaggaaaagtctgatgctgagaccgggaggctgacagtgacatggatgctcaagggtaggatgcatgagg

SEQ ID NO: 132703 - DNA, 601 bp, Human
ttctcagaaagtatttcccataggaccttagcttgattccttccaagctactaccatcacatccagagtaacagaattataattgtgaaaatattcataagtttactgattaaaaatatgttcaccaggatctttcccttaaagagggaatctcaaggtatttaatttttatttgataactttatgtgctacctagatccaaggaggacttcataacagaacatagcagtcagagcatgtacatggcatctgtttgctcagagattgattggttttctggtctggccttattatgctcttsacttcagtagactagggaatgtctctgtatcagtgataaatgaaaagatctaggattgaaactgtgataagtggctatcaactaaaccaggaagcacagctgttaaataagcattacgatttgaacacaagaatagattccattaatccgccctccggggggtccatacacaattagtgaaagtctatccatccctgagagccagctccattataaccagggattcaactcacttccaaataccccataaagacggaccccacaagagttaaagagtggctttccagggctctcatgcaa

SEQ ID NO: 132704 - DNA, 601 bp, Human
ttgatgatgaagactggatgactagcacaagaagcccaggactatgcattacaatgtgtgttaaactgctgtcagttcagtttggcttgcttcaagcatagcactcaaagatccagacaagaactccaccaatcctcctgaacacagccttacttcagtgttctttggataaaagacaaacacaaagcaaagcagaggttcagaagagctgtgagaagaatccttgaaggcctgttgaaaaattcatatgcaactcctctaccaagtaagttgagtctttgctacacaaatcagtatttgwcaattcaaactccaagaagtcttttctttctacatttgaataatctcagcaataacagaacttcagcaatttgccgacaaataatcacattaattaagatttgtataagtgttttataatttatggatctctttcatgtacgtaattgttcttccattatcattctcagaaagtatttcccataggaccttagcttgattccttccaagctactaccatcacatccagagtaacagaattataattgtgaaaatattcataagtttactgattaaaaatatgttcaccaggatctttccc

SEQ ID NO: 132705 - DNA, 601 bp, Human
gggaaccaccccagtgattcagttacctccacctggcctctcccttgacacatgaggattatgaggattatggggattacaattcaaggtgagatttgggtggggacacaaagcctaaccatatcaggttggttattgccttgattctgaccaactctaggaaacttatgaaattgagattggaagactaaaaattcatggggtgtcataatcctgtcaaagcaatactttttgtttgacttctgcctaaagtaccacattggtctccctctgtaacatattcaaaaaattcatttaactratacttaccaagcaactattatgtgtgaagcactagggattcagtggcacaaaaaaaaaaaaaaaagaaaaaaaaacagacagttcctgccaccacagtgttcttggtctagtagatgtctaatttcatccctccaactacaacaagcagtgcctgctctaactgaattaactacaactgcaccatccaggcaagatcacaatggaaggttttgttttgatgatgaagactggatgactagcacaagaagcccaggactatgcattacaatgtgtgttaaactgctgtcagttcagtttg

SEQ ID NO: 132706 - DNA, 601 bp, Human
gtctaccaggcatatgagtactccaccttgggagtggatcctccagccctcgtcaaacactctaactaatgccacttggagctaaaataagctgtccctgttgggtccttcctaaactgtgaaattgttagcagataaataagtgttgttaacttaacacaataagtttggaggtgatttgctatggaaaaatccacaatggaaactgtgtaactaaatgataactggtttacatttcagtctttgatgagtttggtgaggtgtattaatctgttttcatactgctataaagaacttcccragactgggtaatttttaaagaaaaagatttaattgactcacaattcagcaaggctggggaggtctcaggaaacttacaaccgtggcagaaggtgaaggggaaacgaggcacctacttcacaaggcagcaggaagaagaagtgcacacaggaagaactaacacacacttataaaacgtcggatctcaagagaactcactcactatcacaagaacagcatcgagggaaccaccccagtgattcagttacctccacctggcctctcccttgacacatgaggattatgaggattatggggatta

SEQ ID NO: 132707 - DNA, 601 bp, Human
aaatagtataagaaatctgcaaaagaatcacaagaattaacatgtatcacttgtttaacagggatctctgaaaaaagatagggttggcaaaggaaacttgtctgttgaaaacctacaaaagaagaattaatgtataaaaaagtgacttttctagcaccttggagaggagaaacctacctgaaaggaaaaaaaataattttttttttttttagatggagtcttgctctgttgccaggccggagtgaagtagcattatctcagctcactgcaacctccgcctcctgggttcaagtgatttctyctgcttcagcctcccaagtagctgggactacaggtgtctgccaccacacccagctaatttttgtatttttagtagagatggggtttcaccatattggccaggctggtcttgaactcctgaccttgtgatccgcccacctcagcctcccgaagtgctgggattacaggcatgagccaccgcacccagcctttttttttttttcttgtctaaataaatacctttggcagataacaatctagttgagatggaaagattataacttcagtgacaccagaccctcagaccacgtaattcactcct

SEQ ID NO: 132708 - DNA, 601 bp, Human
gggactacaggcgcgcaccaccatgccaggctaacttttctatttttagtagagatggggtttcaccatgttgctcaggctggtctcgaactcctgacctcaggtgatccacctgcctcagcctcccaaagtgctggcattacaggcgtgagccaccgcacccggccaaatcaaaattattattataatatgtagaaacttgggaaggtgaccatccattgaaacattgtctaaaaaagcagaataaaaattaggcacatgctatgatgacaactatataaaagtaagcatgcataaggtyaaaggctacagtaaattaaaatacttatgttaggatggtgggaatatcagtgaactttcttctgttctgattttcgtattgctgctgtgtacgtattatatgccttgggaaagttggcttctctgaggtcccatctccccaatacctgcagtgcattgttgtgctacaaagtaggacatatacactttctggaactaatagataactaataaatggtgaccactagggtctcctaaatggaagtacagtaagcaagcttggaacttttatcaaggtattacaaatagtataagaaatctg

SEQ ID NO: 132709 - DNA, 601 bp, Human
acagagtttctctctgtcacccatgctgcagtgcagtggcacgatcctggctcactgcaacctctgcctcctgggttcaagtaactatcctgcctcaggctcctgagcagctgggactacaggcgcgcaccaccatgccaggctaacttttctatttttagtagagatggggtttcaccatgttgctcaggctggtctcgaactcctgacctcaggtgatccacctgcctcagcctcccaaagtgctggcattacaggcgtgagccaccgcacccggccaaatcaaaattattattataayatgtagaaacttgggaaggtgaccatccattgaaacattgtctaaaaaagcagaataaaaattaggcacatgctatgatgacaactatataaaagtaagcatgcataaggtcaaaggctacagtaaattaaaatacttatgttaggatggtgggaatatcagtgaactttcttctgttctgattttcgtattgctgctgtgtacgtattatatgccttgggaaagttggcttctctgaggtcccatctccccaatacctgcagtgcattgttgtgctacaaagtaggacatatacacttt

SEQ ID NO: 132710 - DNA, 601 bp, Human
tgctgaatgagaagaaagattgcacaccaatttgatacttcaatgaactcatatggacttgggctccctctcattacggcatcatattacaggaacatgtttaagtcatggctcactgtgattctcagctgtatgttgccatcctctttcatcctgttttcctgtaagtgagctcttcattatcagtactaatggaggacagggagggcatacctaaccaaaatcaacagataactccaaaacttattgtaggcaaagggttcaaaattctcccccaccaagccctttgcagagctcctaycatgaagcagaacttaataatgctttagccgttctttatgcttctccatatcagctggtggaagtcctaacaagcagcaaaatgaccaaaacccagcaggaggggaaagggtgaaaagcaaaagacctagaaactgcacaaagtgggtaataagtgcctgaatgatgagctcttggaaaatcaggccctgcttgatgaggtttattcccccacccccaaaatgcaatgaagacaaatcacccagcaagtttgctctaagatgtaaattctgagttgccatgaattactcccacaactcag

SEQ ID NO: 132711 - DNA, 601 bp, Human
tgatgaaggtatagctgcaggacaggagggaggaaagagaataacggagtcagggtgggcagaagcaatggaagaaataaggctgaaaacagggccaattgtgaagcttttgaacaggatgctgtattcctataaataagtacccaagaacagttttcaaacagggcagataagtgatccaattaatttttctaattaatttttttcattgttgttaagaaaaatagtggttggcataaagacaagttaagcggctcatagtgtagataagggaaacaatgcaaacctgaaccccagtagyggaaatgatgattgcatgctggagaataatctgagactattgtgaagagtggatggatgtgacatgtgaaatgtagtggatttaaatgcatcaattgctccctgtgactgcagggagaataagtatagctctgacctctgcaggacactatcaaggtatgacaccttgtatttatgatctttcttactataactacaacctccttaggacttcaaggtcaaaggtgagctgactggttcttattaaaattggcaaaggaagaagaaatgcttgggagtcaagaaggaaaggaagcctgga

SEQ ID NO: 132712 - DNA, 601 bp, Human
gaagagtatgggaatgatgaaggtatagctgcaggacaggagggaggaaagagaataacggagtcagggtgggcagaagcaatggaagaaataaggctgaaaacagggccaattgtgaagcttttgaacaggatgctgtattcctataaataagtacccaagaacagttttcaaacagggcagataagtgatccaattaatttttctaattaatttttttcattgttgttaagaaaaatagtggttggcataaagacaagttaagcggctcatagtgtagataagggaaacaatgcaaacytgaaccccagtagcggaaatgatgattgcatgctggagaataatctgagactattgtgaagagtggatggatgtgacatgtgaaatgtagtggatttaaatgcatcaattgctccctgtgactgcagggagaataagtatagctctgacctctgcaggacactatcaaggtatgacaccttgtatttatgatctttcttactataactacaacctccttaggacttcaaggtcaaaggtgagctgactggttcttattaaaattggcaaaggaagaagaaatgcttgggagtcaagaagg

SEQ ID NO: 132713 - DNA, 601 bp, Human
tctacacctttaggtcatcacatataagaaccgcaagctctccagtatttttatgccttccagcagcactcgtggagagcccatgataacatgcaacccagggctgcttctcacaggtttacatccagaggctgagctgggtccctgacattggcctggagagcctgttaaaaatatggattcctgggccacacttgaaagacagggattcaatatccctgcttcatagtatgcattttaaatctccctgggtggttgtcttgtgtagacaggcatggaaaccatcagaggaagcatacayccctccttccccttctccggtgactcccctactctctgccttgccaagcagtggtgaggaaccttttccttgcctctggaacagcagcatcacacctgttagagagctgctcccagggcacttatgagaccagaaaagtgtccttctgcactgaaaaatgagttagaccagttctggtcaccaactactaccatctagaggagtctgctctcagatgcactctcctataaattctgggtggaagggatagaggggaactaggaagaaagagaacctaggttccaccagaggaccgagtca

SEQ ID NO: 132714 - DNA, 601 bp, Human
ttttctttttttttttttttttttttttttgaggcagagttttgctcttgttgcccaggctggagtgcaatggtgccatctcagctcactgcaacgtccacctcctgggttcaagtgattctcctgcctcagcctcccgagtagctgggattacaggcgcctgccaccacacccggctaattttgtatttttagtagagatggggttgctccatgttggtcaggctggtcccaaactcccaacctcaggtgatctgcctgcctaggcctcccagagtgctaggattacaggcgtgagccamtgcacccagcctctaatctttcttaagtatacatatagctcacatttatcttaatgtttaatattagaagtgtgttaggtctttatttagaagtttgatgatgtttttgtgaccagagagatactataggaacttaagtctttataccaattagctgatggtcaaattggtttcattctacatcatttcgcttaaggttgcagtttccaagaccctatcgatgaagttaagtgaagacttattgcatgtttcttgggacatttaaaattacccagcaaatataaagtaaatacacattta

SEQ ID NO: 132715 - DNA, 601 bp, Human
gcccctgtctgtgtggagtttgcacattttccccacatctgtgtgggttttctccagttactctggtttcctcccacatctcaaagctgtgcacgttaggtgaactgccgtgtctacatggtgccagcatgagcaagtatgggtgtgtgtgaatgtgccctgtgatgggatgccatcctgtcctaggtcagtgttcaccttgaccctcagctgttagggtagtctctggttacccgagaccctgaactcgaatagttgggtagtaatcattacttattttcattaatctttcttttctttytttttttttttttttttttttgaggcagagttttgctcttgttgcccaggctggagtgcaatggtgccatctcagctcactgcaacgtccacctcctgggttcaagtgattctcctgcctcagcctcccgagtagctgggattacaggcgcctgccaccacacccggctaattttgtatttttagtagagatggggttgctccatgttggtcaggctggtcccaaactcccaacctcaggtgatctgcctgcctaggcctcccagagtgctaggattacaggcgtgagccactgcaccca

SEQ ID NO: 132716 - DNA, 601 bp, Human
gtgggtccatgcaaataatgcctgaagtgaatatttcatggctgggaaattaagagttgaggatagttcagaaatttcttgtttgtagataacaccaggacatgatgaagtagttcaggtggaaatcagaaaggtattatgaataagtctctctgaaccacagtaaagacttaatccctgtgaaagcaaaggaagttaatttgattaccacttgcttgaattccctcaaattcttgggcatcctagcataacctacaggaatttagcatttcagtcaatttctttacccccttttccagtcattaccaggttgctttgattatattaagttaaaaacacattcgatatgattggggaaaggaagcaaaatagcttgaagaaatacagtgtttgatgtcttcaattacaaagggggttggggtgagtgtagaagagatagaaatgtgagagaacaagcacacactagagagaaatgaagagatggagaggagatgaaacagcatgcagcatgctggataacatctccatggcaaccacattacatgtacagagaactgccaaaataagtcaagatccaagcaagtaggtgttggtggaaaga

SEQ ID NO: 132717 - DNA, 601 bp, Human
tgagggtgaatagttgatattcacactaagatcttctctacatttggcccaactcttaataacccaggatgtcagtatcttcagagagtccctgtgggtccatgcaaataatgcctgaagtgaatatttcatggctgggaaattaagagttgaggatagttcagaaatttcttgtttgtagataacaccaggacatgatgaagtagttcaggtggaaatcagaaaggtattatgaataagtctctctgaaccacagtaaagacttaatccctgtgaaagcaaaggaagttaatttgattascacttgcttgaattccctcaaattcttgggcatcctagcataacctacaggaatttagcatttcagtcaatttctttacccccttttccagtcattaccaggttgctttgattatattaagttaaaaacacattcgatatgattggggaaaggaagcaaaatagcttgaagaaatacagtgtttgatgtcttcaattacaaagggggttggggtgagtgtagaagagatagaaatgtgagagaacaagcacacactagagagaaatgaagagatggagaggagatgaaacagcatgcagc

SEQ ID NO: 132718 - DNA, 601 bp, Human
tctcattcccacccacaccccttctatgtcacaccacacacacacacacacacacacacacacacatgcacacgcacaatctatttacaaatacttttttttgcctctctctctctctctctcacacacacacacacacacatgcaactggcattgagtactggttccctgtggaagaaagtaattcctccaattattaatttaaaaaaagaataaattctaaagaatatattatctataatctttcttttctaaagaatgagatgaaagtttggattgacttcattcttgcccagactcyttttaaacttctcccttttgatgtttttctcattacactgccataaaaacatagatctgcctgtgaggatcatgtaatctacccaaatccttattctctccatggtattgtgcccttggagagagctgacacaggagtgaacataattaatgatcggtagagaaatcaaaagcgatttctctttgtttctgaaatattttattccgtaagaaagaaaaataaataaaatttcttgatattgcagtttctggctatgatttttttagtttagaaactcaaagcattgggggaatctgaaat

SEQ ID NO: 132719 - DNA, 601 bp, Human
atgctacttcctcacttctcattcccacccacaccccttctatgtcacaccacacacacacacacacacacacacacacacatgcacacgcacaatctatttacaaatacttttttttgcctctctctctctctctctcacacacacacacacacacatgcaactggcattgagtactggttccctgtggaagaaagtaattcctccaattattaatttaaaaaaagaataaattctaaagaatatattatctataatctttcttttctaaagaatgagatgaaagtttggattgacttcmttcttgcccagactctttttaaacttctcccttttgatgtttttctcattacactgccataaaaacatagatctgcctgtgaggatcatgtaatctacccaaatccttattctctccatggtattgtgcccttggagagagctgacacaggagtgaacataattaatgatcggtagagaaatcaaaagcgatttctctttgtttctgaaatattttattccgtaagaaagaaaaataaataaaatttcttgatattgcagtttctggctatgatttttttagtttagaaactcaaagcat

SEQ ID NO: 132720 - DNA, 601 bp, Human
aacatactatttaaaggtaaaaatcaaatctcgtccttctgttatcctttgcagaacccaaactagtatcttgcttgtggtaagtattcaataatacttattgatttgtttttcacttgcagaagactagtgttgaaatcctcccatgctacttcctcacttctcattcccacccacaccccttctatgtcacaccacacacacacacacacacacacacacacacatgcacacgcacaatctatttacaaatacttttttttgcctctctctctctctctctcacacacacacacacacacatgcaactggcattgagtactggttccctgtggaagaaagtaattcctccaattattaatttaaaaaaagaataaattctaaagaatatattatctataatctttcttttctaaagaatgagatgaaagtttggattgacttcattcttgcccagactctttttaaacttctcccttttgatgtttttctcattacactgccataaaaacatagatctgcctgtgaggatcatgtaatctacccaaatccttattctctccatggtattgtgcccttggagagagctgacacaggagtg

SEQ ID NO: 132721 - DNA, 601 bp, Human
ccatgctatgttatcttagttctcctccttcatctgtgatttctccttctttactggatgcctttatcttttctcttattttactttttaaaggaaattcaaaacaggctgtttatttctcattttatgcagatatcagccattcccatggcacaaactcttcttctaagtggattagtccaattcttctcctccaggtctgacctcttattccccatttccatcctttgccagtcatctccacttgcatttatccctattacaaactcttagtgcctgaaattgattggctttatctttkctctcaaaatagctgactttcaattcttcctctctctcaatgagttaaaacttatgaagcacttggaaaggtgcctggcacatagtaggcactcagtaaatattaactagccttattcctttagtcttgaaatcttccagctgtctccaacatttttcttttaatttcccatgcccaatccatcctccaaaacttccctttctttacaaaatgattcttacatttgtcccttcttttctactccctaaatgtttaccctagaccaggcatatatccactcatacccagatacttgcaaca

SEQ ID NO: 132722 - DNA, 601 bp, Human
cacaccgtagaatagctccttcctttgaaattgctttctgtctagatactaccatgctatgttatcttagttctcctccttcatctgtgatttctccttctttactggatgcctttatcttttctcttattttactttttaaaggaaattcaaaacaggctgtttatttctcattttatgcagatatcagccattcccatggcacaaactcttcttctaagtggattagtccaattcttctcctccaggtctgacctcttattccccatttccatcctttgccagtcatctccacttgcayttatccctattacaaactcttagtgcctgaaattgattggctttatctttgctctcaaaatagctgactttcaattcttcctctctctcaatgagttaaaacttatgaagcacttggaaaggtgcctggcacatagtaggcactcagtaaatattaactagccttattcctttagtcttgaaatcttccagctgtctccaacatttttcttttaatttcccatgcccaatccatcctccaaaacttccctttctttacaaaatgattcttacatttgtcccttcttttctactccctaaa

SEQ ID NO: 132723 - DNA, 601 bp, Human
ataggtaaatactataatgaaggcccaaggttgggagcactgggagttgaatccatccacttctgaatgattctaaagcccattttccttccaatgccccacgctaagaacaatgttgtcaagagaagcaatggtcagtagagaagaaaagaaagaagccacaaacttctaagatggtagaactaaaattcaaatccagatctgaatggctccaagccctaggctcttgattatgatttatacaccaaccagtggtccatcagttgttttaaattgtccctgatgccatcaccataaagakgcctacaggaaagtcaactaaacacacaggctttttacagccctaagagagaccagaggcacattactggtaaggagctatgttcataggataattagagaaccccagtctctaagggctgtcaatctgtcatatttcacaagcactaacccaaaaaagtgaagaaattgaatgaatttgccttataaaaaaacaggagaaaaaccacacagcagtaagcttgactggacttatagaggaattaattcttagatcgtgctctggaaggaagtcagttatgaaagtctaagactgaattct

SEQ ID NO: 132724 - DNA, 601 bp, Human
gggggtatgccaaggttcagttttgagcccatattgtctccctctgagatgcattcacagccataacatcaacaatcatgccaaggtctccaaaatccctatcataggttccaccaattccctgaccttcagctcaatatttctgattggaatgttctacttgaatgctcagatcaaacttaacatgaccaagtccaagccaggttcccctgtgtctttagacaatgagaccaccacacttacagctttaaaactgttacagctttgtcttctctctttctgttataatttcatctttaayacatgaatgaaaggaagaattagctggctgctcttaggcactggattcccaggatgaatcaaatcaattaaaagtcaactgtagtttagcttcatgtacaaaatatgctgactgacatttttcccctcttcagcacatagtttcagaactttgtctccacaaggtaaatgaatctcatagctttctgatctataagtgaagttgcttggaagtcttatttctgctctggctgctcaattttttaaaaaacccaacaatgttaccatttattgagcacatgcctagccttgtttttggtgc

SEQ ID NO: 132725 - DNA, 601 bp, Human
aacacaaaataaactaagacaaagatcaacaaaaataaaatcagtagcctttgctgtatcatcattctcctaagtgttctatagtctctaacagttgatactcccagttttttttagcaagtcccttttttgtactttattatttaaagtaggataatatcttggttctccttatacaactcaggctagtcatctctccattttttctccactttgacttgaaactccccaatttgggggtatgccaaggttcagttttgagcccatattgtctccctctgagatgcattcacagccatamcatcaacaatcatgccaaggtctccaaaatccctatcataggttccaccaattccctgaccttcagctcaatatttctgattggaatgttctacttgaatgctcagatcaaacttaacatgaccaagtccaagccaggttcccctgtgtctttagacaatgagaccaccacacttacagctttaaaactgttacagctttgtcttctctctttctgttataatttcatctttaacacatgaatgaaaggaagaattagctggctgctcttaggcactggattcccaggatgaatcaaatc

SEQ ID NO: 132726 - DNA, 601 bp, Human
agaagcagactgaggcccccatcagaggcagatgcccaatattgaactttccagccatcagcatcatcaaaaagtaaacctttttcctttacaaattaccagccttgagttttctttatagcaacacaaaataaactaagacaaagatcaacaaaaataaaatcagtagcctttgctgtatcatcattctcctaagtgttctatagtctctaacagttgatactcccagttttttttagcaagtcccttttttgtactttattatttaaagtaggataatatcttggttctccttatacawctcaggctagtcatctctccattttttctccactttgacttgaaactccccaatttgggggtatgccaaggttcagttttgagcccatattgtctccctctgagatgcattcacagccataacatcaacaatcatgccaaggtctccaaaatccctatcataggttccaccaattccctgaccttcagctcaatatttctgattggaatgttctacttgaatgctcagatcaaacttaacatgaccaagtccaagccaggttcccctgtgtctttagacaatgagaccaccacacttaca

SEQ ID NO: 132727 - DNA, 601 bp, Human
tctcaccatgtgatctctcaacatgcagtgtctctttcaccttcccccacgagtagaagcagactgaggcccccatcagaggcagatgcccaatattgaactttccagccatcagcatcatcaaaaagtaaacctttttcctttacaaattaccagccttgagttttctttatagcaacacaaaataaactaagacaaagatcaacaaaaataaaatcagtagcctttgctgtatcatcattctcctaagtgttctatagtctctaacagttgatactcccagttttttttagcaagtccyttttttgtactttattatttaaagtaggataatatcttggttctccttatacaactcaggctagtcatctctccattttttctccactttgacttgaaactccccaatttgggggtatgccaaggttcagttttgagcccatattgtctccctctgagatgcattcacagccataacatcaacaatcatgccaaggtctccaaaatccctatcataggttccaccaattccctgaccttcagctcaatatttctgattggaatgttctacttgaatgctcagatcaaacttaacatgacc

SEQ ID NO: 132728 - DNA, 601 bp, Human
gttgaaatttgaaccccaatattggaggtggagcctaatggaagctgtttgggtcatgaaaagattaatgccctcccttggggataagttccttttttatcaggtcccatgagaaccagttgttaaaaagagtctgggtgcacccccctccccgaccttgcttcttctctcaccatgtgatctctcaacatgcagtgtctctttcaccttcccccacgagtagaagcagactgaggcccccatcagaggcagatgcccaatattgaactttccagccatcagcatcatcaaaaagtaaacstttttcctttacaaattaccagccttgagttttctttatagcaacacaaaataaactaagacaaagatcaacaaaaataaaatcagtagcctttgctgtatcatcattctcctaagtgttctatagtctctaacagttgatactcccagttttttttagcaagtcccttttttgtactttattatttaaagtaggataatatcttggttctccttatacaactcaggctagtcatctctccattttttctccactttgacttgaaactccccaatttgggggtatgccaaggttcagttt

SEQ ID NO: 132729 - DNA, 601 bp, Human
gacagcaccatgaaccccaattgcatcttcactgggaagctgaaagaaacgtgtaatcatctctccctgctgtactgtgtgggggctagaactctgctgttccttctttgtcaggggatcctagctctttctctccctctgtaggttgatgtttccatggaaacatgctctttaatgcttctgaaattactgtgcatttataccattaactcttttttgaccagggcaaatcacaaagagatttttcaacccctatgaaaaagtaattttattttctatctcttcttactgggaacttttwaaaaaagtaattggcgcctgatgaccctatttcctccccagacttcactccttaacccttgtaatctttgcttttgcctctcttttctactgaaactatcacagctgcaaaatcatcaataatcaaacaaggttgatatgatttggctgtctgtccatccaagcaaggatgtgtgtcccctccaaacctcatgttgaaatttgaaccccaatattggaggtggagcctaatggaagctgtttgggtcatgaaaagattaatgccctcccttggggataagttccttttttatcaggtccc

SEQ ID NO: 132730 - DNA, 601 bp, Human
ccagagtaatgagagagatgcaaagtggaatataatctgggaatggagaaagtgaactgacaggaagatttgtttgcaataaggagtttgttaatgtggttcctgtagcacattctggagaacagctttctgggctacagttcagtgagatgaacagtctctaacagtagggttggttttaagggtacaggaaatttgtactagatggcagtgaaagggatattatggatctgaaaactgtgaagccaaatgtgtacataatcaaagaaaatacatctagatgagaaaaaccacaatgcawaagtgctggtcaaaagttatcagtcaaacccacatcttatatttctagagtttctttaagtttcactctaacgcagtacattatggcactgtttctagaccaggttagaataaagaggttggggaagatcaaatttatttatgtatttagttaaagatatccattgatcttttccaatattctaaaatgagattgacccttgagtcagaatttcaagcaagatgaggccaagagtttcttcaaaccaaaccccatttccttcttttctcatcctcaagaggacagcaccatgaaccccaa

SEQ ID NO: 132731 - DNA, 601 bp, Human
aagaaggttataatttagttttccagtaatggttggcagagttcttcaagtgaagatttatagaagtgattatgttgaattgggaggaggagagggtcaaaggagggaggatcttccagggtcaaggggacatttccaacagagagaagactcaagatgcctgggtgaagattatgtctttaggggagacaggcatgtcatgctatgtatgtgagacagagagagtggtggaagctgttgactcattcaaaaacatatctctgacttcagaaaacccagtcataaaccacacctaccatayagataaaatcctttcacatagggaacgaaatcatttctcccaaggaaagaccagagtaatgagagagatgcaaagtggaatataatctgggaatggagaaagtgaactgacaggaagatttgtttgcaataaggagtttgttaatgtggttcctgtagcacattctggagaacagctttctgggctacagttcagtgagatgaacagtctctaacagtagggttggttttaagggtacaggaaatttgtactagatggcagtgaaagggatattatggatctgaaaactgtgaagccaaa

SEQ ID NO: 132732 - DNA, 601 bp, Human
tcactcatggaaaaagaaggttataatttagttttccagtaatggttggcagagttcttcaagtgaagatttatagaagtgattatgttgaattgggaggaggagagggtcaaaggagggaggatcttccagggtcaaggggacatttccaacagagagaagactcaagatgcctgggtgaagattatgtctttaggggagacaggcatgtcatgctatgtatgtgagacagagagagtggtggaagctgttgactcattcaaaaacatatctctgacttcagaaaacccagtcataaacsacacctaccatacagataaaatcctttcacatagggaacgaaatcatttctcccaaggaaagaccagagtaatgagagagatgcaaagtggaatataatctgggaatggagaaagtgaactgacaggaagatttgtttgcaataaggagtttgttaatgtggttcctgtagcacattctggagaacagctttctgggctacagttcagtgagatgaacagtctctaacagtagggttggttttaagggtacaggaaatttgtactagatggcagtgaaagggatattatggatctgaaaa

SEQ ID NO: 132733 - DNA, 601 bp, Human
cccagagtaggtaggctatcaaaactaagtggtgagaccttcccagagaaaataccaaggcagatcaaaggctagctgatcactgactacgttatctcttttttgtgactattaataattttaaggtgaaggcttgtctttctgacatccattttagctcacaggctggaaaaactattcaggggctatgtaaacaatgactggcaaagatttctctaggacattcaactatggcaggaagactttccttcctgtgaactttcaggcctactgaaagaatgtactcaaggcctactgagcrtatgtactcaagaagcccttgggtaagaacctaaagtgacctaggtatgatatcaacggaaaagaataagaaggcttttctctcccttttgatctttctccatttcctcaatttgtcctttctgtagcctctctctacttcctcttacacattgggtggtcaacaaaatcaacacacaggaaatatctccatacacacagttcctgccccatctgtagctaccatatttttgacttcacaattccctctaacagctctgccaaagggggcaaaatggtagatgaatatatgatgagttgg

SEQ ID NO: 132734 - DNA, 601 bp, Human
aacaggcagtgtagcgaggtgtttaagaacaagggcacagttcttaaacagtgtaatagtcacagtctccattcaaatcctgcacccaccagttctgaagctgtgtggtcttgcaagttatttaacctctctttccttattttcttcaccataaaaaatataaataataatattacctatctcataggattgttgtgtttcgatatatataaaggggatgtgagggtgatctggctgcggcatctgtcactccatcgattgccagggttgattcagctgatctggctggctaggcgggtgwccccttcctccctcactactccatgtgcatccgtccctaagctgcaggctcagtggaagaggatgaccattcccaataaaggaggaccggtcttcggtcaagggtatgtgagtagctgggcttccattctagaacctccaaacaagctctcaacatatataaaggacttagaattctccctatcacagagtaagcattatgtattagttgttattattattacctattttttacattgcctgggtgtcaggggagttagcatttgaagggacttttggatcacagtctaactgttcatat

SEQ ID NO: 132735 - DNA, 601 bp, Human
taaactctgtggttggacaatataattagaaatgccagtttcctaagctgttcttttaggcaaaatgataccttgtagagaagctcaggaataactaatttaaagagcagactgtaatattagtttatgtttacttgagatgggttaaaaatagtttgtcttccagtggataacacattttctctgaaatggtgtttataccattaatttattttgcaaaccattcttcacaaatcataaaatgttcaagtttgggctagttcatatcacagttatttaaattctaaattagtggtgttamgttaatgagatatattaaagtatcttaaattctaaattagtggtgttaagttaatgagatattaaagtatcttgaacagtgattgatacaaatttaatatacctcttatctcctactggtggtgagaaatgtgctttagccccttagtagtttgggctgaactgaattcatgagaggtgtaagtggcaatgtgtaaattcaccatctattatgaagaaaaagtgctttcagcccccttggcctaacaataaaaaatttcagagagctattacctggattctgtttcacaactgaatacca

SEQ ID NO: 132736 - DNA, 601 bp, Human
tcaacatggcaggcaagattattacaatctggtcaacaatgtcctctttttaaggaagaaggatttgaagaagttttaaatgattcctttgagatatgtcatatataaaaatattaaactctgtggttggacaatataattagaaatgccagtttcctaagctgttcttttaggcaaaatgataccttgtagagaagctcaggaataactaatttaaagagcagactgtaatattagtttatgtttacttgagatgggttaaaaatagtttgtcttccagtggataacacattttctctgmaatggtgtttataccattaatttattttgcaaaccattcttcacaaatcataaaatgttcaagtttgggctagttcatatcacagttatttaaattctaaattagtggtgttaagttaatgagatatattaaagtatcttaaattctaaattagtggtgttaagttaatgagatattaaagtatcttgaacagtgattgatacaaatttaatatacctcttatctcctactggtggtgagaaatgtgctttagccccttagtagtttgggctgaactgaattcatgagaggtgtaagtgg

SEQ ID NO: 132737 - DNA, 601 bp, Human
atccagtttagcgtggtcaacatggcaggcaagattattacaatctggtcaacaatgtcctctttttaaggaagaaggatttgaagaagttttaaatgattcctttgagatatgtcatatataaaaatattaaactctgtggttggacaatataattagaaatgccagtttcctaagctgttcttttaggcaaaatgataccttgtagagaagctcaggaataactaatttaaagagcagactgtaatattagtttatgtttacttgagatgggttaaaaatagtttgtcttccagtggayaacacattttctctgaaatggtgtttataccattaatttattttgcaaaccattcttcacaaatcataaaatgttcaagtttgggctagttcatatcacagttatttaaattctaaattagtggtgttaagttaatgagatatattaaagtatcttaaattctaaattagtggtgttaagttaatgagatattaaagtatcttgaacagtgattgatacaaatttaatatacctcttatctcctactggtggtgagaaatgtgctttagccccttagtagtttgggctgaactgaattca

SEQ ID NO: 132738 - DNA, 601 bp, Human
aagatatttaaaaattagattttcagtgttctagtttagatagactaaacagaaatttctgaatttttcccagctaagaaattcataattatcaaaataaatccaaaatgattaatccagtttagcgtggtcaacatggcaggcaagattattacaatctggtcaacaatgtcctctttttaaggaagaaggatttgaagaagttttaaatgattcctttgagatatgtcatatataaaaatattaaactctgtggttggacaatataattagaaatgccagtttcctaagctgttcttttaggcaaaatgataccttgtagagaagctcaggaataactaatttaaagagcagactgtaatattagtttatgtttacttgagatgggttaaaaatagtttgtcttccagtggataacacattttctctgaaatggtgtttataccattaatttattttgcaaaccattcttcacaaatcataaaatgttcaagtttgggctagttcatatcacagttatttaaattctaaattagtggtgttaagttaatgagatatattaaagtatcttaaattctaaattagtggtgttaagttaatg

SEQ ID NO: 132739 - DNA, 601 bp, Human
aagattactctagtgaagcaaattaacttatcacctcacatttcatctgattaatactgttcttagtaatattgctataattctgttattattagctgctgttattactctctaccatgtgaatggaaaaaacacaattcttttgaaagactagagtttctttttagaaattatgattatttatacacagtacctctagaaatagtagaaacaatttcccaaaggattagaaatagtggacttaaaacttttaaaagctacctaattacagactggtattggagaaaagaggcaaagatayttaaaaattagattttcagtgttctagtttagatagactaaacagaaatttctgaatttttcccagctaagaaattcataattatcaaaataaatccaaaatgattaatccagtttagcgtggtcaacatggcaggcaagattattacaatctggtcaacaatgtcctctttttaaggaagaaggatttgaagaagttttaaatgattcctttgagatatgtcatatataaaaatattaaactctgtggttggacaatataattagaaatgccagtttcctaagctgttcttttaggcaa

SEQ ID NO: 132740 - DNA, 601 bp, Human
cttcctcatctataaaacaggtggttcataccatcttacttgtctggtgtgagaagctacagggaggatcctttgacctgttgtttatctctacatttcttttcttcttttttaaacatagtttttagtgtgtatatgtaaggtatccaacatgattttatgggatacatatagatagtaaaaaagattactctagtgaagcaaattaacttatcacctcacatttcatctgattaatactgttcttagtaatattgctataattctgttattattagctgctgttattactctctaccaygtgaatggaaaaaacacaattcttttgaaagactagagtttctttttagaaattatgattatttatacacagtacctctagaaatagtagaaacaatttcccaaaggattagaaatagtggacttaaaacttttaaaagctacctaattacagactggtattggagaaaagaggcaaagatatttaaaaattagattttcagtgttctagtttagatagactaaacagaaatttctgaatttttcccagctaagaaattcataattatcaaaataaatccaaaatgattaatccagttta

SEQ ID NO: 132741 - DNA, 601 bp, Human
ctgtaactctgtaactttgtatcatgcatgtgtcaccttctaaagccttcagcttcctcatctataaaacaggtggttcataccatcttacttgtctggtgtgagaagctacagggaggatcctttgacctgttgtttatctctacatttcttttcttcttttttaaacatagtttttagtgtgtatatgtaaggtatccaacatgattttatgggatacatatagatagtaaaaaagattactctagtgaagcaaattaacttatcacctcacatttcatctgattaatactgttcttaktaatattgctataattctgttattattagctgctgttattactctctaccatgtgaatggaaaaaacacaattcttttgaaagactagagtttctttttagaaattatgattatttatacacagtacctctagaaatagtagaaacaatttcccaaaggattagaaatagtggacttaaaacttttaaaagctacctaattacagactggtattggagaaaagaggcaaagatatttaaaaattagattttcagtgttctagtttagatagactaaacagaaatttctgaatttttccca

SEQ ID NO: 132742 - DNA, 601 bp, Human
ggctaaactagatcaaatggctatattaatcaatttaactttccataagacctgaaaatatccaactacccttggatctggctgtactttgtcgatttttaatattaattagaacctcgaaacgttcatgtgtgaatcctgggtaaaggattaaattataattaagagatgccatagctattctatttctctccaaacatgtcatcctcaagtacacagtcaaaaagctttgcttcaagtggcagccaaatgcagaagttctgcccatgagactcaaatcccctggaagtcccatcaaggktgtgtgtgtgtgtgtgtgtgtgtgtgtgtgtgtgtgtgtgtgtgtgtgtattttaaattgcttgatttgtctctagaatgtagtttgaaccttaagaaaccagatggtctgcctcatatagttctaatattacacagaatctcacattgctaaaactaggagagaacttagaaattatccatagagaaccttcattttagagaggagaaaataggtcccaagatgcaaaacaactttgccaaggtgacctgcctgttcaggactggagcttaagtcttctgactctcagctcagggtcct

SEQ ID NO: 132743 - DNA, 601 bp, Human
atacatcagccttgagcaagatgccctttgaatagcagaacaaacccatccattcactggtaatgaaaagtgtgaaaaaataattgggggtgtggtcacttctagacatgtgatcttggcacctgaatctcagttattcttctctaaaatggagacatcattttacttccagcttatcagagaagtctgttgtgatgaccaaatgaaagagtggataggaaaactatataaaatatgatacaaatataaggttatttaataggaaaaattcagaaaaagaatatattagcataatttgagwgtctaaaggcaagaaagttgcttgattttaaacctcagtgaataagtgtgataaccacattttaacaagactcaattatcaatgaaatacatctgaaaaatggagattggcttctacatatggaggctaaactagatcaaatggctatattaatcaatttaactttccataagacctgaaaatatccaactacccttggatctggctgtactttgtcgatttttaatattaattagaacctcgaaacgttcatgtgtgaatcctgggtaaaggattaaattataattaagagatgccata

SEQ ID NO: 132744 - DNA, 601 bp, Human
cattgaattaggtgtacaagttgagaaatttgaacttgcagaaaataaatcacactcatgagcaatgtaattggtctgtaaatttttctggctattcctgttccagcgccttctgattttccttagaaattgttctctttctggggtgctcctcctcttccagctctaagttcattttatctacctaagcactcctcacatattttacacttatcaaaaacattagtaaaattttatgacaatatacaaaatattcttctccaaagtatcctttcatcattcatatctgtcagcagcatayagattaatcattcacactgtgttttcatgagtaatttcttgtggtgtgagaacatttagccattactgaggagcatgcaaatatacatcagccttgagcaagatgccctttgaatagcagaacaaacccatccattcactggtaatgaaaagtgtgaaaaaataattgggggtgtggtcacttctagacatgtgatcttggcacctgaatctcagttattcttctctaaaatggagacatcattttacttccagcttatcagagaagtctgttgtgatgaccaaatgaaagagtggatag

SEQ ID NO: 132745 - DNA, 601 bp, Human
ggaataactatatagcctctcaagatgacttctttgaaggggacagcattgaattaggtgtacaagttgagaaatttgaacttgcagaaaataaatcacactcatgagcaatgtaattggtctgtaaatttttctggctattcctgttccagcgccttctgattttccttagaaattgttctctttctggggtgctcctcctcttccagctctaagttcattttatctacctaagcactcctcacatattttacacttatcaaaaacattagtaaaattttatgacaatatacaaaatatkcttctccaaagtatcctttcatcattcatatctgtcagcagcatatagattaatcattcacactgtgttttcatgagtaatttcttgtggtgtgagaacatttagccattactgaggagcatgcaaatatacatcagccttgagcaagatgccctttgaatagcagaacaaacccatccattcactggtaatgaaaagtgtgaaaaaataattgggggtgtggtcacttctagacatgtgatcttggcacctgaatctcagttattcttctctaaaatggagacatcattttacttccag

SEQ ID NO: 132746 - DNA, 601 bp, Human
gagtcaacaagggtccagtatgacagttacacagctaattgggagcagaagtaacattttaagcaatatctccagtttcatgtcctttcctgacaccagcctgattctcatatacaacatcagacttagcatcccaaggcctttacatattcctcatatgccatggcttcgtgttttctaccatcccaccttggctgctctctccagacacctccactcagtgacatgtagcatccccaacacaactcaatgctcaatctgctccacttcttgccctgttcctcagctctcagcccagagyggctcacccaagcccatcattagtgtgaaggtaatattcaggtctcttatagtttgcaatgactctaacactccaaccaaaggccctgaagaattcattgcatagaatataattacaaaaccatgagacaggatattttaaaccaacaaactagaatataagcactaatataatatacttgaaaatgtattcttactacaaagaccctgaacaatttctggagtcttcaaataaagtttatgagacatgtaaaacaatttggtctcatctattttgaaaggaggaaggaaagaaggaaaa

SEQ ID NO: 132747 - DNA, 601 bp, Human
tatgaaggacatctaaacccccagttcatctgctggaatgcaggccatacagggaatcagagccctttgttttgggttaaatgaacgtttaggtgaacattgctaagtgaaaatgctatataaactgcatgcattttacaaatggtagcagttctcctgtccagcccaccaccactggattgtccttgtatgtaagtttccccagtaaatcctatgtctcattcattatctctgggtctcttcttaggcctttcagatatggtgccatcgctattggagtcaacaagggtccagtatgacmgttacacagctaattgggagcagaagtaacattttaagcaatatctccagtttcatgtcctttcctgacaccagcctgattctcatatacaacatcagacttagcatcccaaggcctttacatattcctcatatgccatggcttcgtgttttctaccatcccaccttggctgctctctccagacacctccactcagtgacatgtagcatccccaacacaactcaatgctcaatctgctccacttcttgccctgttcctcagctctcagcccagagcggctcacccaagcccatcattagt

SEQ ID NO: 132748 - DNA, 601 bp, Human
ccttctatatcataatattggtcttcttagctcttcttgaattctttcactgatggggaacttttaatggcaccttctgggctcaaggtaggcatctcggtgttggctacttagttctttcttacttaaagctgaaacctcctcccctgcaaccctttgatacatgtttcctctttagagattctacagtcttagtctaatccttcttctacatgagagtttctcaagtatttgaagacatttatcatacatcccttatgaaatcaattttactctttaaagacctgttaaactcttttasttccgtaattttaacttgatggattaaaaaacaagcacaaggaggttaaattattttccaatgttattgtatggcagatgcacctgacagcaataacttatgcataccctgagaatgaccctactgtctaagaaaaatgttcagagtcctaagctaagaaatcttggaatagccaacccagagattcactttttatctatgaaggacatctaaacccccagttcatctgctggaatgcaggccatacagggaatcagagccctttgttttgggttaaatgaacgtttaggtgaacattgc

SEQ ID NO: 132749 - DNA, 601 bp, Human
tgcatctggaaatcagggctattacactatgtatagggaacagaaaatactaaggaatgggaaaaggtgggaaagggatttcacagagtgctctggttacttgtgcatagattagcagaaactctggaggtaactagagtcagaccaatgaaactgtcttcctcccggacaccttcacctcagcccacccttttcccctctggctgctgtcatctgatgagcagtcccttcactgggaattcccaaaggcatgctcattacaactgcattagtgcaactgcactgatggtaattaatgtcyttttaccataatggcccaaggaatcaataatgattagctctgtgttcatatgacatgttactctggagccttgggcttaatgtttcttgtgagaccatgtccctgctaagaagcaaaaggggtatcttgtaactgcagtgaggatgctaaaggaggcagcttgaagactctttttttaactcctctcattcaatgaaactgggaggtcttctttgattcttccaggtaacattaggttaaacaaccaggttgctaggatgcatattcttctggtgattctaatgatgcttatgcagcatg

SEQ ID NO: 132750 - DNA, 601 bp, Human
atgaacctgcacatcctgcacatgtaccccagaacttaaaattaaaaataaaaatttttaaaaaggtgtttggtttaagttcagcctagaggtatgactttgagcaaattactcagcctttttgagcctctgtgtttttccctatcagtgaaaactaggttaataaagggacctacttcattaggtttgtaaggcttaaaggggataacttaggttaaccacttaccatgcggcctggtgcatagtagagtctcattaagtgctaacaattgctatcaaaaaacaaaggtggattaaaggytggaagtggtggagataagaaatgaaagtaggagtgtaccaagacaactttctgctaacagaggtggcatgtaggagcctagagtctccctctatcccagagatatgcacatactctttaactcttgctaaggtcttgccaagcccatacttctaagagttgtgagatgagtacagtaagcagggatctgatatgacaggatgcatctggaaatcagggctattacactatgtatagggaacagaaaatactaaggaatgggaaaaggtgggaaagggatttcacagagtgctctggtta

SEQ ID NO: 132751 - DNA, 601 bp, Human
gctggctggagacagacaagtaaatagaaatacagataccattatcaaatttggtacttcttgaactcgcatttgattatgcaatagagtcatccaagttttcacatagtaggaatcacatgaaaaagtaatataaaaattttaaataaaagatgtttggtcaccgcatgttctcacttacaagtgggagctgaacaatgtgaacacatagacacagggaggggaacaagacacactggggcctgtaggcagggaagtggggagagggagagcatcaggaaaaacagcaaatgcatgctgkgcttaatatttaggtgatgggttgataggtgcagcaaatcaccatgtcacaagtttacctataaaatgaacctgcacatcctgcacatgtaccccagaacttaaaattaaaaataaaaatttttaaaaaggtgtttggtttaagttcagcctagaggtatgactttgagcaaattactcagcctttttgagcctctgtgtttttccctatcagtgaaaactaggttaataaagggacctacttcattaggtttgtaaggcttaaaggggataacttaggttaaccacttaccatgcggcc

SEQ ID NO: 132752 - DNA, 601 bp, Human
ttgtaatactaattgagtgcttactatgaaccaggcaactttctaaatactttacgtatacttcatccttatacctgttggtactattattattattttccttctctagatgagaaaactgaggcatcaagtagtgaagagatttgtctaagatcctacatagagctgggaattggacctagacagtctggtgcccacagaaattaatttctgatggtagaatttcaaacactgtgatcaactggcagtgggagagattgagcagagccttgcatgggaatccttcaatcacaataagtcyaaacctttcttctcataaattcatctttataagcttcccagatgctctctaggacacaactcctgaactataccactaattcagtttcttcaccaaattatgttatattgtacacacatactctcccacaaaaacaaagtcaagattcagacagcaatgcaattatcaacaataaatggtaatacacaaagaaaacaatcccttgattaaccaaaatagcaagtaaatgaacatgcaagtttgagaaatggcttctcctgtgtatcaaggtattgatcccttgctccacaggtctaggga

SEQ ID NO: 132753 - DNA, 601 bp, Human
tgaagaattagatcctggattctactgcctgagccacacatgcctagtttctcgggtgagcattcacacattcacataactagctgtccagggctctctgtgatgaggttgtgaatttcaagaagtttatctctggcctcattttctggtaactctctctagaaatatatagctggatttccattctaggcagaactatgctaacattttgaagcccattctcagccaattggtccatggaatctgtggaagttgtcttaaatcagtttcccaacatgttttcacagaatatgaatatcaygaacaaaggggtctcaaggtagaataattttaggaaattccattctaaataaaagtaaagatgtttctttgctataagacacctctgaacttccaagggttagtatgttccaagactctcctagagtgagaaacagtaggtagcatctcccaaccttatgtatctgtaaagctatttttcagcaaaatgtcttgagagacaagagcactgcagaacatatttggagaaaaatcagtgatgacattactctcaggaatacttgtattcaactgggaatctggaataataaaaaattgtaat

SEQ ID NO: 132754 - DNA, 601 bp, Human
tctagccccagtccataaaccatagaaggctcaagttggctttgggcagagaaggaacatcacagtcagaattgtgcttcaggaagctcattctggcagccatattttggactaatctgaaggagtaaaggcaggtaccagggacaaggaggcccatttaaaaaattgtcacatagtccctggatcatatataaagtaaagaataaattcaagagctagaataaaaatagaattggtgagggaagggatccaaaccctaggaagtagggtctagttctagaaaggggtaggggatgcaggyctcagattctggactcaagaagaggagtcaatatgacctgatggtgagtggtgtctctttaagaaaaggctgttgtgagatgcctcctcctgcttgagacagtaattgtgagcctactgcaaagaaagctgccccctctgtacatcttatgagctacctatgaagcctcagttattaatagttcctcttctagagacagacagaagtgcctgttatacatgaagaacccagaacatttcttaaattatgacatctctacagcagcagtgaaagcagcttgattgtagtgaaaagcagaag

SEQ ID NO: 132755 - DNA, 601 bp, Human
aggaagctgcaacattttaattgggtttcaaaggatggttatgattatataattggataattcattctaggaagacacatcatgacatgtacaggggacgggacctacaaaggcacattctcagaacaagaagaagcccagggtagcttaattgtgagacaggaaatcatgaggaggagaataaaggcttggaaggcagaccagagccttgaatgcaagaacagatcaagtctagccccagtccataaaccatagaaggctcaagttggctttgggcagagaaggaacatcacagtcagarttgtgcttcaggaagctcattctggcagccatattttggactaatctgaaggagtaaaggcaggtaccagggacaaggaggcccatttaaaaaattgtcacatagtccctggatcatatataaagtaaagaataaattcaagagctagaataaaaatagaattggtgagggaagggatccaaaccctaggaagtagggtctagttctagaaaggggtaggggatgcaggcctcagattctggactcaagaagaggagtcaatatgacctgatggtgagtggtgtctctttaagaaaaggc

SEQ ID NO: 132756 - DNA, 601 bp, Human
tgtagaatcttcaccctggtgcctgcctccctggagtccactgacactaaatcctccctggaccaaggggactttctgaagcagcattaggcgtcttgaggatgacgtcctggggacgaggataacagtggaaggaccaatacaactttccatgatgcaatctcaccacaacccagccattccctggagccacacctggctcctgccatcctccctgcccacaggtgagccctaatagaagccttcaagttggggagctacatggctctatgacctcaatgaacactagacatctatcttycaaagtgttccctgggttaattgagtcgatatgaaaatgttctattctattatctcaacccctcccaaatgccctacaaaaagattaaccacagaattcctttaaacagcaacttcctttagtacatgtaaagtatgatctacaaaaattcaatctacacaaatattttctcctgcccctccccatgaaacaacagctaccgtatcaagggcaacaacataaacttggattcttaatggtagattttgggattcttttattatgtaatgattctcatacatgctacaaatatttattgaa

SEQ ID NO: 132757 - DNA, 601 bp, Human
cagtggctgacagtcctatctgtagcccatatttcttccacaaacccacattcctcccctgcttatctgtccagtgttcaaatcctccctgtagaatcttcaccctggtgcctgcctccctggagtccactgacactaaatcctccctggaccaaggggactttctgaagcagcattaggcgtcttgaggatgacgtcctggggacgaggataacagtggaaggaccaatacaactttccatgatgcaatctcaccacaacccagccattccctggagccacacctggctcctgccatccaccctgcccacaggtgagccctaatagaagccttcaagttggggagctacatggctctatgacctcaatgaacactagacatctatcttccaaagtgttccctgggttaattgagtcgatatgaaaatgttctattctattatctcaacccctcccaaatgccctacaaaaagattaaccacagaattcctttaaacagcaacttcctttagtacatgtaaagtatgatctacaaaaattcaatctacacaaatattttctcctgcccctccccatgaaacaacagctaccgtatcaaggg

SEQ ID NO: 132758 - DNA, 601 bp, Human
aggacccaagaagtcttcttagtcccatgccatcattttagagatgagaaaagaaaaatgtagaaaagtgaaaaaagcaggtcctatggctagttagtggcctgaccagtggctgacagtcctatctgtagcccatatttcttccacaaacccacattcctcccctgcttatctgtccagtgttcaaatcctccctgtagaatcttcaccctggtgcctgcctccctggagtccactgacactaaatcctccctggaccaaggggactttctgaagcagcattaggcgtcttgaggatgaygtcctggggacgaggataacagtggaaggaccaatacaactttccatgatgcaatctcaccacaacccagccattccctggagccacacctggctcctgccatcctccctgcccacaggtgagccctaatagaagccttcaagttggggagctacatggctctatgacctcaatgaacactagacatctatcttccaaagtgttccctgggttaattgagtcgatatgaaaatgttctattctattatctcaacccctcccaaatgccctacaaaaagattaaccacagaattcctttaa

SEQ ID NO: 132759 - DNA, 601 bp, Human
caaatcatgagaggctctgatagagacagaagccttaaagcttgttggaactgcatctctgtgccagactatttttaaagcaagtttatgcagctgtcccccacttaggagccttacaaatgagcccagtctgcacacaatgattttttttttcaccatttctaccctttccaactcaccatgctatgtctgcatgcatatgtgtgtgtaaaatatttctttttaaatgtccttctccacattcctacataccagggagatgttcttggctttctgtgaatcaaattctgatccagagatmtctttgctattctagccccctaagcctccaagaggttccttacataggatcccattaaaggttcacaagagcagatactgttcatttttttattaaagtagttgggtaaatgtatcaaatctgtaaatgtttggagtattttcagaggagtacataagaaattggcaataacaattgctctggggaggattccagagactgggaacagcattgctctggagagggaagcaaagggtcatagatgagaagaggactttctttttactggatactcttttgtgccatttgattttttaccat

SEQ ID NO: 132760 - DNA, 601 bp, Human
caaagtcagtaaaaatagcatgttgtcaaacggtggtatcaggagatcctgaataaacacgcttgccatgaggagcttctgtttcacccccttagatgccttctgtagagcctggagagagcatgaatatcccctggcctctcctctgaggctgggaggtggaacaaagtctgtccagctgtgcccaagcagtcaccaacactgcacttactggcctgctcagtgatgtctcacaccatgctaggcacagaggtatagtggagaggcacacagatgtgccagtttcttctgagtgagtgamtatgtatgagcggggatggaggagctgttttattttgccagtcaaaagctttcaagtaatatcaatagaggtagtgattgacctctattgtataaacactgatttgatcattgtggactatgatcaccatagtccttaggggctaggatcacagagcccccacaccctggagttggtgctacctcctggacatgaggtcaccagagacacagcgtcccttagcctgtcttatttattccaggctgcagatactggcagagcattctgttttactacattttcattgcttcagctcttgtg

SEQ ID NO: 132761 - DNA, 601 bp, Human
gtggggaggggagggaggggaggtggggagatagggaggataagccatttagttcacgcattgttgcttgcacgggactgtacattacagagagacaaggacatatacaattttgaggactttcaaagtcatcccctggtgttgttaacagttccagtactcaacacttctctctgttaagaaattctccctttagctaatataaaccctctctgcttgatcttaagcccactcactctggttgtgtctcagaggagaaagtgaacagctgatctccacacttggtacaattattcttcayacatttaaagagaataagtcatcacctcattgccttttttttctttcccttaacaaccccaattcccatagcctttctccatggatcctgtcttctaatcccttaatccaatgatgcatattagtactcagttcaaagtcagtaaaaatagcatgttgtcaaacggtggtatcaggagatcctgaataaacacgcttgccatgaggagcttctgtttcacccccttagatgccttctgtagagcctggagagagcatgaatatcccctggcctctcctctgaggctgggaggtggaacaa

SEQ ID NO: 132762 - DNA, 601 bp, Human
tggatacaaaaaaaaggggacaaatcttctcactttaaaaagcaatcttatggcatcacagttagaccaccaactctgaaattattttcatatgagaaccagagtttctatttaacatgcatatgaatgtctaatcatagggaaccagtttgaagaagcatgttatattctcacagtgtaatattcggcattaagtttcatgcttttgaaaaacatttaataaaaagggaacatgtcctcaatatcctaggaagagaaaaaagtagattgcaaattatccatacattaagatgccaattcygttgtattattctgtattgtattacagtgtacacacagaatgcacagaaaaaaaacactggaaagaaattttaaaatataactgctaattctttgtaggtgcagatatgggtaaattttattttatcccttcaaatgtctttaataaacattaattacctacataataagaaaatcataaatgttgtttttaacctagatataaacatagaattttctcatctctctaccactctttcttcttcaacaccagtactggaaaagcattgtaaaataaaaattagaaaaaattgtttagagg

SEQ ID NO: 132763 - DNA, 601 bp, Human
agatcttcgggtgctagatcaataaaggcatgtttgcatatgaaggacaatcaggtattttagctttaatgccaaacttcaggtcttagctaaagtcaatatgctattaatataggcacaaagtagcttgtttggtgaaaaatatgtaaaggtatttttataatatactgctatagcagcaagtcaggtatgttctatccctactggtgaaagaagggcattgctctctcccttctgggtcatgtatgaaccacagaatagaaacagcgctggaaagggtctcatactgagcagtagtcayatgactccttgggaacgtgagtctgaattttacaagccctcaactttcaagaaaatgaaaccaacatgatgaaaaatgcagacagacatggaacacatggacaaccccattctctgtgatgtaactaccaaagataagaaatacatatctcaacaaagttagaaggcagcgcactgtatgagaagatcaaaaagagaaaaccctctgggactcctagcagacccgaaataacaaaggacagccttccaccagactgcatatgtgtcccctgattgttgcagaatcgatataaacaaacca

SEQ ID NO: 132764 - DNA, 601 bp, Human
tctaccctgtttctggccagctctcataaataggtattgtggagatacagcctgtgcatggctggtacaaatccatcatcactgcaggaaaaactcaacgcataagatcttcgggtgctagatcaataaaggcatgtttgcatatgaaggacaatcaggtattttagctttaatgccaaacttcaggtcttagctaaagtcaatatgctattaatataggcacaaagtagcttgtttggtgaaaaatatgtaaaggtatttttataatatactgctatagcagcaagtcaggtatgttctrtccctactggtgaaagaagggcattgctctctcccttctgggtcatgtatgaaccacagaatagaaacagcgctggaaagggtctcatactgagcagtagtcatatgactccttgggaacgtgagtctgaattttacaagccctcaactttcaagaaaatgaaaccaacatgatgaaaaatgcagacagacatggaacacatggacaaccccattctctgtgatgtaactaccaaagataagaaatacatatctcaacaaagttagaaggcagcgcactgtatgagaagatcaaaaagag

SEQ ID NO: 132765 - DNA, 601 bp, Human
ctcttattcaataaacaaatattgtacttcacctgttactccctctgcctgaaatatcatcctcacttccaatattactcacctctaaaaccttccctatcatttaaagcctatcaataaaatcatgttcttctcaaaacccttcctgattcccttaaccagatatgtaatttctttttataagcccctttgtcttatcatttattagttatctattgctgtgtaaaaagttataaaacttagtggtataaagcacaaatattgattatcccacagtttctgtcggtcagcttccagacaygctttagctgggtcctgtggctcagggctgtatacagggctgtatggcagcgggcaggccccagtcctcatctgttgctactcagggacatcagttccttgtcacttgggcagggttgctcacagcgaggtggctggcttcccttagagcaagggatgcaagagagagggccccaatacagaagctagtcctttcatgtgcacatctcaaaactgacatctcatcacttcactattctcttccaaataatcaagttgctaaatttagcccataactgggggagaggaccacacacaggca

SEQ ID NO: 132766 - DNA, 601 bp, Human
cctctgccatcactctcgcagccacctctgctccatgattgtccacattcattcaggcccaagatgactgcggcattcctgcaggcacctaagttcctacaccccatcacagctgctggatgaattttttgaagagaagtcataatcacatcactctcccactcacaaacatttcatggcttccgattgcttcttgagttaattcaaactatctttgcttctaatgctctttaagctcaatctttacttaaagatgtctctctacccccttatttgtacctatcacctagacaattttttwaaaaaaaaactcttattcaataaacaaatattgtacttcacctgttactccctctgcctgaaatatcatcctcacttccaatattactcacctctaaaaccttccctatcatttaaagcctatcaataaaatcatgttcttctcaaaacccttcctgattcccttaaccagatatgtaatttctttttataagcccctttgtcttatcatttattagttatctattgctgtgtaaaaagttataaaacttagtggtataaagcacaaatattgattatcccacagtttctgtcggtcagc

SEQ ID NO: 132767 - DNA, 601 bp, Human
ctgaggttgcggtgagccgagattgtgccattgcactccagcctgggcaacaagagcaaaactccatctaaaaaaaaaaaaagccaaaaagccaacccacacatttataatataaagataaaaggactaaaatgatataaatcaaaatataaacaaattatctctgggtggttgaatttggggtggattttattttcttcatgctcttctctaattaacttttccttaatgaacgactgctatacttttgacatcagacacaaataacaaaatatcgttacataaaagagaaatgaaaacraaacaggattcctcagattctgaaaaagagatcctcataattagatggaatacatttaagaccacggtttaaggtattttccttctttaggatcttacacttaagaagagtcttttaagcggccaataattcagctggagaataaaaacatagattttgaagagcacagatccatcactgaagaacaataagaatttatatttgggtaaaaatatttgtgtccatctattccttaaattgtcaagaaaaaccctaatgcctgagttttaaacaatgagtaaaagaacagagctacattgt

SEQ ID NO: 132768 - DNA, 601 bp, Human
aaagtaaggtgaaggggaagtggagcaataaaacccactaggaaaaccacttcctgtcttggagcacgtggttactgaatggtgtcctggggaattggggatattccaagaatcagcttttaagggccaaatagcttttccatgttctaaaagctgctagagctccccttcatgaagaagggcccaggtgctcatctattattaagcatgtttaaaaaggcatttaagagaaagcaccaggagacagatttgtagctgcaatgggaatcccaggagggcagtgcttgcttagagaaggagyagagttcatgttagcgatatgggaagagccaacacaagcaggtgtttggtgttccctgacacctgttggtgtgctcttcagcagttcactaaaaagtgagtgatgcagaaggcaaagccaacaaatgccagatcttcctactatcaatacaacacgttcagaccaataagctatgaccaagatttgccccttgtgttggggggcagggaagaggggagtacagaggggcagaaatttaaaaatcatgggataaatacatgaatctaaatagataatggacagagattagatatttcatat

SEQ ID NO: 132769 - DNA, 601 bp, Human
ttttcaagcttgttctcctaacctacctcatcccagaatagaaccacccagcccaaccagtcatgatgatactcaagccatgcctaaggctaaagcaaaaatgctggccagattcttgctgtcagcaaacatcaagtatgaggcttgaattttacagcggtaagaattgactgagaaggaaaatgggcattaggacacttagaagctactgcagattaatccccactgcatcctcaatagaatgagaatgggaccagacctttctctgtgttacattcagtggtgcatgggaggtcagcayagtctctggaattcgactgcatggtccaacgcctggctcttccattgactagctgtgtccttcagaaagtcactaaacctctctgggcctcatgttgttggcctatatttgtttttgtcatattaaatattgactccatagcaatgttgtgaggatttgtatgagttaatgtaagtgatctgcttagaacagtgcctgacctataaatactgacatactgtagacatattatagtgttagctattactaacactttgttatctgtcaatcagggctccagttgcttgagagaattgtctt

SEQ ID NO: 132770 - DNA, 601 bp, Human
atgcaatgatatacagaacagtcttaggactggctcccccaaactgctggctgccaatgcgtcaaatggttctgtttccaacaatttactttcactgagttcctgtatacaaaaagtgctgactctgtttttctttcatagatgaaactgctaaaagccccaaagtccagttctggccatcctgctggtgtgttttgctcttctcaggtggtattgtccagataactcaggtcctggcatctctgttcacctgttacaatggcaattacaatgaggaaaagctagatttgcctccagttckgcaaagcccattctaaggtttcagaacagctctcagggtgaggataatattctgtctcaggttctggctacttcactgaaggttttacaagcaggagaaacaggcttacacctgttagaaaggacaggaacccaggagaacaaaaaacaatatttcaacggaagaaatggaattgaaaaatgtcagtcttccacagccttctccctatgagtaaaagaagtgaattagtaattccctgagttgggccagtgtaacacttttgagaaacccagagaagttaagacttagtagggtggtagt

SEQ ID NO: 132771 - DNA, 601 bp, Human
tgggagctcacctaacaccacagctttacatccactatttcacataagtatatctctacccattttcagtaggcatgtttcatctataaccactaattggtaacattaattgtccatctttcctcttttctgcagtacaggcctatggttcacactaaaatttctatttgttgagccagtcttaggactaagtatctgatttttgtcaaaaatcacaaaaaaatgttatgcaactctgctacctcctttctgcactcccttctgactctcaaaatccaaaaaggctgtacctatgcttccmgtattttctgtctgtgacccaaaagcagaggaatgctgtgccaggggtgggctgctgaatagccctcactgctagagtggctcaatgggaatcctccgatgaaaggcatgacagaaaaggtagatgttatttctggaattattatgataagaggtgtaatgagaagctcactgcagggccagataggaagaaaagggaggaggtggcaagggaaagaaaagcttccctgggctctttgcaaagaagctctaggaaaatatttgaaaatgtgtgcatgttgagaagtggcaggaaacagaa

SEQ ID NO: 132772 - DNA, 601 bp, Human
gagatagcaagaatacatctgattgtctcaaaagccaaggcctaagatggcttatatcttcccaaggtctagtacctcaggcagggatggcctatggtagaaaagagaagaaatgacaagggcaatgtgggcccaggaatggtctttgatagtggagtctgtcctgcattaaaaccaggcatgtggtcaataaaattaatcagcagccatgtgtagacagcggggcctccaacatctgtccccaacccagtggggacaagaatctagaaagaagtttaattattttgggaaaagaaacagrgatgagacgggaaagaaaaatatctcagtgtaaactttgtcaaaaaatagcaccactacctttatattcagcataaaatggtggctcaatgaatattagctgattgattggctggtgttgattttataggcgtttgtagaaattctggaagtgaaatagtggcaagtataatgtccatccattttactgggcttagaatccattgctgatatttcccactcagtgtaactctaaccctaactccttaatatgaacccttctctacctgtctcataactaagctagaaaacagcctatatc

SEQ ID NO: 132773 - DNA, 601 bp, Human
tacctaagaggcataggagctgtaggagccttattgttacatctccttgagggtccagtatcttctttaatttattaggatattggttttaacatatgtgctatgtgtggttgacatcacaagggagagaaggagaagaaagagggataagaagaaatagcctgggaaaaaatagcacaatggacaaaaatactggctttaatcacacactggtttgaatctgggccctgccactagtgtaattgtgaaaccttgagcaattccctgctacctctgagctcagcttcctcatttggagggratattactgatcttgccaggggttgttaggaataagcaagataatgtatgtgaagccggtagcatgaggatttgcatctagtagatgctcaaaagtaatttatcaaaggaaggaacaaaggcaggcagggagagaagacagaagatagaagtgggagggactcgctcttctctactgccttattttccttgagtgttttaggttttcggctgaagcttctctgttatataccttcttctttccttttagcaagaggtcaactggtgctgagaacagcttacaattggttcctatgagcac

SEQ ID NO: 132774 - DNA, 601 bp, Human
ttcttcctcttcctcttcttcctcctcctcctcctcctcttctccttctccttcttctcttatttccgtatttattttcattttttagagacagggtttcactatgtcatccaggctggtctcaaactcctgggctcagactatcctcctgcctcagctcccaaagtgctgggattacaggtgtgagccactgcacccagccacaaaatttcttcttaacacacttgagaaagagattctcctcttggccttgaggaagtaaacagccatttgtcaactacctatgaagagggtcgcatgsccaggagctgtgagctgtgagtggtttctaaaagctgagggttgtttccagtcaatacccagtaagaacctcagccaaatagccacaagcaaatgaattcagccaatgagcagcagacacttagaagtagcatcttcctcactcaagcctcaagatgaaaacatagcagggctgacactttggttgcatcttttgagaccctgagtagaagatccagttaaagacatgcctggagtcttgacccccagaaactgtgatataagaagtatgtgctgtttaagccactgggttgatggaaat

SEQ ID NO: 132775 - DNA, 601 bp, Human
tgatcagggtagtagttgctgaagaatggggtgactatggcgatttcttaaaataaaacaacaatgaagtttgccacaacaattgactcttcctttcatgaaagatttctctgtagcatgctacattatttgatagcattttacccacaacagaacttccttcaaaattggaggcaatcctctcaaaccctactactgctttatcaactaagtttatgtaatattctaaattctttttcgttatttcgacaatgttatggcatcttcattaggaatagatttcatctcaagaaaacacttyctttgctcatctgtaagaatcaactcctcatttcctcaagttttatcatgagtttgagcaatgcagtcacatcttcaggctttatttctaattccagatctcatactgtttccaccacatctgtagttaactcctccactgaagtcttgaattccttaaagtcatccatgagggccggaataaactttttctaaacttttgttaatgttaatattttgacctccttccatgaatcacgaatgttcttaatgacatctaaaagggcaaattctttccagaaggtttcaatttactttgcct

SEQ ID NO: 132776 - DNA, 601 bp, Human
gaaactgaagcccagactggtttagtgactgctcagggccatggagctggctttggcagagttggggcttggctttgggttttgggacgtagagttctgaaatctttccattatgctatgattgcatggctacctagcttattcttcaaactcagtatatgccacaaaagaatacaccatcaattatagcagcaaccaattaaaggcctcaccacacaatagagaactgtctctttttcaatgatgaatgaccatcaacttagtctgtgaagacgaaagttattctaaaatttcttacacwggaaatgtgtaaataattttctttaggaaatatataaaggctattttctaaaggatacttgaatctgagtctggaaaagaataattttgaagaagtcaaattcttagtaccaggtgtacctaggagatattacaggtttggttctagaccaccacaataaagcaagtattatgataaaaaagtcacacaaatttttgtttccaagtgcatataaaagttatatttatactatactgtagtctgttaagtgtacaatagcattatgtctaaaatcacaattcatataccttaatttaaaaa

SEQ ID NO: 132777 - DNA, 601 bp, Human
ctgaggtcaggagctcgagaccagcctggccaatgtgatgaaaccctgtctctattaaaaatacaaaaaattagctgggcatggtagcgcacacctgtaatttcagctactcaggaggctgaggcacaagaatcgctttaatccagaagcagatgttgcagtgagccgagatcacgccactgcactccagcctgggagacaagagtgagactctgtctcaaaacaaacaaacaaacaaacaaacaaacaaacaagctagctaactaaactaaactaaaatgtaacttaaaaaaaccccaastcattattttgattatgaaagtcagtacctattttcaccattcttccctgagaatcacttgtgggcacactctgccttgctgaaggagcactaagtaggaggcaaggtgctggcttctagttccatctctgctattcagcgtatgatcttgggtgagtcaccaaacctttctcagcctagaccttatcttcatcaaatgtgccttccagatccaagaagctatgactctctcttaagggctaattattctcagtggctaattattacatgtatactttgattataagcattcccatgaca

SEQ ID NO: 132778 - DNA, 601 bp, Human
catgcctgtaatcccagaactttgggaggcaaaggcaggtggatcacctgaggtcaggagctcgagaccagcctggccaatgtgatgaaaccctgtctctattaaaaatacaaaaaattagctgggcatggtagcgcacacctgtaatttcagctactcaggaggctgaggcacaagaatcgctttaatccagaagcagatgttgcagtgagccgagatcacgccactgcactccagcctgggagacaagagtgagactctgtctcaaaacaaacaaacaaacaaacaaacaaacaaacacgctagctaactaaactaaactaaaatgtaacttaaaaaaaccccaactcattattttgattatgaaagtcagtacctattttcaccattcttccctgagaatcacttgtgggcacactctgccttgctgaaggagcactaagtaggaggcaaggtgctggcttctagttccatctctgctattcagcgtatgatcttgggtgagtcaccaaacctttctcagcctagaccttatcttcatcaaatgtgccttccagatccaagaagctatgactctctcttaagggctaattattctcag

SEQ ID NO: 132779 - DNA, 601 bp, Human
attattattattattagatggagtcttgctctgtcacccagacggtggcacaatctcagctcactgcaacctccatctcctgggttcaagtaattctcttgcctcagtctcctaagtagctgggattacaggtgcctgccaccacacctagctaatttttgtatttttagtagagatgggggtttcaccacgttggccaggctggttttgaactcctgacctcaagtgatcctcccacttcagcctcccacagtgctgggattacaggtgtgagccactgggcccagccttgcatcgttartttgaggttcatggtaacccatgtatctttgggtagctctcagcctgacttgccatttccatgtcttatacttctctgtctttattttctctgagttcttgacttccttttgcccttgtctttattgaacttcatcctgttagtttctgattacttgtccaatttgttgaggtcattttcaattctaattgcatcccccaagactttagcctacactttaaattcagtctcatctatgaacttaatgagtatgctgtttcggtaacaaagtcatggatgatcatcttaactagaaatgaa

SEQ ID NO: 132780 - DNA, 601 bp, Human
ggtttaaaaaaaatttgaagtttttaaaaatttgtgagcaatagtaaccattagttgttacaccaggttacttattggtggacacaactctgttgtgagaagaaccatttagggtataaaccttccataaaaacttcggaaccatagttttcctttccagaaaacatagaactctgaatataagctaaaccctgctacttaattgtatcatgcttattattattattattattattattagatggagtcttgctctgtcacccagacggtggcacaatctcagctcactgcaacctccatytcctgggttcaagtaattctcttgcctcagtctcctaagtagctgggattacaggtgcctgccaccacacctagctaatttttgtatttttagtagagatgggggtttcaccacgttggccaggctggttttgaactcctgacctcaagtgatcctcccacttcagcctcccacagtgctgggattacaggtgtgagccactgggcccagccttgcatcgttaatttgaggttcatggtaacccatgtatctttgggtagctctcagcctgacttgccatttccatgtcttatacttctc

SEQ ID NO: 132781 - DNA, 601 bp, Human
ctaatgccagataaatcctgcagttttcagcagtccctgtgttaatagctttttcatacccgaagaccattaataggtcacttctcaacgttcaatgtcccatctccttttacgttcccacacgtgttccacttactggccttataatcattctcttgatttccaatagacattcacaaggttctttttatctcctgaaaattctgcagttctcaacaggacccagtactcaaggaagattggaaaagcataatgtgccccagaagagagatgacctgatcagcactcagaatgctcttaycagaagcatactgcatcctctgctggggttccacacttcttttctttcatttcactggagcctttatttcctctctttcttacctgtttatcctattgttgcttcttttgtcttttcttctctccttcctctactcattttctttttcatctttttctctctccatccctttcccttattaaatttcccatgttcttttctttcacttcctccgcctcttactcttcaccttctcttcttctttttacacttttagaggcaaatcagttgagttgaaaaaatagagatgttgaagtcaca

SEQ ID NO: 132782 - DNA, 601 bp, Human
agtgagctaagttaagttttctccatttcactgaggagggagaaaagttgagttgcccaaggtcattgggctaatgagttgcagtgtcaaaacatcaaatccaattgtctctaccaaagccatattctttccaggcaaggtagtctggtttagatcatgcccattctactaaagatcccagcagaatttcaggagcaatgctccttgattcatagactgtggcaaccagtcagcagcagaccctagtgccagatagcgcttggatgggtcataaaaatacaaagattctgcagtggtagargcagtaaaagcagtcacagtgttcatagacactgaagaggtcagttctaatgccagataaatcctgcagttttcagcagtccctgtgttaatagctttttcatacccgaagaccattaataggtcacttctcaacgttcaatgtcccatctccttttacgttcccacacgtgttccacttactggccttataatcattctcttgatttccaatagacattcacaaggttctttttatctcctgaaaattctgcagttctcaacaggacccagtactcaaggaagattggaaaagcataat

SEQ ID NO: 132783 - DNA, 601 bp, Human
aaatggaagggtctgaattttctggacattaccccatttcttaccccagttaccttactcctggttccctaattatgacaacccatggtgaagatgagcccctctctgcacgtttgttgtacctcagaggaaggaaaaaggaaatgaaaaatagcatttatggaatgcttcctatctctcaagccctgaggaaggcctgcatacacagtgagctaagttaagttttctccatttcactgaggagggagaaaagttgagttgcccaaggtcattgggctaatgagttgcagtgtcaaaacaycaaatccaattgtctctaccaaagccatattctttccaggcaaggtagtctggtttagatcatgcccattctactaaagatcccagcagaatttcaggagcaatgctccttgattcatagactgtggcaaccagtcagcagcagaccctagtgccagatagcgcttggatgggtcataaaaatacaaagattctgcagtggtagaggcagtaaaagcagtcacagtgttcatagacactgaagaggtcagttctaatgccagataaatcctgcagttttcagcagtccctgtgttaatag

SEQ ID NO: 132784 - DNA, 601 bp, Human
tactccttgacctgagccaaagacaacataagagaaaacaaagagacaaacaaggtctgctcaaagaaactgggcaaaagctcatttccaatggtttaagtacacaagagacaacttctcagacaagggcacctcccttgaccctgtttttcacactattgttcacaaggttactgaaagaaaagtcgtataagagactagtccctacaatacctggaaataacaatcatataattaaaggattttgagctcagtgatttttgtttttgcaagaagtaaaccaaaaccaagacatgtccaygtgaatgcataagtacatactgaatgaatgtgaatggaaatgtccatgcaaacagaagggggttattggcagaggcagcccttgagcactgaccatggactgtagaaagtatcactagggaaaagtcatgctttccaaagacaggcaagagctgggcttcagttttccatctggtactcaaaacacaagaaaggatctttttcacttgcaaattcaatgtacctctggaggtacatgagtccatctctgtttgaactctcatttcaaaatggttctgtcctcaaaatgtaagtattagga

SEQ ID NO: 132785 - DNA, 601 bp, Human
tgctagtgatgaactgtatgacctctgtatctctgtctctgaatctcagcttcatcctctgttaaatggagatattaataatacctaaatcatagggttgctatgaagattaaacaagttaatacttgtaaagcacttagagcagcatctagagtaaaggaaactctcaataaatattgcctaaaatgaggaacatggagggtgtgaaacagactcacagagaaaatcaagagtttgtattgggacaaggtaagtttgagattcctatcatatatctcagtagaaatattaatgagtaggkgggcataagagtctgggcttcaaaactgatgatacaaatttgagagacattgacatttagaatattttgcaagttgaaagactggattttataatcttgtactcattggccaaattcaggcaatagatgagaaattatatgagttttgagagctaaagagaaaataggcagagttgcagggtagtatgcaagaagaggaattaatctagatgtaggtaactgatgtttcagtggaaacctgaaggatgaacctccattggttattatgctcactgttcccctttgtatgtttttaatcat

SEQ ID NO: 132786 - DNA, 601 bp, Human
tttgcttggagtgtctaaggaatagcaagttggctagtatagctggagaaccttgggggaaccaagggaagagtggcagaaaatcagtctggtgagatagggaggacacagaccatgctgggcctgcagccatagtaaggctttgggtattctgtatgtggtggaaagtcatggcagggttttgagcaaatagcagacacaaactattacattttgaaagaagcactttggttgctacacaggaattgactaaggggagcaagagtggatgcaaaagacaagggaacaggtgatggggacrtgactgtgatgatggcaatagagggagtgtgaagtggccactttctggatatgtttgacaggtggagataagaggatttgctaatgaatttgatattgggttgagagaaagagagaaatcgaagataactctgaggttttgggcccaagccactgggtgaatggtggtgacatttactgagacagatcctgggcagaacagtgattaggctgtggccaatacagttattgataccagacagcttcaaatcaaagcccaggtctgctagtgatgaactgtatgacctctgtatctctgtct

SEQ ID NO: 132787 - DNA, 601 bp, Human
tttatcactgcagggtgcccatacagaagtatcagaaagaaagtaatgagaagcattctggaaaagggacatattgcataagtataatgacaatattttccagaccacaaatctgaatgtaaacactgataattatgaatgtgctttctgggacaatgaagcaatgtagttgaaagtgtgatcatccaggaaattcaagacataaggttgtgaatacatatgaaaagaaacaaggtataaacattaaagagacacataagaattactgaggcaatgagggagcacaaatggaagaggtcaragtcatttaaaatacattataattttagaagcctagaccacaaagaaaaaaaaaggcttgaaggatctgtgtctaagaatgtacttactgttctctctaaggtgacctgtcaaattcatagaacagtttcctcacacctcaccagggccatccaaaacaagactaaatacttaacaataacactcactctaagattgcccagggtcgaccactcttctagacaataacggtcaatttggtagataagaatatctgtaaagagtgaagaaaatagttttttgtcagatattctagactata

SEQ ID NO: 132788 - DNA, 601 bp, Human
aaggcaccaggttgttgcagaagacccctgggagtcagaaatgattatactggtcttcaaacaaggcttactggactggtccccagcttgctctaccccttgcctcctgatcagtctcattacaccctcttcatgatccttctctgaatttcaagtgttttcaatatgtttaaagaaaagtttacttgaaaatatgcaggaatctactgatagatcttagacatactaaactaacccctctcagatatagctcaggacactaatgaaaagtgatgcaaatcattgcacatttagtaaaccwatcaaacaagcaaaattggttctcaagcaaatttctttggagctagaacatgtagctggactagagcaggacatcatcagatgagactgcagagagctgcttttatcactgcagggtgcccatacagaagtatcagaaagaaagtaatgagaagcattctggaaaagggacatattgcataagtataatgacaatattttccagaccacaaatctgaatgtaaacactgataattatgaatgtgctttctgggacaatgaagcaatgtagttgaaagtgtgatcatccaggaaattcaag

SEQ ID NO: 132789 - DNA, 601 bp, Human
gaaggcaccaggttgttgcagaagacccctgggagtcagaaatgattatactggtcttcaaacaaggcttactggactggtccccagcttgctctaccccttgcctcctgatcagtctcattacaccctcttcatgatccttctctgaatttcaagtgttttcaatatgtttaaagaaaagtttacttgaaaatatgcaggaatctactgatagatcttagacatactaaactaacccctctcagatatagctcaggacactaatgaaaagtgatgcaaatcattgcacatttagtaaacmaatcaaacaagcaaaattggttctcaagcaaatttctttggagctagaacatgtagctggactagagcaggacatcatcagatgagactgcagagagctgcttttatcactgcagggtgcccatacagaagtatcagaaagaaagtaatgagaagcattctggaaaagggacatattgcataagtataatgacaatattttccagaccacaaatctgaatgtaaacactgataattatgaatgtgctttctgggacaatgaagcaatgtagttgaaagtgtgatcatccaggaaattcaa

SEQ ID NO: 132790 - DNA, 601 bp, Human
aagaaataatgaagaaaatgactgtaaagcactcagaattcctttgaggtaactaaacaaacatcattaccataagcacatttcacaacatctgtctacaaaaaattcagttatctgccattctaacatttaaaaagatctcttgaggaccaaaatcatctttttcaagagaaaaaaaaaattgcctagtttttgttttttttttttttttttttttttttcagaaaaacagtgatgttttagagtttctggtttggttctcttggtacaggctgaacacctgaatagctgggaatttctsctcagaaggaagtctaccttacaaacctgtggtaccttcgagtggacttggctcataaggcttcccgtaggaaaattctagggaactaatctgtaatgcttttagacttcaaagtcttccttctgctaacagattcctccattactgccagtgaaattggcaccaattagcaccctgacaaggccacacattaaaaagaccacagagactgtgttcctctctgaaagcccccacgtttgtccccccaccatgaacagttgatgtgagcagaagggcgaatgtgtcattgtgaagaaggga

SEQ ID NO: 132791 - DNA, 601 bp, Human
agggttcatgttaaagaacatgtttagatagtcactgccaattctttatggagcaaaggcaggttacaaatgagtaaacaactaaaattaacaaaaaaggaaacaaaaattatgtagaagaacaaggtgtatttcaagcaatctttctctcaagggggagaaagtatggtgaaaaatataaatggaaaagtttgaaagagcaatgaaaaatagtaaatagagaaagagaagccggagacaccaagcaaacatcttgaaagtgcatccaggatgtccgaagtggtgtgagtctacaatcctrgaagtgcagacagcggtagaacatgaggctaacaggagatatttcagagacaatgtagcgagaagaactgaatgaagaatttatgcttgagattaaaatatgatcaggaaaataaaaaaccttaagaaataatgaagaaaatgactgtaaagcactcagaattcctttgaggtaactaaacaaacatcattaccataagcacatttcacaacatctgtctacaaaaaattcagttatctgccattctaacatttaaaaagatctcttgaggaccaaaatcatctttttcaagagaaaaaa

SEQ ID NO: 132792 - DNA, 601 bp, Human
caagagtgagggaacagagtggtgcagaggctaaatgaaaatggcttatttttcacacctgtaaggtctgaggcatggggagcaattgtctagcacagttctcttccttacgggcctgctcactgtagccggatgatctctgccaatcttgagagctgactggattgtgctcatctcttcccaactccttgttcaagggtgtcaggctggtagcttgaaactggcatgggcaccgtgaagttggcaaacactatcaatcaggctccctctgtccagccctggcccctgttgttaaacgtcwaccagctcaccactgcccagaacccaatcattcatcatttcatggtatctaccaccttctttaatgattttttaaatgttccaagtgattgtcttaattaaaataattctaaacatgtctctgagtatttctgagactgtaaacacatttctaaaacactgtgagcctcagtttctgcatctgtaaaaataggtgtgtggcattctgaggtgccttccacataatttcatgatcataatttctttaggacaggggctctctacatcctacaaattaaagcccgatgaagaggtgctttta

SEQ ID NO: 132793 - DNA, 601 bp, Human
acatttaatgtttcattttacagatggctacagaggggtttgatgacttgcccaagctcccacggtaagtgacttgaagctgagcagtctgactccagagcttggactcctacccaccactctgcactgcttctctgacaatgaaggagtaagacatgttccttttcctccaaggacagtctagagggaaaagacactatccatcgacaataataggctttggtaattactctaatatccactatccattgacaagttaggctttggtaattactgtaataaaagatataaataaagtacyccggcattcagagtagaagtgatgttttctaaaagaatcagaagaaatctcacagagaccctcattttgagctgtggcttgaaacgtaaatgatagctgaggaggtaagagttatttatctgccaaggaaagggcaagagtgagggaacagagtggtgcagaggctaaatgaaaatggcttatttttcacacctgtaaggtctgaggcatggggagcaattgtctagcacagttctcttccttacgggcctgctcactgtagccggatgatctctgccaatcttgagagctgactggatt

SEQ ID NO: 132794 - DNA, 601 bp, Human
taattctataatctactgatttttattaaatatatcattctcatttccccaacagtagtttgttcacgcagttccctctatcacaccctttcccaacttctaccaagttagctgggtaatatccttacttcaagtccattcatttcaaccaccaaccactgcacaccgattctgtgccaggcactgggctatgtgctagaggtaacaataccaggtagcatttgttgagggtatagatgtgctaggcactgaccatatctagtaatctcattatatcacagtgagcctgtgagattgaagytcacatttaatgtttcattttacagatggctacagaggggtttgatgacttgcccaagctcccacggtaagtgacttgaagctgagcagtctgactccagagcttggactcctacccaccactctgcactgcttctctgacaatgaaggagtaagacatgttccttttcctccaaggacagtctagagggaaaagacactatccatcgacaataataggctttggtaattactctaatatccactatccattgacaagttaggctttggtaattactgtaataaaagatataaataaagt

SEQ ID NO: 132795 - DNA, 601 bp, Human
tacaaaagctattgcaataacaatggtatatttatagacatacatcatctagcatatggggtgaagggaaggtacgaatgatcctaccttgctctgtgttcatcataccacagctggaaaactgggttctgatcctataattctataatctactgatttttattaaatatatcattctcatttccccaacagtagtttgttcacgcagttccctctatcacaccctttcccaacttctaccaagttagctgggtaatatccttacttcaagtccattcatttcaaccaccaaccactgcamaccgattctgtgccaggcactgggctatgtgctagaggtaacaataccaggtagcatttgttgagggtatagatgtgctaggcactgaccatatctagtaatctcattatatcacagtgagcctgtgagattgaagctcacatttaatgtttcattttacagatggctacagaggggtttgatgacttgcccaagctcccacggtaagtgacttgaagctgagcagtctgactccagagcttggactcctacccaccactctgcactgcttctctgacaatgaaggagtaagacatgttc

SEQ ID NO: 132796 - DNA, 601 bp, Human
tggggatgaacatgggtcaatgcagatgtgcacctcctgggctgggtggaagccctgggatgaatcagatatgtctctctgtgagccaccacctatggccacacaggctgagtgccccaacaccatggagcaccatccacatgggctccaatgtgaaaggccagtgtccctgaatcatgaacatggcggcctgctggcaaccatcctgagaaatgtatgggttccattatttttcagaagagccactcattcctatttataagggaatcaacatggctttgttggggggttctcattctcyctgtctcattgagtttaatggagaaagagggaacacttgcttattttctataactgagcatcttcaattatcgtaaggaattatggattgcaagcacctgcattttctcaatctatgatttcctccatgcagcaatgcaaattagtagaacaggtgaggcaccaggaactacagcaccacttaatttattaactacagaaatcaataagaagcaacaagttggtaggacttcataaattttcaagcaaatcggcttggatttccatattaatgcaaaacccagactccctccttcttggt

SEQ ID NO: 132797 - DNA, 601 bp, Human
ttcatgaagctcacagtgagtggagtcagatatgtaaacaaatatcttgcagcactgtgtagtaagtgaggatgctggagttcccgcattatgtgtggctgccagttttttctatttaactgtaacaaggagcatgatggtgagagcagcagatagctttggaaatgtcaacagaacaatgggagcaaatgagccaaaatgatgtgttttggctgtagaagagatccagtggggagagctaggtggatctaaattggaataaaattacaaattgggattaaagaatactaacactgtttgsgaagggagcacagttaggctggggatgaacatgggtcaatgcagatgtgcacctcctgggctgggtggaagccctgggatgaatcagatatgtctctctgtgagccaccacctatggccacacaggctgagtgccccaacaccatggagcaccatccacatgggctccaatgtgaaaggccagtgtccctgaatcatgaacatggcggcctgctggcaaccatcctgagaaatgtatgggttccattatttttcagaagagccactcattcctatttataagggaatcaacatggctttg

SEQ ID NO: 132798 - DNA, 601 bp, Human; identical to SEQ ID NO: 20304

SEQ ID NO: 132799 - DNA, 601 bp, Human; identical to SEQ ID NO: 20305

SEQ ID NO: 132800 - DNA, 601 bp, Human; identical to SEQ ID NO: 20306

SEQ ID NO: 132801 - DNA, 601 bp, Human; identical to SEQ ID NO: 20307

SEQ ID NO: 132802 - DNA, 601 bp, Human; identical to SEQ ID NO: 20308

SEQ ID NO: 132803 - DNA, 601 bp, Human; identical to SEQ ID NO: 20309

SEQ ID NO: 132804 - DNA, 601 bp, Human; identical to SEQ ID NO: 20310

SEQ ID NO: 132805 - DNA, 601 bp, Human
cagtgtgggtacacagcagcggccctctagtaacaccccacactggcagccctgtgcatttaggccacccaaccacatctaacaggaggtaccatgcactcaaaaaaaatatatatatatataaaaaatatatataataaatatataaaaaatatatataatatataaaatatatataaaatatataatatatattatataaaaaatatatattatatataatatataaaatatataatatatattatataaaaaatatatattatatataatataaaatatataatatatattatatatwatatataaaatatataatatatattatatattatatataaaatatatattatatataatatataaaatatataatatatattatatataatatatattatatataataaatatataaaatatatataataaatatatatagtatcttttctcaagatactatttatcttctccacatgcttttgaatgttcttgataagtagagatgtagaaggaaaaatgagaatctgagcccctgaagagaatatctcctccttttcattcttctcagaccatttgcttaagtgtgtagggttttagg

SEQ ID NO: 132806 - DNA, 601 bp, Human
gcaaaaaggaagacaaatcagagaaacagataacacaaaggggtaaacacagtggagtatatattttccatgggccatgatgtgcccatctcctcagtgtgggtacacagcagcggccctctagtaacaccccacactggcagccctgtgcatttaggccacccaaccacatctaacaggaggtaccatgcactcaaaaaaaatatatatatatataaaaaatatatataataaatatataaaaaatatatataatatataaaatatatataaaatatataatatatattatataaaaaatatatattatatataatatataaaatatataatatatattatataaaaaatatatattatatataatataaaatatataatatatattatatataatatataaaatatataatatatattatatattatatataaaatatatattatatataatatataaaatatataatatatattatatataatatatattatatataataaatatataaaatatatataataaatatatatagtatcttttctcaagatactatttatcttctccacatgcttttgaatgttcttgataagtagagat

SEQ ID NO: 132807 - DNA, 601 bp, Human
taaatcatgagatgagagaagtaaataaaagcttccaaataagagagaaaaaaatacaagagagagaatttttttttaaataaggaagaagaataaagcaaaaaggaagacaaatcagagaaacagataacacaaaggggtaaacacagtggagtatatattttccatgggccatgatgtgcccatctcctcagtgtgggtacacagcagcggccctctagtaacaccccacactggcagccctgtgcatttaggccacccaaccacatctaacaggaggtaccatgcactcaaaaaaaawatatatatatataaaaaatatatataataaatatataaaaaatatatataatatataaaatatatataaaatatataatatatattatataaaaaatatatattatatataatatataaaatatataatatatattatataaaaaatatatattatatataatataaaatatataatatatattatatataatatataaaatatataatatatattatatattatatataaaatatatattatatataatatataaaatatataatatatattatatataatatatattatatataataa

SEQ ID NO: 132808 - DNA, 601 bp, Human
agacatggtctgccatacctctgacaagtctacacatggggcatggcccatcaagtttctgcaacatccatgttttagggtggtgcgttagtgcattttatgttgctatagaggaatacctgagactaggtaatttataaagaaaaagaaagattcagttggctcacaattctgatgtctggaaaagttgaagtttgggcatatggtgacatcctcaggctgcttccactcatggtggaaggggcaggggagccagcatgtgcggagatcatatggcaagagaggaagcaagagagagggsaggtgccagactctttttaacaatcagctgttgggggaattctcatgggaactaaaaaagcaaaaactcactcagtcccacccctcccaagggagccactaatctgttcatgagagatccacccccgtgacccaaacactggccattaggccccaccttcaacactggggatcaaatttcaacatgagatttaaagggatcagacatccaaacaataggaggtgggcgtggtccaccttaccctaagccacaaccaagtattgagctctgaggttgttcttcaccctattactgtccagg

SEQ ID NO: 132809 - DNA, 601 bp, Human
aagaagcctagaaatggtacttatttcaaaatcatggaaaagaaaactatcttcctccatctcagttatgcttagttcaaacagaaaaacattcagttgttactgcgtggcccatgagggtaagagaaagataagtgcagtatgccaagtaatttttgagacatttgaaggaagcattttgatacccatgcagatcctccacttaacagccaagaaggtctgtgacccacctcatctctgccatattgatgcacggtgacatgatctcaccatacagtgctataaccatgcataggacatratacactacacccctgccatgtcatgcatggtgacatggccctgctatactctgtgtggtacatagtctactacctctctgccacagcctcatgtgaagacatggtctgccatacctctgacaagtctacacatggggcatggcccatcaagtttctgcaacatccatgttttagggtggtgcgttagtgcattttatgttgctatagaggaatacctgagactaggtaatttataaagaaaaagaaagattcagttggctcacaattctgatgtctggaaaagttgaagtttgggcata

SEQ ID NO: 132810 - DNA, 601 bp, Human
aaatgactaatttcccagatgagctagggaaagctccacaaataaagggatctctaatctaggttttgaagtttcagtaggagtttgatgagtgaaaaagtggggaaaaaagcctcccgggcagatgcatagatagaggtatggttgaaaaagatgaacagttgtggatacccaggatatcagatgcaggaacccaagcattggccaatgagactgcagagctggggtcacagtggaaattatttgcaaaggtcttgaaagtctctctctctctctctctctctctctctctctctctctsacacacacacacacacacacacacacacacacacacctgtcttcattctataaaacaaactgatgggatccaacttttagaacataatgaacacggtatggaggacagacatgtgcatatcctgtccgctttaagaagcctagaaatggtacttatttcaaaatcatggaaaagaaaactatcttcctccatctcagttatgcttagttcaaacagaaaaacattcagttgttactgcgtggcccatgagggtaagagaaagataagtgcagtatgccaagtaatttttgagacatttga

SEQ ID NO: 132811 - DNA, 601 bp, Human
gaaatgactaatttcccagatgagctagggaaagctccacaaataaagggatctctaatctaggttttgaagtttcagtaggagtttgatgagtgaaaaagtggggaaaaaagcctcccgggcagatgcatagatagaggtatggttgaaaaagatgaacagttgtggatacccaggatatcagatgcaggaacccaagcattggccaatgagactgcagagctggggtcacagtggaaattatttgcaaaggtcttgaaagtctctctctctctctctctctctctctctctctctctcwgacacacacacacacacacacacacacacacacacacctgtcttcattctataaaacaaactgatgggatccaacttttagaacataatgaacacggtatggaggacagacatgtgcatatcctgtccgctttaagaagcctagaaatggtacttatttcaaaatcatggaaaagaaaactatcttcctccatctcagttatgcttagttcaaacagaaaaacattcagttgttactgcgtggcccatgagggtaagagaaagataagtgcagtatgccaagtaatttttgagacatttg

SEQ ID NO: 132812 - DNA, 601 bp, Human
ggaaatgactaatttcccagatgagctagggaaagctccacaaataaagggatctctaatctaggttttgaagtttcagtaggagtttgatgagtgaaaaagtggggaaaaaagcctcccgggcagatgcatagatagaggtatggttgaaaaagatgaacagttgtggatacccaggatatcagatgcaggaacccaagcattggccaatgagactgcagagctggggtcacagtggaaattatttgcaaaggtcttgaaagtctctctctctctctctctctctctctctctctctctstgacacacacacacacacacacacacacacacacacacctgtcttcattctataaaacaaactgatgggatccaacttttagaacataatgaacacggtatggaggacagacatgtgcatatcctgtccgctttaagaagcctagaaatggtacttatttcaaaatcatggaaaagaaaactatcttcctccatctcagttatgcttagttcaaacagaaaaacattcagttgttactgcgtggcccatgagggtaagagaaagataagtgcagtatgccaagtaatttttgagacattt

SEQ ID NO: 132813 - DNA, 601 bp, Human
agtatcttccagttctctgatttaaacaacatggcacagtctagaatatgagaagagtgcattagtgtttttctgcacaaaggaattgtgaaaatgatacatctcacagaaacatgtcctcaattcccttcgataaggacatcactactaaaaggcctcgtagaaggtagtggggaagtgtgcacataagcagtgtagtacgtattgtgagaaactaacattaatctggctcaaggacacagcaaaagggagcacacaatgacactcaggttttgtaatgtctccctaaaattaaccagcwaggagaagactgcctataaagcatgtctctgcaaagcttcagtgcaaactggatccattcttccaggcaaaggagaggggaactgaatctgatcccactgcaagaaatactcactttgaaaggatggggctgggagactgacaatgcaaatcgggacaaagaggagaagcactgaagtctaaaggatgcaatgagctcaaagtgcagattacagaagaagttgtgaaggccttgtattaggtccctgtggcagccataaaaaatagccacgaacagaagcttattctcacatagttctga

SEQ ID NO: 132814 - DNA, 601 bp, Human
ccctgtgcctgatgatcaaataaagtatcttccagttctctgatttaaacaacatggcacagtctagaatatgagaagagtgcattagtgtttttctgcacaaaggaattgtgaaaatgatacatctcacagaaacatgtcctcaattcccttcgataaggacatcactactaaaaggcctcgtagaaggtagtggggaagtgtgcacataagcagtgtagtacgtattgtgagaaactaacattaatctggctcaaggacacagcaaaagggagcacacaatgacactcaggttttgtawtgtctccctaaaattaaccagctaggagaagactgcctataaagcatgtctctgcaaagcttcagtgcaaactggatccattcttccaggcaaaggagaggggaactgaatctgatcccactgcaagaaatactcactttgaaaggatggggctgggagactgacaatgcaaatcgggacaaagaggagaagcactgaagtctaaaggatgcaatgagctcaaagtgcagattacagaagaagttgtgaaggccttgtattaggtccctgtggcagccataaaaaatagccacgaacaga

SEQ ID NO: 132815 - DNA, 601 bp, Human
aggctacaagaagagagaggacacctgtttgcttttgatgagaaaagagttccctgtgcctgatgatcaaataaagtatcttccagttctctgatttaaacaacatggcacagtctagaatatgagaagagtgcattagtgtttttctgcacaaaggaattgtgaaaatgatacatctcacagaaacatgtcctcaattcccttcgataaggacatcactactaaaaggcctcgtagaaggtagtggggaagtgtgcacataagcagtgtagtacgtattgtgagaaactaacattaatcyggctcaaggacacagcaaaagggagcacacaatgacactcaggttttgtaatgtctccctaaaattaaccagctaggagaagactgcctataaagcatgtctctgcaaagcttcagtgcaaactggatccattcttccaggcaaaggagaggggaactgaatctgatcccactgcaagaaatactcactttgaaaggatggggctgggagactgacaatgcaaatcgggacaaagaggagaagcactgaagtctaaaggatgcaatgagctcaaagtgcagattacagaagaagttgtga

SEQ ID NO: 132816 - DNA, 601 bp, Human
atagacaaattcaatgattccaacagttaaaagaagtgctcactagcctctcccacatccagaacattccaaatctgaaaggacaacatcccatgctgtgtactttgatttttgttaattaaaattgtttgttgcctatttttggctttaattttgggcctagttcaattcaatgcaggtgacaaaactgtgaattcagactcatgctagtttgcatagttgcattaaaaagtcgtagttccaggaagcctctggtcctctaatatcttgcatagggatacctttctaagaagggtaatamagagcagatccaggacagcgttggcttctgattacctccctccctcccttccttccttcctctttcccctcatactctctccatctgtctccttccttctccttccttcatttcatttttgtgtttcacaaaaagatgagtctactaatatcagcagaatgagacaaagccaaattctttacccaggtaagaaagacaaactttctgatatctatttagtaagtcttctacgcacatgggaaacctgtgttccttgtgcagctttgtgagtgctaagttactatttatccagttatcttg

SEQ ID NO: 132817 - DNA, 601 bp, Human
ttagccctccccgtactaaaacattgataatttttttgtttttaatcagaaaagaatgttggggaactctcctattttatgtaactaaactttggaacaaagcaactgccttcaacagttagctaaatagaatagctctcttatagaaacagagactaggctgtaaatagatttgaaatttggtgggaatcctcagagccacctgctcctccccacctgggagagtcagtctgactgggagaggccacatagggaagctatagacaaattcaatgattccaacagttaaaagaagtgctcrctagcctctcccacatccagaacattccaaatctgaaaggacaacatcccatgctgtgtactttgatttttgttaattaaaattgtttgttgcctatttttggctttaattttgggcctagttcaattcaatgcaggtgacaaaactgtgaattcagactcatgctagtttgcatagttgcattaaaaagtcgtagttccaggaagcctctggtcctctaatatcttgcatagggatacctttctaagaagggtaatacagagcagatccaggacagcgttggcttctgattacctccct

SEQ ID NO: 132818 - DNA, 601 bp, Human
aggacccgaggtcttgagcctcctcctcctgacttcctcctggagtgatggctgacaatccaagctgctccgtgctgagggagtcggcttgcctgctcgttttcttctctccactctggccattctcaggatcatgttggcctgaagccaatgctcctgatgctctcgatcaaagccatcacctgagtggcactggagtaaaataggagaggaaacatccgagactatagtgttttcagagtgtcagccacttggtctttaaatggctctctgtgacccatgctggacaggaaatctcgaygtggaatcgtaaactaaatggttgggcttccctagcctcagggagtctcaggcccccatcagccctagcatatgcccagctaggccgaaaggttccaaaaatatagcaggctgcacaccttttccactcttgccaccattacagctggaggcaacaaggctgaaacacaaaagcccagagcagccctggccacaatttcattgtgaatataattctgacatctttaaaacctgactcattctaggcttgatgcttttggccacatataaatttccatgctgcattaatttgtctcaaagg

SEQ ID NO: 132819 - DNA, 601 bp, Human
accaaggacctggacaacttctggtcaagaccctccatcggtaacagtagaaccatatgtgaagagtttaatagtaggcttggcacataatatatgttcattacatagttcaataataagggcagagagaaataggcaggtttggccccaggaatcccagtggctatcatctagccaagaaataaaactcaacgtgatgccagctcttacagatcctgcattcattctagttgttctcctcccactctagggtggggtggaaggcagtggtgtcagggaaaagaggagctgcagaggcaggaaagcacttccttggctggcaccgcagtggtctggcattgccactccctaggcatggcagatgtcctccttgccaggcaagttctgggctccccagagatgctctcaggaagaacattggaccaacctcagtgcagctggtcactcacatcagtccctccagcttttccactggacagcacccctcctgactctatctgttgcagttgccttatcttgggaagaaaggcctttgggcagggagccttgaaaaacacctccctcgacctcaggcccagactgactccctccttcccatatg

SEQ ID NO: 132820 - DNA, 601 bp, Human
ggttcttaaatgtgcaaggggctgtatgtgcacaaatgaagaaaacaaacttcgctggaaatactgttggttagaatgaacaaggtctcttcaaggttcctgtgcactcacagctggataatgagtggtctctggctggagtcccattatcactcctttgagaatccaagaagccaggccagagaaggtccccaggacagaggctttattagattctgttgcctcaggccaatgcctctagaagcatgccctactttcctgtgtccacacaaagaagacacagggctctggtaggcagtaycacaggggcagatgcaggctgtggggtcagctctctggatcaaatcctggaaccctcactttctagttgtgtgacttaggtgaatttgcttaatccttagatgactctcctcatctgtaaaacgatgttaataatggtgatctcaaagggtggacataaagattaaaagtagtgaggcaggagaatagggtctggaggaagggaacttaaggctgaatcaaggaaaaacatcaaggtctggaggcacggaatctaaggccaatttgcactgacttcccaaagctggatcaaaaagaaaaa

SEQ ID NO: 132821 - DNA, 601 bp, Human
gtgcttttaaaaggataaaaagaaaagcagaaaattgctcagtgctccaagtcaaaaccacatctgtaccctatgtggtgtatgtgctggtgtgtttgcagggatgggtgggtgtgtcatgtaaaggcatgtgagttaataaccttgtgtgttcaagtgcattttttttctgtaagaaaaaaaaaaaaggctcacttcccagaggttcctgaaccccagaggtcctcagctgcagagtccttcatgacacaatgctgttagccatcttgttcaatttgtatttgaggccactcacagacaycattagaaatcacagtattctttcttcagtaccaggataacacccagctcaacatctcttttgtacccagtccaaaaaaggtggagtcccagctgcctcagggtctgttggcaatcagttcttgcaagaaacacagctggctaatactttactcagaaaactgtggtgctagtgataagctgggagatgtgtagaggagtttcacagaattaagcatttaggaaattaataccaaggtggtttatagccttaagctactcatggtcttcttgtcacaagtacttcagaaactaaacactg

SEQ ID NO: 132822 - DNA, 601 bp, Human
agaagctggaaaccatcattcgcagcaaactaacacaagcacagaaaaccaaatatcacatgttctcattcataagtgggagttgagcaatgagaacacacggacacagggaggggaacatcacacactggggcctgtaagggggtggggggctaggggaaggatagcattaggagaaatacctaatgtagatgacaggttgatgggtgcagcaaaccaccatggcatgtgtatatctatgtaacaaacccgcacattctgcacatgtaccctagaacttaaagtattaaaaaaaaaaaaagccgctcacatggaggtgccagtagtgccaagtggaagggcagaagtggagtggctgcttgtctaggccatctgtaacctggggaaactcatcttggagcatgggtgtattggataacgtgtgatttcagggcatttccaactgagagttgaagttgcattataaagactttcttcaaaaggagctggagaactgctgtgcttcccaataccaaattcctttttgccccattccaaggcaatgctaccacagctgcctagcggaaatgccccttactactgcataaactgtctggctcac

SEQ ID NO: 132823 - DNA, 601 bp, Human
ttgtgttaatattattagcttatgttcttggaacatttactcatttaataaacttctacaatgtaccaggtactgtctcaggagctggaaagacataattattgaaagcatgtctcttgcctcaaggagcttatgattcagtgaaggaaatgagcacttgctcaatgattctagtggagggtgacgggtgtgtttgggccattgtaggaggacaggggtgggtgtctggggtgtggagtcttgataagttgatagaaacaagaaagaggccctcgctggcaggaacaggaatgagggtagragagagccattgttctaagaagtggctaacaagctattgttgtaagaaatggctaaccacaaacatcctgttcccaaatacctccttccaaacagccccagcagcatgaacctatctgcagtagcctttccagcatgaccctataaaactcccctccatcctctgcatcttggcagacaggcttctctctgctgtactgcctgttgcactcttgcaatgcacctttcttagtttctctaataaatctgcctttctttacccacaactgtcttggtaaattcttttaccacctgtgatgta

SEQ ID NO: 132824 - DNA, 601 bp, Human
ccactcctgtgagaaaccatttccttggggtagagcccagtagtcaggtggaatcatagttgaagctcactcttgaagtcattgttttctaccacagagatgggcaaaagacacagattcagaaatgctcactgagcccttactatgtgcctaggaggatgctgggagcatgctttcaaaagacccacaaggttggctgcaaagaggtactaggcacctcttgtctgagagggccatgaagatgctcttcatccaggcatcctcggagccagagctagtttcaaggggtctaagcactgcractcgcctgctgccccttccacatcttttttagccctgacgtttgaccttccctccaccagccctcctactcccacctcaaaatctcactgaaacaagtgagtgcctggggcaagcagggtggaaggagggctgagtggtgggctcttgggtgtatttgtagcagtttgtggctttcagggcacatgttaatcatctgctagaaacagcgtgggctttgtgagctgggtttaggagcgaaccctgggtggatgtaggacgtgaccactaatatttattgaggatttagcatgcttgaggc

SEQ ID NO: 132825 - DNA, 601 bp, Human
ataggtatacacgtaccacggtggtttgctccacctatcaattccccatctaggttttaagccccgcatgcattaggtatttttcctaatgctctccctcccctagccccccactcccgacaggtgctggtgtgtgatgttcccctccctgtgtccatgtgttctcattgcttaattcctacttatgaatgagaacacgtggtgtttggttttctgttcctgtgttagtttctcactagtttgttgagaatgatggcttccagctttatccatgtccctgcaaaggacatgaactcatttkttttatggctgcatagtattccatggtgtgtaagtgccacattttctttatccagtctatcattgatgggcatttaggttggttccaagtctttgctattgtaaatagtgctgcaataaacatatgtgtgcatgtgtctttatagtagaatgatttataatcctttgggcatatacccggcaatggaattgctggggaaagaccagttttataatttgcccactcctgtgagaaaccatttccttggggtagagcccagtagtcaggtggaatcatagttgaagctcactcttgaagtca

SEQ ID NO: 132826 - DNA, 601 bp, Human
aggctcttctctaagtctctgagagagcttgaagtagaataaattaggtttactttttctgagtgtctgaaggaacagaaaattctttggcaatatatgccatgcaagcagggaaggccttaagaaagacctagtttttaaatttttatttatttattttattttaagttctgggatacatgtgtagaacgtgcaggtttgttacataggtatacacgtaccacggtggtttgctccacctatcaattccccatctaggttttaagccccgcatgcattaggtatttttcctaatgctctmcctcccctagccccccactcccgacaggtgctggtgtgtgatgttcccctccctgtgtccatgtgttctcattgcttaattcctacttatgaatgagaacacgtggtgtttggttttctgttcctgtgttagtttctcactagtttgttgagaatgatggcttccagctttatccatgtccctgcaaaggacatgaactcattttttttatggctgcatagtattccatggtgtgtaagtgccacattttctttatccagtctatcattgatgggcatttaggttggttccaagtctttg

SEQ ID NO: 132827 - DNA, 601 bp, Human
ggtattaattaaaaacttagaaatgttataaattatctggctgcatcaataatttgcaatgaaactaaggctcttctctaagtctctgagagagcttgaagtagaataaattaggtttactttttctgagtgtctgaaggaacagaaaattctttggcaatatatgccatgcaagcagggaaggccttaagaaagacctagtttttaaatttttatttatttattttattttaagttctgggatacatgtgtagaacgtgcaggtttgttacataggtatacacgtaccacggtggtttgytccacctatcaattccccatctaggttttaagccccgcatgcattaggtatttttcctaatgctctccctcccctagccccccactcccgacaggtgctggtgtgtgatgttcccctccctgtgtccatgtgttctcattgcttaattcctacttatgaatgagaacacgtggtgtttggttttctgttcctgtgttagtttctcactagtttgttgagaatgatggcttccagctttatccatgtccctgcaaaggacatgaactcattttttttatggctgcatagtattccatggtg

SEQ ID NO: 132828 - DNA, 601 bp, Human
tgggtattaattaaaaacttagaaatgttataaattatctggctgcatcaataatttgcaatgaaactaaggctcttctctaagtctctgagagagcttgaagtagaataaattaggtttactttttctgagtgtctgaaggaacagaaaattctttggcaatatatgccatgcaagcagggaaggccttaagaaagacctagtttttaaatttttatttatttattttattttaagttctgggatacatgtgtagaacgtgcaggtttgttacataggtatacacgtaccacggtggttkgctccacctatcaattccccatctaggttttaagccccgcatgcattaggtatttttcctaatgctctccctcccctagccccccactcccgacaggtgctggtgtgtgatgttcccctccctgtgtccatgtgttctcattgcttaattcctacttatgaatgagaacacgtggtgtttggttttctgttcctgtgttagtttctcactagtttgttgagaatgatggcttccagctttatccatgtccctgcaaaggacatgaactcattttttttatggctgcatagtattccatgg

SEQ ID NO: 132829 - DNA, 601 bp, Human
gatacaacagaggctttagttaattcaaagaaatgaggacaggagcaggattttggtaacaggtagaatccaagttgaacaaggggcttacaaggtgattgagggtggcagtttctagagactttgagataacaaaacagagctactgatcttttctattctgagggcctctaggccttagctataggcagtctggcagatgctaaggactcctgagatagactaggtggttggacactaaccttagtaccaacaaaaagatcagagattatgtttatgcagagctgttctgattttcctrtactctattccagtaagtgctatgtagtatttagaatctatctgatgaatgaataaatgaaaagtaggcggtgagactgaaaagcaatgaaactgacttgtatccctcatttagagaacatcattacattctacttgcaactaacagatacacaggataagtcacattaatagctagtatgctttaagaatgaatttgccaggaaaaaccctatgtggtatagaggttggaagacaagctctctgggctgggaatggagaagaggagcttcaggaactaaaaccactgggactcggcctc

SEQ ID NO: 132830 - DNA, 601 bp, Human
aaagaggaaattcctctgttgtatttaccatcctattttttaagaacgaagtgtctgcctccctcactagactctgagagtagggctgtttcagcatatctccaacgtctcacaaggtagggtttccatgacattttgggacatacttatactaaaatcatattcacaatttacctgaaattcacatttaactcggtgtcctgtattcttatttgctaaatctgttagctctattcaaagattaactagtaactattcaataacgattaagctaattgttgttatatactaggtattattktaaatgcagaggatatagtaacttttaaaagccaggtagatgatacaacagaggctttagttaattcaaagaaatgaggacaggagcaggattttggtaacaggtagaatccaagttgaacaaggggcttacaaggtgattgagggtggcagtttctagagactttgagataacaaaacagagctactgatcttttctattctgagggcctctaggccttagctataggcagtctggcagatgctaaggactcctgagatagactaggtggttggacactaaccttagtaccaacaaaaa

SEQ ID NO: 132831 - DNA, 601 bp, Human
aatgattaaaagtgaggggagcaagtcttcttgtaaaagattaagactatatttagccttgaaaggagcaaaagaggaaattcctctgttgtatttaccatcctattttttaagaacgaagtgtctgcctccctcactagactctgagagtagggctgtttcagcatatctccaacgtctcacaaggtagggtttccatgacattttgggacatacttatactaaaatcatattcacaatttacctgaaattcacatttaactcggtgtcctgtattcttatttgctaaatctgttagctstattcaaagattaactagtaactattcaataacgattaagctaattgttgttatatactaggtattattttaaatgcagaggatatagtaacttttaaaagccaggtagatgatacaacagaggctttagttaattcaaagaaatgaggacaggagcaggattttggtaacaggtagaatccaagttgaacaaggggcttacaaggtgattgagggtggcagtttctagagactttgagataacaaaacagagctactgatcttttctattctgagggcctctaggccttagctataggc

SEQ ID NO: 132832 - DNA, 601 bp, Human
accaggccactgaatccttttcatggtctgaaatgtgcatctcatgttctctttgtcaatggattacagagaaggtagcctacttcaaaattcttgaaattccaaggcaggagctaattaacaaatggaaaatgtttctaacctacagcaaagaatgctgtaaaataaaacgtttctctttcaaataagaggctccatcactaggcaggtgagatacttagtgaaaggatagacatgaccagttgttgggagtgtggggcaacttattaaacacacagggaagggtcttgttttctttaawaacttaagtgacaggatgaaaaaacctgctctttaaacctgctgtaggcatcaaattggattggatggatggctacttgagaaatagaattaaacatcaaaacagtaagtctggcctgacaaaagaagatattaaaaggatgaagttaaattaggaagcatacaaaataattcttacaggatgtaaaaccacactgcactagaactagaagggacaggaacaggctttgtcaaatgcatgctcaagaaaaatcatgcagttctacctgaccacatactgcatgcatacataatgcagtgc

SEQ ID NO: 132833 - DNA, 601 bp, Human
tatttggggaaatattctcgatgagtcaatttcacacctgtttggttggtgcaaaagtaattgtggtttttgccattaaaagtaattattttttaatgacaaaaccgaatggcaaaaaccgcgattacttttgcaccagccttaatatagtttaaacatgcaaattagagggaaacagactcactaattgggatacttcctcacctacctagtgggaagttactcacaaatggtcttattgaactccatgataattctatcatgagaccaggccactgaatccttttcatggtctgaaatrtgcatctcatgttctctttgtcaatggattacagagaaggtagcctacttcaaaattcttgaaattccaaggcaggagctaattaacaaatggaaaatgtttctaacctacagcaaagaatgctgtaaaataaaacgtttctctttcaaataagaggctccatcactaggcaggtgagatacttagtgaaaggatagacatgaccagttgttgggagtgtggggcaacttattaaacacacagggaagggtcttgttttctttaataacttaagtgacaggatgaaaaaacctgctcttt

SEQ ID NO: 132834 - DNA, 601 bp, Human
ttatataagctttctttgttatcattatatcttttcccctctaaaagtggcaaggggacatagttattttagggttggttactttttgttacagaagcgatattttcctatgaaaatagaaagttctcagcaaacacttggctgactgggaagccgatgcctcaccattcaaagaacagggcaggcttaacacatgcatacaaggaggggactcctgtgcctgtctcacacaggagccgaggaataatcaggggctttgaagaagtcattgccaaataggtcctgaaagaactttataatytaagatccgacaagccacatagcagcacagttggagacctcacttactcagttctcttctgaaatacctgcccgatttagatggtgtgacaggcatagaaaccacaaggtgagaaaattctatctgggattctaaatgtcaaatatttcttatctacattaccctctcttccttccccctcaaccattggtcatgaaactatctttcactgttctcaaattcacatggctaataaagagtgaaaagtactgccttatgctgtggacactatatgaattacataactgtcttcttattcat

SEQ ID NO: 132835 - DNA, 601 bp, Human
tttcaacccttttgatgaaaatcattctaaactatagtcattcaaacatattcagtgagcatctgctatgtgtcatgatacagggaggtaaatgatatacagaaattaagacacaaaagaccatacatggtttaggacattatgtttactatgtacttattccaggaatatcctagaaactgtcattacttttaataatttctttatataagctttctttgttatcattatatcttttcccctctaaaagtggcaaggggacatagttattttagggttggttactttttgttacagaagygatattttcctatgaaaatagaaagttctcagcaaacacttggctgactgggaagccgatgcctcaccattcaaagaacagggcaggcttaacacatgcatacaaggaggggactcctgtgcctgtctcacacaggagccgaggaataatcaggggctttgaagaagtcattgccaaataggtcctgaaagaactttataatttaagatccgacaagccacatagcagcacagttggagacctcacttactcagttctcttctgaaatacctgcccgatttagatggtgtgacaggcata

SEQ ID NO: 132836 - DNA, 601 bp, Human
aaaaactccattcaaagtgcactatttagctgttgatacattatcatgcaacacacagttgagcattaacattcctcagatctagggcaagcctagcatctctggtgaataaggagttaatgtgtcctaatgccagtcaaggacatctttcctggcactttctccatttttccttcacaaaatatatcagatctgaaatcccgcaagagcctgtcagacttaggacttgacaatgcatatgaatatttctttggcaccaaaaatgtgacagagttagagatgattatgataacatggagaygaagtgaaacagaggcataaggacagaggcatttgagttttatccttaagtcatcctgtgtgtgacaggtggccttcgttgagctccttcaacctattcttacacaagattgttacaaagaggtgttattactgtccactgcactctacctcacagaccaacttgggagggtacaagggattgttccagatattttataaaagctgtgggtgctagcaaagagaaatggcctttaaagaagctttcaagtaaagaagacagatggattcaccatggaaactgggattctgaagttgtacc

SEQ ID NO: 132837 - DNA, 601 bp, Human
gccaactcctccagattggccaagtttatccaggcaaagaggtctggggagggtgatggggcaagcgaaatagcatgagaaaagaagcactgggacgtgagcatggcatctgcactgacgttgggaggaatgtttggcgcctagatagaaaccatcccatggagcacaccgaatggtcagactgaggaaggacactgtgaaccccacagtgctcaggtgtagctattgttcagctaaagcagcatggctcgaagaacagagaggttagagaagggacgtttactggaaaactactaagagsctggactattttcagagggaaaataatgggagggataaatgaaaaagaaagacatcagagtggaagccttgactgaatccaagtctgcctatacattcagaagaacgaaggagaggaagcggcagagtcagcctcatccccaccaccttctctcccactctcctccctcacccactcctcaggagccacactggcttcctcgcagtttctaaaactcaccaggcaagctcctaccctcacatgctcttctctgccccaaaagccctggatatccacatatattgatccctcactaacttt

SEQ ID NO: 132838 - DNA, 601 bp, Human
atcacaaaaagaatcaatgcccaaatgccactcagcccttccaggcacccaagagaaaaagtgggaaaggcttaggagatgtgaatggctttgggcctgggctaattatgaggaggtggcagcacatcagaattctgaagacaccacatttttacctactcagcaccctcctgttattattgtcattaccctattttatattttaatagtacttttaaattattgacttttattgtcatgaattttaaccaggtatggaatcttgcagtcaccgccacaatcaagacacaaaacaattccrtttctcaaaaagctccctggtgccactcctttcaagtcacacactccctttgctcttaacctccagccactctatcccatagttttgccttttctaaaacgtcatataaatggaatcctgtagtacataaccttttgagactggcttttttacttatgataatgcctttgagattcatctccaggcctttgcatgtatctgtaggtcattccttcttattgctgagtagtattccattatgtgaatgcaccagttgatccatttatctattgaaggacatttgagttactttcagataat

SEQ ID NO: 132839 - DNA, 601 bp, Human
ttccagggtgagaatgaagaaacatacttgttgagaagtctttaaggtcctggcaccaggagaggagcagattctgaaaacaaaaccaagaatgtcctaaatactgatggtgtcaaagcagtggtcgttctgaccaccagtcaaggccatctcctgatcagctgtcacccagtcccaaggacaataatcagagtcagatccggtgaataacagcacataaatgaaagcagctctgttaaaatgaagaggatggtgaggaactgccttcttgggtagttggcttccctgaaaaatggctctrctcattcagtctgtgtccaatcagcatatgcagattaggacaaaccagtgctgtgaccttgcagaggcggatattgcacatcctatttgcagggatccatccatatgagatatagaatctgggggcttttgtcttcaaagcttgacaatcctacacataaatattcattccattacttctgattttacatttgcatcacaaaaagaatcaatgcccaaatgccactcagcccttccaggcacccaagagaaaaagtgggaaaggcttaggagatgtgaatggctttgggcctgggctaat

SEQ ID NO: 132840 - DNA, 601 bp, Human
ataagaaggaacagacgcattgtcagatatttccctacactactagctaacatacaagaccacagaggtgcacgccattgacatataaatttcctgaaaggcttctagaaggaggctgaattgaagctggcagggaggatggattggctttggaagggtggcgatggggcgttaacatcaatttacaccagaggaactctctgctttaagactcctccaacctggttagcttccagggtgagaatgaagaaacatacttgttgagaagtctttaaggtcctggcaccaggagaggagcagrttctgaaaacaaaaccaagaatgtcctaaatactgatggtgtcaaagcagtggtcgttctgaccaccagtcaaggccatctcctgatcagctgtcacccagtcccaaggacaataatcagagtcagatccggtgaataacagcacataaatgaaagcagctctgttaaaatgaagaggatggtgaggaactgccttcttgggtagttggcttccctgaaaaatggctctactcattcagtctgtgtccaatcagcatatgcagattaggacaaaccagtgctgtgaccttgcagaggcgg

SEQ ID NO: 132841 - DNA, 601 bp, Human
agagaacagaacaagggggctgtctcgatggtgtcccagagcctgtgcactggggctaagacttaaccatttaaacaagaggagcaaaatggtttctagatagagacgagtgtctgttcaaagacacaaggtggtgagaaagattgggcatgatcagagaccacgagcagcttattgttgccagagcctagcaggtatggccatggtgacaggaggttgacacagctgaagaaggaagcagggcctggatcacaaagaaagttgaattctgtgcaaaggagtttagagttcataatataarggatgagaaacagcagagcttctggagttaagctgcctgattcagatcccagctatgccacttgatagctgtgtgaccttgatcaactcacttaacttatctgtgccccagtttctacatttgtacaatgggctgctaatagcacctacctcataaagtttaagtattcaaccagtcaatctgggcaaagtattggcacagtgcctggctgataaatacactatgttagctattgttactatcattattactatcatcatcattgtcatcatcatcttcatcatcgccattggaagcaac

SEQ ID NO: 132842 - DNA, 601 bp, Human
agtactctttattttcttttttcttttttctttttttttttgaaacagagtctcactctgtcacccaggctggagtgcagtgttgcgatcttggctcactgaaacctcaacttcaacctcccaggctcaggtgatcctcccacttcagcctcccaggtaactgagactacacatgtgagcaaccacacctggctaatttttgtacttttagtagagacagggtttcgccatgttggccaggctggtttctaactcctggcctcaagcgatccgctctgctcggcctcccaaggtgctaggrttacaggcgagagccaccatgctgggctcagtactctttattaatcacctttggtcatagagcttccttgaatgtggaatctttttctaggagtcacccagattggaattatcaacacatagatttggataggaaaataacacagacaggacaggccccatttcatagatgaggaaaccgaagtcctgaagagatcaagtcgttccagtagacacagtgtagagggaggacaagctgagacttgacccctgagtatggccttccttttgccagctgaaatgctagctgaacagtcctact

SEQ ID NO: 132843 - DNA, 601 bp, Human
agtaattgaattaaaaaactcagtctgatttcaaagtagggaaatgtgtatagtactctttattttcttttttcttttttctttttttttttgaaacagagtctcactctgtcacccaggctggagtgcagtgttgcgatcttggctcactgaaacctcaacttcaacctcccaggctcaggtgatcctcccacttcagcctcccaggtaactgagactacacatgtgagcaaccacacctggctaatttttgtacttttagtagagacagggtttcgccatgttggccaggctggtttcyaactcctggcctcaagcgatccgctctgctcggcctcccaaggtgctagggttacaggcgagagccaccatgctgggctcagtactctttattaatcacctttggtcatagagcttccttgaatgtggaatctttttctaggagtcacccagattggaattatcaacacatagatttggataggaaaataacacagacaggacaggccccatttcatagatgaggaaaccgaagtcctgaagagatcaagtcgttccagtagacacagtgtagagggaggacaagctgagacttgacccc

SEQ ID NO: 132844 - DNA, 601 bp, Human
gctgtaagacattatatggcacttgcttagcctgagtggcaatttgggaacgagaaaaatttagcgctgtcaagaaccagaatgtcttaacattaatagaacagtgaggaccctgaaaaaataatttttaaacaaatttaaaagcctaatatatcagggagctcagtaattgaattaaaaaactcagtctgatttcaaagtagggaaatgtgtatagtactctttattttcttttttcttttttctttttttttttgaaacagagtctcactctgtcacccaggctggagtgcagtgttgygatcttggctcactgaaacctcaacttcaacctcccaggctcaggtgatcctcccacttcagcctcccaggtaactgagactacacatgtgagcaaccacacctggctaatttttgtacttttagtagagacagggtttcgccatgttggccaggctggtttctaactcctggcctcaagcgatccgctctgctcggcctcccaaggtgctagggttacaggcgagagccaccatgctgggctcagtactctttattaatcacctttggtcatagagcttccttgaatgtggaatctttt

SEQ ID NO: 132845 - DNA, 601 bp, Human
attagccaaagcagtgagtttgccttttcttttgaaaattcttgtcccagcctggtgagatctgtgaagtttacataaaacagagattttttatactgtcattggaacttgaactgtactaaaattcacattcatggagaactgtttagggaggcccgtggggaagaaggaaaaataatttccaaatatcctgatgcttccagaaaatgcccttgtaataaaacttaccccaagctgtaagacattatatggcacttgcttagcctgagtggcaatttgggaacgagaaaaatttagcgcygtcaagaaccagaatgtcttaacattaatagaacagtgaggaccctgaaaaaataatttttaaacaaatttaaaagcctaatatatcagggagctcagtaattgaattaaaaaactcagtctgatttcaaagtagggaaatgtgtatagtactctttattttcttttttcttttttctttttttttttgaaacagagtctcactctgtcacccaggctggagtgcagtgttgcgatcttggctcactgaaacctcaacttcaacctcccaggctcaggtgatcctcccacttcagcctcc

SEQ ID NO: 132846 - DNA, 601 bp, Human
cagggagagaacattgcctcagaattagccaaagcagtgagtttgccttttcttttgaaaattcttgtcccagcctggtgagatctgtgaagtttacataaaacagagattttttatactgtcattggaacttgaactgtactaaaattcacattcatggagaactgtttagggaggcccgtggggaagaaggaaaaataatttccaaatatcctgatgcttccagaaaatgcccttgtaataaaacttaccccaagctgtaagacattatatggcacttgcttagcctgagtggcaatttgggaacgagaaaaatttagcgctgtcaagaaccagaatgtcttaacattaatagaacagtgaggaccctgaaaaaataatttttaaacaaatttaaaagcctaatatatcagggagctcagtaattgaattaaaaaactcagtctgatttcaaagtagggaaatgtgtatagtactctttattttcttttttcttttttctttttttttttgaaacagagtctcactctgtcacccaggctggagtgcagtgttgcgatcttggctcactgaaacctcaacttcaacctcccaggctcag

SEQ ID NO: 132847 - DNA, 601 bp, Human
atgcagttaaaatcataaaaaagataagccaccgactgggaagaagtatttgaaaataaattaaagctattaaaacactaaaggaattagataataacatagcaagacttatatagttaaggcatccttcaaatgaaaataatcgggccgggtgcagtggctcacgcctgtaatcccagcactttggaaagccaaagtgggtggattgcttgagctcaggagtttgaggccagcctgggaaacatggtgaaatcccatctctaccaaaaatataaaaattagccgtgcgtggtggcatgcrcttctagtcccagctacctgggaggctgaggtgtgaggattgcttgagcccaggaggtggaggttgcagtaagtcaagattgtgccactgcacttcagcctgggtgacagagcaagaccctgtctccaaaatgataacaacaataataataataataataataatcaaaataatcagaaaaaccaagcagtcagtactgggaagaagggaagtgctggtttggaggcagagaatttggatttggatttcagctttgtctcaggccagctgcatgaacatgggcaagttccttaaatttat

SEQ ID NO: 132848 - DNA, 601 bp, Human
actttttgaaagatgcagttaaaatcataaaaaagataagccaccgactgggaagaagtatttgaaaataaattaaagctattaaaacactaaaggaattagataataacatagcaagacttatatagttaaggcatccttcaaatgaaaataatcgggccgggtgcagtggctcacgcctgtaatcccagcactttggaaagccaaagtgggtggattgcttgagctcaggagtttgaggccagcctgggaaacatggtgaaatcccatctctaccaaaaatataaaaattagccgtgcrtggtggcatgcgcttctagtcccagctacctgggaggctgaggtgtgaggattgcttgagcccaggaggtggaggttgcagtaagtcaagattgtgccactgcacttcagcctgggtgacagagcaagaccctgtctccaaaatgataacaacaataataataataataataataatcaaaataatcagaaaaaccaagcagtcagtactgggaagaagggaagtgctggtttggaggcagagaatttggatttggatttcagctttgtctcaggccagctgcatgaacatgggcaagtt

SEQ ID NO: 132849 - DNA, 601 bp, Human; identical to SEQ ID NO: 20311

SEQ ID NO: 132850 - DNA, 601 bp, Human; identical to SEQ ID NO: 20312

SEQ ID NO: 132851 - DNA, 601 bp, Human; identical to SEQ ID NO: 20313

SEQ ID NO: 132852 - DNA, 601 bp, Human; identical to SEQ ID NO: 20314

SEQ ID NO: 132853 - DNA, 601 bp, Human; identical to SEQ ID NO: 20315

SEQ ID NO: 132854 - DNA, 601 bp, Human; identical to SEQ ID NO: 20316

SEQ ID NO: 132855 - DNA, 601 bp, Human; identical to SEQ ID NO: 20317

SEQ ID NO: 132856 - DNA, 601 bp, Human; identical to SEQ ID NO: 20318

SEQ ID NO: 132857 - DNA, 601 bp, Human; identical to SEQ ID NO: 20319

SEQ ID NO: 132858 - DNA, 601 bp, Human; identical to SEQ ID NO: 18486

SEQ ID NO: 132859 - DNA, 601 bp, Human; identical to SEQ ID NO: 18487

SEQ ID NO: 132860 - DNA, 601 bp, Human; identical to SEQ ID NO: 18488

SEQ ID NO: 132861 - DNA, 601 bp, Human; identical to SEQ ID NO: 18489

SEQ ID NO: 132862 - DNA, 601 bp, Human; identical to SEQ ID NO: 18490

SEQ ID NO: 132863 - DNA, 601 bp, Human; identical to SEQ ID NO: 18491

SEQ ID NO: 132864 - DNA, 601 bp, Human
cctccctgaactcagacgctgtctgcctgcctccctttgggcacctggcctgctctgccttccaagggagtgattcacccttccatatctatctcctgactcttcgaccaggctcgggaccatcaaggcaaggcccatgcattccagatccttgtattccctgggccggagaggcactggatacaatatcataacgaatatccccacactaagcctctcttacctctgcccacacgaggcagataaggagggggtgccagaaagtatacaaacacatttagaaaaacgagaaggcaggcgsagtcaaagtcagttagttaaaaatctaaaactatttctaatattaagatgtagcctgggggcaagatctggtgtgtctctttcaaactacacaacctagatgttagactgcctcatggcacgatgccaggaggccccattcatgtagaaaacaacatgagtggcaacccccagagagaggtgaagtgtcatggtcatgcaccagaaaaatgagtcctttcagaaaaaaataccaagtcacatggcgcagtggctcacacctctaatcccagcactttgggaggtgaggtgggtggatctc

SEQ ID NO: 132865 - DNA, 601 bp, Human
tttcccatccgcttcctccctgaactcagacgctgtctgcctgcctccctttgggcacctggcctgctctgccttccaagggagtgattcacccttccatatctatctcctgactcttcgaccaggctcgggaccatcaaggcaaggcccatgcattccagatccttgtattccctgggccggagaggcactggatacaatatcataacgaatatccccacactaagcctctcttacctctgcccacacgaggcagataaggagggggtgccagaaagtatacaaacacatttagaaaaaygagaaggcaggcggagtcaaagtcagttagttaaaaatctaaaactatttctaatattaagatgtagcctgggggcaagatctggtgtgtctctttcaaactacacaacctagatgttagactgcctcatggcacgatgccaggaggccccattcatgtagaaaacaacatgagtggcaacccccagagagaggtgaagtgtcatggtcatgcaccagaaaaatgagtcctttcagaaaaaaataccaagtcacatggcgcagtggctcacacctctaatcccagcactttgggaggtga

SEQ ID NO: 132866 - DNA, 601 bp, Human
atggatcagattctacctcccaccagagatttcccatccgcttcctccctgaactcagacgctgtctgcctgcctccctttgggcacctggcctgctctgccttccaagggagtgattcacccttccatatctatctcctgactcttcgaccaggctcgggaccatcaaggcaaggcccatgcattccagatccttgtattccctgggccggagaggcactggatacaatatcataacgaatatccccacactaagcctctcttacctctgcccacacgaggcagataaggagggggtgctagaaagtatacaaacacatttagaaaaacgagaaggcaggcggagtcaaagtcagttagttaaaaatctaaaactatttctaatattaagatgtagcctgggggcaagatctggtgtgtctctttcaaactacacaacctagatgttagactgcctcatggcacgatgccaggaggccccattcatgtagaaaacaacatgagtggcaacccccagagagaggtgaagtgtcatggtcatgcaccagaaaaatgagtcctttcagaaaaaaataccaagtcacatggcgcagtggctcac

SEQ ID NO: 132867 - DNA, 601 bp, Human
tgagctattgcaaaagagtatgattgggtatgggaggggatggtcaaaccctcaaggaaagtattccacaccaggcttacagagaggtatttgctgccaggtttctatgatttgaaaagccatgcttcccccaaggccgaatgactatatttctcagcctctcttgtaaataggtgtaggtgtgaccatgtcacatttcattaaaagaaaaggagattcattcttccccacctcctttctccaccctactgcttgaatcatggatgagatggctggagctctagcagccttttgtttcctraagatgacagccaaacccaagagatggcaaagaaatgagctagaaagtgtctgcatctctgacaatttcatggaacctccatacctctctcaggctacctacttccagacttctttgaaaagagagaaaaataaatgatcttacttaagcccctatcatttgaagatgttctcttatacacaatcaatcctaatcctaaccagaacactagccaaccagtctaccccatcccctgccttgttctacccttaccttaggtcacagggaatattctcctccccgttgcctgtattgacttaa

SEQ ID NO: 132868 - DNA, 601 bp, Human
gcgtgaccacaggtgggcaacaggcattggaacaatggggtggcctgagggacccgtgacaatgctgagaagagaaagaaggaaacgcgtcaagtcaaggcagactctagatgtttggcttgctggctggtgaagcagcattcactaaaatactagaaagtgacagaggggttgaattggcggaggaagataaggactgtctctggcctagtgacttgggggcctctcttagatatcccaagggaagtggccaggagacagctggataaacaggtctgggattcagaagagaggtctggaytcattaaataataataagatggccaggcatggtggctcacgcttgtaatctcagcactttgggaggctgaggcaggtggatcacctgaggtcgggagttcgagaccagcctgaccaacatggagaaagcccgtctctactaaaaatacaaaaaattagccaagcgtggtggcgcatgcctgtaatcccagctacccgggaggctgaggcaggagaattgcttgaacccgggaagcggaggttgcagtgagccaagatggcgccactgaactccagcctgggcaacaagagtgaaactctg

SEQ ID NO: 132869 - DNA, 601 bp, Human
tgtgcttttttaaatatcagcctggattccatatgaaaaatgagtcacagaggagcaagaaagggttcaggcaaactagttaggaggctgccctggcgcctctgacaaacgaggaagcagcgtgaccacaggtgggcaacaggcattggaacaatggggtggcctgagggacccgtgacaatgctgagaagagaaagaaggaaacgcgtcaagtcaaggcagactctagatgtttggcttgctggctggtgaagcagcattcactaaaatactagaaagtgacagaggggttgaattggcrgaggaagataaggactgtctctggcctagtgacttgggggcctctcttagatatcccaagggaagtggccaggagacagctggataaacaggtctgggattcagaagagaggtctggattcattaaataataataagatggccaggcatggtggctcacgcttgtaatctcagcactttgggaggctgaggcaggtggatcacctgaggtcgggagttcgagaccagcctgaccaacatggagaaagcccgtctctactaaaaatacaaaaaattagccaagcgtggtggcgcatgcctg

SEQ ID NO: 132870 - DNA, 601 bp, Human
gttcacagttattttctgattgtgaaaataaaagatctcaatgaggaaaacaggtaaggcagcaaaagaaagaaaacagccaaagtgataagaatcccgtcacccaaaataatcactgaaaatataccgatgcatttctaccttgtacaatttctgatatattctgccttatagaggcttctggactgtcactccaacttggaatcaaatggaccactgagaaacccgtggaagacagcaggtctaaggaaatcacaaagattagaaatgcatccatgtgcacccaactccttcctagtgkgggtggggggtacctttgagatggtctgtgattctacttacccctcactctctgttcccactagtctgccctgccctctgtccctcaactacgccaagctccttccctccccagcgatcttgcacttgacggtccttctgtatggaacctccccgagatgttcatatggctggctcctggccactcctcaaggagaccttccttcaccactgcaatccctctttatcccattaccctgtcttatatagttcttaccattgcccccaaattctccatgtttactgactggtttgtccagta

SEQ ID NO: 132871 - DNA, 601 bp, Human
acataaaatgttcacagttattttctgattgtgaaaataaaagatctcaatgaggaaaacaggtaaggcagcaaaagaaagaaaacagccaaagtgataagaatcccgtcacccaaaataatcactgaaaatataccgatgcatttctaccttgtacaatttctgatatattctgccttatagaggcttctggactgtcactccaacttggaatcaaatggaccactgagaaacccgtggaagacagcaggtctaaggaaatcacaaagattagaaatgcatccatgtgcacccaactccytcctagtgggggtggggggtacctttgagatggtctgtgattctacttacccctcactctctgttcccactagtctgccctgccctctgtccctcaactacgccaagctccttccctccccagcgatcttgcacttgacggtccttctgtatggaacctccccgagatgttcatatggctggctcctggccactcctcaaggagaccttccttcaccactgcaatccctctttatcccattaccctgtcttatatagttcttaccattgcccccaaattctccatgtttactgactggtt

SEQ ID NO: 132872 - DNA, 601 bp, Human
aaatgcaagggatgttttcttggtgctggtgaaatcttggggatacaattgaagtttttttaaagcaaagactatagattccaggtcatacagttcagacacaggttcaaacaaacatttcatactaattcctgggtattggcatcagagaaaccctaagggttgaaatcctggcatgctgacaacacattccgtcctctgtacctcccttgtaccaccagggtctcagcatctcataagagcctgtaaaatccagagccattccttgggtagagattatgggttggctgagggagccacraagattttaaaatgtaaaacatgaacccataaatgcagaaggtctcccgtgttttctaaaatctggccaaaagctgagccacagacaaggaaattgtctggtgtccttgccaaaatgacagtgtcaccaaattgataaacaagtctgggatcgttttgaagacagcgatgataggagaccaccaagggctcaggttgggggctgctgagactggcaagatttagtttctctaattttcaacccaaagcattgatctaattcctcacacaacctattgatagtcatgagtttgctgttgct

SEQ ID NO: 132873 - DNA, 601 bp, Human
gcccccagcactggcagggacctgaccacagtcagaaggcttcatcccagacagccttctctcgggcaccaaagatcaacatccacaacctcaggctgcaccatggccagtccctgctcctgaaatgcaagggatgttttcttggtgctggtgaaatcttggggatacaattgaagtttttttaaagcaaagactatagattccaggtcatacagttcagacacaggttcaaacaaacatttcatactaattcctgggtattggcatcagagaaaccctaagggttgaaatcctggcatgytgacaacacattccgtcctctgtacctcccttgtaccaccagggtctcagcatctcataagagcctgtaaaatccagagccattccttgggtagagattatgggttggctgagggagccacaaagattttaaaatgtaaaacatgaacccataaatgcagaaggtctcccgtgttttctaaaatctggccaaaagctgagccacagacaaggaaattgtctggtgtccttgccaaaatgacagtgtcaccaaattgataaacaagtctgggatcgttttgaagacagcgatgataggaga

SEQ ID NO: 132874 - DNA, 601 bp, Human
accagagaagccactgaaagaaggaaggaaagaaaaactgcaatcgtcaactgtttgaagagtcatcgtgtagaggagagacaggggtcaccctgcagtcattgtccaggaggcactgtggagatttaaattctttaaggacgtgccaagcaacttgataaaacccaagtccagcacatcaggcaagaatgaaggcaactagaagtgaatggacaaaagaggggcagtgttgggtttaacaaggtaatttctttttttgagacggagtctcactctgtcgctcaggctggcgtgcagtggygcgatctcggctcactgcaagctccgcctcccgggttcacgccattctcctgcctcagcctcccgagtagctgggactacaggcaccggccaccacgcccggctaattttgttttgtatttttagtagagacagggtttcaccgtgttagccaggatggtctcaatctcctgaccttgtaatccgcccgcctcagcctcccaaagtgctgggattataggcgtgagccaccgcgcccagccgaggtaatttcttaagtgacaatatctcctggcattcctccctcatcactggctgttca

SEQ ID NO: 132875 - DNA, 601 bp, Human
tgtggcaaagagagagcggcttcccttattctctgctcatcagcctgccaagccaaaccactgaccaaacttcagaagggcaagaagaggccctgcttatgcagctgggaccagcaccagagaagccactgaaagaaggaaggaaagaaaaactgcaatcgtcaactgtttgaagagtcatcgtgtagaggagagacaggggtcaccctgcagtcattgtccaggaggcactgtggagatttaaattctttaaggacgtgccaagcaacttgataaaacccaagtccagcacatcaggcawgaatgaaggcaactagaagtgaatggacaaaagaggggcagtgttgggtttaacaaggtaatttctttttttgagacggagtctcactctgtcgctcaggctggcgtgcagtggtgcgatctcggctcactgcaagctccgcctcccgggttcacgccattctcctgcctcagcctcccgagtagctgggactacaggcaccggccaccacgcccggctaattttgttttgtatttttagtagagacagggtttcaccgtgttagccaggatggtctcaatctcctgaccttgtaatccg

SEQ ID NO: 132876 - DNA, 601 bp, Human
agagaagtcaatgatatgcttgcaatctaatgaattaaattattctaccaccattcttcagacttagaatccacaaaaactagagagggtggaaggagaatggtgtggcaaagagagagcggcttcccttattctctgctcatcagcctgccaagccaaaccactgaccaaacttcagaagggcaagaagaggccctgcttatgcagctgggaccagcaccagagaagccactgaaagaaggaaggaaagaaaaactgcaatcgtcaactgtttgaagagtcatcgtgtagaggagagacrggggtcaccctgcagtcattgtccaggaggcactgtggagatttaaattctttaaggacgtgccaagcaacttgataaaacccaagtccagcacatcaggcaagaatgaaggcaactagaagtgaatggacaaaagaggggcagtgttgggtttaacaaggtaatttctttttttgagacggagtctcactctgtcgctcaggctggcgtgcagtggtgcgatctcggctcactgcaagctccgcctcccgggttcacgccattctcctgcctcagcctcccgagtagctgggactacag

SEQ ID NO: 132877 - DNA, 601 bp, Human
tttgggaggctggagcaggagaatcacttgaacccggaaggcggagactgcagtgagccgagatcacaccactgcactccagcctggaaacagagcaagactcgtctcaaaaaaaaaaaaaaaaaaaggccgggcgccgtggctcacacctgtaatcccagcactttgggaggccaaggcgggtggatcacgaggtcaggagattgagaccatcctggctaacacggtgaaacctcgtctctactaaaaatacaaaaaattagctgggcgtggtggcgggcacctgtagtcccaactactygggaggctgaggcaggagaatggtgtgaacccgggaggtggagcttgcagtgagccgagatggcgccactgcactccagcctgggcgacagagcgagactgtctcaaaaacaacaacaacaacaaaactaaagctaaagctctttgcaggcctcctgttctgagagtgtccggtataagagctgctgacagctttctgacatgggccgtggcagcacccagacctagctcccccagcagatagtgggaagctcgagttgcacaaagatcaaagctcatttcaaggtcagattcctgctgt

SEQ ID NO: 132878 - DNA, 601 bp, Human
cgcagtgggtcacgcctgtaatcccagcacttgggaggcccaggagggcagatcacgaggtcaggagatcgagaccatgctggctaacacagtgaaaacccgtctctactaaaaatacaaaaaaaaaaaaattagccgggcgtggtggcgggcgcctgtagtcccagctactctggaggctgaggcaggagaatggcgtgaaccctggaggcggagcttgcagtgagccgagatcgcgccactgcgccactgcactccagcctgggcgacagagcaagactcgtctcaaaaaaaaaaaaaagaaaaaagaaaatgagagccacaatgttcacacaagccaggttattagcacattggccagaactccaaaagtgttttgatacaactttggtatcaattcatatctcctctccagcataagggtgctacagagtcagagtgcaaatatctgcacagatagcaaactatctataaagaatcagagagcaaatactttaggctttgcaggtcatacggtcttcttaacaactactcaattctgcctttgtatcacaaaatcagccatagccatggacaagatgtaaatgagtgggtgtgaccc

SEQ ID NO: 132879 - DNA, 601 bp, Human
ttttattgggttgtcataatgatcaaacaaaagagttgttattgaagcgctgttaaaggatagtgcaaataaccccacctaaaaggctgatgtgagaaaacagggtaaacaagcatttacaggctgttattgaggggccaggttctggagcatttccatctgggtcacaccaagcagtatgaaaatgggagccacaggccgggcgcagtgggtcacgcctgtaatcccagcacttgggaggcccaggagggcagatcacgaggtcaggagatcgagaccatgctggctaacacagtgaaamcccgtctctactaaaaatacaaaaaaaaaaaaattagccgggcgtggtggcgggcgcctgtagtcccagctactctggaggctgaggcaggagaatggcgtgaaccctggaggcggagcttgcagtgagccgagatcgcgccactgcgccactgcactccagcctgggcgacagagcaagactcgtctcaaaaaaaaaaaaaagaaaaaagaaaatgagagccacaatgttcacacaagccaggttattagcacattggccagaactccaaaagtgttttgatacaactttggtatcaat

SEQ ID NO: 132880 - DNA, 601 bp, Human
ttgaaaggtctccaagacaatgaaaagagtaaggtgcacacacaacatgtcatcattatgaaaacaaacaccaaaaaactatgtaattgcgtatagacatccacaggcatgcaaatattcgtagagaaagagccaaagttgtgtcaaattgatgtcagtgggttcccccaggaactactgttgcaacgaagaagagtttggtcaagaagcctttcagttgaggatattttcatgtattataatacttgtattacttaaataattaaaaccaatttaaaagattacaaaggtaaaaacagaygcagcactctattgacttactaagagtcaggattccaaaactcaaagggctagtggaattctgggcaggactgggcttccacatgcccaggaaaacaacaagggattttcctttcctccagtgccattgatcaaaagctacacaaggacagcgagaggaaaaaaaacagagcccagcccaggagaaagcaaactccattccagctccaaaaggctggtgcaagattcaagagctctcgttgttgctcaaagggaaccccacagggccctgaggacatttctaagctcagatgatgctgct

SEQ ID NO: 132881 - DNA, 601 bp, Human
aagatatggaattttatctttgattaagacattttgggaggctgaggcaggtagatcacttgaggccaggagttcaagaccagcctggccaacatgccaaaaccccatctctacgaaaaatacaaaaaaattggccaggtgtgctggtggacacctatagtcccagctacttgggaggttgaggcagagaatcgcttgaactcaggaggtggaggttgtagtgagccaagatcacaccactgcactccagcctgggcacagagagagactctgtctcaaaaaaaaaaaaaaaaaaaaaaaagagagacattgtagctatattctaatataatagatacacctaaaacaagcaacagtcaaaaacaaaaaagattctgaaaagaagcttcaggcaaatgttaacaaaaaagaaagaagataaattaataataaaaaatagaacttatgttgaaaggataaaagtggccagagagttgtttggttgtttcatagaggaaagatttggtttatttgatctttacttctggtttacatgatctatgactgaagaaaataaatcattatgcatataataacatggcctgaaaaagttaaaatcaaa

SEQ ID NO: 132882 - DNA, 601 bp, Human
tatatatgtgtatatacacatatacaaatacgtgacacacacatatatataaaaaacacatgtgaacattcagggaagggctgtaaaaaaatatctatagttccatcactaggagttaaagtcattttaaaatatattgaatttccttccagtgttggtgcaaatgtgttacttatgtacatgtgtctgtgttaaagagggcctgagccctgcctactaccttccctcttcttgccctcaggggtctttgaagggcttatcagaacttctgtattccaagaaaaatagcttaaaaccactrttcaaattatctgcattccccaaggagaggtaaagatcacgggaatggctgttagagcccaaagtaattttttggaagaatggaagaaaatactgatgaagaaaggtatgctctctataggtatggaaatcaatttgcttggacaacccgtatttttttttttttttttttttggtcaactctgatcatggccattagcctcagcacagagcggtgtgtgatcgccaaccaccagacgggatgaaggcttacacttccttatctctgttgaaccccaaatctccaagcttccaactgaaa

SEQ ID NO: 132883 - DNA, 601 bp, Human; identical to SEQ ID NO: 18492

SEQ ID NO: 132884 - DNA, 601 bp, Human; identical to SEQ ID NO: 18493

SEQ ID NO: 132885 - DNA, 601 bp, Human; identical to SEQ ID NO: 18494

SEQ ID NO: 132886 - DNA, 601 bp, Human; identical to SEQ ID NO: 18495

SEQ ID NO: 132887 - DNA, 601 bp, Human; identical to SEQ ID NO: 18496

SEQ ID NO: 132888 - DNA, 601 bp, Human; identical to SEQ ID NO: 18497

SEQ ID NO: 132889 - DNA, 601 bp, Human; identical to SEQ ID NO: 18498

SEQ ID NO: 132890 - DNA, 601 bp, Human; identical to SEQ ID NO: 18499

SEQ ID NO: 132891 - DNA, 601 bp, Human
gtaggaggttctgggctgtggtggtgtctgcagctgcgtgggaaggtcaggatgggtgcagttgaactgcttgggttgggggtctctgtgttgttctgcaggtgagtgagtgcatgtgaggtgtgtatgtgatccaccgattccagatacttctgaggggtgtctgagagcctgcggggagggaatggagttccatggatctgccgggcagtgattatctccaattttggggtctctctgagactgagacttcctagggccctcatggcgacctcctcaagggacttgtttggggccctckcttatctgtgcctcagtttcccctgaggtaccaaagctgtggacttctatgggccactctgccaagctttgtatgcactctacatcacttatttctcacaactctgtaaggcttgtaacttttgtgtgtttatgtgtgtgtgtgatggagttttgctcttgttgcccaggctggagtgcaatggcgtgatctctgctcaccctaacctccacctcccgggttcaagcaattctactgcctcagcctcccgagtagctgggattacagacgtgcgccaccatgcctggctaattttttgta

SEQ ID NO: 132892 - DNA, 601 bp, Human
tgtgatccaccgattccagatacttctgaggggtgtctgagagcctgcggggagggaatggagttccatggatctgccgggcagtgattatctccaattttggggtctctctgagactgagacttcctagggccctcatggcgacctcctcaagggacttgtttggggccctctcttatctgtgcctcagtttcccctgaggtaccaaagctgtggacttctatgggccactctgccaagctttgtatgcactctacatcacttatttctcacaactctgtaaggcttgtaacttttgtgtgtttatgtgtgtgtgtgatggagttttgctcttgttgcccaggctggagtgcaatggcgtgatctctgctcaccctaacctccacctcccgggttcaagcaattctactgcctcagcctcccgagtagctgggattacagacgtgcgccaccatgcctggctaattttttgtatttttagtagagatggggtttctccatgttgctcaggctggtctcgaacttccgacctcaggtgatctgcccacctcggcctcccaaagtgctgggattacaagcgtgagccactgcgcctggcagc

SEQ ID NO: 132893 - DNA, 601 bp, Human
cagggcctggggcgctgagctgctgtggctttgggcaggtcgtttgacttttctgagccccagtttcctgttccctaaaatcaggatggtaacatatctcagtcccacctactaccaggaggtggtgatgggaaagagctttacgtgctgaggattcctggcttgacaggggcaagggtgggggtgcgactgggacaggggaagagatatagcggccaagaaggaattagaagctggagaaattagactgggtgcattggctcacagtggccaaggtcaggggattgcttgagaccaggastttgagactagcctgggcaccatagtgagactcccgtctctaccaaaaaaaaaaaaaaaaattacccaagcatggtgctgcgcacctgtagtcccagctacttgggaggctgaggctgcaggatcgcttgagtccaagagttcaaggctgcagtgagctatggttgcaccactgcactccaacctaggctacagagtgagatcctgtctcacacaatacaacaacaacaacaaaagaacaaggtagagaaattacaattatttactaggcctttttggggcaggcactcctttacgtgga

SEQ ID NO: 132894 - DNA, 601 bp, Human
agtttcctgttccctaaaatcaggatggtaacatatctcagtcccacctactaccaggaggtggtgatgggaaagagctttacgtgctgaggattcctggcttgacaggggcaagggtgggggtgcgactgggacaggggaagagatatagcggccaagaaggaattagaagctggagaaattagactgggtgcattggctcacagtggccaaggtcaggggattgcttgagaccaggagtttgagactagcctgggcaccatagtgagactcccgtctctaccaaaaaaaaaaaaaaaaattacccaagcatggtgctgcgcacctgtagtcccagctacttgggaggctgaggctgcaggatcgcttgagtccaagagttcaaggctgcagtgagctatggttgcaccactgcactccaacctaggctacagagtgagatcctgtctcacacaatacaacaacaacaacaaaagaacaaggtagagaaattacaattatttactaggcctttttggggcaggcactcctttacgtggaattatttaatcttcatcacagctcccagaggtggggctgttattcccatctcgcagatgga

SEQ ID NO: 132895 - DNA, 601 bp, Human
gcccacaaggtggtggtgtctccttgcgggaggggattccagaaagatgtcctcaggtgagacacctgacaggtaaatcacaccatccacccagatctggagcataaggctaccattctggcatgtccctgtcacagtaggtgatccaaaggagtcgtttatgcagttcctcaaagccctgttcagctggaacatttacacttccttctcgttattattattattgacccttatgataccacatttaaaagggcttttatttaatcctcacagcaatcctggtttttcttttcttttctcyttttttttttttttttttttttttgtagagacagagtgttttgctgtgttgcccaggctggagtgcagtggcacgatcttggctcactgcaacctccgcctcccgggttcaagcaattcccctgcctcagcctctcgagtaactgggattacaggcacatgccaccacacccggctaatttcttttttgtttgagtagagacagggtttcaccatgttacccaggctggtctcaaactcctgagctcaggcaatccgcccaccttggcctcctaggattacaggcgtaagccactgctcc

SEQ ID NO: 132896 - DNA, 601 bp, Human
aatggtctcccttctcgaatttcctggagaatttgagaatcctaaggctccttagtctctcccttcctaagactgtgtgtctgtaggtctggggcagagcccaggcacctgtatttgtgcttctgggtctttggcagaatctttgcctttttctgtctgcaccccgcatctggtacagagaggacaaggcacagtcgctctgaagcagatgtctaggagagtgggtgggccagccagagaggagcctcgggtggaaggggtggtcacccctgccaggcagtcacagctgctgtggcgacasgaactccagccccagggtgagatccagccccacacctccccagccacccagccatgaccctgggccagtcacctccaggtgtctccctgagcctcatcctggcatttgtaaaatgaggaccagacagcctgggcacgttgagatcaaatgagctggagcatgtgagagcctgggcagccgggggagcaagagacaagtgcagggcacagggtcagctgagggctggcatgacctcaagaccaaaggcccctcccaccagggatggagggacaatgggatgaggtcagaggcagggcaggg

SEQ ID NO: 132897 - DNA, 601 bp, Human
actccagccccagggtgagatccagccccacacctccccagccacccagccatgaccctgggccagtcacctccaggtgtctccctgagcctcatcctggcatttgtaaaatgaggaccagacagcctgggcacgttgagatcaaatgagctggagcatgtgagagcctgggcagccgggggagcaagagacaagtgcagggcacagggtcagctgagggctggcatgacctcaagaccaaaggcccctcccaccagggatggagggacaatgggatgaggtcagaggcagggcaggggcmgaaagcagggccaggcagggagcacagtttggctttgatagagcactggcttaggctggacatggaggctcaagtctgtaatcctagcactttgggaggctgaggcgggaggatggtctgagcccaggagttcaagatcagcctgggcaacacagtgagatcccatctcttaaaaaattaattaattaattttaaaaaaagaacattcgctgggcatggtggctcacatttgcaatcccagcactttgggatgccaagggtggatcacaaggtcaggagttcaagacaagcctggccaag

SEQ ID NO: 132898 - DNA, 601 bp, Human
aatctgaggcacagagaggttgctgggtcatccctggggctgcacggtcagagagcagcattggggcaaggggtctggcaggctgctcctctaggcagctgtggagggggctggcataggggcttgttggtgggaggcagatagaacaagcaggaacagtcccaggggcaggggaaggccaggatggttcaggccatgggccgggaagaggatgtggcgactccttgtccttgactttctatttcgggctgatcaatgctctaggggctcaggatggaattgggagccttggtcagcctgraatagggtgagtcggtgtccttggggcgcaaaggtcagcccacccaggccctggccgttggtgccccccttgctcctctcccaggacctctcatggacactgggccctcttccattttactccacctttggggtgagacagccctagaagcagactccctagcttcaccactttttagctgtgtgaccttgggcaagttagtcagccccactgtgcctgtctcctttcagatgggaatggcagtaatctatcccatagggttgctgcgaagatcaaacagggcaatactcttagtgttta

SEQ ID NO: 132899 - DNA, 601 bp, Human
gggccgccatcttgctctggcgtggtgtgttgctgtggcaacctggagcctccagccccactgcactctgaaaaatttatcaggaaaacttccatgtttaaaaattaaccatgggattgaaatattaaagatgagctgctttgggtgaggcagagggcaatggatttgggggtagaggagccaagtccttactcccaacaggatggcacctgcccgtcgcccagtttccaggggcctagccatccattcccacccattcgcccctgtccgaggcctcctatgtagatggaggctggggccrgggtagggggacaggcagcgagggtcctgcctcccatttcctgtttgtccctttcccatgatactcctggggccctcccgttactctgcctgatggtggggtgcccctcaccagccaggagggcataatgaggcagagggctggccgggctgcccctctccatcccagctgcacctgcagcccagccccagagaggatgcacaggtgcccgggcccagagggcagaaagggggctgtgcccagggctgagcactcctgcctctgcccactagtaaaggagcagggtcgtggaggaagagg

SEQ ID NO: 132900 - DNA, 601 bp, Human
aaataaataaataaatacaaaaattagctatgtgtggtggcacatgcctgtaatcccagctactcgggaggctgaggctaaggcatgagaatggcttgaacccaggaggcagagggtgcagtgagccaagatcacaccactgcactccagcttgagcgacagcaagaccctgtctcaaaaaaaaaaaaaaaaaaccattgctacagtccagcttcctcattttatagatgacgtgaaggaggcccagaggttcctaaccccagagggctaggaacttgcccagggtggcacggcaaattargagcaccagccatctagaaacaggctccagagccccaggcatacccagggattgtggccacctgcacacagggcagcttcagtgtcccccaaaaagccttgaggcccattggctgcccccggcctcatgccagcgttctgctcactgttctgctccttcagggggctggagaccactgctactaccaggggaagctccgggggaacccgcactccttcgccgccctctccacctgccaggggctgcagtgagtatggggaggggccgggcagctgggagaagcctctggcccaggcctgg

SEQ ID NO: 132901 - DNA, 601 bp, Human
gggagggaggctggagcggctctggggcttgcaaatccgtgtggtctgggtccagaaccagacagatcgcttgtcctaggcgtggaagagccctgtggcatgagcccccaatggggggcacttggtaccccagcattcctccctggggcagccctcagctccagtcctgggactgctccgctcaaccccacccctctctccacagtgcccgcctaacctgcacaagctggacggttactactgtgaccatgagcaggtatgatggctgccccctgagcctgggattcagggcagtctcttrtctccactctgaccactcagcatctccatcccttgcctcttaattcttggactctcagggccgctgctacggaggtcgctgcaaaacccgggaccggcagtgccaggttctttggggccatggtgagtctggctagggctgggagtggggactccggaggacccagagctgagaagctggggagagtgggttccagctgaacaggcccccaagtgtgtagctccccaggatctcagggacccaggcagagtgtgggagatgcaggcctgaggtcttggggtgggtcctggggcgcgtggg

SEQ ID NO: 132902 - DNA, 601 bp, Human
tctcttgtctccactctgaccactcagcatctccatcccttgcctcttaattcttggactctcagggccgctgctacggaggtcgctgcaaaacccgggaccggcagtgccaggttctttggggccatggtgagtctggctagggctgggagtggggactccggaggacccagagctgagaagctggggagagtgggttccagctgaacaggcccccaagtgtgtagctccccaggatctcagggacccaggcagagtgtgggagatgcaggcctgaggtcttggggtgggtcctggggcrcgtggggtcacttggcatcctctccccacagcggctgctgatcgcttctgctacgagaagctgaatgtggaggggacggagcgtgggagctgtgggcgcaagggatccggctgggtccagtgcagtaagcagtgagtactgaggctcccagagggcctctcagctccagggcaggtgtgagacttttcagagatggggcagcaggttctcccaggaggagcctgtcagtcccaatgggcgggcacgtggcaaatgaggtggcagggtgcagggtgagggcagattagagttcagtagttg

SEQ ID NO: 132903 - DNA, 601 bp, Human
gccaggttctttggggccatggtgagtctggctagggctgggagtggggactccggaggacccagagctgagaagctggggagagtgggttccagctgaacaggcccccaagtgtgtagctccccaggatctcagggacccaggcagagtgtgggagatgcaggcctgaggtcttggggtgggtcctggggcgcgtggggtcacttggcatcctctccccacagcggctgctgatcgcttctgctacgagaagctgaatgtggaggggacggagcgtgggagctgtgggcgcaagggatcyggctgggtccagtgcagtaagcagtgagtactgaggctcccagagggcctctcagctccagggcaggtgtgagacttttcagagatggggcagcaggttctcccaggaggagcctgtcagtcccaatgggcgggcacgtggcaaatgaggtggcagggtgcagggtgagggcagattagagttcagtagttgagtctgaggtcaaacttggggctcactgtctctatatgccccaacagggacgtgctgtgtggcttcctcctctgtgtcaacatctctggagctcctcggctaggggac

SEQ ID NO: 132904 - DNA, 601 bp, Human
agggcaaggagctggactgcaggtgctggccaggaccaagactagggaggggaggttgcagctgtgctgggggttaggagacagggggctgaggctggctgtgtcacttccccaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtgactgcctggagccygggatggcgggagaagcttacaagaggggacaggcccctgctcacctctcctggccctgccctgcctctaggtctgcagcaatgaagggaagtgcatctgtcagccagactggacaggcaaagactgcagtatccataaccccctgcccacgtccccacccacgggggagacggagagatataaaggtgaggctggagctggccgaggggggtctgtctgtcccgctctctatgcctgtccttgccagctaagccctgccatcctccccaggtcccagcggcaccaacatcatcattggc

SEQ ID NO: 132905 - DNA, 601 bp, Human
gccttcaacttcagcacctgccccggcagtggggagcgccggatttgctcccaccacggggtgactgcctggagcccgggatggcgggagaagcttacaagaggggacaggcccctgctcacctctcctggccctgccctgcctctaggtctgcagcaatgaagggaagtgcatctgtcagccagactggacaggcaaagactgcagtatccataaccccctgcccacgtccccacccacgggggagacggagagatataaaggtgaggctggagctggccgaggggggtctgtctgtccygctctctatgcctgtccttgccagctaagccctgccatcctccccaggtcccagcggcaccaacatcatcattggctccattgctggggctgtcctggttgcagccatcgtcctgggcggcacgggctggggatttaagtaagagacacacacaccctgtgccccctggcatccttgaggggggatcagaatccctactggtggagctgagggggccctccctgaaagcccaactgaaccagagctcacacgtcataggtccaagtagcctgcagggcttaacatttagaaactaggaga

SEQ ID NO: 132906 - DNA, 601 bp, Human
ggcgggagaagcttacaagaggggacaggcccctgctcacctctcctggccctgccctgcctctaggtctgcagcaatgaagggaagtgcatctgtcagccagactggacaggcaaagactgcagtatccataaccccctgcccacgtccccacccacgggggagacggagagatataaaggtgaggctggagctggccgaggggggtctgtctgtcccgctctctatgcctgtccttgccagctaagccctgccatcctccccaggtcccagcggcaccaacatcatcattggctccatygctggggctgtcctggttgcagccatcgtcctgggcggcacgggctggggatttaagtaagagacacacacaccctgtgccccctggcatccttgaggggggatcagaatccctactggtggagctgagggggccctccctgaaagcccaactgaaccagagctcacacgtcataggtccaagtagcctgcagggcttaacatttagaaactaggagattttaggctagatgaggtggctcacgcctgtaatcccagcactttgggaggccaaggcaggcggatcacctgaggtcaggaa

SEQ ID NO: 132907 - DNA, 601 bp, Human
gtgccccctggcatccttgaggggggatcagaatccctactggtggagctgagggggccctccctgaaagcccaactgaaccagagctcacacgtcataggtccaagtagcctgcagggcttaacatttagaaactaggagattttaggctagatgaggtggctcacgcctgtaatcccagcactttgggaggccaaggcaggcggatcacctgaggtcaggaattcaagaccagtctggccaacatggtgaaaccccgtctctattaaaaatacaaaaattagccagccatggtggtgcrcacctgtaatcccagctacttgcgaggctgaggcagagaattgcttgaacccgggaggtggaggttgcagtgagctgagatcgcaccattgcactccagcctgggtgacagagcaagactgcgtcaaaaaaaaaaaaaaaaaaaaaaaaaaggaaagaaagagagaaagaaaagaaaagagaaaagaaatcaggagattttacactagcaattcggatttccagctctggaaacatgaaaaggttgagccccagcgtgcctctaagcatccccaaatagccacagagtggagctgggcag

SEQ ID NO: 132908 - DNA, 601 bp, Human
gggggccctccctgaaagcccaactgaaccagagctcacacgtcataggtccaagtagcctgcagggcttaacatttagaaactaggagattttaggctagatgaggtggctcacgcctgtaatcccagcactttgggaggccaaggcaggcggatcacctgaggtcaggaattcaagaccagtctggccaacatggtgaaaccccgtctctattaaaaatacaaaaattagccagccatggtggtgcgcacctgtaatcccagctacttgcgaggctgaggcagagaattgcttgaaccsgggaggtggaggttgcagtgagctgagatcgcaccattgcactccagcctgggtgacagagcaagactgcgtcaaaaaaaaaaaaaaaaaaaaaaaaaaggaaagaaagagagaaagaaaagaaaagagaaaagaaatcaggagattttacactagcaattcggatttccagctctggaaacatgaaaaggttgagccccagcgtgcctctaagcatccccaaatagccacagagtggagctgggcaggggccacccaagccaggcatgtgtcctccagtctccagtccccacccagcct

SEQ ID NO: 132909 - DNA, 601 bp, Human
aaaaaaaaaaaaaaaaaaaaaaaaggaaagaaagagagaaagaaaagaaaagagaaaagaaatcaggagattttacactagcaattcggatttccagctctggaaacatgaaaaggttgagccccagcgtgcctctaagcatccccaaatagccacagagtggagctgggcaggggccacccaagccaggcatgtgtcctccagtctccagtccccacccagcctataatgctttgtgcgtgtctaagtttggggtccttgtgctggtctaacccccttaatgtgcagaggaggaacccayggcccaaggtcacatgattgagttagtagcagagtcagagctggaaccgggacgcatttttgtgggtgccctgggtaattctccctggcccttacattagtgtccaggccccggggaccccggccccgctctggggcaaggggtcgcatggcagccaaaggcccctccctgagagaagcaaaaggtcagatgtctccttttcctctccccttccaccatcctccccctgcagaaacattcgccgaggaaggtacgacccgacccagcagggggcagtgtgatgccggccacgtcatccct

SEQ ID NO: 132910 - DNA, 601 bp, Human; identical to SEQ ID NO: 132891

SEQ ID NO: 132911 - DNA, 601 bp, Human; identical to SEQ ID NO: 132892

SEQ ID NO: 132912 - DNA, 601 bp, Human; identical to SEQ ID NO: 132893

SEQ ID NO: 132913 - DNA, 601 bp, Human; identical to SEQ ID NO: 132894

SEQ ID NO: 132914 - DNA, 601 bp, Human; identical to SEQ ID NO: 132895

SEQ ID NO: 132915 - DNA, 601 bp, Human; identical to SEQ ID NO: 132896

SEQ ID NO: 132916 - DNA, 601 bp, Human; identical to SEQ ID NO: 132897

SEQ ID NO: 132917 - DNA, 601 bp, Human; identical to SEQ ID NO: 132898

SEQ ID NO: 132918 - DNA, 601 bp, Human; identical to SEQ ID NO: 132899

SEQ ID NO: 132919 - DNA, 601 bp, Human; identical to SEQ ID NO: 132900

SEQ ID NO: 132920 - DNA, 601 bp, Human; identical to SEQ ID NO: 132901

SEQ ID NO: 132921 - DNA, 601 bp, Human; identical to SEQ ID NO: 132902

SEQ ID NO: 132922 - DNA, 601 bp, Human; identical to SEQ ID NO: 132903

SEQ ID NO: 132923 - DNA, 601 bp, Human; identical to SEQ ID NO: 132904

SEQ ID NO: 132924 - DNA, 601 bp, Human; identical to SEQ ID NO: 132905

SEQ ID NO: 132925 - DNA, 601 bp, Human; identical to SEQ ID NO: 132906

SEQ ID NO: 132926 - DNA, 601 bp, Human; identical to SEQ ID NO: 132907

SEQ ID NO: 132927 - DNA, 601 bp, Human; identical to SEQ ID NO: 132908

SEQ ID NO: 132928 - DNA, 601 bp, Human; identical to SEQ ID NO: 132909

SEQ ID NO: 132929 - DNA, 601 bp, Human
ccagaggccttggggtggggcaggagggagagaatggagagatgatgatgaaaggtttaaagcctcagttaggcaggagaaataagttgttttttggatatctattgcatagaatagcgagtatagttaataataatgtattacacacttcaaaatcactgaaagagtaaatttcaaatttctcacgagataaaaataagtatttgaagtgatagatatatttagcttgatttaattattccacattgtattcatgaatcatagtatcactttgtaccccataaataaaatacaactatawtttggataacaactccaatattgtttaaaatacacacacacacacacacacacagatagaacaaatgagatgaaaatatatatacatgttaagtggttatctctgagtagtgggcttataggcaaatttgatttttctttatacatctttgaatcttccaaattcactataataaacacaccataatatctccaagttttatacttggaaaaatgtttcttcttcattactttttagcttctttacttaaccaatgttgatacaagcagcttcacatatcagttatcaaaaaaatacctc

SEQ ID NO: 132930 - DNA, 601 bp, Human
gaacaaatgagatgaaaatatatatacatgttaagtggttatctctgagtagtgggcttataggcaaatttgatttttctttatacatctttgaatcttccaaattcactataataaacacaccataatatctccaagttttatacttggaaaaatgtttcttcttcattactttttagcttctttacttaaccaatgttgatacaagcagcttcacatatcagttatcaaaaaaatacctcaaatacataaaaaaaaattgtcagcttgatttttctttcttatttatttatttttttcyttttggagatggagtttcgctctttcacccaggctggagtgcagtggtgtgatctcagctcactgcaacctctgcctcccgggttcaagtgattctcctgcctcagcctcccaagtagctgggactacaggcatgtgccaccacacccggctaatttttgtatttttagtagagacgcggtttcactgtgttggccaagctggtctcgaactcctgacttcaggtgatgcatctgcctgggcctcccaaagttgtaggattacaggcacgagccaccatgccaggcctgatttttaaggt

SEQ ID NO: 132931 - DNA, 601 bp, Human
ttataggcaaatttgatttttctttatacatctttgaatcttccaaattcactataataaacacaccataatatctccaagttttatacttggaaaaatgtttcttcttcattactttttagcttctttacttaaccaatgttgatacaagcagcttcacatatcagttatcaaaaaaatacctcaaatacataaaaaaaaattgtcagcttgatttttctttcttatttatttatttttttccttttggagatggagtttcgctctttcacccaggctggagtgcagtggtgtgatctcrgctcactgcaacctctgcctcccgggttcaagtgattctcctgcctcagcctcccaagtagctgggactacaggcatgtgccaccacacccggctaatttttgtatttttagtagagacgcggtttcactgtgttggccaagctggtctcgaactcctgacttcaggtgatgcatctgcctgggcctcccaaagttgtaggattacaggcacgagccaccatgccaggcctgatttttaaggtctagaagatgagcatattattcctagtcttttctcttgataagtattaggcaaatgt

SEQ ID NO: 132932 - DNA, 601 bp, Human
ttatacatctttgaatcttccaaattcactataataaacacaccataatatctccaagttttatacttggaaaaatgtttcttcttcattactttttagcttctttacttaaccaatgttgatacaagcagcttcacatatcagttatcaaaaaaatacctcaaatacataaaaaaaaattgtcagcttgatttttctttcttatttatttatttttttccttttggagatggagtttcgctctttcacccaggctggagtgcagtggtgtgatctcagctcactgcaacctctgcctccygggttcaagtgattctcctgcctcagcctcccaagtagctgggactacaggcatgtgccaccacacccggctaatttttgtatttttagtagagacgcggtttcactgtgttggccaagctggtctcgaactcctgacttcaggtgatgcatctgcctgggcctcccaaagttgtaggattacaggcacgagccaccatgccaggcctgatttttaaggtctagaagatgagcatattattcctagtcttttctcttgataagtattaggcaaatgtgtcagaactaaataatggttgtc

SEQ ID NO: 132933 - DNA, 601 bp, Human; identical to SEQ ID NO: 30760

SEQ ID NO: 132934 - DNA, 601 bp, Human; identical to SEQ ID NO: 30761

SEQ ID NO: 132935 - DNA, 601 bp, Human; identical to SEQ ID NO: 30762

SEQ ID NO: 132936 - DNA, 601 bp, Human; identical to SEQ ID NO: 30763

SEQ ID NO: 132937 - DNA, 601 bp, Human; identical to SEQ ID NO: 30764

SEQ ID NO: 132938 - DNA, 601 bp, Human; identical to SEQ ID NO: 30765

SEQ ID NO: 132939 - DNA, 601 bp, Human
caggccttctgtggacaggcgcggtggctcacgcctgtaatcccagcactttgggaggcagaggtgggtggatcacaaagtcaggagttaagcctggccaatattgtgaaaccgcgtctctactaaaaatacaaaaattagctgggcatggtggtgggagcctgtagtcccagctactcgggaggctgaggcaggagaatcacttgaacccagcaggcagaggttgcagtgagccaagactgcgccactgaactccagcctgagtgatagagtgagactccatctcaaaaaaaaaaaaaaaggaaagaaaagaaaagaaacagtcctcttacggtaatgagggtcacctgaaagtttctaggtaaaggcagtgtatgccccaggaagggctgaggagttccagatgttactgctgtgagctcaggggctcgccactgaccagtcccttgacttgcatcttgaaaaatcagaactcactttgcggctctagcttctggatgatgggcagagcactggtcatggccacggaggtgatggtcttcacaccgttctctgccatctcacacacagacttcaggtagggatactggtcctttgtact

SEQ ID NO: 132940 - DNA, 601 bp, Human
agctgaggcaggacaatcacctgagcccgagaggcagagactgcagtgagcagtctcaaattccaggcctcaagcgatcctcccatctagacctcccaaagtgctaggattacaggtgcaggccaccgtgcccatcctctgggggatttttaattaaaggatcataaacatctgccaaagctatgaaacaggccttctgtggacaggcgcggtggctcacgcctgtaatcccagcactttgggaggcagaggtgggtggatcacaaagtcaggagttaagcctggccaatattgtgaaacygcgtctctactaaaaatacaaaaattagctgggcatggtggtgggagcctgtagtcccagctactcgggaggctgaggcaggagaatcacttgaacccagcaggcagaggttgcagtgagccaagactgcgccactgaactccagcctgagtgatagagtgagactccatctcaaaaaaaaaaaaaaaggaaagaaaagaaaagaaacagtcctcttacggtaatgagggtcacctgaaagtttctaggtaaaggcagtgtatgccccaggaagggctgaggagttccagatgttactgc

SEQ ID NO: 132941 - DNA, 601 bp, Human
tatacaaccatcaccactatccatttctaaaactcattcatggccaggcatggtggctcacacctgtagtcctagcactttgggaggccgaggcgggcggatcacctggggtcaggagttcctgaccagcctggccaacatggcaaaaccctgtctctactaaaaatacaaaattagctgggcatggtggtgtatgcctgtaatcccaactactcagggagctgaggcaggacaatcacctgagcccgagaggcagagactgcagtgagcagtctcaaattccaggcctcaagcgatcctsccatctagacctcccaaagtgctaggattacaggtgcaggccaccgtgcccatcctctgggggatttttaattaaaggatcataaacatctgccaaagctatgaaacaggccttctgtggacaggcgcggtggctcacgcctgtaatcccagcactttgggaggcagaggtgggtggatcacaaagtcaggagttaagcctggccaatattgtgaaaccgcgtctctactaaaaatacaaaaattagctgggcatggtggtgggagcctgtagtcccagctactcgggaggctgaggcag

SEQ ID NO: 132942 - DNA, 601 bp, Human
atttcaaccatttttaactgtgcaattcagtggcattaagtccatttacaacattatacaaccatcaccactatccatttctaaaactcattcatggccaggcatggtggctcacacctgtagtcctagcactttgggaggccgaggcgggcggatcacctggggtcaggagttcctgaccagcctggccaacatggcaaaaccctgtctctactaaaaatacaaaattagctgggcatggtggtgtatgcctgtaatcccaactactcagggagctgaggcaggacaatcacctgagccsgagaggcagagactgcagtgagcagtctcaaattccaggcctcaagcgatcctcccatctagacctcccaaagtgctaggattacaggtgcaggccaccgtgcccatcctctgggggatttttaattaaaggatcataaacatctgccaaagctatgaaacaggccttctgtggacaggcgcggtggctcacgcctgtaatcccagcactttgggaggcagaggtgggtggatcacaaagtcaggagttaagcctggccaatattgtgaaaccgcgtctctactaaaaatacaaaaatta

SEQ ID NO: 132943 - DNA, 601 bp, Human
tctcaaaatcggcattcccatgctagtttaatccctacctacgcttacttcagcacaggtcagtgtatttggggtcctcaggaggaaagagtatgccaagaccaccctggatctccctaacaagggagattttagtgtgagcttcccactaagaataccaaaccaagtactagtaccaaattcatttaggaagtagcagagttggaatggctggtctctaaaggctccttataatcctaaaagtccctggcttaaccatttgaaagaatgatttaaatctttattcaaaagcagttcatgwtgtggagaaattggagcctccatacagtgttggtgggaatgtaaaatggtacagctgatttggaaaacagtctggcagctcctcaaaagcttaaacagttattatataacccagcaattccacgcctgggtatataccaaaaaaacctgaaaacatgtccacacaaaaacttgtatacaaatgttcacagaagcattatacataatctccaaaagtagaacgaacccaaacatccatcagttgaagaatgaataaatattgtctgtctagacagtaaattactattcaacaataaaaaga

SEQ ID NO: 132944 - DNA, 601 bp, Human
aataatgggctgggcgcggtggctcacgcctgtaatcccagcactttgggaggctgaggcaggcggatcacgaggtcaagagatcgagaccatcctggccaacatggtgaaaccccgtctctactaaaaatacaaaaattagctgggcgtgatggtgtgcgcctgtagtcccagctactcaggaggctgaggcaggagaatcgcttgaactcaggaagcaggggttccagtgagccaagatgcatcattgcactccagcctgggtgacagagcaagactccatctcaaaaaaaaaaaaaaaaaggcaagaatgttgatcttatacaacagaaggcattgcctggtttatctagttctgacaggaagaggcctggcaagttgctggcaactctcttctaaaggtaaggaaatatgggggtgtgagggaggagcaggcagaggcagtgacaggccaaacaggaagctggctctgaagcttcttccttatcaactggcccctaatgttaatgccaagagtagccgggctttccctgaactgtcattcagagaataaggtatctggaaactctctcaaaatcggcattcccatgctagtttaatc

SEQ ID NO: 132945 - DNA, 601 bp, Human
cagatccaggttgggaaaacaagtatttgcctgtttgtgatatgtacagcttgttttaacagatagaagatgaaaacatgtgaagtgtcaagtctcagcacttttgtcccaagctcacctgagttgatggctgattcagaataggcagtctctcctcaatcctgtctagccccttacaggcataggtattggcaactgcaactagaatcacaaatgggaaaatgttaatgtagtactataggtatagaatgaacacacattaccataggccttataaaaaatggcaataatgggctgggcrcggtggctcacgcctgtaatcccagcactttgggaggctgaggcaggcggatcacgaggtcaagagatcgagaccatcctggccaacatggtgaaaccccgtctctactaaaaatacaaaaattagctgggcgtgatggtgtgcgcctgtagtcccagctactcaggaggctgaggcaggagaatcgcttgaactcaggaagcaggggttccagtgagccaagatgcatcattgcactccagcctgggtgacagagcaagactccatctcaaaaaaaaaaaaaaaaaggcaagaatgttg

SEQ ID NO: 132946 - DNA, 601 bp, Human
gtctcaaaaaaaaaaaaaaaaaaaaaaaagaacacaagttaccaacatttaaagaaaatatccgaaatggaaaataactctcaccattagcacagtctcaagcaatgtaagtgaaaaatttaaaagatttgcacaagcattctaaaggctatacactaaacctacctatagttgtgtaccacataatattttggtcagcgatggaccactattcaatgatagtcccataagattataatgaactgccctataacaggtatacttttttttttcactgtaccttttctagtttagatacacraatacttatcattgtgttacagtagtcagtgtagtcatgctgtgcaggtttgtagcctagaagcaagcaacaggctatataccatatagcctaggtatatagcaggctatacaccatatagcctaggtatatagcaggctatacaccacaagtccctaacccccgggccatggaccattaccagtccattaccagtccattaccagtcagaggcggcattagattctcataggagacctaaccctaaccctcttgtgaactgtgcacgtgcatgctccttatgagaatctaatgataaat

SEQ ID NO: 132947 - DNA, 601 bp, Human
ggtttaatgagttttatgctcagatcgctgggtctcctggctgctcttgtccatctctgcaccttggtcctgagcattctgagactcagtcagctgaggataaaagggacctaccagccagttgaggggcgtgttgttaacaagataatccatcacgtcatctaaagattccttcattttctgcagctgccccttgctagaagtgaggaggctgtcagacacttctttaaaggaggcagcattgcggaacactgagtagatgtcgcctgccatcacccccatgtgcttggcttgatcttgratgttctgtggtacaccttggatgttggacaggagggtgtggcacgtggtctggagctgctgagtcaggttgcgggcaattgcaagagtacgtgactcaatgtgctaaaaataaaacttaaaattagcagtggatccaacagtgctatgtataaattagttcgatgacagtaggctggttatgtgtccaccacatatgtggattctttggcttttaaaaatcctcattacaatgccgagtgcagcagtattattcacatttcatagatatgaatataagcttagagtttaagtagatggc

SEQ ID NO: 132948 - DNA, 601 bp, Human
tgatttatccagggtgtctgtgcacattaaacgaaggcttgagaagctctgtgcccaccgcctctcgtcatcatatgcagccctctccgttacccttaatcccctttaaacacctgccacagatctttcagtggtggggacctggggatggctctgctcacctaggcaggttccactaaggggcttcagggcctgccgtaaccccctgcaaggactttcctcagctctgaatggctgagacctttccattttaagaactcttggagcctgagtaaagcctcatctttttttttttttttttaatttttatttaaaaatttcggagtttcgctcttgttgcccaggctggagtgcaatggtgggatcttggctcaccgcaacctccacctccagggttcaagtgattctcctccctcaacctcctgagtagctgggattacagatgtgtgccactaggcccagctaattttgtatttttagtagagatggggtttctccctgttggtcaggccagtctcaaactcccaacctctggtgatctgcccgcctcggcctcccagagtgctgggattgcaggcatgagccactgcgcccagccata

SEQ ID NO: 132949 - DNA, 601 bp, Human
gtgccacatcataccatgcggacacgcagcaagcacctcatccttcatttttgtggctacataaatgtttcgttgaacggatgcagcctagtaatgtccgcgttgtcatacccactgtcgcttccgcagctggtgtgattggcccgtgccatgtgccttcatgaacagttgtgataatggcaatgtcagtagcgaacatgagggcagatgtgcagaggcagcgaggccccatctctgaagctgagtctttgaggctggcaaggcccaggctggctcaccctggctctgacgccagcctccyccacccaccccccgcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcaggtgagaggctggaaggcagagctgacaggagtgggacagcagtcacgggagggtagcacagcctgttcccaaggccacacacttgg

SEQ ID NO: 132950 - DNA, 601 bp, Human
aatggcaatgtcagtagcgaacatgagggcagatgtgcagaggcagcgaggccccatctctgaagctgagtctttgaggctggcaaggcccaggctggctcaccctggctctgacgccagcctcctccacccaccccccgcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctcygagcagggctgggaagacccccccatcggggctgagcaggtgagaggctggaaggcagagctgacaggagtgggacagcagtcacgggagggtagcacagcctgttcccaaggccacacacttggggggtgggggacagggaggtgcctatccaccctccaccctcagcgaggacaggcccagtgtgtcctgtctttgagcaggccaagacagctggagccccacggagctgggccctggcctccaaagtcaccagcaaagcccgagctttgacccttactgtcccaggaagagaatggc

SEQ ID NO: 132951 - DNA, 601 bp, Human
agattacctctttgtggctcccccccacctatcaggaagtgccctgggcaggtgagggtcatctcacctgacacatggggaggctgggacttgtctgcacacctgaggacacagggggtgctgggatgaggagccaagacgtgggagtcagcgctccccaagccttaggacagtagacccccagaggggggccgcttgcgggaggggagagagaaatcctgatggccagtatccgtcagagcagagctttcacctggccctgctgcggcagcccggcatctacaagcccttcatcatcggygtctccctgatggccttccagcagctgtcgggggtcaacgccgtcatgttctatgcagagaccatctttgaagaggccaagttcaaggtaaaagggccctgcctggcctgcctcgtccagcccccacatagatggagcttcctccccaagcccagggcccagccatccagcacaggcctggagagggagggacccagctctcagctggcccacctgacctgcctgggctctgtctcccccaggacagcagcctggcctcggtcgtcgtgggtgtcatccaggtgctgttcacagctgtgg

SEQ ID NO: 132952 - DNA, 601 bp, Human
cctagagcatagagaagtcagccagagatttaaagtgaaaagacctgaatgcaaatctagcctgaacatcctaagcctattagcaagttattcatcctgtccgcaaggagctccaggagttaattatgtaacatacatggaaatgtccggtgccagtatcttggttaagctttaaaacctgccagcaatcccattcctcccccataacggtattcggagaattgctgtattttaagatgaaacgtgtatgtaagagcatatggaagcatcattgaaaattctagacagcagcagactctargaagtgtgtgggctttaggaaggactccttcccatgcccagcccctacaatgtgtttatcatattcttaacatgggtaatactttcttttcttttggcccattgtttatttggtgaacatttacagaaggccaaccctgtgccaggcacagtgcatgagctgcaggagagacattctcttctatctgccaacacacgggatctcatgcagagcctagaaaactacaggctctgggttctttcctgtcagaaaccagagagtgtttgccctcttctgaaactccattttttggtaatatct

SEQ ID NO: 132953 - DNA, 601 bp, Human
gaggttatgacccttgtccccattttacagaggagaaaattgaggctcagaagagttaaataactatctcatgagcgaacagctaaccaaggggtagagcatggatgcaaacccaggtcttattcctatactatgtatctgccagcttagttcaagcccaggaatgtcctgaaatgttttgagttagaaaccagagacacttaggccagaggagatctgttgagtaaccattgagtccagcctgtctccagtcagggttataacaacattcaactgagcctttgtttggtgcccaagggcacgttttaccctctcggtattctatcaagacaaattaacacaccctgccctctctttcagagcttctgatttaaagcagacacgtgtacagatggaacgccagagctaaaaaagggactgtttatttcagtctccttgttttaagatgaaaagacctagatcaaaggaggcttgtagtttaccgtggacccagcattgtgctaaacatgttttttgcagtatttcgtttcctaaagtgacaggcactattttaatctatcctcaattaacagatgaggaaaccgagcctcagggggacaaa

SEQ ID NO: 132954 - DNA, 601 bp, Human
tgtgaggttatgacccttgtccccattttacagaggagaaaattgaggctcagaagagttaaataactatctcatgagcgaacagctaaccaaggggtagagcatggatgcaaacccaggtcttattcctatactatgtatctgccagcttagttcaagcccaggaatgtcctgaaatgttttgagttagaaaccagagacacttaggccagaggagatctgttgagtaaccattgagtccagcctgtctccagtcagggttataacaacattcaactgagcctttgtttggtgcccaagkgcacgttttaccctctcggtattctatcaagacaaattaacacaccctgccctctctttcagagcttctgatttaaagcagacacgtgtacagatggaacgccagagctaaaaaagggactgtttatttcagtctccttgttttaagatgaaaagacctagatcaaaggaggcttgtagtttaccgtggacccagcattgtgctaaacatgttttttgcagtatttcgtttcctaaagtgacaggcactattttaatctatcctcaattaacagatgaggaaaccgagcctcagggggac

SEQ ID NO: 132955 - DNA, 601 bp, Human
ttgttcaagttgtccatgccatcctggccatagcccaatagcccatctgttgtgagatggggtggcttcctgctagcactcttgtcagtgaagcaatgtggggacctcctcatgtggtcccaagggaaggtcatgtctactgacatttatacagtcagggctaacatttaaagaaatcagaacttcacacttagctatatgttgaaagacttagctatacattgaaatgctgagtagaaggaaccccagaggatatgtccagatttgataaaaattaaaaattagacttcagttgggtccrtttgctgggagtcaggtgcacgttgtactttctactggggagcttggctggttcctgctaggcctagggagggggagcatgatgttggtgggttggtagcgacagtgttttgtgtcattggaaccatgttctaataacaaatctaccacctttgttcccagagctcattttaaggaactgtttggaacgtggtaccaggaagtagagctagaaggtcaggaagtagagatagaaggtcaggtccctgtggcagctggggccaaatcagacattcacggggtgatttttacaccagttccc

SEQ ID NO: 132956 - DNA, 601 bp, Human
acccaaggcttcctgggtgagggaggtctctgatgtagaggtgggcagtgccccagggttccacaggcacactaatgagagtggccatggctctgtcagagactgtggtgctgtcctgcaggcacatcatggaagaacttatcagacccatgactacaatccacagatatggacaggtagcagtcccatagttggcgagtgtattaaccctttccaaggaagggatcagcttcattggtttcttctttaagaacctatgtcggctttcattggtgaccttttaatcttccaaatgctcacraaccctttgtgtactcttttctataattttactggggcttcaccacaagccagttgtatgtgatttctggtatgcattctttttctgaaagcaggacatttgtctggcaccaagacttgtcttcatgatttcttgactatcactggtggtggttctgagagcaccacaaggcccttaccttcctcatcacctccttcaggaagctttccccaaccccaggaaagctactttatccttttcagtgttcccaaaatgctttgtatatttatctctactggaataaggtaagaatggtgatga

SEQ ID NO: 132957 - DNA, 601 bp, Human
cactgtccaaagcattgcgtcgctcttaggtttccaccagcgctgttgggcaggaggagaaacaggggctttaaagacattttaaaaaagagtttagaaggggctttagtggtctcactgtgtacagaggtgagcagctcaccttggctccctgggggcagtggccagttgtacccaaggcttcctgggtgagggaggtctctgatgtagaggtgggcagtgccccagggttccacaggcacactaatgagagtggccatggctctgtcagagactgtggtgctgtcctgcaggcacatcrtggaagaacttatcagacccatgactacaatccacagatatggacaggtagcagtcccatagttggcgagtgtattaaccctttccaaggaagggatcagcttcattggtttcttctttaagaacctatgtcggctttcattggtgaccttttaatcttccaaatgctcacgaaccctttgtgtactcttttctataattttactggggcttcaccacaagccagttgtatgtgatttctggtatgcattctttttctgaaagcaggacatttgtctggcaccaagacttgtcttcatga

SEQ ID NO: 132958 - DNA, 601 bp, Human
gaggcctccgtgggcaagagggatgcctcttctctctgacgtgcctgaggtgtggggggaggagcagagtccttcctgcccacagcgggactggaccccatggctggccagcagcctgacagtcctttttatcccctgagtccagccccaggtgtcagaatttgaccaccttaggccactcagaggaccctgtggcctgtgggaaatgttctggggggctcttggttctgggaagttgctcctgtgaatattttagtccatacgcaggcactagggagaggcttctgtgatatcactaagwtgcagtctgcttttcatgagaactgtatgctgttttcagttactctcactgatggtctgtctccaaaaagtcttcttaccactccctgaaacatttttctaacaggagaaatgactaactgttgaaattggatctgcaatttcctacccaaattaatgcatctgagtgccacggcacgtggcctgcttaggtgagagtcccacccaggccagcatcaggactcactgggcaccccatgagggcaggagaacagacacacagggtcgggggatggggtgtgaggggtggctacagtgagaa

SEQ ID NO: 132959 - DNA, 601 bp, Human
aggtgtatgcacccagggggtgtgcagagctcacacactacttcttttcccccaaccagaacgaactcaagaatgagggatccatgctgacttagctctgtgtccttagaactaatgttaatctttgccagtcagccagcgaaaaaaataaaacataaaaatttacagttctttgtcgaggtgtaaaacttttaaaaatctttaatgatttttttcttccgtatttaccttttggtgttctttgcccatttttcaacgattgtagtgtctgttatgatgtagaagaagtttttcttttttwaaaaaaggcaaacggggtaattcttttaaggctttctagaataatcgagtaggtatcaaattgtgtagaaatgtttagtattttctgctgttacaaaaaatgtgcatatgtgtctgtacacggaatttcacatgacaatcaggccccattagcttccatcaaaaacacaaattcaaacacaatttcccttagaacccttagtagacctctgtgaaatctcctgcattcaaacacatttccttttcacacattaaaggcaccagtggcaaaggtcagaaacatcactgatggatgaaaatt

SEQ ID NO: 132960 - DNA, 601 bp, Human
ccccgataagaaagattggtttgggtgctgacacttaactcaggggcttctcccttcatcttctggggaggaaggatcttctcacccatttacctttttgccaggcctcttctctaagggatggggcaggacccaatgctccccaccccagggtagcagatggggcacaagcagctgcttcctttgccagtgccacttcctgcctttcccccaccactccctcagtatccttcccagggaaggggaggctagacctccagaaagagcatttgtgaaggagaaaaaggttttggttgtgttyagctgaagccccagggatggaggcagagaatgggagtctgtccccaacagctggagcagagcgccggtgggcgtgggaggcctcccagctccttaccaagtcagcagcacaggagaggccgttcgatgtgaatgctggtgacggaagatccggcagaagcctgcaaaataacgcccactgagagcgagcagcccagcctcttactgcacagctgccaggactgctgcagaattgtcagaggtaaaggctgcctttgaaggaggcgccacgtagggagaggctgtggaggctgctgggaga

SEQ ID NO: 132961 - DNA, 601 bp, Human
gagtgggctcttctattggttgctcaggcctctcttggggtgggccagtcaccttgtgggcagcacagacatcccctgccgagtctcaccttgtacgtctcccagttcctgaagaagttaacagagccatccaggcgtctctggatgacggtccagcccccggggtcgtgtctctggtcgcaccacacctgcatgaggcggttggtgttctccggcttcaccaggtagatggagctggtgtcgtggccatcctccagggcctgcaggcagtctctccatgggcctggggacacagacatgsatatacatcacagacctgcctgtcaccaggccgcacccccagctgcaccccaagcaggcacaacctctgttgaggctccagctgggagccacaggcccacggtctgaggtaaccaatttttgttttgcgagtttaataagtaattataaagacaagagcctcggaccaggggtcaggatgcccatactccaagctcactttctcctctcacccgcctcacagtttgacttttggcagacttcttcattctcccagcccccagtttcttctgattgtagaaggaagatcagatttccctca

SEQ ID NO: 132962 - DNA, 601 bp, Human
ttaatacaataattatttagtattgagcgcttgtgatgtgctggcactgttttaagaactttacataggttgttttactaatcctcatgtcaactcgaagaactaagtgctatcattatcctccctagtatggatgaactgaggcccagagaggctcagggtctcagaatgcctgagggtgaaccaggatttgaaccaagaacccagtcttaatcattgcactgtattgcctctaagaaaggaggagtctcccgctcctaatgtaggtggaagaggagaaaaaagcagagacacaggctgktcaggaggtggggtgggggacaaccaggacaggagactcaagaaggggcatggcagagccatgtgtgcaaggcatcatggcttcaggtagtttgtgagcttcagtgtcagaggcctcagctgcagtcactactgggccaattcctggctttgcaaccctgagcaaattactccacactttcatctgtaagctgggtccataacagaacctccctcaggaggttgatacgagattaaacaaaataatgcacgaaagcccttagcatggtgctggcacgggttgggcactcagcaaacagag

SEQ ID NO: 132963 - DNA, 601 bp, Human
ttgacctcttttccctaccctgcacctgggtttgactccacttttcctacctgtgtagacatcatgatctctgtccagggtggtgaactgcttgccgttgtgccatgtaaaggagtcacccgcattgccatggtagcgccccagccgcagcttataatactcgctctcaggttccaggcggaaactggcgtattctgcaaagactttgcggccggaccagtcctccatggtcaccaggagtttgtagttgccttggttcgtcagccagtaaatgttctccaggcccagccagtattcgccrtcaatgttcccaaacccttgctggggaaaacccaggagagtgttaatgtggagcctgcagcacctgcagccagcaggcttggctgtcagacactcagccctggatagaggggcctgggaaacaagcagagcatgaagcagacctggttcagacccctactccacctcttaatctctccatgactcacacattattcaaaaatatgtagagtgcctaccctgtgccaggcatcatgtgaaccccagattccttgttcttacatcagggaggctatattaccttccccacaggcttgctgca

SEQ ID NO: 132964 - DNA, 601 bp, Human
tgcagcatgactgccccaagcggcgcctcaagtgcgagttttgtggctgtgacttcagtggggaggcctatgaggtgggtggggtctggctgaatgtggaggagggggtacctgatggcctaggcatctcttaactcagcacctctgacatttccagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttygtctttgacaccatccaggtgaggccttccctgaactgtgggttgcagggtaggtgacaggtagtcaggatattgactcctgcctctctacttctgtggccccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacagggtgagatgccccttttcctgtcagcccccttttgccctt

SEQ ID NO: 132965 - DNA, 601 bp, Human; identical to SEQ ID NO: 19679

SEQ ID NO: 132966 - DNA, 601 bp, Human; identical to SEQ ID NO: 19680

SEQ ID NO: 132967 - DNA, 601 bp, Human; identical to SEQ ID NO: 19681

SEQ ID NO: 132968 - DNA, 601 bp, Human; identical to SEQ ID NO: 19682

SEQ ID NO: 132969 - DNA, 601 bp, Human; identical to SEQ ID NO: 19683

SEQ ID NO: 132970 - DNA, 601 bp, Human; identical to SEQ ID NO: 19684

SEQ ID NO: 132971 - DNA, 601 bp, Human; identical to SEQ ID NO: 19685

SEQ ID NO: 132972 - DNA, 601 bp, Human; identical to SEQ ID NO: 19686

SEQ ID NO: 132973 - DNA, 601 bp, Human; identical to SEQ ID NO: 19687

SEQ ID NO: 132974 - DNA, 601 bp, Human; identical to SEQ ID NO: 19688

SEQ ID NO: 132975 - DNA, 601 bp, Human; identical to SEQ ID NO: 19689

SEQ ID NO: 132976 - DNA, 601 bp, Human; identical to SEQ ID NO: 19690

SEQ ID NO: 132977 - DNA, 601 bp, Human; identical to SEQ ID NO: 19691

SEQ ID NO: 132978 - DNA, 601 bp, Human; identical to SEQ ID NO: 19692

SEQ ID NO: 132979 - DNA, 601 bp, Human; identical to SEQ ID NO: 19693

SEQ ID NO: 132980 - DNA, 601 bp, Human; identical to SEQ ID NO: 19694

SEQ ID NO: 132981 - DNA, 601 bp, Human; identical to SEQ ID NO: 19695

SEQ ID NO: 132982 - DNA, 601 bp, Human; identical to SEQ ID NO: 19696

SEQ ID NO: 132983 - DNA, 601 bp, Human; identical to SEQ ID NO: 19697

SEQ ID NO: 132984 - DNA, 601 bp, Human; identical to SEQ ID NO: 19698

SEQ ID NO: 132985 - DNA, 601 bp, Human; identical to SEQ ID NO: 19699

SEQ ID NO: 132986 - DNA, 601 bp, Human; identical to SEQ ID NO: 19700

SEQ ID NO: 132987 - DNA, 601 bp, Human; identical to SEQ ID NO: 19701

SEQ ID NO: 132988 - DNA, 601 bp, Human; identical to SEQ ID NO: 19702

SEQ ID NO: 132989 - DNA, 601 bp, Human; identical to SEQ ID NO: 19703

SEQ ID NO: 132990 - DNA, 601 bp, Human; identical to SEQ ID NO: 19704

SEQ ID NO: 132991 - DNA, 601 bp, Human; identical to SEQ ID NO: 19705

SEQ ID NO: 132992 - DNA, 601 bp, Human; identical to SEQ ID NO: 19706

SEQ ID NO: 132993 - DNA, 601 bp, Human; identical to SEQ ID NO: 19707

SEQ ID NO: 132994 - DNA, 601 bp, Human; identical to SEQ ID NO: 19708

SEQ ID NO: 132995 - DNA, 601 bp, Human; identical to SEQ ID NO: 19709

SEQ ID NO: 132996 - DNA, 601 bp, Human; identical to SEQ ID NO: 19710

SEQ ID NO: 132997 - DNA, 601 bp, Human; identical to SEQ ID NO: 19711

SEQ ID NO: 132998 - DNA, 601 bp, Human; identical to SEQ ID NO: 19712

SEQ ID NO: 132999 - DNA, 601 bp, Human; identical to SEQ ID NO: 19713

SEQ ID NO: 133000 - DNA, 601 bp, Human; identical to SEQ ID NO: 19714

SEQ ID NO: 133001 - DNA, 601 bp, Human; identical to SEQ ID NO: 19715

SEQ ID NO: 133002 - DNA, 601 bp, Human; identical to SEQ ID NO: 19716

SEQ ID NO: 133003 - DNA, 601 bp, Human; identical to SEQ ID NO: 19717

SEQ ID NO: 133004 - DNA, 601 bp, Human; identical to SEQ ID NO: 19718

SEQ ID NO: 133005 - DNA, 601 bp, Human; identical to SEQ ID NO: 19719

SEQ ID NO: 133006 - DNA, 601 bp, Human; identical to SEQ ID NO: 19720

SEQ ID NO: 133007 - DNA, 601 bp, Human; identical to SEQ ID NO: 19721

SEQ ID NO: 133008 - DNA, 601 bp, Human; identical to SEQ ID NO: 94077

SEQ ID NO: 133009 - DNA, 601 bp, Human; identical to SEQ ID NO: 94077
